United States Patent 7,868,149 (PLANT GENOME SEQUENCE AND USES THEREOF) - sequence listing, part 85

SEQ ID NO: 44932 - DNA, 37893 bp, Oryza sativa
ccaagcaaatagcaacaatatctaaaccaatttgaggtgaaattgagcaagtagctgagtattacaagcttctagaaggttctatagagggagacaggaagggtgtagtggctggtaggaaggagtagtgagggagagagatcgacaaggttcctgcccaaacctggtcgccgctgccgccgtggccgaagccgccgattgccagttctgttctatttcccctcctctcctgtaagctgctgttgcccttgtattgtttcagcttgggcttgcttgggcttcttggcaacgggttgcctagcggcccatgtgtagcccagccgagaccctgacaatcccttcttcttgaaattcggcttgtccccaagtcgatgaagaaaacctcctggatcgaatgatgtttgaagttcctcttgtaaaacttgatgctcaagtacagcaaccataccaatctgtgtaggagcatcagataaccaggcgttgcatagcatgatcaaccatgcatatatcccagtcattaccaccatatgattgtcccttcttggattgaattcaagtaaaccggccatggagaatctggatagtactgcactaaatgtattccactccaccaccagtataacctcatgtatctcctctgatgcatgtactaatcttagcccactagaaagaaactgaggattgatagacaattcggtgagcacttgccatgcaactgtagctatcagttttgtatactgtagagagtatgtgtgtcgctcaataatctgatccactaaatgtgtttcagccacctgattaagcaagaaaggcaattgatttccatactttattccatagttatcggtgttctgttggctatacatgcattcttcaccttggatgacatttgcattagttggcaacaagcaatctaaagtattagccaagatgagcccttgagcaccactactgtgtaaagccagatctgggattttcttgagtgcatcactgtagatatcatccaagttttcttcaccttggaacttccatgcataaggtttcagataatcatttagctttgccggctggaacgaggccttcatcacctcccgcaccgccaccggctgcgcgcggtcgacgagcatggagaggagcagtgacaggttctgcttcagcgtgcggagcgccgggcggatgcgggcgtcagcgacaccgccgacatagagcccatcgtagaacgagtggtgcgagtcgaggaagatgaggcggtacgcggcgacctcggcgacgtgtccgaccgcggattgcgccgcggcgcgcgcgcggtcgaagtgggagcacggcgcgaggaggcgggcggtggcggcggacgacgacgacgagcacctgccgcgggagaagaaggagagcgacttgtcgagcgcgtggacgtggctgaggatgaagtggagcgtgttgagccggacgtagaggcgctacgtgccgcggctggtcgacgggcgcgggttctggccgccggacgccatgccgccctggccttggtggtgcccgtgggcgcgcgggctcgacacgggcacctggcacggcgtcgccaccttcttccacagcctgatgattatcgagtcctggttgcacctcgtcagcggcggcagcgacgggcacgcaccgtgtccttccattatcccagctacccgcgttctcacaatggaggcaccgtggagttcatgtctctcggccggagcaagaacgccatcgtcggcatcgaagaatggctacactacttattcatccaatcacagaatctccaatatgatatagtactactatttactagtataggaatgaatattcagggttagtcgtacactcataccataaactactacttgcatgctccatggctatcacaattgtatgacaaaatgaagatccactttcttgtctctcatgctcgtcctcaactgaaacaagacctccaaaaagcttcaggatcaaccaaaccattacatacacaacatacagactataaaccttcacaatcatcgatcacaggctataaacaatgacgaatcaagcaataaaaaggagatttttttaaaaaaatatcatattttcacggtgtctggtgtcgctagcggcgaagaacggcggcctgtacgtcatggagatgtatccccggggagacggccatgtcaccttcgaggtgctcgcctacggccgccacagccagccgccgcccgcctacgtcggcagcagcggctgggccagatgcagcatccaactcgaggactggcactggcgcgccctcccgcagcctccctacgtgcagtacccgggctacgaacgcgacgaggcgccgccgtgaaacacccttattacaatatcacggcgaccgcggtggtcggcgactcacgtctctggatatcgacggagggcgtccgcacgtccgcctttgacacggtgcgagatacctagagcaagcagggcgagtgggcgctgctgttcaggggcaacgccgagcacgtcgcggagcacgacctctggttcggcctctcgcgccacggcgacaagctgtgcgccctgcggcagcacccaccaccctttgaccgcttgacgcggagctccccgccggcctcctcccctccccacccgccggtggtctgcagagagagagagagagagagagaggaggaagggagagaagatgggaaataaagggtggtgacatggcacactgacatgtggggtcccacgctgattcagccgtcacgtagaccaaaatcgggatcaaaaccaccgaatgatctcgggtgaccggttttatataattaagagataccgtatatctgtttttacggttcgaggacgtttttatatccgatgacaagttgagggaccttcagtgtactttttcctttttctagtgcacatgaaaaggacaatttcaaaattgagattttgcgagcaggggcgatctgtggccgtccattcgttgtggacgttaaatcgaccccgtcgatttgtgatagaggttacgccgcatctgcgcgacccgctaccacccacacatcttcccgtctcaaaacaaaaagaaacaaaagaaaaaaaaaatccccatttctctaaaaatctagaggcttcttctcttctcctctctctcgttccccttcgtttcgattcgtctcgcccaaatcttcaaatccaaatccgcagcggaggcggccggggcgcggcggccagatcctggaagagaatccattccgggaggggaatccgcgcatgccaatgtcggatcccacggcggcggtcatccccaagccggggggcatcggcgtcggcggcggaggcggcgacgacgaggagccggtggagatccgggaggtgtgggcggacaacctcgaggaggagttcgcgctgatccgcgacgtcgtcgacgagttccccttcgtcgccatggacacggagttccctggcatcgtgtgccgccccgtcggcgccttccgctccccggccgactacaactacgccacgctcaaggccaacgtcgacatgctccacctcatccagctcggcctcaccttctccagcccgcgcggcgagctccccgcgctcggcccaggccgccgccgatgcgtatggcagtttaatttccgcgagttcgacgacgcccgcgacatcttcgcctctgactccattgagctcctgcgccgtagcggcatcgacttccgccgcaactccgagcgcggcgttgacgctcgccggttcgcggagctgctcatgtcctctggcgtcgtgcttaacgattctgtatattgggtcaccttccacgcgggctacgacttcgggtacctgcttaagatcctcacatgcagcagcctaccggacacgcaagccggcttctttaagctcatgaagatatatttccccaccgtgtatgacatcaagcacctcatgaagttctgcaatagcctgcacggtgggctgaacaagctcgccgagctccttgacgtggagcgcgtcggagagtcccaccaggccggttcagatagcttggtcacttcatgcgcgttctggaagctcaaggattcgttcttcgctggctctaccgagaaatatgctggagtgctgtatgggctcaatgcggagaatgttgtcagtgcgcattgatggatggtactcctctttgaattttagctttgtgaatggattgatttaggacagaaaatgtgacaaatgatcaagatgatgttatgtaggtcaagtttgtctcactccatttgggtttaatgtgatcctagtgttcttcagttattcgcgatgaaatagtgaactgtatttatgttaagttgttctgtccgctttcattttctcctacctggtttagttagataggaaagaaaaatcacctttaaggattaggagatggtaaaatgaatatattttgttgctgttttgtcattgatatgtatagcatggaagctggttgtttccaaagagtggggtgcgggtacatcaaagtgctcaaacatgtaacttgataacattacaatacaatacacagagcgcgacctctcttcacatgggtattttagatgctgttattttaatttcccagaataattagttactctaatatgtatccttctagagaataacacaatgcaatattgagaataagggcatctctctatttcgactttgtgctgcagtttttggtaatctgaggtaatgctatctggtctacattggaagcctggaaacatttacggttttcagccaaagttttctactatttgttcatcaattcaattatccagtaagcctactgcctagcgaatagttctgggcttctggccaatgttcactaggcaaaacctctgtactccatggagtaaaactacagtgaaatcctgcaaatatgcaaattctgcagatttgctaacaaaatattagatacgcatctagctatatgtgtctcttgatccagcaattaagtcacaatgatgcacagagcatgaatactagcagtttactttttccataataggttgtgggttacagtaacaaatatgcatgtcttgagacagtgatgctgatactatttcccttgccttcctgcaacacttggattgaatttctacttatccaacttatattctagatacaacattgatccatttacattctttgtgaaaaacttatcataactagatgagctttgaccacaagttacatcattccctgcaatttaatagcatcagattatttcattgctggatgtaccggaccactcttttttgctttgcaactagaatattagttcctttggcactaacatgtcctcaaatgttgcatgtggagatgaaatctagggcatttaattaagttactaacgagtttatttacaggttctgttggaacccaatttagagaagaatctagttagctacatcttctcgttttattaagactcaacttggacactaccttaatcccggttgattgccattgtccagtttatttaaattcatgtatataatcggtccttcttaagttcggacattgttggagagctattctgaataaaggtaatggtggctaacaagaaacaaggtaaggattgttagaaactggagaagtttgggtgccaaaaagcttcaaaagtattgaaattgtctaatgtttcatattttgcaggtaaacctgataatactttcctagtgtatcattttttaacgggatgcatttctggtgttaaaatgtggtactcgtcatgccaacttgtgcatgggttcaatttgaagactgagaagccttgtgcacgcatgaactttcttcatcacagattgatggcagcagcagcctatctcaattccccaaatctccagggatgagatcaaaccatctgcattgcacaagcttcctcccatggataatgcaaatgtgtaatgcttatgcaattgtaatgtgtagtgttaaacagttgtggtcatttttgtgagatctgaatactgattccataaatcggggctggccagaaacaagtgcttattgcatccagagaacatgttttcagtttgcctcacaatttcactaaaaatatcagtacagatttgttaacctccaaaaagggaacacagaaggcgagctaatatgcaagtttacatcatgcaaagaaatggcctgaagtttacattagaaagaattaacatttttcctgtcaagtctctattgacaatgaaaatcttaagcaggcaggagtcgttctatcatccctggcttaccgtcaagatctttttctcaaaacaccgtaattggatcaaaagttcaaaacagttgccatcttaagtaatgcagcgcagtgcactgttcaccctctaatctgcaggttcttagtgtaattctgcgttttttggctgcaaccacaaagacagtcgggtgagttatatttgccgtgtgtgctcataagcagcaactgttcatagcctacccatttacttttcacgtgatgtctatcttgctggcacgtatgatcaattggtccatttcttcgtccatatctatttgatctcctgctatcatctgaggaatattttgtggcacaatgtcagcattaatatatgccccaagcaatgacttgtacaggggcaagcttgtcaagttgaacttttgaagaacctttatgaatctatctgcatcctccacactgccttgctcctcgaaatactttgcaatggcctccaacagctcaagtggaggtctccagtggcaagtcttcaacagagataagcccttcttcatggcattgacagctttatccatctgcttactctgaacaaatccctccatcagtatctcccaagtcttgtaattcggatgcgcacctttctctagcatgtggagatgaagcctctcagccttttcgatccatccattcctcacataagcaccaaggagaacatttgaaacccgcacatcgtgcttcttgctttctgcttcccagcttccaaaggtccactcggcccgaccaatgtcgccaacttttatcaagcataccatagcagacatgtagtttgcagcagggatgctacctggaacaattttactagcctcccacagcctaataaccccatctctgtcattcagggctgcataacatgtcataatgaaagagtaccctaaacgccctgttgatgacaactttgtttcagccgttctaaggcaagcaagagctttactgctctgtccatacttcttgaagatgttagctaatgtacagtatgtgctccaaccaacctcaaccatgtcatcattcagcatctccttgaatgctgattgtactgaggctaagccagagacctcagcacatgcattcatccaaatgttgtaggacagaacatttcttggaatgttgttccgtttcatcagataaattacactaaggaccttctcatactggcacgttgcaacatatagtttcataatttcattgaaagaatgaggatcgacaggcagtccatatctctgcagctcagccatgaaggtttcagctttctgcacatttctttctgtaacatagcaatggagaagcgggaatgacgcggccttcttggaagcagcagtacttagttttctgtagtactcctcagcttgagaagtaccatgaacttttgcaatcaaatccagtctaaccatatgatctgagggcgatagtctaaaatcattgtgcgagtccatccatgataaaatctgcagcataataaaattccgtttaggtagtgccccttgcatcgccactgcgcgatatagattggaacagcaataaacattcagctgagctgtgcaagtgtgtcaataaatcatataacaaagagtgaaacaatgttcactttgcagcataacattataaggaattattaagaagtttgaatcaaattgttgcaaaggtgaaaaagactcctatgtcctatctgtatcagatttttctcggttcaaattcgttcatcaggtagagctgtttggagtgtgctcacctccagggcttgctcgtagcggcgcgcgcggcgaagccggacgacgtcacggcggagctccggcggcgagacgcggccgcgctcccgagcccatctctcgacggcggcggccgcggcggcgcgcccgctcttcctcgggatccggaggaggcaccgcgacagtaggtcgccgccgtcgccgtcctcgcgagcagtcgccggaggagcggaggaggaggaggaggagcagcagaagggtctagggtttgggcgggaggcgccgacgaggagggcgagaaggcgcgagcggcgcacgacggcggccatgggcccaaacaatccatgggcttgcttgctttaagaaagtttaccttcttctcaatccctttttttaaaaaaaaaattagtaaatttcagaaaactgcaactatagtcataaaactgtagtgtgctgcaacattagtgatctatttcagtttgctgtaataataacgtggaaaattatcacaaaattacaacttttacgtgatatgcgtagaagttacagtttcgtgataatttatcacgctattgttctagcaaactggtagttttgtgactataattgcagttttttaaaatttactcaaaaagaaatgaagtgatagcataaatttgtatctcaattatagtggatgaaaatttagacatgtttttaaaaggctaactcatacgtgagacctaaccggattctacaacttcagtttcgctcccaattattttagataatagattaaaccggcctctgcatccaaacatatatgcacagccaagaagctccccaaatatatgtcctaaaatgtaaatccagccgcgccacggctgtctgtgccaaaccaggacgaggaagaagaaactgacagtaagctcaggtttatacaagccatcaatgtctctctttctaggtcgagttggcaacccatctcgtcctccagattactactacaatacatatattgacatagatacacaggcctagactagattacatcacaaactaacactgctagctagtacacagcatacaatggggggacatgtacacagatgcagacgagagatctgtcatatgcaagctccaagggagtagaaatcgccgcaccccaggtcgtcgctgaaggtaacatcatccttctcctgcatggaaatcgagtgtcagatagcgaaacagcgccgtcaacaagatgactattgcttctgatggtcttatcatcagcgaaaatggttcaataagtttgctggtatgtgtcacttttgtgtaatcttaatatggatgtcatggtaaaaaaaattaggtgaaggaaaaaatccttaccactttgactatggaattgagaaggccgtcgaagctgcagctgctagagctaagttcgctctgaagtttcgggatgctcaaatcggaggcgttcttcggcatcgccatatctcccgaaacgaggaaatctgtcttcatttgtgggataactgttgaaccacttgaggttgcttgcccaatcattctggcaccaatattgctactgttactactgctattgttccatctttggctcatagcatgatgagccccaatgttgcttgccaattgagagctcggtacagaactccatacgaacttgagatcaaacagactgtctgcagtcctatcatcgaacttctgtttcaaaccgtttccacctccaaaattcaagtacttttgctctgtatctggaggtaaaagcatcgcgccaccaaaagagctagctccaccttttgtgtctcttgctaccataaggtcatttgaagagcgagcaggtgcacacgatgaagatgtaccacccaatttgtttgcacaggtattgttaaacgaaccatggattagcaacccgttggcggaaaatcctgataaaggaatagtactctgctgggatacacgagattcaagcagaccagatgaaactccaacggcgccttcaatatgttctgaacttacagaggaagttcgaattgatggctgactgacaattttggcttgtgtgcactcggctagttcttgaggcagcaaaggactgcttgtgacactttggagtgtgccagacataccattagataggccattcccagaaaggatggtggacagatcatcggtttcttcatggatccacttctgttgcatttgggtctgcccaagcgatgttgccaaaccttgtcccaagtttcctttctggtttcctggtaagctaaggtggtacttatttgcatcattaatggaatggctcaatgtatggcttccgctcatagtctgaatcgattttgaagcaggtaccccctgagttccaagagctgctggattgtttctaggactgtttaacaatccatgtggagtaaaagatgatagagctgcggaagaggtaaaagcttgataaccctgtagtccttcaaatccacccatgtgcagaaaggggtctctacctcccaaagcagcaacgatgctaacttgttgcgacgccacagcgcttagccgtttgagatagagcctgtacttctgcgtggtacacaaagcttgagattagactctgcaaacaagttgtagtgtttatctgtgaacaatttgcttttagtgtctcagcatgagtcacagaatagcaccggaacttgtttttggttcaccatatatgtggttgctaaatctgctagaaggtttagagaagtgctgaaaaatgtacggccttttcctcaacttaaaggccactcatttaattgttacagaatctgctcttggaagcagaggggcaaagtacacaagactcaagttagaataggccttaaatgtgtaatagctctgtgttgataaaggatgccacagtgactttctatcagccatatttaatacagtattgtaaaacagtcagcgcacaattcattggtattgaagaacttctgaattcggttaatatttcttcagggccttagtaaagttgaaagatggtctatcttaagctatagtttcctctgaacagtaaaaacttgtagtgcaattaattacaatagctgctagctgtggtacagatttgttctattcaaattacatcattaccagtacatgctaataaatagaagatagtgaaatgagttccttgcctgtaggtgacttgcaacattttcccttgtgagtttctcaacattcatgagctcaagtatcctttttggcacagcctctgcataaatagaaaaaaattataatctcatcttttcacttatgcttatgcttattagccaaaaattgaattttcaaccttaaatttggagttgattttggggtttttttcatcgtagtttattttttagcctttgcttttagatcgttaagaacacgtatataaaagttttattcacaaattatttttcatttgcaaatatgtcgtttagttttttcctccaatatgccaaacgatggggccgtttctctctctctctctccaaaaaggaaaagattagggtgtaacatgagtcaccataaaaaaattgtgaacagcaaaatggaggcagtggtgagaacatactgtcaattccaagctggttgacagcagcgacaaatttccggtgtagttcaactgaccaaacaactctcggcttctttggagccgagggatcatcaatatcttgagtattgacctcaccctcatcctcctcttcactacagtactccttcctcttcttgctgggcctcccactttgatcaggtgatccacatgtaacatggccatgcacatggtctgaatccgcatttggtggcttgttgcactcttcatagaaatcgagattagcacggtcgcgagtactgaatttcctcctgataacatgctgccagatattcctgagctcttcgattcgaacaggttttaggagatagtcgcaggcaccatgggttatccccttcaatacagttttggtctctccattcacagataacactgcaaggaaattactaattggttaacatcaacatttccccctacccgtcatagaaggaaataagtacagtacagtgctcaggatttgctgaataaactgaaattgaattgatgctctgcagatacaagaaaaatcttcactcacagtggctattactatcaagaacagttgaactggattattggatagctctgagaagggataagattcatgacttactgatgacagggaggtccatttcaagccccacaagctcaagaagcttaaagccgtccatgtctggcatatggacgtcgctgataactagatcaaacatgtccctgttttcccgcagcattttcagcgcgatagcagcctgatttgttgtcgtcactggaaaaacaaaacaaaaattactctttcaagtgaatagctgttgaagatacaggaaggcatctgcgacaacaacaattcaccctaaacccccccccccaaaaaaaaaaaaaattgcagcatgcatttcttttatcaacaatgacaccataaatccagatcatgtaaacaatttacaactagacatctctgtagctgcatgcagcatatatagtatacgataacttcatgaaatattttattgaataaacataaagcattaggcaaaattctgaagaacatacatatagacatctaacaataaaatttgtaagaattgatattgctgttccaagacaaaaaaaaaaaccaagactgaactgcaaaaagaaaagaagaagtatttaccatgatactggcagcgcagcagcagggtctcgagcaccttgagacacaccgggtcgtcgtcgacggcgaggacacgcataccgacggggaactggtccctcctcctcgccgccggcaccacacccttcctctcctccgccgccctcatggcaacaaaaaacctcccaatccaattcacagcacaaaacccaagaacagcaagaaacctcccaatcgatgaagcaaatcaagaacaaaaaccaaccaccttataaccaaagttgcaggatgctgggaagcagatgtgggcaggggaagattgggattcagcttcaaggcaggcctcccaatccccagcaagaaagcaaaggcaaagagcccaaaggtacaaaaccaacaacctactactactgctcctgctgctgctgctgctccccaactagaacaggaaaagagaaagggagaagcaaaatggaaagaaagaagctggtggtggatttggacagggagaggagagagctggagagagtgggcatggagcttcaggaccaaacccaccaccatctccaccaccccatcattattgaggcaaagaggtgggaaagcaaaagggagggagttggagaagaaagcagagttctctctctctctctctctctctctgcagccaaaaaaataaactaaaaaaatgggaggaaaaaagcagagacactgactgttccagatggccaagcaagcaagcaaccaacctcagcttcagctcacacacatgtgaactactcctagctcagcagcagcagccaccacaactcccagcaagaaaacaagaggagattggagcaagaacagcaagaacatctcaagggagaagaagatgagggagagaatgtaagtagactgtccatctgtctgaattttaaggggtcaaaaatggtggagggcaacagaaattggggcccatttcatccacaagctccaaccgatcgctacagacgaaacgccatccctctgtagtctgtagtatgtactaccccgcaccggcgaaattcttgcgtctgtaaattttgtattgtatctcatgtatcaattggacggggcaaaaaataattttccatgaacatgttaaattggtactagtagtaatgtttttttttctgaggccttaaattagtagaaaatgggcattccatatgacaattccgtatctcatttttaactttttttaaaaaaaatatcattatttttttgagaatttttttggaacaaattttctgattaaaatgatccaaacttttaagagttgtggaaacggatgagacacatctcgatcacacaagtgaatatagcattgcaagctagtagtatcaacttgccacgcacaaatgaatagtatcgcacagtgactgtactcctacattgagggccttttgatttggagaaaaaaaaatataagagtaggagtttaggatgattccaaccctataagaaaatttcctaggaaaccctttaaaataaaggattgaatcatattgtatgctttaaaattcctatagaatgaataatcctagaaagattttgtgaagaaaatttagcaagagtttcaacctcttagaaattttcctttgaatctatccctttataagattattgtgtttttcctgtgattcaatgaaatggttattcttgtgtttctcctatattttataatcctctgttttgtacatgcaattgttattagaattatacgttttttttctatttcttcccttttttttcattggcccctacggagtaccaccaaacagtataataccatatacatatttactgcttgtataaaaatactgtagtaattatagagaagcgtacacgaacagaagacatatgcttgccttaacaactttagattcttcacacggtataccactactgcagctgggccccaaattataatcatccaatggagcaaacaaagacgacctgatctctggatctacaagtagttaatggtaaaacaccattaaccccaaagtaaaactccccttaaatgcgtgcctttaattgacgccatttactaacgcttttaataaccatccattaaagctttggatgattgattggaagggggcaccactccctcgcacacgaacgagattacgagatgaagattgtcacgaaaatgcccgaccgaccgagcgtgcttttttgtacggtctcattttctaaaacatgatataaacgaagacgctcataaacacacatcatatccttattagcatctttaaaatcctaatttaattactccctctatccaaaaatataatgtacaatcatgttttttcatgcctcataatataaaacatatgcgtatatatattaactagcacctcgatcctctaaatttggtttgttttaaaccatcgagctcttcaattatattgcttgtatgcatgaatgcgatccaaccaatgagaatgattaagggccagtttgttttgaggcctaaattaggcttgccaatttttttggcaaccttaacaataattgtgtatgtttggattgaagccaaattttgacatgcctatataacataggccattttaatagccaaattagtttaatttggcttcaatccaaacacatgttggccttaccaaaaattggcatgccaaaacttgtcaaaattgccaaattttggtaaggccaacattggtcacaaaccaaactgaccctaattttttttcttaatctttatgttacgagtggtgagcatttttttttatagatggagtagcatctttgaaagactggactaatataacttaggattgataaagtaacacgtgtatattgtcacacattgaaaaataataattagacgtaaatacaagcatctatatcaagtccaggacttgaactcatgtgaatcggtttctaatcaattgagttatgctcacttcaccatacgatattattctaaccctatataaaataataattctaaatcatttcaatcttgtattaccatctccactaaataattagaatgacaaaaacaatcgatcatcggttaaagtgatagtagttttagatattgtttccgaccgttttcacccctagcggcgcacacacaaatcacctctatttcccgtgctcgcgcgcgcgcgcgcgcacggtgggggcggccacacggggggtcgtgggggtgtcgatgcggtggtttttcgcgcgcagccagccccctttgtcgtctcgtctgccacccacgtccccatggcgctgctgctgctgctgctccttgctgcaacctgcaactctgcaaggccaacaagacaagcggaggcagcagtagcaggagggcatatgcctcgtttcccggactctccttccatctcatcccttggttgacccatgggtttgaccatctcaaccgttgattgatcccacatttttttaagcaaaaggtatagtcaatgagtactccctccatcctaaaatatattccatatctcaaaatatgaagaattttaaatagataggacattttctagtactatgaatctggacagactctctgtacaaatttatttaactatcaaatgttccatctgtttaaaatctcttatattttaggatggagaaaaagtaaatagtattgaataagaagaagagagtataaataaacaataattatgtgcgttaaaaaggaggttgtatacaataaacaatagttaattagtatttaataattgaacggttaaacatttaaagacactaaggcaaagatggtactacactaagcttagtatttgcaaatggattaattatgtggactaataagtgtttacactcatatactgccaggacatgagagaggagactgtaatttgtaaatagctgcatgtgtgggtttcttgtcattttgttcatctttctcgtgaagttttttgcgtgaaaaggggaaaactggacgtgccggtataaagtgagccagtactacaattcactgcctatatatgccacgtactcgatccaacctgctacgttgaaaacttttgcgtccatgactcactgcacgttgcttccggcgatgaactatcaagcgtcatatgcattcacgtaagctatatatatatatattattcccttctcctaaaatataaaatattttatataaatgtaatatatttaggatcataaatctgatttgactttctgttaagatttatagtcacacacccacctatttttttttcatattttagtacggatggagtatatgtattggcccacatcaatttaagtcagataatgcatcaggtgtttgcatgcttaattacgaccgttaattgtgacagcggggcatacatggctaccttcaatacgggtcaacatttactgttcacttctttttaaagcccgtttgaatgcgagaaattgtatgtgttcacttcacgtggaagtatgaaataaaatatactaggatacctcctctccggaacgcaaaacgatatttgcattaacatgtgattaattgaatattagctattttttaaaaaaaattgattaatatgattttttaagcaactttcgtatagaaacttttttttaaaaaacgtaccgtttaatagtttgaaaaacgtgcgcacggaaaaccatgatagggagttgggaactcccaacaaagaacgcaccctaattaagtactcttttatattcatcaccatataaagtactttcataaactatacacgaatttctattagtcaatgataagaaaattaactggcttaacaccaagtaatttaaacggaagtaatatatatgttttaacttttattaaaggtgactttttataataatttaagaacgtgttcaacctataacctatacatatatgtatcgttagcaaactcctttttttatgccatacatgacttgtgtgtcgcataaacatccgcgagcacccaatagtacgatgataacactaaattaatattctccccgcttcaaaatttagcaatctatgaactaaattcatagtgttaggttggatctaatctcatacataaattgttatattttgagacgagtaataattaacatatttaaagtactcatctcacacttttcccccgcatgatgcaacgtttaccgacagtttatagcttccaacaaacaaatgagaagatggttgcatttaatttaattagcttgtgtgattggtgagtggtgaccaaacattatgtcatcgatcgatcccatgcatgcatccacgcccaattttttcatatacaccctccgtccctaaatatttaacgtcgttgacttttttatgatatgtttggccgttcgtcttattcaaaagatttaagtaattattaattctttttctatcatttgattaactgttaaattcacttttatgtatatatatatttcacaaaagtttttgaataagacgaatggtcaaatatacttaaaaaaaatcaacggtgtcaaatatttaaggatgaatggagtatatttttctccgatccatggagcacgcgtatagaagttcacaaaacatatggtaactaaaaaaatattcacagcatttttttctgcagggaaatattcacatcattttcacaggccacgtaagaaaagaataatattcgtcgtatgaagtcattataatcttcctttatggatatctagaaggcatatgcatgcatgcattctgcgatattaatatatatatgtaaccggcgctgccggccacgtggttaattagacagttaattagttgatgatgccaggtggtgtttaattactgtggaaaacttctactagacgtctgaatatcttgttgccctgatgataattagtatactgataaatggttttaattaactaggcatcttagtcagcttcacttaagtgcagatcttaaggtagctaggcccagtcatagttccaaactttttttttcaaacttacaacttttccataacataaaaacttttctatacacacataaacttctaacttttccattacatcgttacaatttcaatcaaactttcaattttaaccaaacttttaattttgacgtgaactaaacacagctctagtggggttttttttcttccaaatagctaaatgattgaataatgtatgtgatcactattcgagagcacaaacgaatggattaaacattatgaagttaaagaatagatctaaactagttttgtcgaaattcacatataaaagttttttttctcaaaaatcgtatagtttgggtgcacgtaaaacatgtggcatatattaatcgatcgattaatccttccttagaaaaatgttcaagggtcttccgactagttccacaaggtggtggctagactatctgggttcggagcctcaccccttttaattatttgatattaggttatttcctaatatttgccttttttttattaattcttcctttaaaaaaaagagtaggttgatttaatgctaattgcattgccatgtttatttttttttctttttgtgtggatgacgtcgcacgcgaacacgattcgaaccgaagtccatttttcctgcgcgtgtacatagtatatacgtacgcgtgtagtggacggttgcttttcatctgctttcttcagagaagctctatgtttattatgatacgcatgcacgtcgctcttatatatgtttctataatattatgcgatgattctcaatcatgcatgtttcaatattacctaaccatttcaaaattgaacgcgatctcaattatttaactacatatacgcatgcatgtgtgtatatatatacagtacgtacaccaccggctgcatgccggccaatgatcgatatgatctggacctgcttttgctagcttaatttactcgtatttataattttttttgactgaattatttataattgtttgtaaacactgctccctccattccaaattgatggtacaccaagaccaagaaaagctaataactctctcatattatatttactctagcaacaaacttgatgcatgcatcatccacactattttctagccaatagaaaatcaagatattgcatgtgggttataaatacttgtgtggatgcatgcatcaatgcccatttactccaatgcaccaataacgaatagacttaatgaataaacacaaatatatagatcatttaagaataaccttaaaaaaattatatgcagatcaattttgaatgaagggagtagtatacatgcctcttactacatatttttggatcgatcacttgagaatttatggatggagggcacaagctgcattcacgtacgacaaatgcgatctacacccaatctttgcgcgtaaatttctgatcgatctgcatttaattcactctccatcgaaagttcatttaagagctagctaggggccgaccatcgatccatcccagaagtaattactactctagttattgatctgggcccttcatgcaaggtcgaacccatcaacatgcacgtaatataagctgtgtttagttccacgctaaaattaaaagtttaaagaaattagaacaatacgatggaaaatttgtaaatttgtgtgtaggaaagtttgatatgacggaaaagttgaaagtttgaagaaaaaagttaaaatctaaacatggccatactctacatctaaaaataacacataagattaagtggtgagatgaaaaagagaaatgaggaaaaatatatgtatcacctttaatcatgtaaggggcaatcttcacacaactaaaaaaaagaaaaaaaagtgaattggacaaacaaataaaataaaattattggggttagtgtgctacagtacagaggtaatataaagatgatgtattgtatataccaccttttatagataaaattgaaggtgtcaactacctttgctataaaacttgttcctatattactcgtttaattataattagcatttaactgcgacgctaaaacgcacgcttgcatgcatggtacaatattggtactgcaggagtatatatatgtacgacgcgcatgctacctgcagtatgtacatgtccctcgtctgtgcgttgcacgcaccgttttagaacgcaaggtaatattggtttaactttgatcgatcatatataaacataattaaaaatataaatttcaggtatctgaagaaaaatggatgtatatatagtctaccataacgagagatttcttcatagtattacacttatgtaatttctaaaatttatatcgaagggctagatagtcaaatttttatccccgcaaaaaaaaaggatagtcaaatttatagagtataatgttaacttagaaaagtcacacacggcttgtttatgctaccagaggaaatagctgtataattaattaattaattaattaagcccgacttacgtacgtactctttctataaaagaaacttaattgcaagctattggtcaacaaattagtggtaagggtaggggccgggtgagcagaaaaaaaactgaaccgaaaagaccgagaccgagaaattcgatcctagacagtcaaagaccgatttttttcgatcaatttggttagtctcctcgggtaactgaataaactgaaaagactgaattaaaaaaatgtttaaatgcaacataaaatccactaagttcaataggactagactctaattttttcacatccctacttcttctaagcatgcaacctaacaagagtctttattcatatgtgcttacaatttctttttttgatttttgtgttggcatttttcactatttttttgcatatataaaaatgttgttgaatttcggtcaggaccgagaccgagaccgaatttgtcagtcctgacatttttgcgttgaaattcggtcttcacattccaaagaccgaaatgaccaaaagaccaagactgaaattttcggtcaggttgtatgcccacccctacgtaagggtaagtgcgcccctcacaaatacacataaacacatataccctacatcttaaattatatggtgcaattaacaccaatataaagaccaagaaagaattattatcacctttcgtttggataactccaataaatacaatgcatacacccaatgggattagagattttgagagggtggatgattttgaaaaagaaataattaaagaggagagagatgtgctagtttattgcatcatgcgtgctttatattatgaaacattgaaaaatatggttgtgtcttatattttgggatggagaaagtaagaaaagtaatattgcaaattggtagttaagggatactgagagcaagtactataaggatatatgtgttggtctaaaagtgtcgcataagataagtacttgatgagatctactccagaagaaaagtgatgagagagactatgagctagtcactagttatacaagaggcaatctacatatataatctccaaagaagagcacacaacgaatgtgagatagtgtgaaagtgaacataaggctgtcatgggttggcctaataatgttgattattttcatacagcttattaataaaaacttatttatgagcatcacttttatatatgtcatagcgactttaaaggcaatgcataaaaataaacttttcttttgagatggaaataataaatctcaatagcatcaaaatcaatttcaaaattaaattttacaattcaattttggtaacgatttataagctgtatgataaaagataggtatagtatatgacatggctaaaattaaggtagcacattcactataaaacttgctctcttaatttaggaacacaacttcttccattcccagatcgatcaaggatcaatatataagttgggacaaagttgcaaggctaattaaagtctttttagggtggaatagtaattttgaattttgatttggtggttgttttagttccaccaccagcttgtcataaactatatattccatgctgctagctagctagatttggcctagatcgatagctagcacttgcaaatttattaggtttggagctttgggatcctacgctgatcatagagagatcgatcacttatatataggcactcgctgtcgtgatagatcacatagtcctaacacatgagatcctgtaagattatggagtatcacacaggtcatgccaagttgtagaatcaattaattaacggcggccgtggcgtctgaagaaagaacagctagcagtggtaaaaaaaaaaaagaaatcaaagatatgtgcctgccatgtcatttatcacatgctacgtacaacgtgttggcacatacagtaactgatgagcaattcaagctatgcattagggtgcatttctttttagctaacgattacatgttatcacggacatgtttttttaaaaaagtttataataaacacggtactttttcaatggaatatgagcaatgctagcgcaataaatgaccacacatcaatctagccggaaaaaaaaataaagggtaaatagctaaagtggtcctccaagttttaattatctgaggctcagtttagtccttgacattttaatctatccatattagtccttcaagttttcgttttagttcaaaattatccttgaacttacttagaagccacatggctaaacataaccaacaactctcttgataaatgacacttatactcccctcattcacatatataagagaaaaaattgcatgcaatgatttttttatagataatgcatagtaatttatgtaaaacgaaaataaattatgtacttgcaggtgtatacgatagccattgtttaagtttcatgtgcatatgttgaaataatgggaaatacatctgcaatattgtttatttattttgattttcccttttctaatgtatagttgcatacaaattaagggcaaaacggacattttgcaatggaaatattgactacaaatatccatatggcatattaagtgggcccaaggatgattttaagccaaaacaaatacttagaggacctatgtggataaaataaaacctgaaggaccaaattgtgccttcggtgaaatttgcgggactaaattagctattcacccaaaaataaatgacaaagttacttctagtcaatgtattagtaaattactaatttacccttaataacaaacggatcatatcatttctatcgatagtataatactactagtagaaagcaccggagcatcactcaatattgaattcattcattcatgccatcaaataattgttatgaacaacgcaatttcacaaatcatccatagacactttagagtttagaacgcatcatatccttaggccagattaaccaaaagaacatcaataagcaggactatatatagcaagtactttctgagacgaatattattggtgatcccgggtacccgggtacgtacaaatcagggtgcatgaacgacatagcaaaggcaggactaacaaaaacggaaggcatatatatatatatatatatatatatatatatatatatatatatatgcatgcagcagtgtgcattcagatcggaagtggtatataatgtggttgtacgtagggtaagaattaagcgtgcgtggcaataacatcatagctttgtcggcaattgttcgtctcttctcctcacatggaaatcttgagagcagagatcgaatcgatcgtcgaagaacgtacggtcctcaaccaattaataagcacatatatatcgtcttgagatatcgatcgagctggcgactgactagctagtaaaattgtttgaatttttctagacaaactgtattaagtttgatcaagtttataataaaatttagcaacatctaaaatattaaataagtctcattaaatctaacattgaatatattttgacaatatatttattttgtgttgaaaatactactgtaattttattaaatcaaatattttttattagaaaaaagaaaaggtctaacgactttaaaggaaaggaagtactgtatattgttgtacgcatgctagcaagcaaatgcaaggggcagtctggcagtgcatatatgatagcgtaatgatgatttgttcctgcggctccctccgagcactggtgaccagtttaggttatgtttagttcacataaaaattagaaattcgattgaaattgaaacgatgtgacagaaaagttggaagtttgtgtgtatagaaaagtttcgatgggatgaaaaagttagaagttttaaaaaaaagttagaaactaaacaggccttaggagtacatgttggtcaggaggacgcattctgcatttctgcggcaaaatcaatcgtattttccgtcgtggtgacacgtcgcggctcgccggggccgggctacgagcgtgaggtccccgcccgttgcagactcagcccagcccggcacgtacttccaacttgcctcgccgtgcgcggagaagaatagtgggccggcccaacttgtcggtgcaccactgcacctgcacgttcgtgggtatcgcgttacggcccatactgctctcgggctgcctgtctacaatacatgggccaacatcgtcataccagtccacttctgacggtatgagcttttgccgtttctccttgcttcttgcatttcgatgacgacaacgtactctcttcgtctcctactttaatcatttgtcttgcttaaaatactaggcacaaatatatttaaaataagacggacaatcaaaaacttatggttgcacttaaaataggacggagggagtaaatgctgcttgaaacaatgttaaatctagaaagagtcgctcaaaggcatatggtacctgagtttctgcaatcaattcgaattaatcgattcccttcttttgcatttgcacatctgcagctaatagtacaaactgaataataataagtaagaaaacagaaccccagagggctcgtaaactgaactacagaacattgctactacatatctcctgcttccactaagctcccctcgattcagctcacggctaacactttctcatcgcatctccatttctccatccaagctgctacccacaagtatacatctgttctccaatctgatgaaactcacactgaccattcttgtgcagcatcagaattcagaacacactccttttccttcacataagctgtctcccttccctgtcagattcttcgtcttcttcttcttcctccatacgatcatggagcaacgacagctattgcacggttagtagattgtgacaagtgacaacggctaaaaacgatggaatcagctgctctccagtttcatctcttgccgaatctcaagcacttgttgtgttttacttcggtcatgttattgttcgaggacgacggcgccaactggggcgctttggctgtcttatccttggagagcttctccatcgcgttgatgaacttcctcagatgcctgatgtattcagggtacgtctccaggttgcagtggccgccacctttcacccataagggctcgtacttctccttcgcgagctcccatagccgcttgccgtgggagaaatcgacgatgtcgtctgctgtgccctgccattgtcattcagcaggtaagttctgagttctgatcacaccaaccggggaaaaaaaaaacagttgagagcagcaatgaactatctcagaacttaataaagtcttagcatgttttctgttgaactgtaactagtaattggacatgagatatatactgaaaagtaaatttgaagatgatttcagacttgaatatcaatgaaaagctaaggaggctttgaatcagaaatgaaaagggtacaagctactcacatgtataaccagcactggacagtcaacctgctttattttgtcgatgttctgcagacatgttagcagtaaccagattaggatggtaaatgacagtcgttttagaagcaaactgaaatcatggtccagagttccagacataccttgaagatatcaaaccaaagtgttacttttaccggatatagaacccgaatgcctgaaagtatagcactgtgaaggacaacccctcttaatttttccaagcgcgaggctaaatgcaatgttggtccacttccaactgattgtccatacaagattagatcctctggttcaatcccgtacaccttcgttaaacagtcataaacagcctctatgtcacagtatgtgttgtattctgatggcttttgaagcagaaaacatgataagaaaaggaacaaaattaggtatgtcttccacaaggcgaacaattacctagcttaattacttattgtaagttcgtagaaaggaaaacatttactatcgttcgttctgatcatcagaaagaattcgttaatcaacaaaaccatgtgccacatatgggaacaactgaacaagcacacatgccactttatgagctagtactacttaaccaagttcttcaagtagggatcgataatcaatcacctagaagttggggttgatggtcccttggtataacaactttgacaaaaggatgactaacagaacaaagttgccatcatggtcgagaatagcagaaagcatgtgtgactttttccgatattcataatgaaagtaaaattgaaaaaggctaaacagccatttgccaaagtcctattccagatgaggccaagaaagacagaatggctaataataattgctttgagaaaagctgcccatatacctatagaagaacaggatgttgattatgaaaaaagcaagggaaacaatccaatccaaagattgtcgcttgagtcattgatgaaaatatggcataaacatacaggagacatcatgatcacaaaaaagtttaggtgacaatctattcaaagaagacaagtttactgcaaattaacctaagaatcaagtttgagctcttaaaatcactgaggaattcagaatcttactttgcctgtagaggccccatatcctgaataatcatagctgcagaacgaaaccaagtaaaaagttcagtcacatgtaacacacaatattggtcatgtccatcaaaggaaaattgtcatgatattaatttgacacaattgtccatgttttatatatttattgatggaaataaatttcaaatcccatgaggatcaaatagcaacttttccagtaggggaaattctttcgttcttaaagttaaaaggcaggcatcaactggatccccaaaaggtgaaatagataccatttgaatgtgaagttcgacaggactccatccgaaataatttatagcagaattattcatgatacatttttactctatccacacagcaagactatatgcaaattatcaatccacgatccaaatgccacaaacagttataacagtattataagaataagatgccaagcactattctcttacaaaaatgatgctctgtaatccttgtatattttaagagaactgcaacaaacaatgccgtaaaatttttttaccccagttccccaatctagagaaatgccacaattctaacaaatgactagaatcgctgaaactgaattcgaaagcaatagcagcagatcacacacagcagcatgcatctgcattggagcagaatctgacagtataaagtacaatgaatcatccaaaaaaaagtacagtcttaacctcgtcggatggcaacctggcaagaactaaaatctaaaacggagggaagaaacgatctgtttttcaactcttccataattgtggtcaggccatcaggatatccaagaaactaaatctaaacataaaagcagaagtcaaagcatttattcaggaaaggagtggtcgtcatttaatcaaacgagcagttcgttcctaacattgaaggtgaagcttaatcaggtgcgaattcaacccctcaaagaaggtttaacaagaacaatggaaagaaaaaagcaaaatcttttgcattgcaggtcaattaacaattctgaacgccatgacattactgttcaacacagttggctcaccaactaaaaaaagatcgaatcaaatcctctttcaaattaaagcgaggaaaaaaaaacataacgaatgcccgccaaatcggagcttgcaaaacggagtatttacaaaattgatcctaaatcataagactaattgaaagtttgatactgattaggcatgaagagtagagccatagagcgcagcatatctagcaggcaagaacacaacaaatgcaaaggcatataatgaaatgcaaatgcaaatgcaggttcagaagttggaagtggaagcaagaaaagaacaaggcgagcaatggaggagaggagaggagagagggtgacctcatgatgttgacgcggaggtgggcgcggagctcgaggaagaggccgagcatctggccgaggtcggcggcgttgccgtgggagtagagcagcgtgaggcgcgcggaggggtggcgccagaaggcggcgacgacgcgcgtccctcccttggtcggcagcgcgtgcacctccacgccggcgtccgccgacacccccgtcatcctcaccacccctcctccgccgccgccctcctccgccaccagctcgtacgtgggtggctccggcgggaagaaggccagcctcgccgccaccgacgacgtcacgttccccattagctccccctccccgcccgcctatctcgctccgcaacgtgaggccgccttctcctcctcctcctccttttcttgatttcttccctcgtcaagaaaaagaggtgaggtggtggtgtgtgttgcttttctcgggctccttacctaagcttgcttttcctcctctctctcgcgcgcgcgcaatgactctggtggattcgggtagcagttgcagtcggggggttggtttctttggttggttgcgcggcgggggcgtagcgtaggcgtacgtacgcttgtcgatcgatcggcgacgacgacgacaggttgacgaccaccacgtcgcgtgtgtgcgcgcttccgtcttcgtttagtactactcccacacgttttttataaaaaaaacagtctaatactaaacatatcttaataagttgtgttttcctgaaaaaagttggaggtttggagaaagttgggagttaaaaaaaaagttagaagtttactccctctgtccaaaaaaaagacaaaccctaggtttctatgtccaacgtttgactgttcgtcttatttgaaaaaattatgaaaaaaattaaaaagacaagtcacacataaaatattaatcatgttttatcatctaataacaatgaaaatactaattataaaaaaaaattcatataagatgtttttgggacggagggagtatgtgtgtataaaagttatatgggttactgtagcacttatgactaattatggactaattaggctcaaaaagatccgtctcgcgatttacatgcaaactgtgtaattaatttttctttttatctatatttaatacttcatacatatgtccaaagacttgatgtgatatttttggaaaagttttttgtaactgaactggcccttagcaatgttttagtagccacgcacgaaaaattgtgagacgtctcggatactcacccaaggaggcaacaggacggagtattattacaccatccgttccaaaataaatttatttataaatttgtgtgtctaacgtttgattacctgtcatatttaaatcttttttataatttggcatttttattgttattatgtgataaaatatatataatcctttatgcgtgacttaattttttaatttttttaaatgagatagacggtcaaacgttagacataaaacctacaaataaactaatttttggacgaagggtgtactattatagatttaaaaatttattttttaaaaaatgagttttatatagattattttaaaagaaaatgtattgtttaatagtttacaaaacgtgctcccggtaaacaagtgggtagtaaaatcgaaactcactttcaaactcagtgttagatttacatttagcactggcattaaacaccaaaagtagctaaattggttggttagtgttgttttttatgtgaaattctcgaggattttggtgttagcttatgcgtttaaaaatgatcgtgcaaataactatcggctcatccgaatagcagcagtacggtcgctcgcacggatcggatgcattacctgaccaatcaacagtacagatattagggaaaggaagacgttgtacctgcatataggtgactcaataactgatgttcagttagctataataaatgcgtggaagagccaaagagggtaagctgaggcttgtttagagcaagtttaataatacagtggttcaaattatctatagctaatctaatagtctattcagataatagctaactataaaaatatactacaccgttaatacacgattctacccctcatacacacgtaacgtcttagagtttttgttacaattagttataaatctacaggccgatttattctctcttttcttttttcttttcgatatatgattatagctagtttatagccttttattgtaccgctcttaggtggtcaagattcggtcaaaagcagcggcagagcaaagaaaggatgatggagaagaactcgcagcggtgactggtcgatcagacggcgaagatagactgatgcatgcctctccctgcagctgtatacagtatgcttccgtccattctaaaatataataacttttatcccttagtatttatcctaaaatataataacaactctccaccaatattctcttcccaaccaatcacaatcattcatcatttatttttttccacctacctctactaatcatcaatcacaaacctccaccactcacttctacctactttcttaataatcgtgtccaactctaaaacttattatattcttggacggaggggtagcagactataaatcagctaaatacatatcgagaagataaaaaaaagagagaagaacaacgtggcaacagatttataacgaggtctattgagatatgttgtactagaatatgttctatcccatcttaggttgtgtttttgggacgaaaaaagtatatatttatagataattattgtataaattagttattaaattgagtatagatgatttaaagttagttggctataccattgggtgagactgcgagttgagcgagtgaggcactgtttccctggccccacattggctgtcttcatccgacagctgccagccctcgaagtcctcactgatctctctctatacttcttccagcatttctgcttgatcatcatcagcagctgcattgcctggcctactagtagtagtattgctattgctcaattgttatcgagactgttagagactgtttaatctgacgaaaggatagatatatttcgcttaatctgatgattaatcatgtgctgcacactctatgctatggagtagtagtactcgctgggcagaacattctccttgcgcgtcttttgaagcctctgccgctggaatgattggatggaaaagaaagaaaattatgcgtgcacaatgagagccgaggcagccatcggctgtctcgcccatggacaagaaaaggtcactagtggccattgcgttgcaatgacacgaatcaacgaacagctttgagtccaatccaaaaacacatttagttttggtacgaatcaacaaacgcttcgtcgctatgcatccatccatgcaacacactgctgttcctatggccatactccatccgtccaaaaaaaagacccgatccatttcaactagtgtcacaatcaattatttcatttctattggagcattggcctagtagcctcctcctcttttgttactacaagaatgtccctttacttccatagaaaaggttaattaagttttcttttcttttctatcgctgactataattagcacatactccttctgttttaaaataaaccaacttatacatatgattttggataaatcaactatgaatctaaatatccgtatgtaaaagttgattttttttactagagtatctctttcttttaacaatcaagataaacgccacacaacagctagcatggactcatatgaagaaggtgaagatggttaattagaggtagaaaagatcaagcacaagggtaacacaataaaccaactgctccaaatctctctttttgtccctgaccagattagtgaattgccttttgtcaacagtgacgttagctggatctgatcatgaatactctctccccaactgtactgttgataaatatgggaattgggcaatgtggtcaagcaaagggaccatcagttcatcattctcttttgcatttctttatcaggtgggacccacacccaaagctccaccccgggaccacatgcagctcttcctttcatgagggctgatgcggtcaaagggtgaaagggggacggtcaacgggagattaccactacctggatgcatgtgggcataatgatagtagtactagtaattaagagttaattatccatatgcacatatagcagctaagcttagcctcaaaccttggagtgcgaaacactgtaaccaaatccattggaacgtgaccggcacatgcaatgagtgcctaaattagaaaggagcacggcttggaaaagttagtgctcacatcattgtatatttgtaccaacagattgtgtaaatacaaagcgtacaatatcataaaagccacatgaaaataaaagagatgatctagatatacgaaattgattgttcctttccccccaaaaaaaaaaagaaattgattgttccttaccaagggtatttgttagagataaaactttatagtggagtataatcttgtagcaactcatatggaccattaagatcaaaatatggagactcagattatatgacagtccttataactgcatttgatgtaaatcgagagatgtactgtggtagttcctgttatttataacagtcttttctagcttgttccttgtagattttttttcctaataatatactccctccgtttctaaatatttgacaccgttgactttttagcacatcaccgttcgtcttattcaaaaacttttatgaaatatgtaaaactatatgtatacatataagtatatttaacaataaatcaaatgataggaaaaaaataattacttaaattttttaataagacgaacggtcaaacatatttaaaaaagtcaactgggtaaatatttagaaacagatagagtattaaagtacaaagcttttatgcactcaaaaaaaataaccacacttgatctcaatattgagcgagggtcctcccagtactgcagaggatctggatttctcaatatcgagagtcaaatattcgcattcgtatgggccatagagctgagacttgagagaaggaaaacgtgtggaggaaaagtccgaaaatcccatgcttgtgtcctgctatctcgactgggagcacaagcagagacgacgcgaaggctgacatgtgaagtacttctactaggagtactactcgcacaggtctgggcggcaagcaaccgaggcaggaggagccgtacgagtcagcagtcatcatcagccagcgtggcgtcgcattggattcgcttccttcttctgctcccttctcctgccccaaaacgtcgcaacgaataacgatgcccctcggatctgcctgcacccgagtactcctgtgtactctatccattccaaaataaaagaaaaacatgtccaggcactcgatattccagatagcatcatcttatcttagatttgattattttaaaacggtgagagtagtccagtactgctgctgctgctaattggatttttatctgaatatggaagacatattcagatttgttattctaaatatcatcacatcttgttttaggttatcctaagttaatttattttgagacggagagagtagcccagactgtccggtactgctaccgctgctgctaatgttgatttttatctgggagcaaatgaggtctcgttgagttctaggaataaacaacaattcatttgctactttgcttagcttaaacagcaggtcatgcggctcacgcccggtcgaggatatgcgtggcaattcttgctttgtattggtagaaatcatcatcatcttatgtacatcggtgaggattacatgtaccgtgtctaatgtcatgtgcaacagtgtaagcctaattaagcagaggttaatatgtacatggggacgccatctcttaccagatggacggagcagaggagaggcgggctacttccacaccttgacggcgccgtctctgcttcccgagatgagcctgtggctcgacaagttcacggaggccagcgcgaggatcgcgtctcggtggcaccccgcggaatccgcggcggccatggcgagctgcgtcttgtgggttagcctcgacgccgtcgtgggctgtctgcatatttcctgcacacagaagcaagcaagcaaacacactctaatcaggttcaagatttgcagatggggaagaatgtggcacaaaccaataatcatgaagagagatttgacattgatcaatcgaaagttaaaactgaaagatacagcacagaacagcatagatgtagcagaaaaattcatattttacgactagttacctgcacaacttgtacacaagagctggatcttatatcgtacgtctcgtcgtttccagctcctttcaccgagggaccggctatacagaagctttgctcaggccttcaaaaacatcaaaggaaaacgctagttttatatgacaggcacctcaggagattttttttttgcaaaatcagtagtagtatggtacaaatactgaacctggcctgatcccagtagcgtatcttcaagtccgttcctccggtcaataggtcccctcctggcaaaggaagcaaagagcggatgcctggaaggcgtggaggcgggtcacataattcttcaattcggtaattataattcgctggccgggtctcatctctggtatttggatgtattgatggtgcctttggtacaacagcttcattctcagtacttgctgttctaaatatctgcatagttcatcaaatttacagggcatgagtagagtcgtcaagtgactgcacttgatagattagaggtgttcacttcatttttctcaaaaaaaacactgactcttatagaagactaactaattacaaatgtgagtaaacaaggtattttatcaactgtggcagctcaggaacccccaagcagaaagccatatgttacctggtgacggcttccattctcagcatcccatagggtaacttcattgcagcctgcagcaacaaaaaccacaggtctcccgaaagaagaaattgaattcggtggtggtataaacaagcccaatttctctataggggttgctggcaaatatttccatgagttaacgggaagcaaaaacctattatcccacaacgtaagaacgcctcttgaagacccagagatgaaccaattcccgcactggcccactacaagtgccgatacatagccctcctctggtgaagatctaaatgaccaagactcagcattggtccttgtatcccatttatgtatgccacaatgttcagtgctgaaaagaatggttgggctaaaactctctgtggaacagttcacaacactgagaattgcaccttctttcaaatctttcctttttacatcagcaatgccagaatacctttcgatgacactccctacaccacgtgcgcagtcaacagaaaacaagtgcaatgttccatcactagcaccaccaataacttggggagtaccatgaagcattgtcgtacatagagctcggctactaccgaggctatatgttaacctagatctgaaggcaatgtccttttccaattttcttgtatcccatatcttgacacttgagtcatctgaagctgttacgaaaaaggtattgtcggttgatacagcaatatcattgacagataagcgatgctcctgaagatgggccatcagaactccacggggtttccaagttgtctccagagacaatgctggtctggtgaacgatcctgaattatcagagttggaaatgatatcacctggtatagacgagctgctattcattgagtcactgatgctcccatctcggtgcatgttactgaaatgattttcctagtacgtatgcctggaactgaacttgataaactcccatgccggtcagatcccaaatttgcatgtagtgctgtcccttgcatggagtataatggtattcctttaggtacgccatcataaaaggaactagatccatgtactgcagagcttatatatgctgaactagcagaagaaaaatctttaatgttcaaagacacatcattggacatcttaggtcctctcaaccttgaatcatcttcaatcatgattgatgaaccactttgtaccatggcaggataccttcctccatgcactgtcaattcttttttaccatcacccttcagtaaaatgtctcctgcatcatggacatcctctaaagcttggtacaagactaattttgagaccggaggcttaatacatgaaagaagagcagtttctgatgacaatgatggtggctccctgtgtaaaaaatgcttaagatgtggaaaaaggtatacaaaggtgtctacaggccctatgctctcactgcaagcaacaacaaatcttacagcggaccgtttaacccattggactggatgacacagcaagggaagagcctttccaaataggccaacaatcgcccttttcctcaaataaccacttttgcacatcatagtcaagcagtcaagtactttcacaagcacaacctccatttcatcacttagtgcctgttcaagatagggcaagagatactcctcgacacttctggaaccaataaaatagcacacaacaacaatctgaccaaaataaactgcacggagctgctcatcacggtcatttagaaatgctggaagtatgggaagaagaaagtcgttagtttgtctatgtccgaagaagtaacacaggtaacctatatcttgcagaagagctctgcggacattacgtgtctgtttctgtcccattaccaactcttgcactatttcataaatagattttctgagtcgtgcaagttgaccattaatgctatcttgctgcctctttactggtgattctacagactgtgatctgggagctaccattgattcatctagaggcctagcatcctctatactccgagaacgaagcaggaatctgtaggctgtcaaggccaactt

SEQ ID NO: 44933 - DNA, 17276 bp, Oryza sativa
cagatagagtttccaaagcagcacagcggactatggcagctggatctgaaagcatcgcaataacatatggaataaccagctgtaagcgactatcatcatctatgtatgtgaacaaatcttcagaagtatgagactagcccttctaagctctggctttttgacacttcgtatgcatgagcaaagtaatgaggcaagcaaaaccatgccttcacagctcaccttgtactctgtttgttggaaaatgtcaaaattataggtatctgattgagcatcataactagacactaacgcaagtaggttactctttgagatcttctgcaaatgtgatacacaattgttctggcccatcaaaccactttcagttcttccagcttgacaaacctgctgcaaggactgaataccatttgcatgggaaacattgggagtaacagaccggtctctgtcttgtgtgatctttgtacttgtacggtcgtccttctccagttccttgaggaggaaattgagatctccaacaatatgcttatgctgtgcaggactgtttatcttaactacaggtacacttttggcatattcttttggtgaatttacagtttgccctccgatgcccattttcccagacagttcattatgcacaggcacagtagcagatccttgaattttctcgagtgttgagccacttatcattatatcatgcatcttttcaaaatattcttgagtcttctcgacctgtcaaaaggcatgtatgtttggatatccatggtcaagaatacaaagtagaagtttaacatagatgtaattgatccttaccctagcatctgagtgaagcggaacaatatctgagaaaaatttgcggagaaatttcgaaaaataaaccgggaatacaacagattcatatttttgcaagtagtttttgcatgatagcctttctttcgggtctaactgaatcatgtgaagtaccatgtcacggataccagtatcttgtatctgcaagcacaaatggataatgagccatttttctttatgcattatctaatgttccactccatgacccaggaagatattacaatgttgcaagataagaacagaatagccaagagactacattgctttgtatgtgttttttcacctcctgactattaggcaagaaaactgatggaataaaggacaaggcataactaatagctggaccaataaccagaattatttgtgcaacacaaaaggaacaaggaacaataccagaaaccttttcaagggtatgaatagggtcgtactgaccacgccgataagctagaagttgtgaaagctcaaaaagtggctgaccttctaggaaaagttcagcaagaacacacctgtaaagaagacaagccatttaccatttggagaataaggaaacgaaaaatacagcctcagtaaacaagtctaacatagcaaagtaccacataaaagttggagctattaaagaaaaaagattaattttcttaaccaagggtcctaccgtcctagcaaacaatcatgcaccgatttccttttgggatgtgcaaatattttaatgtagacagcaaaacatactgagggtaggtctctcaattataccgtcagttcgttttacttctaactgagcattcctcaatgcgatcaagtgaatttgtaccaaccatgcagcctcaaattgatcaaaattatgttccaaaaagacaatcaaaattattttcaaacgctaacccagcctaaatgttaaatttcgtatttcagttaagggcgtgtctcaaatgacaagataccaagtggagaaaaaaacacattggtaacaatggcatatattgacaacaaagaacactttgtgcattgtctatcagcaattatcagatttcatgggacaggaaaaatatgatatatgatttccctctttgtcaagtgagatgccaaatgataacacatccaatgaaattaaattataaaactggcatgttcaagcaaaaggcaactgtgaccaaactattagtataagggattgaaaggtcctatactcgtgaccaaatcgataaagatttataagaagaaaattacccaagagagaatatatccatagatcgttgcaaaggtgcatctgctgcgacttgggtttccgcaccatgctcatagaatctctggaaacattgagttaggtttattcaaaagagttgtaggtaatcaaagatatagcattaagacatccaacagtgcattgcaaaaatgcaaagactgactataaatcataatgtgttttcatattcccaaccaggatgactacatatgttattacatctttggtaataatgaaagaatccaaatctcctagaaaatagcaatagtttatttgtgaaatgatcaagtgaatgtagttttcaacccatatggagatggcaatatactttcaaaaatcaactgcatgtaaacccaatcattgtaaataaaatggaaaaaccattgacgaactgccctgacactatacatgttactctagactaacaaattagtacataattgtattaacaggtttcgaatttgtgcatctgcagtactgcaactacaattttccccgtaattcaatcataatcctttagctcaaacaagagttccccatgtagatttcattttgttgatcgtaaatcagagaaagcaattgccaaaactttaaacagaagtctgcgttatctgcagctcctaaaggaattctttttaaaaatgaatgcactaaaatatagtagcaccaaaagctgaaacatcacaatggtgagagaagggtgtaactaaagatcctaacagcagccagtctaaacatcacttattgagtagttgtttaaatgaataacaatttgcaggaacaagcaatatacagaagaccataacaatattagtgataagggtgaaaactatgcctatgagaacaaataaattgggatatcatcgacaaaagagcataacactttcaaatataattcagattaaagaactaacctcaggtgctaggtagcatcttcgccttccaccagtatcaaagaagaacgaaaaatcagatggatcatcatccgggatgtaagttggtttgaaagatgcaaagtccgcaagatatagccaattccaggaggtaacaagaacattctcacattttatgtcacctaacaagaaaactcagtgtaaacatcaatagacaaaaaaaaaatactgctgatgcacagtaaacccttctcaccatgacaaatccccttactatggctctgctccacagcatggattaactgcacaaccaaatgagctatgttggtaaccatatctggaatggaaagagaataatgactcttacatgttccactagttttaagtgcgtgactcatagctatacaatttctaacagtcaccataggatctgatcattaactctgtaaatgcaaatgattatccagtaacaaccataaaaaggatggctcacctgaaaagcaagccatttcttctcaattttactgaggaaaggccgtgtgcttagtcgatcatgcaggttgctgtagaaatactgcctaaggagatacgctgccttatccgtttgcaaccaaacctgaagacatgggatgtcatgtcagcatatgttacccaaaaataataggagggcatatatttacaatagacgtagataactatgttcacatcctgatggatgcaacaaccgctaaatttcactatttcatacaactatctagtgtgaaaatattacgagggcatgagcatattcctaactccattagaatttaatcaaccatagaaatcgatatcatactctagaaacccctaatggtatggcttgaaaagccctaatgacagtttaccaaaggaaacaaccttttactgcctgatctgaaatttccacctaaaccccacacagagtaaatacgcattatttttctgaatgaaaactacagtctaatccaccaaatacccttatgcaacataacaatgcgctaaagtcccacgaccgattgcgctagttcgtaaagcacgggcaaaattcgatggataccacagcacgcaatcctcacctggaagggccagacgtgggatccctccaacccctcgaaggcgttcctaatccgctccagcctccgctcatgctcctgccaaaaccagcacccacagatctcaaaacgcgatttccaaaccccaaatcgagggggggacgggggcagagtgaagggcgcgcgagccgcgaagcctgccgaattttcttaccttgaggtcgaggggctcgccggcgcgcttgaagtagaccttgacgaggagcagcccctcgtcgtgcttgcagcggacggacttgaggaagcggccgcggctgacgacctcgacgagcacgaggttgtacgtggacgggaggtcgtggaggtagtactccgtcgccgacgcctgcgtcgtcttggcgatcttgttccccatcctcctccggcgccgccgccgctcgccgccgggctcctcgcgctcgctctgctgtgcttagtttttgggtttcgatttcgagggaggtgtgcggcgtcgttgcgtttgcgtggtgcgtctgcgatcggaacccggtgcgagtgccaccgcgtcacggagcggggacggagaaccaaacaagcaaacccaatactaatccgaattgcacgcacgcaacagaatgcagttcgagcacaacacgattaacaatatatggctgtgtttagattctaatttttttttcaagcttctaattttttttatcacgttaaatattcaaacatatatatgaagcattaaatgtggacaaaaaaaatatcaattacacagtttgcatgtagattgtaaaacgaatctttttagcctaattacgccatgattagacatacgtgctacagtaactaatgatggattaattaggctcaaaagattcgtctcgtagtttacagtcgaaatctgtaatttgttttgttattgatctacgtttaatacttcaaatgtgtgttcgtatatgttaaaaaaaaattggctcgaacgaaacacgacctatgtctaagttatatatccctcatttcatatcgtataagtagaccaaacttggttaagtttaactaaacttatagaaaaaattagcaacatttaaaattatcaaatttagcaacagaatagagttcgagcacagcacgattaacattaatatgtcaaagttatatacaagtataatgtaattgtaatatatttatttatatttgaaaaattgttaagagaagatttgtagacaaatttatagtaaaaccaaaaaaatctgaacaaactatcaagcttcttttttccctttttttcacggttaagttattgttgatgttttatattaaaaaaagaaaatgtccacttcaccaactaacctaaactaccaaggcaacgagaacagggaaaccaagcacgacactcaaccaacgccattcaccacaggaacaagcagctagaaaaaaaagagactctcgcacactgaagacatgatgttatcattatcacaccatcaccctcgtgatcgggtgactccaccttcgttgggaaacatcagtgtaagggtaacaacctagcctgcatcaaatcatagcttaaataggctcatgttatcgttaccacacgtcatgccccgctgatgctatagctccaacttcacaactaccaaactcactgatgtactgttgagccagtctaacgtacattacagatgataagctttgaagccccacacaagagcgaaaacacaatcggtgaagtctaacttatgaaaaatgactaaagaaaaaggagtgagttgatcaaacggtgttcatactatacaacatagtatgtcagtagatattaggccttgtttggatcatctggtctattaaatagctctccggaatcttgctatttaggagtattaaatgtagattactgacaaagctaattccataacccctaggctattttgcgaaacaaatctaacgaggtatattaattcatgatcgcggatgatactgtagcatcactgtagcaaatcatggattaatataccttgttagattcgcctcgcaaaataccccaggggttatggaataggttttgtcagtaatcgacgtttaatacttctaaataacaagattccggagagctatttaatagcccggaggatccaaacaggatatgagaaagaatcttcacttctattcaaacattctgagattttattggttagtcaacaggatcacaataaaggacgcctgtgaagagcaactgaaatgattatttactctgtttagcattataagccgttttgtgttttgaataatacatgcatgcatccttgtatgtgtttttttagacgcaaaaggtagagagactctaccttattaccattgcattaatggtggtcattaagtaacaaagccggtggctggcaagagattataaggggggaacaaagaggaaggataaagaaaaaagaaagatagaaaaaaaaaggaagggtgaagaagaagaagaagaagaataaaacgatacacaaaaataaaagaaaacctagctaagtttgtctgcccaagtgttgatgttctcgcgaaggctgggctttaggcgatgaacccacaactggagactttctcttatttgaagcaggatgtacgtaacgcttgattcagttagcttgaagatcagctagttgtgtgccttccaaagaccgtgcgaacaagctgcaaagcacgcaggccatcccagtttctggtgttctggcaaggtatccaggattgattccacgaaatcttgtatgttagagctgcgcacggctggctcatagaggttgagcttcttccagacttctcctgctaatttgcaatgaagaatgatgtgatttgctgtttcaatagctgggcaagagatacattagtggagaaaccatctcacaatagtcccagttctattaaaaactgggactaaaaaacgatttttaatcccggttaaaaaatttttgatcgactaaagatgatttttagtcccggtttatcccatgtcagatgtatggcagggggtcgaggatctttagtcccggttgatactaccaacactttagatcgatctttagtgccggttggagttatcaaccggaagtaaatatttctctcccacatctgatcggttaagtcccagacagatatttagataagattagaacatcccctctcttcctcttctcagatccaatcctcttcctcctctccttcctcttctcctcctcctcccctctcctctctcccatcagccggcccttcctcctcctcccctctactccctcttccatcagccgggcgggcggcggcgacgcgaccgcgaagagggaggaggcggcgggcaggaggccggcggcggcgggtggcggcggcgggcaggcggccgggccccggctcatttgcttttttttatataatttgtatttcactggatgtatatttttttttagattttatgattcattgcattgcatggatctgagatgtataatttgtataatctgtgatgtatttaatttgtgtgtagtcttttaggatttgtgatgtatttgatctgtgtataagtaacttaatatttggaatgttgatttggggatgtgcatcccattcaattcgggagaaaatatatggattaacactagccattagcaaatcaacagtaaaataaaaaaaaaaggatctcgaggaactgtcgattcacctcaccaaccggaactaaagattccccctctttagtcccggttggtaacctctttactcccggttggtgttaccaaccgggactaaagagattcgtagtctcggttgaaaaaccgggattacaaagggttctaaatcgggagtaaagagtatttctccaccagtgatacagtgtgggttggaatcccatttttccttgtatgtgtttcacacgtgtctaaatttatactcctgtgtgttagggaatctagataggtaatggatcataaggtaaaacgtaaaacggagggagtaatacatactcttattgtgaaacagagtaaattagttttcttcctcgtacactccgagaggtgaggcaagcatggatacataaaaggcatattcgtcatttttgcgtaaccttacagtcctgctcatggtcatgttgcagcacgataggtagtttggtacatgatcttcctgagatgtaaataacttgtaatgtacggagtaaataacttgcatatcatatgtaccattacaactcatgtctgtaaaaacatcctcaggtgagtcaggtcctgccgatcgatgctccagtagctcactttgccttcaaagcaacagaaagtgcgctctctgataataataagttgatgataccccatgcgttgctgcgggatatttgaataactttagtaaaaatataaatttataaactttgaacatgttgcattagcgttgttttttttgaaaaaaagaaaaaatgatatattgtgtaatcataataaaagaaaagctaaacaacaaaatagttatgaatccaattaatccataaatcaccaagaacaaaaaaaaatgatggtctatgatgatgtcgttcatgatttactccttgatcgatgaacaaaataggcaagacgtagctgaggagacccatactttatgaattatggttgatcatcacataaaagaactctataacaaatagttcaaatgaaaaaaaaaagctatcatcaaggtaattcacatataattttaggggatcaccaagtgaatagaatcagctacagtgtaaaatataaagacataacaaactacaataacatgatttttgatcaacagtgctacatacctgcaccaaaattatgccaaataatccaaaaggcttcacacagtgacagtcattagcaatgcagttgctggccggacatgagctgcatagtggcaaacctgcaatagtggcaattgagacaaaacaccaatctaatatctgtaaagcacggctatgtgcgaggcaaaggctggtattttattctattatatctaaaaatatatctgtaaagcaaccaacaatgaaaaatataaccaatgcaatacagtgtgtgttgacagaggaagatacctgctgccgtgcatgtgacagagtcattatctaacctgaagaaacaaaacaggacatgccaatactattccctttacgctagtgttatatatacaacatggcttctcgatcgacagtttccttgataattgtgtggatcagtggataacatcgctcgattttatagacatgaagcagcagaaattgaaggcttgataggaaatgtatagttagcaattgaaaaaaaaacagacgggaattcatgtaatcctccatggaataaacctgcaaagaaagtgaagtaatccaaagaagagattgaaaggagtgactttccactggcacaaatagtgctccaagggagagataaaaaaatagagagaaagaaaaggatgaaggtattaggaccattaaaaagtaaaaacatggatgaaggtattacaaactattcgaaaaatggcccaatttgcatcatatagattataaagagagacttacatatttagctggactgaggatgaacctacaataatggatatcatggcatggaaagaaacaacctcctccagtcctcgtagtcatccaggaagcagcagcatcaaccttcatacccacttctcttcttgaatcataattagcagaacaactcgcgtacgtgtcgttatataaaagaagatgagaagggaggagacgttccaataatgcaagcggtggttattggaaggtgaagattaaaaggcagaagtggggcagccagcgacccttcgctccctaccgcgggaggggctggactgggccgatcgagtactatagaactgagcagggcaggaaggacggcaaaaacaatctgatctgttaaagcagagcgatccaatggacgggaatagacagtgacgtggcaaagcgagagagcaggaaaatagatttagtggggatgacttgtataggtatataggatactcaattaaaccttcttatacttcacgcctataaaggtaaaaggtagaaaatatgctttaacgcctcaatttttgggacattagaatctattttagtaaaaaccttgattttaaaattttagatctttgtaagaatgtaagtgccaaaatctcagttaaaatttcgaaacaattacccctatccaaattcaaatccatgaattcggatttcttttccaggttcattttacaattcctccgaatcccaagtccttaaatatctacacacaaaaaaaaactctcccctaaactcctagatcaaatttaaaactttgatttgaagctctccattgaaatgccctctctttcttttcctcaaattcataccaatattcaagtctcttccaaaaatatccaagtattggtatttcagcccttctataaaatatttagaatttcatgagaacaaaatataaaattttgaatcaaatccccgtttcaaatctttcaattatccttcaaacaattcttggaaaaatctcaacattcactattcattcgggccgctcttttccttttctcccggaccggcccgctctctctctctctctctgtgtgtgtgtgtcttaactgggccaataataatttgctgggcccgtagttagtttgcccactgggatggatggtcaagatgtggccgtttcgaacggactgatatgatgatttcttcaccctcaagaagtattcctatactgtatagggggtcgtatactaccgtataactactagatgttgctatatagttactcctcctctcacccatctccccactcgatacacactttgtttacatctaaatttggcacctaagattaaaataggaaatattgccaaaatttggaagtctaccggttcctccgaagtgggccggtctgaccgccgtatgttgggcggtcagaccgccggttgagggccggtcagaccggcggtgtgtggccagtctgaccggcaggtccgagtccgactctgtttcgtcgggtctcgaagtttccttgctcaggaagacatgtttcgggtttcctttggtttctaccccgagttggacgtggaggagggcctatagagggcaagaccaacccctatataagggacatggccggttcattgtaagaaaccaatctacaatcaatcaatcgaatcgttttttatattgcttttagttttctcttagtttgtccatctttatcggtttgcaccgtaaaccgtccgtcgccgctgcgagagtgcgacatctctttgtcggtttgtcctgaaaaccttccgtttttcccacgagacgggtagctatctagaaatcggctccgctagccggtttagttatcaaaacccatctaggtttagctctttgctagatcgaggtggttggcgactctaggatcaccgcaaggtttaagatgctgcgatcgtgcttgtcaacttgtcaaaaaagttgccaacacgatttttggcgactccgctggggaggagatccgttcatcgtcaactcaacttcgatttcgccatgacgaagccgccatccaagacggaggtggagccatctaatgtgatgccagtcacattggatgacttcgaaggagaagatcgcaaagctatggaggaatacatcaatgagctcacacgggaggcgttgatgagagcaactactaggactcgtcaaggcatgatcatcaagcccgggccacgtcccaagctcactcccgacgtggtaagtaatgacgaggtatcacaatctatccaacaacaaattgcatctacaatagattcatctatggctaattttaaagatagattagatgtaatgtttaaggataaagttgatggttttttaaggagtaggctcgattcttttatggatgattacacattaaaggataaagcctataccactgttgatcaacctcctatagatccaatgggtagtaaaaccgacggaacggcgttcacggtcggtccgaccgggcctgacggccggtcagaccgcaacatagccgtcgatctgaccgtccagacggccggtcagaccgggtattaccccggcggtcagaccctgggccagtcagaccggcacaatcgtcccaattcaggctatagatccaatgactaatgctagttatttgtatcactttaaaacatttgatcctcctgtatctactgccaccactaatcctcaagttcccccacatattcctaatgcttataatgatgtttctagaggctatcctcccgatactatgcaaggccaatataatcatattgcgccacaaacacatcctattaggccaccaaacccaccgccaaatccacaagggcctaataacatggaggatatgattagtgatattatgaggaatagattcgggattgaaactaggaatcatgctagagcttacaaaaagccatatcctgattattatgataatgtgtcgtttcctcgaaattatagagttcccgaatttgccaagtttagtggtgaggatggtaagaccacatgggagcatgtaggtcaatttttagtgcaatgtagtgaggctaatagtgatacttttaaattgcgcttgttttctttatctttatccggtaatgcttttacatggtttacttctttaccggcaaattctattcatacttgggctcaattagaagaacaatttcatgattatttctatactggggaaactgagcttaggttatgtgacttgacatcggttaagcaaaagtataatgaatatgtcattgattatattaagagatttagagatgttagaaaccgatgttatactttgaatataactgatagagatttggccggtcttgcttttaatggtttagttgctcctcttagaaaaaaactagacggccaacaatttcttgatgttagtcaactcatgcaaagggctctggctcaagaaagccgggctaaggataataaaaaatttgctagaccatttgacaaaaagcctaatgttaatgtagttgattaccctgaggctagtgatagtgaggaggagggtgatcatgatatttatgttgccgaatggtcgtggaataataaaaataagccttttgtttgctctaacttaatgccgactcctcgcaaagatcggcaaagtgaggttaagtatagttttgacgtggccaagtgtgataagatttttgattaccttttgcaagaaaaacaaattagattacctaaaggccatgtcataccatcgcaagaagagttgaagcgtcgagcatattgtaaatggcatgattctcattctcactctactaatgattgcaatgtgtttcgacgacaggttcaatcggccatagatgaaggacgattgaagttcaccgatggctccaagatgaagcttgatcatgatccttttccggtgaatacaattaatttcaatgataagaaggtgttgattcggccggagcaagccgaatctactaagggaaaggaagtggtcattggtgaaccaagatcaaagatgatggtgccaaagaagccggaggttggtgtttggaaggagaataagagtggagcttcaacttataaggctcctaggaagaccaaagtgacctttgatatgcttttggagaaatatgagaggcaaggtggtgagaaaattcgcaacaaagggaagagaccaagatcacctcctagggaacgatttggtcattcaccaagacggtcgcattcaccttcatatcatcatccacaagacatgtcatggggtccctatccgatgccgccgccgggttattcttatccctacttcatgccatggggggcaacgccgccaatgtaccatcatatgcctccaatgcaattcaaccaagggtggggaggaccaaggaggacaattcatgagcgtttgtcttcgccaaacaatagccggttctatggtaagaatcgggctaatgaagaaaagagggaaggaaagcgcgttaaggtggaagagaggacttcggaagtaattactatcaaagtgggtcccatgatgtgcctatacattctgtagatggagttggaaagtccccaagcaaaaaatccgaagccggtaccagctcctcgcagacggtcggtctgaccaggccctctggccggtctgaccgcggccatgttgccggtctgaccgggccatcaggccggtctgaccgtcgacccgatagtggtccgaccgacgcctcaggctggtctgaccgtgtgccacacgtcggtctgaccggcgcgactggccggtctaaccggtggtctacggccggtctgaccgggctccagcgccggtttgatgagaggattgtaaagagcgatgtgagggcttcatcattttcaagcaaagtcaatagaggacattatttacctcctggaacagagccgaatcctaggtggatgcctaaggatttgacggctactcaaaagagaaggttgcaacgtcttcggacccaagaactaagggagaaaaaggccgaagatcaaagggataaaaggttcaatgagttgcgaccaccaccgatatggaggcctaaatccatagagaaggcaaaaccgattgatgtacaggagaaggaagaacaatcggttgataaaagtgatttatctccaaaagaagacatgtatataaatatggtatatatgttgcctatggagttttgtgctatggatgaagccgaggttgctcaattctcattaggtcctaaagatacggtttttgagaagctcgatgaatcaaaccatcatatgaagcctctctacctcaaaggccatgtggatgggaagccggtctctaggatgctagtggatggaggtgctgctgtgaacttgatgccgtactcgttattcaagaagttggggtgcgaggatgatgagttgaagaagactaacatgattctcaatggcttcaacggtgaaccaacggaggcgaggggtatcttttcggcggagctcaccgtgggaaacaagacgctaccaaccgctttcttcattgtcaatgtgcaaggtaactacaatgttattttgggccgttgttggattcatgccaattgttgtgtgccttctaccttgcatcaatgtttaattcaatgggacggcgatgatgttgaaattgttcaagcggatacatcggccgaggttgcaatggccgatgctacttttgagtggcgtcatgggaatatccaatgcttatcggggagggatctttctagctatgattttattagtatctctgatggcaaatttgtacctatctctgtaaagccggctagtgtagcacggctaagccatataaatttgtataacgagtaaagaggctaatttagagtggttacaaaaaagggtgcaagaatatcggtctacaaagaacgatattggagaaaccgttgaagattttgatgaagtggagaagcttggacaagggtttacatcggccgatccattggaagaagtagacataggtgatggaactaaaccaaggccgacttttgtaaacaaaaacataagagccgattataaggttaagataatcaagctacttaaagagtatgttgattgctttgcatgggagtaccatgagatgccgggtcttagccgtaagctcgttgagaatcggcttccaattaaaccggtttttagccttataaacaaccacctcgtcgttttaatcttttactatatgaccgagtcaaagaggagattgatcagttgttgaaggtggggtttattaggccatgtcgttatgcggaatgggtttctagcatagtcccagtggagaagaaggggagtggtaagattcgagtttgcatagattttagagatttaaataaagccactcccaaatatgagtatcctatgcctatagccgacatgatgattaatgatgcctcgggtcataaagtgattagctttttagatggtaatgccggctacaatcaaatctttatggcggaggaggatatgtacaagacggcttttaggtgcccgggatttgttggtttgtttgagtgggttgtcatgacttttgggttgaagaatgccagtgcaacatatcaaagggcaatgaatttgatctttcatgatttgttaggtattatcttagagatctatattgatgatattgttgtcaaatcggatggtatggaatgacacatagcagatttgaggttagcttttgagaggatgcgccggtatagtttaaagatgaacccacttaaatgtgcttttggtgtgtcggcggggaagttcttaggattcatggtgcatgagagaggagttgagattgatcctaagaagatagaaaaaattcatgatttcaaagtgctgacatgcaagaaggaggttcaaaagttgctgggtaagtgaattatttgaggaggtttatttctaacatagtgggtaaaatcgatgcttttgtttctatacttcgcttaaaaaaggaagccgattttacctggggggcaaaacaacaagaggcgtttgaagagttgaagagatatttgtctactccacccattgtgcgagcgcctaaagccggaaagccttttcggttatatattgcctccgaagacaaagtcattggtgccgttttgacgcaagaggaagatggcaaggaatatatcattacatatttgagtcgccgtcttttggatgccgaaacgaggtatgtctttatagaaaggctttgtttatgcttatactatgcttgtaccaaattgaggcattatttgttatctagtacatgcatagttacttgtcaagccgatgttattaaacacatgttggaaaggccaattctaagtgggagaattggcaagtgggcatatgctttgatagaatatgatttggcttataaaccattgaaatctataaaaggccaaattgtatgtgattttatagtagaccatcatatagatgttgcttatgagggagaggtttgcttagttgaagttataccttgggagatttattttgatggttcttcttgcaaagaaggtcaaggcataggggtagttttgttttcacctaatggcatgtgttatgaggcatcggttcgtttagaatattattgcacaaataatcaagccgaatacaatgctttattgttcggcttacaagttatggagatggttggagctaaatatgtggaggcctttggtgattcggaattg

SEQ ID NO: 44934 - DNA, 1635 bp, Oryza sativa
tgaccggcgaccccgagcgtctgaccggccctgcgtggccggtctgaccggttttgggcagagcgctggggggcacgcttcaatcgatttggaggccgaattaattgagaattcggatatttgtgtccaggatacagaagaggattggagaattcctttgattcaatatctaaaagatctcacgcttaaggttgatcgaaaaattcggcggcaagcattcaaatatacattgcttgatggagatttgtatcgccgaaacatagatggtatcttgttgaagtgcttagatgaagatcaatctaaagtggctatgggagaggtacatgaaggaatttgtggaactcatcaatcggcccacaagatgaattggttgcttagaagagcgaggttttattagccgaggatgattgatgattgcttcaaatattatagaggatgtgaggcttgtcaacggttcggcaatgttcaattggcgcccgccgctgtgttgaaccctataatcaaaccatggccgttccgaggatgggctttggatttcattggtcaaatttatccttcgtcatcaaaggggcataggttcgtgctagttgctacggattacttcaccaagtgggccgaagccgtgcctttgaagaatatgactcatacagaggtaattgactttattttgaagcacattattcatagattcggtattccgcaaacattaactacggaccaaggtgcttcttttatgtctaaggaagtgaagagttttaccgaatcttatggcattaaattgttgagttcttctccttactacgctcaggctaatggacaagctgagtcgagtaataagacattgttaaagctagtgaaaaagaagattgaggaacacccgaagaggtcgcatgaggtgctttctgaagcattgtggcgcataggatatataaacatggtgccactaaagtcactccttttgagttggtttatgatcaagaagccgttttaccggtagaggtaaatcttggttctcttcgttatatcaagcaagatgatttgtcaagtgaagattacaagatgttgatgggggacaaccttgatgaagtcatcgacaagcgcttgaaggcattggaagagatagagaaagagaagaagagggtggccaaggcgtacaacaagagggtgaaagcgaaattgtttcaagttggagacttggtttggaagacaattttgcctttgggtactcgatccaaggagttcggtaagtggtctcctagttgggagggtccttattgagtgtgcagcattgttcgagggaacgcatactttttggagacactacaaggggagcgttttcagtaagcaatcaacgggaaatacttgaagaaatacttcccgagcatttggcaagacgcttaggaggtactatggccggtaattgggttatcgtcctaaaaccaaaaacatgttctatgcttttagattcacgttgttcatcaaaaaggcagggggcatgtgtttacacccaaatttggcacctaggattaaaataggaaatattgccaaaatttggaagtctaccggtttcctccgaagtgggccggtctgaccgccgtgtgttgggcggtcagaccgctggttgagggccggtca

SEQ ID NO: 44935 - DNA, 4643 bp, Oryza sativa
acccctatataagggacatggccggttcattgtaagaaaccaatctacaatcaatcaatcgaatcgtttttcatattgcttttagttttctcttagtttgtccatctttgtcggtttgcgccgtaaaccgtccgctgccgctgcgagagtgcgacatctctttgcaggtttgtcctgaaaaccttccgttttgcccacgagacgagtagctatctagaaatcggctccgctaggcggtttagttatcaaaactcatctaggtttagctctttgctagatcaaggtggttggtgactctaggatcaccacaaagcttaaagtgctgcgatcgtgcttatcaacttgttaaaaaagttgccaacacacttcttaccaccggacacaagacaccgcaaaaagaggcagcgcaaccagccaccgcacctctccccccctccgcgcgccgaccatgtcgtcgtcgcaagctcgccgcccgcgtttcccgaggggaccggcggccgccctcctgcgttaccagttcaagacagtgaggccaccgacgaaggacatcgtggagctcctgcccgagggagggtctcgcaccgtcccaaggagcgtgctgcacggaagcgcgcttgcggacgagaacaagttcaagtccctgagcaagatggagccggcgatcgtggcggccgcacaggaggatggcgatctggcggcggcggcggcggccgaggcggcgccggcgccggcggacgaggagtaggagaagcctgacggcgatgtggatctagctatcgtcaagttttttcatgtttcttagtatcttagttccatcggatcgagtaactgtactatgtttccatgttctggtatatctgtatgatgcatggaccagttatcgaaagatctttggcgctactgccttgttccaagcaaattaattctctatgcgtcatgaattgtgttcttggtgccgtctttgcataattaatttgtattcgttcgtggtcgccgcctttgcttgctcatccaatgtcatcgtcatcgacgtgtcctcgccgttgccggtgcgcgtgctcgccgtggaattggagccgtgtacatatcccaactgaattagcaggactagttaacccgtgcccttttcttgtcgatgtttccacaagtatttttttggataagttatataatttttttataaagtactacgaacagaacactttcttttgcaattaaaaaaatgcaaaaatatatgcagaattcaccactagtggtacattatctttttaactccaattacattcttatcttttaaattccatacgttgctttgcgccttgcatgttgcatgcgaaggagtacgtaccactggacggggcaggtcgatggcaggagagcggtgcaccaaatagaccaggaccatgatagttgcaagtgaaacgggcatggtggcccacatgtcgatcgtttaaccgcgtagaccgtgtccacgttgggatccaccagcagcagcaccggggggaccactagactcccagagcttcgtgtgatgtgaggcaacacaacgcggacaaaagcccaggtagactcattccaccagtgcatgatatcataggcaaaggagacctcacatatcagtagcacggtccacgaagagcagggcgtagggaggggagccgcggagcggcctctgacacgaccgggaatcccgggagaaaagcaatgcggtagggtgctaagggcggttagatggagatcgaacggccacggcgtggtagacaaccaaagccggctggtatcgcgggcgccagtgcgaaatgggtagtatttgaaattttcttttctttttcacaagtaacttttttcttcgtcctcctttcttattttttttgtaaatttgctcagacacaaaattccgatcctacgaaacaatattaagtcataggccaactgaatctaaacaaaacagaaggaacttaccttgatatatacgaaacgagagttgttcgagtttgctatcgacattatcgctttctataatataccgacgactttaacaattgtcctataatacaccattgggctataccttcttttcaaaaattcccaaaatactcttatgtacatacaaggttaacaattaatttatctaatttgaagtttcaaaaaaatatgaaaacttttgtgtggactccttacacaacatagaattttgtatagaagttttcaagttgtttatatttctattttttataaacaaaaatataacttatttgttaaatgctatatttttttgaaacttctgatgaaataaatcaattgttaatcttgtactccctcatctccaagatttgatttttttagggacgaagagagtatgtttctaagcatattttaggtatttttgagaagaaggtccagcccaatggcgtattgcacaataattgataaagtcgccggtatattatagaaagagacaatatcgatggcaaatcattgaactcgaacaaactcagtggtatagaatagattctctcatacgaaaagcagacaggtcacaaatattcataaccaacgacaccttaaaagaatactaatataacataagctaaaaccattgaaaaaagagtgcacagcaacaacatggtcaaaggcgatagtagagcaacggtgacggggaggtttgattctcgagacttgttatatctatccagaatttcttttctcttcttcaactcgaagtgtgatcttgtcaatgcttctttgagtggcatgtcgtacagacgactatgaactacaacatcacatatttttgtctgcggtgatatgtagaagagtccgcatttcaagcgacggtccttgtaccgtctgagcttgttgttgataacatctatcagatgatttataacatgtagctgcttcccgaaagctatccacctgaccaatcctaatttttgaagcttgcaatagtaatccaccattattatcttttgcacttgtagtattgcttcgcgtcccaatgacgttgtcttaaccatggtgcgatgctcactacaagcccatgtaccttgctcgtccctagcgcatagtctatacttcttttttctaatcttaaaccccttctttctttgtcctttcctgaagaaaaaaaaaacctggcgagtaagaggagaattaaacttcctaaaacataaacatgaaaaagctaaactggcgagtctaaacatgaaaagctaaattatggctacataaagaagaaagacgaatctaattgcaaattatgtaggaggaaaacatagatggatttgtaatttagctttgcatatgcacgtgtagcgacgactgacaaatacaattatactcagatgtcattgtgtgtttttattctcaaacatatttgcaaataatatttgcatatttgcgtggtcgtttggggattgaaagtctattgatacatacttgatgtgactgccgcaagttagattcttgtccattggctttgctttgagatgcaaacctgtgaatcccctgtcgatcgcggatgtcttttgttttttgatggctcgatcgtgaactgaacagtatatactagtagtatatatatcgtagtagatcatgacatcatgtatgtgtcctggttggtatccagaagctctttttgtcgtctgacattaaggtactacaaccgttcagttgtggggaacaaggggattcacagattaaactcgcttagttaaagataatctatctccaatctaccatatctttactattataaaaattaaaaatatttttattaaattttgtcacgtaatccgtgtttgagttggttttcgaagatggttcggccccttttgacgtttcgtccgtttctcgtcacgctggttccgtccgattaaattcatatcgatcaatctttttttttctttccaacgtcagcgttcgagtctgcatcggttgcgagcgaacgagaaaccgtgtagcttccggtatttttgaagcgagcgccgtcgttgtcagttcaactcctaaaaccatctcccctccgccaccgtcgcatcggcgccttgtatagtcaccgtcttcgtgctgcccgggagcagtaacaacagactgttggcccaaggaaattgggctaagctttcgctcggaaccccctaccgacgtggttcgtcgcctaatccgaaaccaccatctaaacatcagcggcacatggcttccgccacacccgaccgacgtccctccgccggccatcttccagtcctgccaacgacaagactgccaccacaccacaccgacgtcctgccatcggccgacttcattgaaccaccatccttgagagctggctcaggacccctccgttccaccacccgctgccctcctcaccagatctgaccgaaggagaacctgggactgggtggcattgcttcggcaacctgagcttctcccgctgacaagctaccacctcaatccagcctacaaacttcccgcaaagaaaaggaggagcaccaggaaggtcgagggtgccgaccaacaacgaaaaagatgacccaccaccgctagctcctgttgcactaccatctgggcctgcaccgacaccggaaacgctaccgctccggctctagcgccggcgccccctttgtccggcttccttgatccac

SEQ ID NO: 44936 - DNA, 1291 bp, Oryza sativa
  unsure (1)..(1291): unsure at all n locations
cgcgccgcgccgcccacctagccgcagaaggcaccgtgacagcttcccagctgcccggccgctgaggcctggccacgccatctcgcgcctgcaccaggcctcgccgttgctagtcggaggaggcgtagggcggctgctcgtgctgggggcggaaaccgtaggtgggctacggaaggcttgtcggcggagtagtgtggggcatcgtaggaggtggagggagcggagcaagggtagccggactcgtcggagggtcggagcgggcggccatggggcggcaacgccgccgggcaggccacacccctgagccgccgcgcacctcgttcacatccacctccgcgtccagggcggccgcacaccttgctgccacgcaccaccgagccgccaccgccacccctagatggttgataatgtcacaacgtgtctttacaaatcactagctccatttttacctcctgtccactgtccacttcattctttcagtggagaaagatagcttcagatctccgtgattgctgtattttggaaccgagggagtgatgaccagagtttacattaccgtttccaacatgagaaccgttttcgataaaatgggccacgaagtatactcttgatctgggtctaaatttctatagtatcaccctcttaaagaccagtttaccattgttgacgagcccaacaaggcatatattaaccatcgaaagtagcccaattaagaaattgcggaaaaaataggcccagtccaattagcccattctatataatccccagccgcccacttcttccgcccttcacgcatctagggtttcgccgccgcctcttcgtccccgccgcgacgatggtacgctcctcgatctcgcgcccttctctcgtggaatccatgccggccggccgacgtttcgctgatgtgatcgcttgcttgtttcgtttcgccgcagccgtcccacaagaccttccgcatcaagaagaagctggcgaagaagatgcgccagaaccgccccatcccctactggatccgcatgcggaccgacaacaccatcaggtgatttgatttgcttgctcccctccttcttgctaagtcttttgctcctcccgcgttcgattcggcttaggcatatctgctgagatgtcgtggtttggtttgtgttgttcaggtataacgcgaagcgcaggcactggcgccgcaccaagcttgggttctgagcaggaggtggcaccggctgctgcctgcggattttgttttatggatgtttcagtgtttatgnnnnnnnnnnnnnnnnnnnnnnnnnnnnnn

SEQ ID NO: 44937 - DNA, 2005 bp, Oryza sativa
atactacctagattccattttagcaatccctttgcactaccatgctcccctctaagctgccgatgtgagcacggccgccgcctatggaggcgctcgtcggcaactattctccgcaccttgccaaaggtcggcaagctgccggaatccctctagacacctcgtagatgctctagaaccccctcccctagccatgtctaactcatatcaccttgatcaccattacagcctaaccgtaccaccgccgccctagtcgccaacccatccacataccaaattagctcctccgccgccgatcgccgtcgccggagatacctagctccctcccctcttcggccgcaaccactttccccctccatcgccgccgtaatcccaaaccctagcaccgccggctgcatttggggaaacggccgaaggtagaagaagagaagagagagagagagagagactgacaggtgggacccgcacacagtgccatttcacttttatttgatttttaaactttagaagctcatatcttttaaaatatagatccaattccaatgaaacttggaccaatattcttctaaaatcattctctatcttttgagcccctttttgctatttttgcattttattttattttctctatttttcatatttttggatttcatttgaattccttttaaatttgaattttacatatgtctaaccctaggtcttgaggattcttctgactcaatatataatatccatcaatctcaggacatctagcaaggcaagttaccatataccttttgatcattcaagcctatattttataaattatttaccatagccttctattcaatattctattttctatgcataaatcaatcatagaaacccagataatttactattgcttattttgctcacaatctggttaaaataccctatacttagatcgggacagtacgtaagatttggctgatttccgggtggctagtactgtctcaatcaatataagttttaccagatacttatgttgaacgaacgactacgaccgcagtttctacactagggacacacctacttattatgttaattagcaatatggcacctctgtatagtggttcttatttttaagtcctcgtgcaggaggcaactatagccgcgaagggaaactttaaccattaccatgtacaggtaaatggtatgtgatactcaagtataaactatatggtatatttctaaaccctgatcgagatgacgaggtgtcatacgatcagttccccttaaataccttgggaaagccagaactccttttgctgctgttaacattacattcagagcatatgaggatatgagttcatggaacaggtgccacaattgttaatgacttaatactggagcatgactaaagccgatgattatcagcaagtcatggactgcgggtaaagcgtacatctgctacagtagaatatctttgaaactattcgaatagccgtactcatggagttgagtactgggactcatatggtaccctggttagaaatctaaagtttatatgttttataaattcttgctataacttttccagattgtctagtactgctttttgcaaagaaccctattatatgtcaatgcataacatattcccatgataacttgctgagtattgtaaatactcacccttgctcttataacccctttttcagatctgggtcaagaggaggacccttatgactattactacgaacatcccgataacttagagaatccctaaaggttatacctcactagtcagaatgtatagaaacttctgttgtgtattaattagttaggtgagtacctattattgtaaaacccttagtattgtaagactttttaacatatgcaatgaagaaccggttatattgtatgtatcaatatttactgatccagggattgattcattaatctcagtcggattcaagttattagttttgggctccgacaccatatgtgcctttttcctctataattattccatcgcaacacagggctt

SEQ ID NO: 44938 - DNA, 716 bp, Oryza sativa
atgacttggatatattctgctctgtcatggcaggatcggggtcttttccagatggatctatatcagatggtttcctgcaaagtattctttcagaatttagcatcattttcatgagagagcttaccaaagtgaaatcataccgagaggtcttatacctggaagatgttctaatttttggcattgcgcggccggccaattttttcctgggcatggtgcgctttgggggtttgttaggcgagcccttatccccagatttatcatcgtcgccttcatcatcatcaagcaccagtttcctcttgcaggacccgtctgaccagttgatttggaggtctgaggttgcggatccggtctgatcgttggccctccacctccctgagcagtgtgttggcgaggagaccggcgctgagtgactggtggatctgacttcatcagtgcatattcctgaaccagatgcttccatagttagtcaactcagcatgaagacaaaattatgttctgatcatggtttgaggattttcgatacatacctgtggaggcggattgaacgcattatatggcacgactggcagctggtgtgagtagctgacgacgattgcatttgagaagattttatacatcctctccttcatgattctgaaatccagagagtctgattcttcacggttaggatcatacctgccgtcgaactcgaatgccgtgcgagatctctccttgat

SEQ ID NO: 44939 - DNA, 1919 bp, Oryza sativa
ttcacaataatttagggattaattcggcctttttcaaaaaaaaaaatgtaaatgcgagcacctacgtcaagttattgaaccaggtgcaggtacattttattgtattttgaggtgcgcacatacattttattttacttcgcttgaatttattttgaggtgcacatacattttattttaacctttttaatacaaattttatttgacaatgaacgatcaacagatagcttattttgaacataacctttagtaagccacaccgcatgataagatgacgcatcaactcacactggtgaaagaagaatgccatttttggcttttcagagtgtttgcgttgtactatgtaattctcaaaaaagaaaaagtgaaataagttgtaattctgaacatgaaatcctttacaacaaacctaggtaagctagcaatattggtgtaacaacggtaacatttgttatgaaaaaaaactggatatatctatctgatattgtcaaaacttatactttaaatgaaaactatataccctgtccgttttctaagttgatgacaccgttgactttttatatgatgtttgactattctcatatttaaaaaatttatataaatatcagttattttgttgtgatatatatgttttaacattaaaggaaatttaggtgtgatactttaagcatatttacacaatttttctaataagatgaatggctaaatattattttaaaagtataatagcatcatctattaaaaacaaaggtattagattgccgtgttttaactgtatacattgtatatgttgtcatacatttcttttctgaccatagaaaagtattgcttcctccatcccaaaatataataacttatagcgtttaaaagttgtaataaaatataaaaacttatatatacctttctcaaccaatcacaactttctacctttcgaattaattttcaccaatttccttttcccaactattcacaacattctcttatttaattctacatactttcttataggcatatttaaacctaaaactcttcgcatttaggaaagaggtggtattaagcagctaatgatatatatatgtgtaaacaagtgtgagaagagccaccagtttcagaagacaccagccgactacagcagccacagtgaatcgaaccagaagaaattaactagcgcttctgatgcatgcacagtggtgtcgtcgatcgatcgatctgcccagcctcctctataaataacagtacgtagcaacaacacatctacacccctccagctgctacctcgatcatcatttgtgcactatagctagagaaacatattgtaaccagctaggccagcccaatcaatggcgtccgccgcggctaagattgccgtcgtctgtctggtggttttgtccgtggggcagtccatgatgatgacggcggcggcaactactgccgccaccggcgccacgacgtgcaactgcgacacaagcggttgctacaattgcatgctggatgtcgtcaccaactcgtgcaaaggcagagatttcaactggatggtgttcaccgcctgcttgatcaaatactccaaggaaaaccagtgcttcagcaagtaatagacttatcggagctagccgacatacgccgatctatcgtttgacgcgtacgacatatatctatttctattatctattatctatttctattatctattatctattatctatctattctattatctatctatctatctatctatctatctatctattctattatttatatctattatctatttctattatctattatctattatctattatctatcgattttgctatatatttatcgacaaatttttccccaaaaatttgacggatgtaattacagtacaatcgtagtgtaattacactgtaacttgcatgtaattacactgtaactatag

SEQ ID NO: 44940 - DNA, 1484 bp, Oryza sativa
tttccaaatagacaaaatcgattttcttatgcggttgtctggcccgcatgcgagaaaatgtctgcgaaaatccctattttctatgtggttagcgcatatgcatgcaaaaaggtaattttcgcatacgaaaccttaagccaactacatgcggaatattttttggcaaaaaaaaaaaaaaaactctagccatcccaccacgtgccggacgcccgctccggccgcccaccgccgtcacctcgagtccttgtcgtcatgcgctgtcgcccttcgctaccacccaccgacacacccactcgcctgctgtcgcgcgtcttttgtcgctgccactggatccgggcggaggacggccgtcgctgccgctcgtctgcctgtcgacgcgccaatccacccgccatcgtgctcctctcgcctttgccgccgctcgccatcgcgcctgctgtcacccgccccatcgcccccgcccaaggtcaagggcggtggatccgtcatcaccaaccctccgtagtgctgtcactgtcacccgcccaaccaccgcccgtccgtcgttagtagctgccgccaccggtcgtgcgggcgccaagcccaccgtcggctgccgagagagagagagagaggagaggaggaggttatagagagaggactgagaagtggtggagagggaagaggataagaagagaagtggtggagagagagagaggaccgagaagagaagataaggttgcctgtgaaaattttttgaagtggtggagagggaagaggagaagaggagaagtggtggagagagagaggaccgagaagagaagataaggctgcttgtgaaatttttttttgaagtagtggagagggaagatgagacaaatcagacttagcagacccttacgagacccgcattcaaaaatgattttcttatgcggacctcttaagggtccacatgcaaaatgagcatacggcccctaaagagacccgcatacaaaaatgaatttttgcgggcctattaaggagtcgtatgcggaaatgcctgctcgatttttacaggtgcgggttgttatggtctgtctgcaatctaacgaggatctcgttcagaaaaatcatttctgtagtggtgatattatgtgaagtattttgcccaaatgttagttttttttaatatgtgttgtcgtgcgtttcatggcaatttggtgaaaaaaatctataacttgctaaagctaactagaaaataagcttcataattgagatgtatggtgccacacgacaaaatttctcctgtcaccattgtaaaattgtcttgggaaatgaaaatgttcccatattctttgtatgcctactctgaaaaatgcttgaaaaatggaaccatagcgaatttacaattacttgatttggtgttaatccacgccaaaattaaattaagtctctgaatctacctacttttgacctccaaagatacattatgcagcagcaaggcaaactaacctggtactaaacta

SEQ ID NO: 44941 - DNA, 1138 bp, Oryza sativa
ctgcagggccgtgtatttggcctcctttccggccagagccaactcggcctgctgtttgttgccccagaggaggacaacatggagacgatcgtcgcgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgggtac

SEQ ID NO: 44942 - DNA, 55070 bp, Oryza sativa
  unsure (1)..(55070): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccggcgaatccgagccgttggctcgtctcccctcgtctcgtgcaaccacccggtgtgctcgctttcgccggtatcgccgtggttcgctccgccgctcgccgctgtcgaccgccgtccgttccggccggcgtcgtcgtctacctcccgccggcccgcgtggcagccacgtaggcgccacgtcggcgccagctcagcctagaccgggtcgagccgaccccggtcagtcccttcccgtgcgcgcgctccaccacgagccgtgaggctacgcgtgggcccgccgcacccgcgtccttccccccaccctagcgccgcgtcgcgtgctccctccgcacggtgagccaagccgctgacaagcgggtcccacccgggaccgcgcgtggtgagcccggtccaccggctctctctctcctccctcccgcgcgcgcgcgtcttgggccgttctgagccgccttcttgggccggccggcccgttaagctcggccgagccgccccttttctctcgggccgcgccctagccgcccgagggaagtctaatttccatccctcttttcttttcttttcttttcttttccaataaggatttaattaaatccttttcctttagacgaaaaatccaagaatcttagaaattcaatatcctcccaaccgtagatccgtttgactccgttcaacttccaaaattcctcaaatctcgagatctatctaatagcacgcttagaggtcattaatagggctttattttcgccgtttgttgagttgtcccgtttcgcgtgtagtttcggagccctaagacccgcagtgcgaggatttcgaggatcaagcttcagctctcgagcaaggcaagccacctttgaacatcttgagcctatatttgaaatttaattatattgcttgcaaaatattatgcattgataggatcgcacttgatctgcttgtcccgtctgcaaggcagattggcagacctacctaattttgttgcatttgatcctccctttgttaattgcgataccatgtccccttgtaaccatctagttgcgtctcgatattcgtgcaccctgcgcgagtatcaacggatgccttcaaacttaaaatctgagtaacaacttgggtaaaacttgggttttgcaaaagacttggaaaacccgacacctgggtcggtgcttgcgaactaaatgaatttccaaaaccgcggaccggggaacgtaccgggtgtacggtttcccgctcttgcacttaaggactgtttccttggaatttcatccaaacataagacaagtacgaccacatgggtggaatgggagacatgtggattcaccggggtggtgtctgggaggacccctgggcttcctggcacagtatggtctgggacctaacctgttgttggtctgggacccctctcgtcggcatatggtaaacctgtgtcggctttggaaatatcttgtcatgaaagcttggaggtctcccgacgtggctgatccccacgggctgggtgatccgggttagtaatgtcgtgtgggtaaagtgtaccccctctgcagaggttaacaaactgttcgaacagccgtgcccacggtcatgggcggatgtgaggtgattcctagcgtagttttgtttgactactgcttgtgaaattgctgttgtgaaaaggggttcgacgtttgaaaatctgtagctgatgggatcagctaggcccgggtggccgtttgaaaagttgttggcccgggtgaccgttgaaaagctgttggccgggtgccaaccttgttttcatttctaaagactgatacatggcacatactccgaccggacgagacgcactgtctcatccgtgtcgtttgagaagcactcacttagttgtttcagaaaagagttcaaataaaatcaattgcaaaaacaccagtctctccttgaagcctgcattaaacacttatttcccctggcttgctgagtactcccgtactcacccttgccctatataaataattcccccctagttgctgaagaagatgaagcggatcctgctgatgaggagttcttccaggagcaagccggctacgatgagttttagggtttcggcctagttcccaagtcgtgcctgtattgtttggtccaagtcctgcttccgttttccttttgtaatgcagttgtgagctcggggtctgtccgcagcccaacataactgtactactactctataataaagagacctctgttgctgtgatattctgtcttcctgtgataccagcactgttttctgggactggtatcgattaacaggttaatttggagcgtcacgggctagttccagtcgggactagttcggggcgtgacagggcgccggcgtggctgtacatcacgtcgtcgccaccgcctcagctcgccgccgccgctgccctccaccacaacgagcgggcgccggcggggctgtgcttgacgccgccgccgccccctcagctcgccgtcgccgccgcccccttagctagccgccgccgcacacacaagtgagagagaggtacgcacgagtgagagagagagagtcagaatagggtttggctttggagggtatttttgccattaggaactctggaaacattttcttttttaaaaaaaaattgaaccctaacggagtcagcgaaagagggtcagacggaaccttcgtactcgaaaaggagggtcaaataagcaaagttcaaaaggtagggtcaaatcggcaaaacagggtcaaataagcaattgccaaaaaaaaaaaggaaaaagtccccttagactcccttaatagttcattgaatctaatttgtgacccttaactagaaaaccgggtaggatgactccctgaattattaaaaccagtacaatttgactcctccagcggttttagagtgtggtttggcttatgtggcgctgacgtggcggtgctaacccggttttcattccacgtggcgcttatgtggcattaaaattaaaaaattatttgtgggacccatctgtcattcatacacaagaatatattatgggacccaccgacatgtgggacccacgtatcatcctttctcctccccttcttcctcctccctctctctccctcctctctcttttctctcccccttttctctgatctgatctccttcccttattcggtctccgccggatctcctccgccctctgcgccgaggtccacggccggcgtcgtcgggccccctccgccgcgttgctcccacggcgtcctcggctccgagcgcatcgcctcgtctcaacgccgccatcgacccctccgctccctgctccgccatggcctgaccaggcgaccagctcccgtgacgtccatggccggatgacgacgtgctgcgctgctgccatatatacgatcgaggaaggttggagaggggaataacaacgcgtttgtcagattgctgtacgcgtaatatcggccgtgtgcccgtgtctatgtcgtcgagctgcaaatggcgtggaatctccccggtgatacaatgttgctttctagtttgactcgatccggccatcttgtgaaaagatggtgctgattgatctgagagaaagacgccattcgccggagaccagggggatgagcgcccgtcgccgaccggcgcccgccctggagggcctcgccgccagagccgggtgtttgcgcccgttgccgaccggccgccggccatcctccgcgagccaggacggttcgggctccgccccgcttccaccaccaccagagatccacgccgcgtcgccgccgactccatctgcgccgcccggcctgctctcatggatgccgccgcccgtcggtcaccacgcacgccggtctcgccgagttgctgtcgagggaggccgaagaggcgcccccgggagcctgctctcatggatgccgccgcccgtcggtcaccacgctcgccgatctcgccgagttgctgtcgagtgaggccgaagaggcgcccccgggagatcagatcagagaagggggagagaaaagagagagaagggagacagagggaggaggaagaagggaaggagaaaggatgacatgtgggccccacatgtcggtgggtcccataatattcttgtgtgtgacaaatgggtcccacaaacaattttttaattctaatgacacgaaagcgccacgtagaatgaaaatcgggttagcaccgccacgtcagcaaaaccgtcctgtaaaaccgttggaggagtcaaattgcactagtttcaataattcggggagtcatcctatccggtgtttcagttaatggtcaccaattagatttggtaaacaattaagggagtctaagtggactttttccaaaaaaaaaaaaaagaagggaactccgggtcgtgttcaggcccaaccccgtgcgcttcttgggcccggaaggggagcagcctacaaaactcgcgcgagaggagattcatctgctagcacaagattcatctgctagcacacgcacacgtttgagatgatgggagcaccgatgccgcgcggcggcggcggcggcggagaggctcgtgtcacccccgccgtcgccggcgagcagcggcgcgcggcgttggagatgaggaaggagaggctggtgaggaaggcgagctcgctcgcgacgcggtgcgacgtccccgtcgccgtgatctgcccgggcgtcggcgccgggggcgagccgacgtggtggccgtcgaaggaggaggtctgggcgatcgccactcggtacaaatcgctgccggagaaggatcggcggaagcactccgtggacaacgcctcctactgcgagaaccaagccgccgcaaagcaaggacccggcggcggcggcggcgagttggccatggcggcggcgcaggtggacggcatcgccgccatgcccgacgtggagctactggagcttctccgatccatcgacgtctccctggccgccgcgagcgacacgatccagaaggccgccgacgaggctgaacaaagtgtctcgctcgagcgcgcgcacgcgcacgctcacgcgggcgcgctcatggtggactcccaggaggatgccgcgccgccgccggcggcgagcgggaacggcgtcgcgtacgacggcgagcacatcaacttgggcgggtacatgatcgagcacaaccgattcgaagcaatctggcgcgaacacgcgatccctcctccacaaagcctcctgccggacgacgacggcggcgaaccgctgcggctgtggtcgttcgacgacggcgaaacggtagtcttgccggacgacgacggcggcgaaccgctgcggctgtggtcgttcgacgacggcgaaacggtagtcatttgaaccgtgagtgtttttttgactaaagattttgtttttgagaatgttttgtgtatatagtagtttgatttatgcagagatggaaaaagccgctgcgaggaggggacgatcagagctcgctggacttctgtgttgatgaaatcctggataaactgatggattttcgatcgatactttgattagatagcaaacctggagagactgattagatagcaatcctggagagactggagggttatactttgattagatagcagtgtaaggattatcttttttgtgaaattgatgttcatgaattggattatcttatttgtgaaattgatgttcaacgaactagaacgagaaccagcaatcccagtactctttttttttttaccgagtttcctcttttttatcgagttttcacggaaaattatcttagattgaaaacgagataataattaggagaagatatcgtcaaacaacaagcgatgacttatggatgataattggcgctcatggataataattgggagaaggatatcgtcaaacaacgtttgacaagcgatgactcatgggaacttcttttctctttgtgcaacggaaacctgatagatcttcttttctctttgtagcaacggaaacctgcttatcgaaaccaattatttgaatgagcacgtatttggacatgacgcataagcataactttgtaagtgacgcataaacatgactttgtaaatctattatggttgagatccattttacatgcttattgattcaggctctatttgttttaacttaattgtaatctagattattgatctagattactataagctgtattataacaagctgatatagaataaactgtttgcagggtttaatttattggattgaccgactgtatcggaggtcaccgatagaccaaattttctgaaattttagtccgaaattttgaacaaatattactgaaattcatgaaaagttaaaaaaaataaaattttggccgaaataatatcgtatcaaaggaggtccgaaatgactggaatttccaaacctgattgtttgtttctctttctcttgattattaactgtttgttagctgttagtcactcaataatctaagaaaaacacatttagagtggatttatagattgtaataatctatcataataagctatatgtttgtttcatcttacttctattataatatagattaatagaagtaagatgaaacaaacagatagcttattttgatagattattataatctataagctagattactataatctagttatccactctaaaggtgtttttttagattactgggtggctaacacctaacaactagctaataattccgagaaacaaacagctatactgggtggctaacacctaacaactagctaataattcagagaaacaaacagctaacaacttattctatgtagagctaatgattcagagaaacaaacagctaacagcttattctatgtaggctttttataatccaacttataataatctgactcaataatctagattacaataattttaaactaaaacaaacagggccttagtacccttgggtatgcgaatttaacagtctttattcaatttcataaaagaataattcaatttcaataaaaataggaataagtttactgtaactctcttaacatctagtagctaaatctaatcggtatcaatgaaccataatactggatatagtggagtagcttggcggcgttgcgaccgggccgagtcacgggtcggcggtggagagcacccagcccgccagcgaatttttttcggttttagattttttttaaaatatttacagaaataatctatcggccaaaaaaattacaaaaatagaccataccgcccacctctagggcggcaagttgacgtggcaaacgggggaggaacgggcggtgacggagggagggtttttttgcaggaaaacccttgccgccctctggtggggcggcaaggggcccgaatgcaaaaaagccagtcggggccggccattttgcaggcggccccttgccgccctctagccgggcggcaggcctcgctgcctataaaaggcctgccgcctagcccccagccctcattcttccctcctcaattccagtgaaaaaaaaaagaagagaggggaggagaagagaagaaggggcgaagccctgccagattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaatcaatacattaccgttgcattggcttacacaagaagatattacgttgtagatgtttattgcatgaaagagtaatatgatctagttatttcattgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatagttaatgaggggcttgagagttgatccacagacaagtgacataacaatcaatgttatagtaagtcgggcaactgaaggtttttattgggaactaatgccagttcaaaactctcgagtgtggagatggtatttggaaaatgcattgcaacgcgggtggcctctagctttggttccgtttgttcacccgaaggatccaggtgtgcagatgaacatggatgatggcgagggaccaagtgctgaagtaaatgagacttctgtggaggaggtcaacgcacgagaggacgggggcgtagtagctccagtgggcattcaaccaggtgaagtggccgacgagggggagactgtcggtgccattgtggatgaaatggagagggaggattctgacaacgagcgtgtagaggaaggtgattcgtcagatgatgagacggatattaatccagcagaatgggctagtgaggatttttctgggctgatcgtctctgaagaggatagtgtgagatgggagcacaaagaaaatgaggttattcagggagcgatttatagtagagaagaagatatgaaggaagcagtaaaacattttgcagtgtcacttcatagagagttttgggttgccaagtcgaaccggtcgcaatatgaagttcggtgtgttaagaaaaaagatggttgtccctggagagtgcacgcatataaggggaaatggaaggattattggacagtgtcagtcgttaccaagcatacatgttttctacctggtgttcagaaataccacaggaacattacatgtgcatttgttgcatctgagatgtatgcgcatgtcatcgataatctcacatatgaaccaaggtcaataatccgacacatcgaagagacatacaagtatactattagctatgccaaggcctggagggccaaacagaaaataatagagatgagatttggaacttacgaagcctcgtatgacaatttgccacgcctgcttggtgttatcgaggaaagaaaccctgagagctcttacgaagtgaagaaattcccctcaattgaacatcctggcaagagtgtgctgcaaagggcgttcttagctctacatgcatgcaagatagcattcgtgaactgtcgtcctgttctctgcattgatgggacattcttgacaggaaagtatcggggccagatactaacagcaataggggtagatgggaacaatcaggtattgcccttggcatttgcttttgttgagagtgagaataccgacagctggtactggttcctgaaattggttaaaacaaaagttgttggtatgaggccaaatgtgagcatgatacatgataggcacgttggcattctgcgagcgatagaagagttgcagtttgggagtatggaacgaggataccccggtgtttgggaagatgtatagagtaggtggggcatgcgtcatatgggggctgatttcttcaagcaattcaagaacaaggagctcatgaacatgttcaagaggctgtgcaatcataaccaggagaaaaaattcaatgagctttggaagagattagatgagttgacagccaaatgcagtgatcagcgtgcagcagctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtattttagggatcggttccaggcagttcttccctctatgccgaataacagcattttgtttggagctttcatgcagaaaaagctagaggagttgcataaaaaggccatgaaacatcgagctctagtgcaaggtacccaacagcacaggtttgagatactatgtcaagataaggcaggcatgagtatctaccgcaagagagtgaagcaggagtgtgttctcaaagccgacggcacatgtcattgctcttgtgcaaagccgaagctgctccacaggccatgcacccatgtcattgctgccgcagcggagtgtggcataccagatgcaatatatgtgtcatagtacttcagtaagcaagcaatatatcatacatggagcggcgagatttatgggttcggcatagctggggagttcacagagactaacgatgaagtactcaatattcctgacccatcgaagctccgaggcaaggctggaaggaggaggactcgtcgcatccgcaacgatatggacgagtcggaggctggcagggtgaagcgttgcagcaaatgcgatgaacatgggcacacctacaagcattgtcctaaagacaaggagaaaccaagtgcggcggaggcaggactatcaggatcaacagcagatggagctcgccctacgggtgaaggcactacctccactcgaccacgtcctaggcgtcgtcgtgccacgtctggctccgtggtgtagttcttatgttctatgtttcgtcgtgtaatgtcagacttcggcatgtcatgtcttttggtctcgtgatgtaacgtcggactaaggcgcctaacgtctttaggtatgctgatgtatgtcggacttcgacacgtaatgttatgttatattatcgagctctacatatatgttaaattgcacgtcatcggagtgtaccattagtaacgtttgctatatttaaatagcctgtactcttgttgtacataattattctcatgattttattactatttcataattttgcaaattatcttttgttttacattactactttctgaattgttctaacacgaaacactatatttttcagagatggcacgtcagtatacacctcagttgttggacccggcgatagatcaccgacaccggtctcaccttactgcggtgcagggggctcagcttgggacgttccgggcacggacgtgcggtgagctactcacggttcacgactcctttgtcgagaggtacgaacagtgtattactataagttagttgcgctgtaatattttttataatgacatattaatttgttattgcaggctgcgtgaggccggcctcctaccgatgtgtcggctggtggaggctgccgccggcgacgcggacccggccagacaatagactgtggacaggtccctcctagcagctttggtcgaccgatggaggccagagtcacacacttttcacttgccgtgcggtgaggtagcccctaccctgcaggacgtatcgtacttgttggggctaccgctcgcgggagacgctgttgggccagtgaccacggctgtggactggtaggacgatctgacggcacgtttcgcactagtaacgttggcgacttttgttgaggactggttcctcgcaaccgaggaggtcgtggaccacgagggagagccacacactgaggaggcgtaccaggcctacctacgctggtaccagccacgcacccgtactagggtcaccttcgctcccttggagcagcagccccacgttgcgagcactagagacctctacgccaggcaccacgaccaggacttcgctcgtgctgtgagtaccctgcatcgcaccattcctttatgttttcatgtctttctcttcatcaaattttacgaatatttacgaacaaattaaccatgcaggtcgacgacatcaaccgggtcgtcgttgatggttcaacgacgatccaacatttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtactgactggtccccgtccagctgcgcacgttcctaggccgactccccctccgcacggaggtaagtatttttattactatttctgtacatgcctcgcacatataagtgagccgtttcacctgccgattgcttcagggtttcgtgcaccgttcagcaccccgccttcctcggctaggccttctgttgtgccccccacaggtacttaaaaaaacaacattacttcgacaatcaatttacatgcattatgtcttagcttacaagggtcccgttgtcgatgtgtaggtttcgcccagttcgctatgacgcaggccgcccacttctcccaggctgcaaggtcagcgtctcaggcagctgcgtcgacctcgcacttagcgcagttctggcagtacaccgggacttcatcacaggcagccggcacgtcgagtcagggtccaccactggaccatgctgggacctcgtcggaccgcttgctgccttccaccttgctcttcgacatcactgactttgacttcgacttcgcttcaggctcgacagaggatgtcatcggcccctcacagctgggaggcgcaccgccggtgcagacgcaggaccaggcgcaggccactcctccgcgggacactcgtgctacccgtgctgtgccaccggatcgtttcacctactcccaggactacgtgcgagcacaggcccggaggaccaagcgtggtcgcggcgcggggcagggccagtagagcaatcttctctttgtttatttgcttcacttttcagtactgtatgcttgtgtaatgactacgttgttgttatatgtgcacgatacctttcggcgcatgcacgatacctttcggcgcatgcatgactactttctgccgcaccgatgcagcctcctttattcgcgtgcgatacgatatttgcccgccatttggcgcatacgaccaatgtaactttcggcgccgatcatgcatgtaactttcggcgccaatcaggcgtacccaccataccccaccacgttcacatgtcaggggtatcactcgattttttgcgcctatataagtcgccttaacgagtgaggcctcacaatctttcagaactcagtcacattcagtactctcttccccacttgcttcattacaaatccaaccggctttcgtcaatggctagacgccggggtgttgaggatccaaactggcgtagcgatccttgtgtatacctactaccaccttggtgccagcgtcctctctgcctatgcggtgatcgatgccaattaatggcttcgaggaatcctgatattcgaggaaggcgcttttttaggtgccctaactatgaccgtgaggtattttattatctgcatatgcttattcattccgtatgggcaatcgctttattcttcgtaacactactctattcggcagacccgcactacggcttgtgcatacatcgagtgggtcgatacagaaaatcccgttctcgacctaaccacttgtttacaagaaggttgctggtatttcgcatccgaaagtactgagcaatacttacagagaaaagcggcttatgaacgacaatgtcgtgaacaacagagcgactggcgggtgctaactacggcactccctccatgggaagcccgtccaagatgcaggtgtggtgatcgttgtcaggttctttgttccataaatcctacaacattgggtcgaaggttctttgtttgtccaaatattcttgacgacgatttcatggtaagaatattttgattacatgaatccttattttctcacaacatttactaactttgcttgctttacatttaatctttcctcccaggaaccaccaaggagatgtcaatacagagaatggatagataccagaagggttctaactccacctagccgtgttgtgcagcttgaactaccagagcaatacagggttactaaagcgcggtttgagagaggagagggatcctcacgtaggggttagctattatcggacaacttagcatattgaaatttctactgtcatgcttccttgtcccattactatatcgtcgttgtgttcaactattgcactacctccctcctagttcgaatctaatatcatctatgtaaccgcaatggaaatagttgtatcatgttcaaattgtactactatttcttcatgttacataattctccttgtttaagtccatataatgtttctatgacccagactgcgataggcctatataaattatctgagtactaatacatcgaataaggtacaaaataatacctcacttaacatatgaaattgcgcaacaaccaacttcaatacatttttataacaatattaacaagttttaccaataaatacttctttatttattattaacataacatagaaatatcttttggccgtacttttttcatttgggtcccttgtcgctctctattggggcggcaagggacccagatgaaaaaattacggccgcaagctctttatgggcggccaaaattgcaattagccccttgccgccctagggtctaatcgcaattttggccgacggcggcagacggcgtggtcgacccaccgtctgccacgtcagcttgccgcccaccattggggcggcaggggctatttctgcaatttttttggtcgatagattatttctgtaaatattaaaaaaaaaattcgcccgccagccgagtgctctggagcgagacgatactcgacggagacgacgacggcccagtagtgattcttcatattgggctttatactgggcccagtagcttttagccttcttcccaccgcattggcgccgaaaacccccccaaccagcgaaagaggcggacacacggcgatggcggcggcggcggcgggggaggaggcggagagctctgccgccggcgagcagcggcgcatgcccttcgctcgtggcgggcccgtgttcgtccccttcatggtcggacccgtctccacggtccccgagttcatgtcctccgcgctccacgagctgcaggttcgaatccccttgagcacaccgccaaaccctagctcttcaatccgtgcccttgctttggtgtaatcgcgttctgtgttactttgcgagcagtcgctgaaagatgaattgggcgatcctggtgatgaattcgacgaagagctctggtaagccccccaaattccgccgtatcaggtggagaaatcccccagtgtctgtcatgttgttcatatgcttattcgtgttctggtttgtacattttgtggattctgcagcgtagatgagttgagggtcctctcagaggaggagctggtggagcgcgctctccgggaggctatggaggtgaccgttcctatcgagcttatgctaatgtgcttaattgtagttctagttttgtgaacaatattttgatgtgatgtctctgttatttggtgtttttaggagggctgggattccactgctttgtcacagctggaggatcagaggattgatggagggtaagctatttttgcttgattggtgcttcttttatgcgagttggaattagatgcaacacggacggttaattgttggatagcgtcattccatgccaactcataaagaaagttctattgtgaattggtagcatggaacagcggtttgcactttatgcaccaaatcatctcttttcaatttttatggcttgtagctgaattcctggcatctaaattttcttttcatattattatatttaatattcatgtcttatgtggctcacaaaatgatagggtctgatgttctttcgaactatcacatgcagaatgtcagctagttccacctttggaaatggtgctatcacatcaagctcatcaggtgagagagagacttccagatcacctactgaggatacggcaagcataccacatgtgcatggaaacaacggtaaaacaagaggggtaaaaggggaaactagaggcaggaagcgaaaaaatgtcactccgaccttaaattcgtcagttgaaacggagatacctggaccatctgttgacacggcagttgtaccatacgtaccacaacaaggcatcgaagggaaaacaggtggcatgaaggggaaatccagaggaagaatgaaaaaaggtggaaataccacttcaaattcattaggcgagaatctggaagttgtttcacatgagtctgtaccacctgtcgaggatctggaagttgtttcacatgatgctgcaggcgcagatggagatacaaaatgcggaaagggcaaaaagagaggcaggcattttgatagagaagttcgagcacatattttacaagtatgccttaccctaatgttgcatctctgcttaattgcatgcattttctgatgaatttatcttgtatagtagttttctctaaaaaaatatatatacatatttccctcttcttcttgcatctattgttaatctctggaaaatctgaccatggttttgcgtcatcatatgttgtggcatggctataactaggggagctatcttactaaagcagtgaagatggcagaaattaaggccaaacaagaggaagacaaacatgcagccagcttgcactcattcaggtaaaacagttaactttgtgggcatgtatttatttgaccttgatttgtgggtatgtattgttagtaattccattttctgattgtgccataagctcatagatatatattatttaattttctaccgaatgggatggtgttatcacagctttgctgaagagctgtggaatttctgttgataagtaatttgaacttttactgatgggctgtggcaaataacagtgtaaaagtaatgtaaatcgttctttgtggttcagatgatagcaggatgcagcccagtttggctagattcatgtttcagtaaaaaattggtacttctgtgctggctgaactaactaggtatagaaatttacctccccttaatactggattttgattagcccatacatttactcatgtatcctatttattagcccatttatgtaaatcatatatggtatgcccggtaggaatagtttgcttcctttttataactgagccactagagaataagataagtataaaatacagctgtccaggctatgcacttatggccataactagatgatttgattttatctgttatattgttttcattacagccttctataaacatatttttttgaacgcagtggtgattctgtgttggccaaagtttctaagccatcagctgagaaagttgatgttgcaaaatctcttaggtacatcagcacaacttggaaggtttgcattaaaaactatagcctatttcatttgctcttttacacaagtggctcatttgtctcaaatttcacactaaccatttttgttatcccagaacaaaactttcaaacctggggagcacagacctgtagtctatccagaagtacttctgtgtgtggaagtttatgagaagagatatggctctgtgaaagtaatgacttatatacatatattttttggtatacttatttgtagggtgaaatatgtggggaataaattttttggtgatctcctttccttgcagagccaggaatttctagtgttgggaagccagctccttacagatcttagagacaatatttactgtttcaaagacaagctgatgaatgtggcaaagcaacacgttcattctggttattttcttattgaggtatgcatctgtgaacagaaatttgctgtgtgttcttaaagaattgcaactgtattaatcaacgctctctattgtcaggacacattctataatgacacaaggcgttctactgttgattatagtaaacctatacttgactggattaaaaattccagaaatgaggcggaagagaagtgggatgccattacttctggtgtgctgaagaaacgacaaaaggatttactgatgggtttgaatgtttcaaatgttcctgattttaaatctgcaaaaatggaaaagactcgcttttctgatctgaacttccgtctcggtgctgggtacctctactgtcatcaggttcttatctattctccttatgcctttattgttgtgatgtttctgcatcactttttttgtggaaatcaaatcgtcatttagtcacaatcaaaccttgtgttgtttgttatctatgttttgtgatgaaatctaaaatcgattaacttgaagctgtagtaatgtatgatggttgaggtagagatctacaaccctttcccccatgtttctgacaataccctgcacatacgttttcagggaaactgcaaacacatgattgtgatcagggacatgaggttgatccacccggaggacacacagaaccaagcggaataccctctcatgacattccagatgcagaggcggctacagaagtgttcggtgtgccagatcttccatgccacgaagatgacggtggacgacaagtggactctgaacaatccctgttatttctgcgacaaatgctactacctcctccactacaaagaggacaactcactactttatcaccatactgtatatgattacctccaggagtaaagtactcttcgatgcaagtatattttatctgttgcatgtagcccggatcacaggtgcatctttcgatttgttgtccgtaaactgggcagttttggagcaacagaggtattcttcgtgtctatgggcctgtttggggagcttaagattctgagaatgagctgctgagaagctagctagtgagaatctggagaagctgggtcccagcttctagcttctagttcatttttcagattctacaactacagattctcaaaatctagattaaaagatgaactgtttgggggagcttctggcaactgaagattctaggagaagctgcagctgctaaaagctcccccaaacaggacctatacttcatccacaaaatcatctcccatttgcagtcccatctgctttctctgtttcatattacatgtacctttgactttttaagtttgatcaaatttataaataaattcagcaatatctaatacattaaattagttttatcaaatctaatattcaatatgttacaataatacgtttgttttgtgttgaaaatactatgatattttttatatacttaatcaaagtaactcgtaaaatgaatatgaaacagagagggcagaatacaagaattacataagtgacgcatgattttctagaacagtttctataagaaaacattgtgttcttcaacaaaacacgaagctagaggcacgtgaaagctcaggaaagtcatgcccatcctgggatacatcttcctcgttgggcctagaagaaggcagtccactagaaaatactagacctatagtagttggcacgggccaattttgttttcccttaaaaaaattgaggaaaaatagaagagaaatgagaaatggaatggactagcagttgttgggccagggctaatggagcggaggccacatgtggcaacgagaggccgtggagcgccgcgccttatcctcccgccttttcacgtcccgccacgccgaccgcgccatgggccaccaatggccaccgccaccgccaccgccgccgctctcttctcctcccgcaccctttccccctcctcctccccccggcgacggcgacggcgaggcatccccgccgccgtcaccggcttcctctcccgccgccatgctcccgcgctccaacgccgcctcgcccccctgcacggtgaagatctcatctcaccaatgcgatctcgccgtgcggtccagctcgcacgtacgtgatctaattaactcccggctctgtgcgtgattgcagttgtggatgattccaaggaggtagagacggctgccggagatggtgcggaggagaggtcgcagacggacaagctggtggacgggatggacttcggggagctctgcaacgacttcgagtgcataagcagcccctacgtggaggccaccgcgaggcagctcgcccgcgacatcctcgacctccgcgacgacaaccgcgccttcacctgctacgccgtctccgtcaaatacaaggtgtgcgcatcacccttgtaccaccaattaccactttactgctactccgtactatgtgttatcagtaattcagacattaatttggtaccaatctcgcaccaatgctttgcatctcctttcaagttaatctagcaaacatgtaagctacgagtctgatatgatcatgggattccatgaactgtggcaaacactatctgtagttttttttttaacagtactatctgttttttttttcttggaagggaaaaatagagctatgccatttcaatcagcgagtaacgcttttgcgtattcgctccgaaggtttagcaacaccaacaagaatagtttcaggcacagagtagaccccgagaagctcttgcaaaagctctatgaaccaacacaaaatactgctgttagctgatgaatgttttttttccccgaggaaatctgatgaatgttaagtaggtaacatgcctccattttcagaagttttagccaggctgatgctgattttatattaagaagaatagcaacgaaagtaccactcaaacaacagcaagaaacaaactactgaactagtgacagattaggatgtccagatgcagatacaataactgatgagctacttgacatcaccttgtggtttcgtgcctttctttttttttcaggacccggtcagaacatttgttggacgggagaagtacaagaggccattgtggatcaccaaggcactcgaaaaccctacagtggtaaggattgctgcaattctataccatatccatgaagttagaactctgttgtaagatatctaacccaaacaagttgcataacatactgtccaaaagaaaaaggactttgtcagttcaaattcaaacaaagaatgcctctctccttatttcacattggcatgctcatgagtttggattgattccagtctgactatctaatcagcattcgtgttattgcgtcagacagtccaggaaatgtcaatgcaatcgacaagcaacctgaccatcaaatggacattcagaggcaaacctaagaatccaatcttcgcaaccatcggaggagacctgatcgtctctgttacctcacagttcgtattgaaccagattagcggccaagtgctcgaacaggtcgactcatgggacctctctgcctcgtctcctcctgcccaggcctacttttggttgtccaggagggccttctccactgttgaagccggaaaggacacaatcgaagctgcaaagggtacagcatctcggctatcatcaaagaaagatgagaacttggaggtttatccagatccctcaggggatcctactaaggtacatgaatcatacattgcaaaaattgatgtcactttatataaacccacccacttatctgtagctatccagtgatagtgttttcaactttttgagcttttgtgttcaatattgcagttcttccaaaggccggatgatggattgaaccaagatgtgtaccagattgcgcttttcctggccgttctctacttcattgtacagtttttgagaacgactctgtgattgtactagctcccacagtcccaactcaacctgatactctggcctgattctccaggtcaagcttttgtgtatcagtgtatgcatatatgtgtgtgtatctatttctaacgaaatcctatcagcggcatgatcgacagttgattcagcatctggctggccggggttttcagatgttccaactgttaagtggttcgtgtttgcatgcatgtatgccagattgcgcttccttttttttttggaaacaaaagaggaataacgtttggtcaaaaaaaaaaaagaggaataacggagctggctatctttgtattaagaataaggggtacaagaaacaccatgagatgacgggcctattcactttgataaaaaaaaaaccttaccaaattttggcattgcgaaaattttggtaacttgccaaaattttggcaggattttttatatagttaccaaaatttagctacaaactaaatgtagccatttttttggcaactttattaaaacttggtaaggttgaaaatgacattaaagtgaacaggcccgacaagtctgatttaggattcaaaaccaggacccaggttgactgggcgaacaccctcgcaccatgtcacctgagctatactttgaactattcacggttcccttgcatgaagaatatgtttttttttacaccacccattttcaagttctgaaagaaaatttaattataatttacattcggaaaatcatttgcatgttgtcataactcaaaatccaaaaacatctctgcagcttaaacaaccaccttatccagttaaactgatcgtcttatacatatatgttgaaaattgtacgaacaaatgtgttcctttttttcccccttattacaacttgcaagaaccaccacacaccacccaaacccattttcaagttctgaaagcaaatctataatttaaagggagaaactggtgctgcgcacaaacacacgagctccaaaccgcaaagatgcaaatgttgtcagctcagttcggtttgaagaattctatgaaagccatgtatatctccaaatggttcccggtgatcaccgccgagaccatggccatgactgccctgacgatccgcctgaacgtatcgaggaacccggccgatttcctccggtacttatccacctcgagcacggggaagctgttgcattccacaatggcagtcgaactactagttgaagaagcagcgcttgctccagcagcaggcggcggcggcagcagcatcttcggcttttgcacgccgtaaagcctcgactcgaactgcgaaacgagagctttccggacgcaggcgacgtgcagctggatcatcttctcgctggaggcgtaggcccatgggttgctgaagctcccctgattccgctcgtggcacatgccgcatttcttggtgatcttcctctccagtttcagctgcaccgtctcggtggttatcacgcgggggagatctgcgcagcaagggtgcaggctgaccttcttgtccgggcagtagtacacgtaacctcgcacctgcgagcttcctaaagcatggtgtaaattaacggcgggaaagggttttctactgggaaactattttcatcgagaggatatcctctcgttatttatatattacccaaatagctataaaaaattgaaaaaatttgagaagatgtattaacatgtgatatatatatcactctacaaatatgtaagttcaaattcaacttctacacctcgcaacgaaaaaaacaaattaaaccatgtaagttcaaattcaacttctatattgaatttgaacttgcatgtttgtggagtgatatatcacatattaatatatcttctcaacttttttattctcaatgtatatggctagcaccttttaatctttattcttctaaaagattaaattgaaggagtagttttgaggaaaaaaaatctactaatactattttcgtgaatacatatatatttcatggaaagtcatttttctccttaaggcatcgtttcttcgatgccatcttaaataaaaaaatatatctaataatatagatcaaaggtggtatgttatttcagaaacattaaagttaaattcaacctatatacaaattaagttggaatagaaataataaatatgactgtgaatatgtgaacaatacactagcttgctagttagtttcattatctttttttcaacttgtatgagtcaaatttaaacttacatgtttacataatgatatatatatatatattacatattgattaatgttgtcaaaaataatttatattgtttggatgatatgtaagaaacgagggacatccaaagaaaagaaacaactccatatgttttggaggtattatcgccggcttttacaatggatcggatgacgtctctttttttaatatgcatttaccttattcaaaatatgtacaaatatgtaaaaatacaagtcatacttaagtaactgtaatcataaaccaaaccataataaagaaatcataattatataaaattttaataagtcaaatgatgaaatctatgtaaaaaatcaaaacgacgttctttactaaaaagtcatagagagtattaatttgcagtcaaggtcaaccttgccggaaggaagtattaagaatggagagagcgaggacctcagtagcgcatgcctcgccatccaaggaaagaaacatcaacatatgtttcgggggagtggattctgataactcgaggagatgtctcatcgttgtttgtatgtcacttaaataattatgaaaaaaatttaaaaaaaaagagaagatatattaacatgtgatatatcactccacgaacatgcaagttcaaattcaatttctatatctagcaaagaaaaaaaataaaattgactgtgaatatatgttaactagctataatttaatttttttgcgagatgcataagttgaatttaaacttacatgtttgtagagtggtatatcacatgttaatatatcttctcaatttttttcataactatttaagtaacataagtaacatataaacaatgagggaacatccctcaagggataaaaatagtttctcatgtttcggaggtattatcaccggcttaattttatgatggatgactcctttgattttttttaaatatgcatttatcttattcaaaattactttggtttttaaatatgtatttatgttattcgaaatacgtgcaaatataaatatatacaagccagacttaagtatatctaatcataaaccttgccaggaggaattagtaattaagaataagagagcggagacctcagcagcgcatgcctcgcaacgggcaccagctgtactgaccgacttgaagaagaagaagtcgtgcttgtagaagggagctggcacgcgagtgttgagaggctgcagtgtacaggacctgtggtactgatggttgcagcccgcagtgtggcaagcgtaccggagctcgaagccgagctctttgcagccagagcaaatgaaaggttcgtccttgcgaaccaagcacaccttgtgctcgtgatggttggtgtccaaaatttcggtgtacccggccatgctgagtatacgtacgtacgtaaacgtacctcaccacctcacgctcgccaagctagatcgatcttttgagtagctaggtaggtttcagtagctcatagcataccgtggcttggatcgatctcgcggtcacttatatatatagaaacgtacgagagattaattaattagctagctagtgggagaaacatataggtacacagtatatgtagtatctaataacgtcgcgtaccacgcggggtttagaatgtaagaaccggcaagtgaacttccaaacttccaagtaaacgagtacatcgataggcatcgatagggataaggtgttgattattcttacgagaatgctccttgtcagtcgcccatgcacatgcactactagctacttgcatatgcgtgagagaagtgctgctaattgaccttgcatagttggcaacttttaaaagggaaaggggaataagaagagaggggggggggagtgaaaagattcatacttcatactcaagtataacatgccttaaagcatgttataaggatatcatatataaagatgacaaacacacgtgacatgtcttatagcgaggcacgctactttgtaaactattctaacctaaaaaataaatattaccaaactacatgaaagataaagatttaatttttttttagaagtactcaagctcagatacaaattaataaatcaaaactatatataagaataatattatagttaaaaataagtaaaattgtatattgcataccgatgcagttttaggcttatgaatgtgtaatttttaggtgacctaattttcgcaaatttttatgctcttggaatctagcaatacacattttttaaaatgaaattcatcccaacatatgctacaaagaagctataaccaattattacgtaggttgtggctggatcgaatggctacgaattaaaaataccaaccttaagataaagataataggtattgctaaactttaatctatgtttggcgagaatctacatagccattcgttgtttctgctcaatggcttataagttgcatgaagtctttatcttctatgaaatcagtggttgattattgtgctaatcgaattttgtgttgtatgaagtccttatcttctgtgaaatcagcggctgattattgtgctaatcgaattttgctcacatctgacatcgaacctaaatagaactggagtaacatcggagaatatcagtcgttgacctagatattaccacctccaaagtcatcaaagccgactaggcaaggatactgccacaaagtacacaccacatcctgccgcggttcccgtccgctaaccacgctcacgaaggtcgccgccaaacgcacgacctcgatctaagcatatcaacactgctccatgtgccatccaccaaaaaaaaaatcagaattgttgattaggcttgcttgtttcaaagacaattaataatgttgagttttaaagcgtactcttaggatttattgggaatttttcatcgttttatcacttagctatatcttttggtccactaactaaaggtaagggtataaaagtcttgctgtaaattaactgcgtttttccattagtggtcacatttttttttcacttacgacccataaccctgaaatgcctgaatgcccaacgttttgaatgcgtacgttgtgccccatacacactccggttagttgctacatatgtctgtgtcaatcagactatcaaagtacctagtttacttgcgtttacttgactggttcaatgcatatactacttttttagactatttttattattattatttttagactagttcaatgcatatacttgcggtcatgtcacttgcaagttgcaacatgtgtcctgatccacataaatggcgtagtgcctaaaacgacagctattaatctgatccatgtgcttgtgcatattatcttgcggcagctacacctacaaactagatcgatcgaccacgaattaacaacgcgttaactgaataaagtcgaatataaatttgacatgagataaaactacactactagaaaaatgatctttgctggatcggctgttttccacaataataccggttccaataagaaccggtagtcccggttataaaaattttgatctttagtcccggttagtaacacaaacccctgtcagaggcatgtcaggaggctgaggtatcaatcggcactaaagtagtcccggttgatactaccaaccggaagtaaatatttctctccatatctgatcggttaagtcccagatgatatttcctcctcaccaaaatatttagataagatcatatcctccttctatccctcgtatttccttcctcccctcccctctcctccccccttcctcctcttcccctctcctcctcacatctggcgggcagcgtcggcgagcaagcggctagcgggtggtggggcagcacgcggcggcggccagcggggccgcgcacggggcgacagcgtgccggccgtggtgagcggcagcaggcgggaggcaacgcgccggttctcctctccgtttttttaataatttgtgattaagagatgtataatttcttttattacaatttgtgatttattgcatggatctgatatgtataatcgatctatgatgcatttgatttgtgtgtaattttttttaagatttgtgatgtagttgatttgtgtgtaagtaacttaggatttgtatttgtgatgtgaatgatttgggatgttacgttgatttggggtttgatttaggtatatgcatagcacacgatttggggatctggtgtttgatttaggtatatacatctcactcaatttggaagggaaaaaaaaaaagaaaaatggaccaaccgggactgccgctccctatcttacggcagtcctgggactctctagtcccggattcgtacgttatatataaacaggtgctagtacgtacactaaggaaattagatgagttttcttgtgtggcgctatccatataattcttctatacattgtcctcgcaaactcgcaaggtagaaattcagtaactcatttgttagcagaaacttaaaagtttccctgttatattttatttaaactagttgaattccatgtaattgagaaatcacacttaaaattaaatattattacatgacgtattttattctagaagtattacttatgtcatatgagccaacgcatattcttatatatttattatttaaactctaatggatgaagtgatgtacatacttaaacttaactcaacacctatgatacttcttctcaccatatacgttgaccgaatagtatcaatattttttttttcgattgtgcatccatatggttagtgctatatggagaaaggtgtgatttttctcacacaagctgagaaaatagcccaacttgtcttgaagctaagtcatattcacacatacttaaactctactggatcaaatgatgcactcaaatttcaagaccacactacacaccaatattaattataactcgtctcacgatagacacatcacccagaaatttaattccattgatttttcgattgcgcgtatgtagttgatgccacacggagaagagcttgatttttctcgcataagctgtgaaaatagcttaaagtctcgagtcaaggtcattttcatggacatccaaacttatactctagtggatacccattacaaatgaggattatattatcacccatttgcgatgatgatatctttagtagggacacaaatagtactttctcacgatagatatatatccctaagaaatttatattattttttgattacgcgtacttagttaataccacgcgtagagaggtgtgatttttctcacataactcaaggtagtggtccaacttgtcttaaggcaacatcacacaatccccttcgttccatattactccctctatttcacaatattagtcattctagcatttcccacattcatatcttctattatattattaagacagctcgaaaagaaggcaccacgttcactgtgggggctagaaattctcacattaatcggagaaaaagagaaaattatacaccgttggattataatagatttagattacaacggtttagatttgctatagaaaaaataaagaattatagagctttgatatagattaaaaagtcctgtccgtttagaaaaatccaattggattactatacggtatcaaaaattcaagcgggatacaatacggtacagaatttgttatgattccaaaacgcaagtatatatgcattgttaccgcacatataaaacgcagatatatgaagtagatatacttgggctgctgcggcagaacaagtgacaagcaaagttgattaccatcgcccccaataggtaaagcaaacaaagcaaagctgcaaccagcattccagaccagcaatgcatgcaacccacccagaagcgtccggccacattggcaactgacaacaaattataatcataatcgtgtaaatttattttaaacgtattcagctcggagctgtattcacctcggagcataatttagtgttaattaatgtagttaagcctaaaatataaggcttataggttataagttttacacagaccatctaaaattcaaaatgagattaattatatttataataaaatatgaaataaatttcaaattggattttcaatacggaaaaaatatcattgaaacgagtccatgctcacgaggcatcgaagcttacaaggtgtcggttgttaagaaaagaccatctaaaacacatgacgagataaattaattaacaggcctataaaggagtagagtggtggcggttggtacgacatataaaaattgttaataaaacaccaaattgaatcctaataatgattaaaagaagggatatcaggcagaccgtgaagtaaacaagtaaggcggttgccgggacttctagaaagtaaaaaaaacccattgataatcatatttgatttttaaaatctcaatgacaataaaaaggagaagcagcgggcggggtgcataagagtatagttgcagagctgtcgacggttgacgggacttctagaaaataaaaaatgaattccaacgatagttatattcgatttttagaatcacaatgacaataaagagtaggtggcggacggactgtacaggagcatagtggcatcgtttgatgggacttctaaaaattataaaaaataaaactacaagttcaattttttaaggttcagaacttctaaaaagtaaaaaaaaaacaattattatcatgttcgattttaaaatctcaatgacaataaagaaggaaggcaacgggcaagccgtagaggagtacaatagcaaagccgctgacggtttggcgggactactagaaagtaaaaaatgaacccaaacgataattatgttcaatttttaaaatctcaatgacaataaagagaagagacagtggacatgtcacacaggagtataatggtaacgtttgacggaacatctagaaattataaaaatgaaacccaatgtgacaataaactctaaaaactataaaatccaatttttaaaggttccaagaagaatgaatagaaatattggtagatcgagcaagcaaataaagaagtagatgacataaggggtagcaactggtgtgacttttaaaaactatataattagaaacacgaggatgataaggtttgatctttcaaaatcttaagacaatgagatagctatttaataaattttaagtaaaatcatactaaaaaaatatatgattttgtttgggtactagccgcgcaattgcgcgggccacccagctagttgatgttaatgaatctagacatatatatttatctagattcattaccactaatataaatgtggaaaatgttagacttacattgtgaaatggaggaagtataagatattttgagtttattctgagttaaacttctttaagtacataaggtttataaaaaaaaatcgaaatctacaacataaaattagtttcatcaccaccattgaattttttacagcctatttgttttttttaagaaatgtcgttgctacattcattctataaattaagttgatcaactttaaaaagtgcgacttaaaacaaaccaaaaggccaggtcttatatagtatataaagaggggatcacggagtagcatgatagcagcatgctctacgttcttgctctccaagtataacgcttgcttttagagttcccaatccgattatattgttgcatatatgtgatgcatatgcacctgcacgtagatatcatagctagccggccgcttcacttgatttcattgtttttgcgagatgacggggcacagtaagcttcgagctcccgagcaccacgaccatgagctcacactgacggccgggaaggagtcattccggtgcgatggctgcaaggagcacgggtaccacatgagatacgtgtgcaagctgggagggtgtcgcgcggggttccatctccacgaggcgtgcgcgcagcacaggttcggggattcttaccaggatcccttcaagcgttacagcctcgtgttccataaatctcttcccaggtacagtgcaggacgacgttcgctgcgatggatgcggaggcaacgtaagtcacctctttctagattatatctcgtgcgatatcccctcgttaattgcatgtcactcaaataattatgaaaaaataatctgaaaagatatattaacatgtggtacatcactccacaaatatgcaagttcaaattcaatttctatatctcgcaacgaaaaaaacaaatttaactgtgaatatacgttaactagttatagtttaatttggttttccgttgcgagatgtagaagttgaatttaaacttgcatgtttgtggagtgatagaccacgtgttaatacatattctcagattttttttttcacatttttcataaacatttgagtgacatgcacaaaacgagaggatatccccttaagaaattaaaatagtttcccattatatctctccttctcttgatcatgtttcttgtcatcgatcgatgttttcttatttttcatctactaccttaattagcttcgtccaaataaaaacttttgaaacacggatgttgtcgatcgtgtcttagttggttttaggtgtttcttttttctcaatacctacatgcaattctcgaaatatacgatacttggcatgtttttttttttgagaggggcatgttgttttatatatgtatgattcggaagatcttccgtccccaaatataaaagattttggctacatcgcagaaaactctaagctagtatacgtacgtgtaatcagttgtgcacgcttgcaggtgaatggttatgcgtacgtgcgggacatcggaaggttgcgcaccctgctcaaacgcggcagggtcctgcacccctgctgcgcggcgctgccgaaggtgatcgaagccgagggcagcgtgacgaagctgcggctcacgcggaagctcaggtcgccgtgctgcaagtgcaggcacgtcaagctcggcgacaggaggcacacctgggggtacgtctccgacggcggcggcggcgccggtgtcgtccagatccatgtcgcctgcgccaacgacctcttccgcgaggagtacgagggcgcgcgcctgcagcagcagcagcgcacaagggtggaaaggctcaaggcgcgtctggtgaatatgctgagaggagcggcgaccggcggcggcggcggcgtcatgatcctccctcagctgccgaccggcgtgccggaggagtcgtcgccgtcgccgtggacgatggacagcccggtcgtgaaagcgttgctgtggaccatctgcaccgttggtgctgtcatcaccggtaaccccgtcggtatttctaatttctttttaaccttgtaggaacaaggacgcatgtgttgtacaagaattcgatcaccactgatctagcaattggttaagtcgttaagatcaaaatacggcgacctcaaaacatgtacgtacttatgtgttctggtttgtaaaaagagaaaattgttgactatacatttgcccaatttcaatttcagtttcatatatgtgtattttttgtacagaaactttgttagccatatatgcccaatttcagttccacattaccatatatatatccagcatgtgagtttttttttttagaaaaaggtccaaggacccggcttctattgaaaaccatcacgggccacgagtctgctggggatgccagcttgacagaggttcagcacaaaagcagaaaaaaaaaaaacattaatgggccacaccccggcttgatagggattgcaagtatcaatgaaccaaacagaaacaactccaggctaactccaaccaaaaactctcatgaaactagctctaaacatcacctaacgaggacagctaaatagaaaatcaggttcagaaggacacagtgttaaccaatcccagttcttgagcgtaggcctgatctcgtctccctaaggtgggtcatcagcatctccagactttgtttctgatcagggtgaagcagaggtttcaactgcagcataagggaaatgatttgaaaaggaatgtttagaggatagtaaacgattttttctctaaaaatcattgcatttcttgtcaaccaaagtgaccanggcgttgcagcaattaaacacatcttaacagatttgctcttagcaattgagttcatctctaccagtaaaaaaatgtcatcaaaactcctggcagtctgcccccaactcatggcatctctccaggcacaccaaacaaaaaaaaaaacaatggggcaatcaaagataatatggttaattgattcaatttccccacacagttgacaaaacaggtgaggttttccagtaaaggagatgctttttttctcctatgaggtagttctatgaaactaactggtttcatgcatggtaggagatagatccatctcacagcatgccacatagaattactagggtttactaaacatttgaaatcatgaatgggttaagaaatttacgaaaaaaaacacgttatttcttaaggtttttttcggttaatctcaaggtgatcgatcttcgagggtgattcattccacaccttgattccgagggagatttgttctacatccactaaggtgcatggaattaatcccatcaatccccttcaatccatcctcctgtattaatcgaataaggcattaatgggagggaaagtattttaacagccacatgtaacgcccctcataatttaaagtacatgcaaacttagccaaattatgtgcatctacatttagatcccaactttcatgacaaaattctgctttaacaaattgacgtcttcttatattggtgtcattaaggacgccaagtatctgcattttgatcttgtagcaatactcgaaataactttcatgacaatctgaatctatacagaccttcaggacgttgcagtccatggcgatggcaggtccttcattgcaagcaagagcttctaatgtagttggatcggatgtaggtcactctccggctcacatgtcagtgagcgatatgcagtaacctaaaggatctcaattgagttggattagatatcccggtatcccctcccaaaccatagcgctagctgctataaatataccggatgtgtcatgacaaaataagcttcaacaggtccttagttgcctgatcgagtaacaggggcattcgctttgccagatgcgtgctctaagccgcctctgcacatgggccgtctcttccaccgtatatgttgggccttgcctagcagctacatttggggctatgtttgggccggatgcatgtttttgggcctcatcttcgccttcttggcatgttgtcattttgtgtcggtttgggaatttgactagtaggttatttagaatctttattattattattattattattattattattattattattattattattattattattattattattattttgagatgaggttattcagaaacttgatactaccattcacgagcctgtgaaatttgttctcaaactcaaactctcgaagcaagatagttagtgcaaaaagaaaatgaacctgattgcattggttcactaaaccttctacctgtgcatttccgacaatgagcaaagagaaaatatccatgtaatacatgatactactcattgtgacatctggcatttacctacaatatctcaggaatattcctctgttttttttccaagccagaaacgagcagtccacaattattgttcaatatctggcggctggagtttgactaacgagattgtgtcgagtagggtagaattcgcaaaacgtggcgatgatgctgatgtgtttgtgcagctggattggcttttcgctagagacgctggtgattttttttttcttttcacgtggtactgattctttgatggtacagtgcatttggaacacttgtttgttcactgctcaaagggaagacatacaaatagtagaaaacgatgctgaattgctgatgtgtttgtcatagactggaaataacccaaaaaaaacgagataaatatctgttatagcatctactcgagctgttaaattgtatcaagcatgtgctggagctgtaaaattgtataagaaacatatcccgttttcaacaaccagaaaaggagtaatactatggtttcactgttaacataattcggctagttaaaagtctacactgtcaacataattcaattactatggtttccaagtaatactggcccagcatcatgttggtaagttcacaacgctatagcgcctaactccaattcaaccactatacaacacaaccttttgtgtgcagtttctaatctttacttcattagggtctctagcaatctaacatagcatatgtgtaaatgtaaaaggatctatgacatctatgatactgattccatgttaccgtcaatcgtgaggccatcagttccagacacaaagagccatctacaaatgttagacaagctctctcctccatgaaacctcagagatgcgcaggcaccacacaacccgatctttcagataccggaaatgccccatcccacagaaagctataggtggagtgccaccacaaaagtgcaggaattacctggggcagccatgtcatttccccgccaagaaactatctccactagaaaggctatgaataccgccaagcaatgcaagatatcctttcaagctcaccactcatctgccgctgccgctgctgaagaaaaacgcacatccttccttcctagcaccaactcgccacccaattaggccattaccttccaaaattctcccatccaatggcgctacgcctctccgtctcctcctcgcacgggccggcttcctcgccggccatctccacatgccgccccgccgcctgcgggcgcttccccgccttgctcggcggcggtgtggcttctcagaggaggagcctgacggtggtgtctggccctgagacaagggcggtgatccccgtgaggtcgagcggctcggacaccgccactgttggggccgaggcggaggcggtggccgtgaccgggcaggtgacggaggtgaacaaggataccttctggccaattgtcaagtcggcagggcccaaggtcgtcgtcctcgacatgtacacccaatggtacttcacaaaagccacaaaactccactgatctcttcgcgtcaatctccattgatgaactgttgcctcgcatgaattcttcagtcttatcacgagctggatttattttgaaatgagcggcgtgaataagaaagggaacagatctcatcccactgctcagtgtaataactgtaaaactgactggttgatttgcaggtgcggcccttgcaaggtgatggcaccgaaattccaggagatgtccgagaaggaccaggacgttgtgttcctcaaactcgactgcaatcaagacaacaaggtcagttagaactgattttctttctcttgtctacgctccacccaccattattcgattggaatgtatctgctgttttcctgaataaatcgtgctaagcctccttggtgcgtgcgattcgcagtctcttgcaaaggagctgggcataaaggttgtgccaacattcaagattctcaaggacgggaaggtcgtcaaggaggtcacaggtgccaaactagatgaattaatccaagcgatcgagacggtgaagtcaagctgaggaatgccctgaaaatttgcatcagttagcttgttgtcactagtgtacgttatgggtgaaccaccagttattgaagtgggtattcgacatggagacaaacagttaatctagttcttctgcctatgatgatttatcaagcatccagaacaatatacggccatttatatggaatgcaccatgtaaataactatttccaacgtcatgatgatctgttttctaatcttactgatttgcaagtgaacattgtattcatggttagcaaaatttcaaaatatatcaacaaatttccagctgaaccatcatagtttaaacattcggatgccggtttttttttatgacacatcttaaattcttgataacacagatacctacctaagatgacgagcttaaattgcaagtgtcatgaaactatactcaattcttctagagataaacaagcatatttttttaaaaaaaaacatggctcaatgaacacataaaaggatcaaagtaatttatcatggcaaatttcagacatgacatgaaccatgaagaattgaagttaccttaacgacaaactgatccatagatcatccgcccctgataattagcttgtttaaaaccagcttagcttgcagcatctcagaaaagttaacaatcttgcagcaacgagaattgtctatcaattccttgtagtcagactactatgctcccgctgtcaagagtgaaatcaggctgatcaataatacccagaataattgcaccaattagcatcctttcgtgaaagtggataatgaacatggagaaaaaactattgttctagttcttctgcacatgatttaccaaacattcagaacaaaatacaatcatgcatgatggtgatgcaaataatcgttccatacttcatgtcttcgtgaggagactgttactttctgaaattattgatttggaagcgatcgacatgctcttgcctgagcattttctgcatactagattacagaaaattttctttctaaactcttgcagttacaagcattaagatatggattgcaaattgccttatttgcttaccccacaccatttattaaaatatcttgccaaacaattatctaagatatagaggttaaaatacaagtgttggtattatgctgtaccgcatcaattcattgagatgccaaacttactaaagcaataaagttatctgaatacttccacaaaataatttgcattgggatctttcagatataacatgaactgtaaagaagtgaaagtaccttaatggcatcagtagctcctgcatttctggcagttcaataagatctgtttggcatcatctgaaaatttacatttgaaacaaagagagatatgtgttcgggttttcagctcctcaaaggaaacctgccacgctccctctgtcgatcctccacccaactagagcctggctgtttgaagggcagtcttgttctcataactgatctaattctttctgcctcctcccattgttctttctcagcatatatatttgacaacattatatagttcccagtgttgtgaggttccaactcaaaaagtttgtttgcaacaatttcagcaatctcaacattgccatgcgtcttgcaggcactaagcaatgcaccaagagcccctgggtgggggcccattggcatcgtttgcaccatttcaaaagcctcctcaagcctccccgctcggccaagcatgtcaactacacaagcatagtgatcagctcgacgctccatcccatagtacttcaccattgcctcccagtaatccaaacctttatcgacaagtcctgcatggctgcatgcggtaagcacaccgacgaaagtgattggatcaggccaaactgactgagcttgcatcctttcaaacacttgaagcgctaattttgcatgaccatgagctgccagcccactaataagtgcagtataagggtatgcatctggctgtgcaatctccctaaaagcactgagagcctcgtcaacattcccacacttagcatgcatatctacaagtgctgtaagaactttatcgttcctttcaatcctcttcttgtcaacataacttccaacccacccagccaactccgtgctgccaatctgcgaggcagcagatataacgccgaccatagttgctgcatcaggctcaatcccagcagcctccatttctctaaacagcgcaagtgattcctttggcaccccactctgcgcatacccattgatcatcgctgtccatgccacaagattctttgccggcattctatcgaacacctctcgtgcactccgcattgaaccacacttgcagtacccaacaatcagcaccgaccacgaggtggagtccctggtaggcatttgatcgaacacgcggcgagcagaagagacgtcccctgcattgacgtagacgaccaccatggcgttccacgatacctgggttctggatggcatggcaacaaagagggactcggcgtcgggcacggaggcgaggcgggcgtgcgcgcagaggagcgagttgaacgagacggcgtcgggggccgcgatgtcggcgagcgcggtgtgtgcggcggggagatcgtcgcacttggcgtagagatcaacgagcgcgttggcgacggggaggcggcaggggaggagcgcgaggcggagggcgagcgcgtgcagggaggcgccgagcgggagcaaccggagcgacgcggcggcgttgagcgcgaaggggagggagaagtggtcgggggagacggggaggcgcggcatgaggaggagcaggcggagcgcggcgcgcgggtgcggcttggagaggcggcgaatggcgcggttgaggagggaccggatgacggggggcggcgtgccggcgtgcgcgcggacgagatgcgcgtggaccgcggcggccgccggcggcgggtggtcggaggcgagggcacgcgagaggcggtcgaggcgcgggtcgccgccgtgctgggacgccatgggaggtggcccagctgtggtcggtggaggcgattgagtcaggagcaagaaataagggaggcaaagtagacttccactgtgccggagacgtgtagttggggttgcggtttttttttgtatcttgggccttttgaaccagactgggcttttcctgagtttgacggcccaattaatttacctgtccctccttgtttttaattagggccgttttggtttgataccaaaacatgcctttccactttgttggcaaactgaataatatgtgtgttagtttggactaacaccaaatatttggtagtgcctaccttatttggtcatattctagaagtttctcctctatactataagagtttggttttatattggtagcaatccaaatattagctaaataactttaccctacaatattttgatagtgccggagtttacctagaatttggcactaccaatgaattcaggcgttaatatgcagtttactggtgtgatgagatcatgagaagagtgacacacacaggcacacgggtgacaaatgcctaatggttcatgtctccctatatttcacatttttactgcaaaaaagttcttttggacacacctctgtgtgcaaattgtacggcactctggctctttccctgaatggaattggaatcaatatcagaaagttgtatctgatgtcaaatagatcgtataccattaaggcattttaccatacgaacatctgctccaaaaataaatacgtaaagttcaagctatgatcagtgtcatccaaccagctagccatccggcactacaattgacctggcgattggttgtctaacgacggatagaaatgcatgaatgcgaagacacgcaaacagcacgttccaagtttttgccaagtagggatcatacgcattcacatttgcatagcaaatgtttagtgatgtgacctcttaacttaccaaagcaatttaccaataaaaacccccacttgctgactggaccaagattcatatatcatgccaagcctaaccatgatgatccacaagagatgatcagatcagatcagatagaacatcagaccccattcttcactccggttaatctacaaaaacatgattgactgacgccaccccatcagcatgtgacatgtcacccgtccaacaatgacacagtttcaacaggtggacacccaaacacctcatcacccattgcatattatcccattgcatcgcatggcttcctcctcgtgcctatccagatcacctaatactctatccaaagttccaaacgcaccaaaagtgaacccaagaagcagcaacggacagtgaaaaaagaggagggcaacaagtcgacgacgatggcaagcagcaactgagcaaaatgcagctgatgacactagttacccaggtggctgtggcctgtgtggctcctaccatggtcaatcgatcgatcacttgccccgcgccggcatcccactcccacccaggcgcgggtggtcgtcacctactccaccaacccggcagctgcaggaaggcgctgcagttgatacgcttgtctctttcccatcattagctttcccccatagcacatgccgctgctcctccaatccacccatttctccctctcccgtaatgcaaaatacgcaatcgctcgcctgatcctctccccctctctgtcgctcgctgttcctgtgtaacttcaccagttcactcccaagcgctatgcgaaacatgctgtcttgccccttgcccccgactagttcgttcgttaccaactgtggcattggtgtcacaaagaacactatgcaacgcaggcaggattgtgacgtgccacatgtagtttagcggttgcattgacttaagtagcatattcatgatagcaaattttagattgggttaggctaaatttataatttaaaaatattgcatatatccggtcggatgtagaggccgataaaaaatacccttctctaagaaaagatcgtgatgtgccctatgggatccacgtgtcagtgacgagtcatcctgggcgttgccgagctgttcgtaatgccgattggtggttccaccacgtcagccagccgctgtcagcttgcggtgtgtgtggatgtgcagcagcgaattattgcccaggccgggacttcgatcgatcgatcgatcgcaacatgcaatgcgtacgctacgccgtaccagatccaacttatcaattcggagctcgggaagaatgctgcgcccatgtggcacatagcggtgcacggtttcgccgctttgattgataccccaaagttaccaaacggggtttacacctcgagaagaattccgtgtgcgcgagaagaaaaccgtgtacgcgagcagagagcatttacatggcgctcaccgtgcgtgcagtatgccagtattcacatttcacagacaagaacgggtcacacaccacccagcagtcnnnnnnnnnnnnnnnnnnnnncgtggcgcggtgaatggtccaatcttatccaatcgccgcccccccgcccccgcgcgcacaaagcgagctcacttttggcgagacatgtcagagaagagccatggcgagagggagggagagaggtactgcaagctagggaaggcatatggtcaatttggtcatggatgggcacagatcacaatgctcgcccattctctcgcgagactggcgctagctgatcgagaaggcgaatgccgccgaatctgacgcatcaggaggagactagtagcagtaccgcaggatgcgcgatcccattggatgccaacatggacggcttcgcctcagatacgcgccaccggagcatctagcagcagcaacaggacactgaaagccaccggaggagacgcatcatcagcagcgccgagagagacagacagcgacgcttgctgtgctacccaaaaccgcatcatccaacggaacggaacacgcgtgttttgccgatcgccacgctggattggatccgggaacgatccaagttcatcgcccacggcaagaaacagattcaacacgttgtaatccccgaaccatcataaccacgaaaaattatcgccgtggcggcgaccggaggccggcagcctcctctaccggccaccgtcggccggctttgatcgcactggacaacaagaacggcaagaagaacagagtgatgaggaatgaaaggttactaactagtagtagaaaacgaaaggaatgttcattctatctatctgcacagatgccggcccgccggcgacggaccggccgaccactcccatgcctcaaaactgcgcattcttttggtttccgcctcgccgatttcaaccatcgagtccgtccccttcattgcgacgccgcgccgccgccggcgaccgatccgtcctcacacacctgccccgcgtgagcgcccaattcagagatgaactaggtgggtggagatttcacttcgtgattggttcgaggaagaaggattagattacctgcgtgaggaggaggagggggtcgggggtgcagggcggcggggcctcgaagacggcgagggggaagtgcttgaacacgacgccgacgtcgaagtagatgacgccggaggaagggacgtcgacgcggatgccgcggacggggaaccagaggaagaggtcctgcgcggagacgcccgacagcgacgcgatccggccgtagctgatgaccccggccaccgtcgcgttgtaccgcagcccgacctcgaactgcgccgtgcacgactccccgagcgccgcctcgaacctcccgctcccttcgtcgtgcctgaaatccgcgatccccgccggcaggagcccccgcggcagcccgtgcgcccgcagcacctcgtgcgccgcctccgccgccgtcgccgccgccaccccgccccaccccgccgccgccaccaccatcaacaacatcaccacccaccacgacgacgacgacgccattatcaacgaggagataactgccgacgcgaggaggagaagatatggagatgaagatggaatggaattggagggggaggggatggacagaagcggcaataattgagggggagaaagaaaagaaaagaaatggaatggaatggaatggccggggtggtggagtggatggggacttggggtggtgggaccgacctgcccgtgaccgagaaagcggggtttaattttagttaattagttccgcgtaaagcgctcctctattctacggtgtgtttagttatgctgcaatgatgcccaacccttagctgggtgtgcgttttccgttttggctttggtcgcgggtgtaacgtgatttgttgttttgttcctttaccttagtgtgcgattttggttgtgttctaaaggttgttcattaaccctaattttagtttaagggttggtttggtttgtggcctaaataggccttaccaaattttggcactactaattttggtaaggcaaagttgtgtttggattgaagccaaaatagcctaagttcactattaaaatggcctattttgttaggcatgctaaaatttggcttcaaaccaaatagacactaaacactattgaaattaccaaatattggtaagcctaatttagacttcaaaccaagctagccctacatcttaaagttgttccgattcttttttaaaaaaaaacgcagttcatacaaagtttgagctccgtcggcaaaaaccaaaatttaaatttttcaaaaataattttgaagttgattttaagatattttgaacgtttttttttcagcattggttttaaatcactaagaacacatatataaaaatttacctgtaaaataatttttatttcttaataagcccttacggtgtgtttggataatgggaaatggagggtgggattgggattaggaaatgaatgaagggttaggattaaatggaaaagggagaatgaatggttagaatctaaagatggtgggaaatcatttccgtttcccatttgccaaacactttcttactgtttattagagaatgtgggcaatcagtggtaccttagtaacatttgtactgacattggaacagcgtgttgtgtatggtaggagcatatgaccgggccataagggagccgtttgaacgtaaaagcatggaacaaatggatgaaacttaagtaagacttgcgtaaaaataaaaaaaaaaacttaagtaagacgacgatgaggatgagaatgtcgggcgccctcaaaatgctaatgccaatgtggcggagcttgagccagtttggctttgcacgaattatatgtaatttgacctttctaaaaaaatgtaatttgttgcctgtttccttctttcttaatgacacaaattgagtttttttaacacaccctaattttacttgtagactagagactattgtgaatttgtaattatgttcgtagtttggacgatggttcgttactctctagtagaaatgatttgatccattagttattagagataaagataaactagtaatttactgatagattgattaggggtaactttattatttatcattttttgactaatcgatatgtggccatccacgttggcatcactcatattcaatcgaaatatgccaaaaaagaaaaaaaaaagagatttagccactactaaatttcaattatatttctccgtacttttttttatatataataatgtccctccatatttctaccaccgttatttgaggtggggtgatgaaaatgtacatttcactgagagaatgaacgaaaggaatgtaacacgaggaagacaatggtgaggatgagaaccattgcatggtaggctatcctacgatcacacctactacttgcaaacttaagtacaactagagggcaagatggtggagtggacgggaacgagatgatggtgctaatttgcccgtgaccggtgacccccaaaacagtttaatttaggcggtaatttcacgcatagcgttctttccttcccacatggtagaatgtgttttagttttgttgaaacttgagagtgatgcaaaacctgagcggttttaccggttcggttttggtcacatgtatgcctactatttgggcttgttttcctagtactccaagtatatatttttagttgtaaactgaaggaagacgacgacattgacggcgagaatgccagtccgaccgtggagcagcagtgtcttctgctgtcatgtggggcccttgttgcagccacagtgtagagaaagccttgtttctttctcctctgaagtctgaacttaacgtgggctgcctttcctcactgacgcaaccatcgtggcacgaacacgctgtacatacatacgcggtgaaacgcccctaatgctttgcagaattgcaaaagcacaaacgaacaagaaacaaaaatgtcctgtgttctcttctcttggtccaatgccccatagagtgaatgcattagctgtgcatctgggtttttggatgcttccggttggtacaaggcatgtgcgccctcgtatatcattctgacatctcggtgtaccgcgatgaccgggagataaattttgcatccagctcaagctagccaacgaggtacagtattaattaggagacgaaacaaaagcaccgaaacagtatactccttgtttcccggttcagaaaactactgaacaaagttaatgctttggtcttttaccaattaccagtgttcccatttccgattgagcgacgaatcccgatcttgacggtatgacagtttttttttcaaatttcagttaaatctatcgtctcaattttgaattcttaaaaaccatttgaaattttacttataatccgcttccgtcctccgtgaaaacaaaaaaaaaactacagttctcaaccagtttttattgaaaacttaaaccctggtctatattaatgatagaatatcatgtagtaaattatgttttgagattcatgcaaagccctcaaaactctaaccttttctttttttcctttttcctccccatcaccacatgaagtgctcaacacttccgcttcttgttgccaccaacgccctggccttgtcagctgatcgaaatacgctaatggcaccagagaggctccctcgaccagccgcctcccctccctactacccttccccctctatttctcctcaaggtggcggcggcgaggtgcccccgccccaccgtctcccccatctccagcgactcactattgtcggatccaccaccatctcctaactgtacacttgctttgcctccaccaccaacaccagtccaccgtcttcctccatccccgtgactccgatgtcgccgtgccgtccactagttccaccatgcatcgtcgggccaccgcttgtcggcaagacgccggtcgtcatggctggtgaagaaggggtaattggagcttgaggagaaagaggtgaggtcgccggagcaggaaccgcaaagcaaatctaatggtagaaatttacaatattttagcctcaattttctaccaacagtagtttagcatttccgtgtaaaaaaaaatggttgacatgtccgtatagctggctagctattactttctccatttcacaatgtaagtcattctaacatttctcatattcatattgaatatctagattcattaatatcaatatgaatgtggaaaatgctagaataacttacattgcgaaacggagggagtagctagcagctgtagttagcaatctcgtgaactagtgttggccctgcgaggtgtgagttcaggctgcacctgatgggcacaacctgtcggggaagctagcgagccatcattgggagcagcatgatagcagtggggatcaacccattgatccgagcaaaaacacgcacacagggcaggcagagcaggcaccacacgcgcatacgggattcacacgcctccagtacgcatagtgcgaacatattctcctttctgctcgccatgaagaggaaaatctctgcagaaatgcagcctctcgaccgtggcgagctgaggctgagctgagatgagctttcggtcgccatcgacgcatcatgggtggcatcgttgtcgtgcatttggatgctgccgaaagaatcagagaaaacctcgagaagaaagaaagggagagatgcagatactctgtctgtgctgtccaggtttgccttcccttttcttcctttcatcagtcaccaacctgcatgcatggatgatgatttggagagaaaaggggaaatggatgaatgatttgattgcacaagagcgagctaaagctctcatcatgtaccacaacctggatgcacctgtaacaagctcgtagccgtcacctacatcgggaaatattcagcctgttttttttttggcttaattatctgctgttccagcctgtatgattttcagaactactcggctgtttcagcgtatgagcagctatgattggctggctgagacagtaccactgatcactcatcattcgtgcttgcttagatcttaatggcgagtgattagcaccgagttagttaagggtttggtgaaagctactactagtgctgccggattaagatttaacggcgatggcaaggacggggacgtaccgggccgggtgtgtgcgcgggcaatgatcgtgtcgcgccgaggcggagcccagatggcgcgaatgattcgggcggcgaaaaacaaaccactgcacatgacctactacagtaccactccgtcctaaaaaaaaatactgctagctacgaatctgaacacacatatatatcaagttcgtatgtaggatgggtctttttctagacagagagagtatacttcatccgttaaaaaaaacaaacctaaaactagatactatcatatattctagtgcaacaaattatagacatacttctactagtatatatcacgttcagttttagattttttttaaaaaacatatgtagagtagtcgaatgcaagattgcaatgcagggatcaggtcaccaggacaacggatgggccatgcacccatcgccgtcgccggccgcgcggcgcggtggcgcgctccgctccacgctctcttcttccctgatgcccgacaagacccgttctttgctaatggtggtatagaatacttctgtgatgcgcttacaaaagtagatttcgccaaagttaaccttgtacatcagtattattagatataacttttctaactatttgttattttctctttttgaatttatttatgtatttatttatgggactagctatatttatgatatcatattaaaaaaagttaaaatcttgttacaatgtaaatagcatacatttacacttcaaaacttatactaagtaagttatttatattgtaaataacatacatttacaatgtaaataacttatggatgttaacatatatataaatacgaacaatattagaaagtcttataatatgaaatgagggaagtacaacatttatactgtaagttatataagagaataatgataaaagtaaataattaccaacttggaagataagattgagagagaaacactagcaatcacatatttaaaaaatgattgagtcaagtcagaaatgtggcactatatttacaccaaattcgttaatttattggctaataagcttactaactaaaccgaattaacatgccataattacggtcacttggagcctggaggccaagtcatcaaacggcaccggctggacccacgtttggttacgtctcaccaaccggttcccgattctgtgcaacagagaccgaaaggaaagggaaaggattgggatatttgggattaggacaaacagatggtacactttgtcactctatgattattatcggtcacgtacgtactagtaagtgcaggcccctccacctgagccggagttgatagcattagtttagattgttagctagcggctacagaaagaaggattagttggtctaataaaaggtttagttttatggggatcttagaaaggctttaacttttggacgtgttttagttaatcatgagcttgattgggtgccggctgctggatgcatgggcacgttaagtacgaacacgcggcatgatggatgcgttgtcttagctttcgggacgtcccggccggaaatgcctcttatgattattaaagaattaggtcatggggttaataatacatggaaatacagggtctaatgggcgacctttgatcgaggcccagtactggttatgggcccaataaactgtgcaaaggcttcatgggctacaaaggagatcatccacaaaatttgtgggtccaagatagtcacggcccattatttgcaacatactccctccgtcccaatatataagagcatccccagcagctcatctaaatttcatcctccatactcccatttggatagccatccaaaaaaattctcactctatataacttttcacttcaacagatcatccatattacatcctaaatataccaacatcctatattttattaatatttttcaactaccacacatttttactcatatccctctcacctttcaccacttaaaaaaaatctcgggaagtgggtagttgaggatggagtgaggagagagaacctccatatttagcataggaagggctaggtttggagaatctccaaaaatggagtatgtgatggtgactttgctggagcactatttttctcctccatactccaaatatcggatggatgactagataaaggagctgctggggatgctctaagaacctagaaccggataaaacattttatagtactatgaatctggacatcataggctacctgtccagattcgtagtactaggaaatatcccatccgattttaggttcttatatattgggacggaggaagtactcatcagcttccatgtttaatttccacgataatttttttcactaaaaaccaaactttcttcattcattcacgggagaatgtggactggactgtcagtaccgcgcgcacacaatcaacatgaccaaaaagcatcagatgccgctagggatggcaatcgggtgcgacgggtacgggtagtgcctatccatacccgtgcccatgagattatttttttccgtgggtatatctattactacatgacgggtaagaatggttgcccatgcccatcgcccacgggcgccttgtgcccgcaggcgtgcccgtttacccgccactacaaaagtagtggaataaaaagtctacaagcttctaagttcgatatcgaatttaaaacatcaaatattctctgtctcggtgtggtgtctctcctctgacggcgatagagtaagagggagagataataagggaaataaaaggaaaaccgtagaaaacaaagaacgtggcttatgtattctagtggattttgcttctagcctacatgtaagttagatttcgtgggtaaacgggcaaagcgggcatgggtagtgattacccatacccatgcccatttacccatcaggcatagcttttaacccaataaaatatctatgggtataaaatggagaacaaatttaatcctaatagggtttttaaccacgggtaaatagaaaaacgggcacaattgccatccctagatgccgccatggactgtctccatccaaacctacgtgtatcttcaggatgagacacgccgacgcgtcatgccgcctcaaaggccgcggaaacccaaccgcccgtccgccagcccagccgctgtgacgtgctcactgtttcggcggacggacgcatatgtgtccgtttcgcaataaacacacgggagcaatcgcatcacgccgacccaaaaaaaaccgtcccgtccgctccgcggcgcttgacaacgcgtggtgcacccaatagctctagcgtgacaagactcctacgccgtcacgcacccacgcacgcacgcacgcacgcatatatgtgcagtgtagcgtgatgtaccacttctaccaactggtggtagtagcattgcctactttcacatacgcgcggcgccgctggtgctggctggctggcgcgcgcaccggcgggcggagagcgaggtttttcgccggtgttttggttggcctccgccgttccgcgcggtggtggtggtggtggttgctgtggtagcgagggtacgctttggagacggagatggagatcggcgccgttgagaacgggggtgtcgtcggtggtgaagttgtggcaggcaagagggggaagacgccgcaaggttggaagtgcatgccattcatcataggtgaggctcccgttccagtgatttctttctacgttttgcgatccgtatagtatgttaacggccctttgaatcgtaggattaagaaaacataagaataggaaaaacgcaggattttaaaaaggtatataagtgtaaaacagaggattacaaaacgtaagaaaaacacatgaattaccgtttgattgaaccgcaggaattggatgagagagataaactcaaagaaaaattaccaagaggttaaagctcatgctaaattttctctaaaatctctataagattgtgcattccataggaatttcaaagaattggataggatttaatcttttgtttcaaatggcttcatagaaaattttcctatagaattgaaatcctctaaaatttctatgtttttcttccaaatcaaaggggccctaaaggagcgaaggcaggcctagagtagttagggcttgagccttagacttgtcttcagaattatggttaaattatcttaaaccaccatgtaactttaagaaaaaaaaagcaactcactagtttaagttcactctttaatgatttctagctccgtcgctgacgttactagacctaatacctctgccgtcactgatgttacttaggctgcgttcgtttccagggacctaataccaactccccctctcatatttcgtgtacacgcttttcaaacagtgcgtttttacaaaagtttctatacaaaagttacttaaaaatcatattgatctattattttgaaaaaaaataactagtacttaattaatcacgcactaatggaccactccgttttacgtgtgaagggaatgagttccttagccaagaaacgaacgcagccttagacctctcaaatgctgcacggctacaccgtaggcttgaaaataacaagatagacgcaacgctcaaatacacgtatgtatacacacgcacacctacctacacatattgaatggcaaggtttattttggctacaatttaaacatgcccgaagtcccctttttatagatagtttcatgtgaaagatcaattcatttcctttgataatatagaaaataaattgcatcctgagaagggccatatatatagatcatagatgtatatgtccatggtattcgtattcgattagcacgtacggaagactcttttaatcactcgtattcgtgaatcatctcattaatacttctacatgactaccgtaaatcatatactaatatccattcaatataagagtattttcagactctgagcctagaccaagtatatgttgatttggtctggcttggcttggcttctttgtctaaatttagacatgacaacatgggtgctctaacccggtgatccctgcacaggatacaccctgcctcaaatcaaagcaaaaagggattcacgaatgaattatgttgtacttcaagcggatcaaatcaaaatgctcattataatgtactgaatggatgcccttttctgattgtatctatgtagcaactgagacatttgaaaaggttgcgacaattggagtggtagcaaatttgacggtctatcttgtgaagcgcttcaacattgggcaaattgaggcagctaatattaccaacatattcttcggtacgcttaactttgcgccattgctaggcgccttcatctccgacgtctacttgggaaggttcaaaacactagcctatggatgcttcgccagcctcctggtatgtccatatgatgaccaaaccatctctcttagtagtttcatttcacctgcttggcagcagaaagaaatgcaaggtcacttgtcattgtcaaataaggcttcacccaacgaataaaaagatcagcaatagcttaatgcttttttttcattagaaacgaagaatgtacaataagccccaactgatgcaagaaactgatatatagtgcacatccaacatttttgttgatttaagctcttcccaggagtgtagttcatcaacatgaactcattttaatttatttatttgctaaaataacaggggatgctgggaatgactttgtatgcatcacttccagctctcaagccaccgatctgccatgaaaaaacccgactaggcggaggctgcaacagtccatcaacactccagctaagtgtgctatacctttctctaggctttctaattatcggtggaggagcgatccggccttgtagcttgccctttggagtagaccagtttgataagaccgacgaagaaggtcgaaagggactaaacagctattataattggtactatggaacaagtactgctgcccttgtgttatctatgattgtcatcatctacatccagaacaatgtcagctggccaataggatttggcatacccacattactcatgtttctcgccattatcatgttatttctgggtaccaacctgtacgtccatgtacaaccagagggaagcatatttgctggaattgcccaggttttagtggcttcatttaaaaagagaaatctcaagcttccttgtcctcatgatataaaccaacaaggattgatgctctacaaccctccttccaagggcaaccgcgtattcagattgccacttacttcccagttcaggtaaacatctgttaccactaaagatgaacagaattggaactaatgt

SEQ ID NO: 44943 - DNA, 5893 bp, Oryza sativa
caggctctgttgtatccatatcccttattgccctaactctattcatccccatttatgaccggattttagtaccaatagctagaggattcactggagtggaaagtggtattacacttctacagagacagggtataggattggccatttctcccatttcaatggtggtagcaggacttgtcgaacgtaagaggaggaactcagccttgtcgaatggaggaatatcgcctatgtcagtcttgtggcttgcaccccaacttgttttaatgggtattgctgaggccttcaatgcagttggacaaatagaattctacaataagcagtttccagagaacatgcaaaccctagcaggatctctgttcttctgtactatagctggagcaaactacctgagtactgctctggcaaacatcatgagaaaggtcacgaccagagatggtcactcaagctggttaacagacaacattaatcttggcaaactcgactattacttctattttattgcccttatgggagtcctgaaccttatttattttcttatatgctcacacttctaccaatataaggtaatgtcactccattctgaagaatccatcaaaatacctaccaaggaagaagaagccacagagatcgacattgacacagatgcacctagcaaatgaatagtgcaactgcgagtctaattgatctggcacaaggaatatacttttggacatggtgacatattcaaattccaatttcgaattcactttagaagaggctctaatgtttgtaacatcaaacagacctctgtgtcatcttatggatgtgacaaaaacaagtgtaccatagcaagggggtgacatgttatctagcaaacatgaataaagagtttaaatggcctgtcctgttgtattcgaagtaatggagtgtgagtgatagcttatgaaacttaaacaagtccataatggttatgcgacaagtaagcacaggtcatacaccatctttttctattagagcctttaatgtgcaatatttgaaattcttatagatgcttttacgaacatgatttgcagtaactagccatttatcaggtaataagaaaaaagtgagctctattaatagttgtgtcatctttgaactattgctgtcggtaatctcacattctcacacagtgtgggtgatccttcgtatacttaatgtctaatataagtaacttttttttattaaaaaaagtcatgccaggtggagagatcttatttgattgcttaaaatgttatatgataaaaatcacagaaatgtttatatagaataaagaatttatggtaccaaaaaaatcttcattccagaaatgtaatgaacatgtcaatcgttaaactcaccgtggaaagtcgtggaacaacaactggagcaccacggaccttgtcaagagcaaaacttatccgcaatggtcgtcctagcattacctgtagaataaaaagaaagaccatgtttattttcctgtttatttttcactgaaacagttaatattacaatctgttagacatttctcttcatcaaacagtacctttccatccatagcatccttggcgcacttagcttcatactcgtttgagaagtgcacaaacccaaaacctcttgaccttccagagtttttgtcatacattattctcactgcatcatcaaatagtcttcatataattctgttcactaataccagcgtaatgaatatgtaaggaagggattaagcattgcaatttgtggggtaaatagaataaacaatagcaaaacacatgttgccacacacatcttataccaggcaaacaccaatatgcctccaccagataattccatggcatatgcatattgagatgtcatctttcagaataaaactatatgataggtgataaataatcacgccacatatgaacctgcttcaaacagaagcaatagccattgacactggggcatacgcatgaaaagacatgaatggcagcatctatacaaatatgtgggataatttagacttacagagcagacaaatgttcattgattgaagagaagtgttagtacttggtagatatatatgtcatgaaacaaatatagctttcctctatgattatctatcgagtgtcaacatttgtgaactatatctgttggtgggagcatgaaacgttaacacctttaaggcagaaaagtgggacaacgctactagatccttgaacaaacatccaagataaattttaaagtggctgattaatagggactgccaggctgccaaatgaaatggaagtgcaaagcaacacttgcacatatgtagaggtgcacacccagcagccccaatatactgctcatttttttttaaaaaaaaaaactgccacagctggtatttacaggctctatcaccaattctttttactatcaatagtatgttgttgtcctagcatgtaggaaagtcaacatgcacaatccagatgagggcataaggtcagatggaggatcaccgtaaaaactccaaggcaacttttaaaaggaaaaaaaaagacaaatgaaaaaaaggaagtaatgaaaaatgagtatgcactaaacaagctgccttagaccttagtgtgtcagtaccattagaatccatattcacgtgttagagattcctggagcaatagtgagttgagatgtgatatcgttggtcatgttccatagaccaaggcatatttttcttttaaagaaaaaggtccaaggcaatcatctatttcatcaacttgcatttgaaaatcatgcttgatgctttactttttccacaggagacttggcaacctgaaagtgaatactcaacttatgcctgagatagattccaatagcttgagacagacagacagtgaatactaattgtttgatgtatcttctctcttccctaggtaagagttgttctactatcttctgctgtacggcactatctcaatggaactaagccctaaagttttccttgtaattcgctttgcataacaggatctgacagattcagcagctctatatttgccagatgatgcataagcattagaaagtaacacaacatgcccataatcaaatgattccgtggtgagcaccttctttgcagcaactttagtaaatttcatgtcaccatgcaaatgccctcctcccatcaaagccttccaagcatttgctcctaatttattgtgagtcaagctagccactcctgctgcttcctccaagcggccagctcttgccaacatatcaactatgcatccgacatgctctgggcatggaattattcccttgtcattaaccattcttctaaagacgagcatcccatcatccaccagtccagagtggctacatgctagcaatgtgttcaaataagtcacactgtcttgatcctcgctagatttctccatttcattgaaaagtgatactgctttctctccttggccatttacaccataggataaaatcatagtattccatgagacagcattccgagaaatcatctcatcaaacactttatgcgctaaagtcgcatatccacacttaccataaactgcaatgagggtattaagaacaggtttgtacagacacaaacccgatttgtaacaatatgcatgaagttgaatacatagttcaaacttagcaacctcatagcaagcaagcaataaggtgaccagtgtcacagaatcaatcataaaggaaccttcatgcctcatcttcgcaaagagatacatcccttctagggcatatccattttctatatacgctgacaccattgccgtccatgaaaccaagcttttctccattgtaccatcaaacaacagtcttgcagaacttaaatcctcacatttagaatacattgtgattaacgagttaactgcaggaagctcaccactgaacccacagattacaatctcgttatgaaccaactttcctatccttccatcacccagatgtgcacaagcttgcgccactgtaaccaatgctaccctatcaggcactatgccactcaacctcatctgaacaaacatatgtataacttcaatagcctgggcttcctcaagaaggaaacccatcatcatcgtccaagaaacaacatcattaacagcgatctttttgaaaatctctcttccaatcgcaagactaccaaagctcaagtacatacccaagattgagtttgtcactgagacatctgaatcaagcccaatcttgactgaataagcatgtgcactctcacacaatccaaggtcaccacaaccagcagaagcctgagcaatgctaatcatagtcacaacattatgaactggtccaaatgaaaacagcaacctcttgaaaaccagcaatgcttcctcaaacagatcgttgtgcactagaccagaaatcaatgcattccaagtaactataccaggatccctcatttcaccaaacaatgcccaggccttcgtaggacgtccacatttcgcataggaatcaagcaatgcggtccgaacaaaaggattggattccaacaggctcttcatagcccacccatggatgcactcagcaagcaccaagttgcccatcccagcagctgctattaaagcaccaaccaatgtgaacgagttggggctcacccccaccctcatcataccaacaaacagcctgacagcctcgccaaacaacccgctcttcgcatgccggtagattgcagccgagcatgcgaccaaatccctaacaggcatttcatcgaacatttggcgaggtcgcgcgcgagcggaacacccacttcctcctccgagccgtttcatcgaacacctaccgcgcacaccatctgaaccctcccccagtcccccaccgacaaccactcaataggttattctctagaccctgaaacgaaactgtttcaagtgacaaaaggtcgcgattcggggattaccttcggtgacggtgccgaaggaggagaaggcgtccgtcagcgaccgctcgtccgcggaccacgacaaccctacgcccgcgcgcgcaatcgcgcgagagagaaagcgtagcaaagcaacaaggtgagaaccatggaacagagtggggattggattgcggggaaggaaacggaggcgggagagcagaggctttaccggcgacgaagagcttcgagttggagggcggcgtcggtggcggtggaggatgcggaggaggagggggcgactcgtcgggtggtggatcggcggtggcggcggcggagagagcgcggccgaggtggcggtggtggtggtggctgagaggagcgaagcggaggcgggagagcagcgcacgagccgccatggcggcggcggagactgcagctgcgacggctgggttaatcgcgagcacggcggcgccgcgatactcaaagtgaaccacgtcagggtcgggagaggaaagaggcctcaaggctgcgtgggctatagcctgagccccgaggactcaagtttcgaagcccaccaagaatcctagcagaccttggctgctatccggaaaaagtatactttgactccctcaactatgacacgagtatgattcatgacctccaaccataaaaccaggtatatcgactccttcaactatcaaatccaatgcaaactatatccttgagtggttttggaagcggttttggctgacgtggcgcctatatggcggtgttgacccggttttcgtctcatgtgtcgcttatgtggcattagagtaaaaaatatatgtgggaccgacatatcattcatacaaaaaaaaagtgggacacatgtcctcttcctccttcccttcttcctctcctctcttctctctccttcctcttcctcccccctcttcctcctcttcctcttcctgcggcggcgagcaagggggtacccgttctgcaacgagacgctggcagcggtgggcgggagcaggagtgggctgcaggaat

SEQ ID NO: 44944 - DNA, 3343 bp, Oryza sativa
accgccacaccaacattcccctccctccgcatctcttacgcgcccaacttgccacttttcctctctatttttcttggctccggccttgccgtcccttcttgctcgtcctcaagccgtcattcggcgattccaccggcagcagagacgactcagcgttgacgacgtcgacccccgccgtggccacttcatcgtctacggaggtgacaatggggagcgtcatcccagtgtagggtgacgtaacgataaggagagcgagaagggggaagatgggaatgagagatatgatgacatgtggggtacatatgtcactgtgtcccataatatttatttgtgaatgacatataggtcccacatatttttttgcttttagttttttattctaatacaacataagcgacacgtcgacacacgtgggacaaagaccgggtcaacaccgccacgtaggcaccacttgaaccaaaaccgcttccaaaaccaccaaaagatatagtttgtatcggttttgatagttagagtccatatacccagttttgtggttgaaggtcatgaatcatactcgggccatacttgagggagtcaaagtatactttttccctgctatcctcattatgcctatccggcccgtagatcatagcccaaaagaagcccaacagggcagcagcaagcagacacagactcaccctataaagacacacacatatcctactctagatgtacattcggaagattggaccaaattggagtggcatataatatagttatatgctatagcgcatgattcggatatgatatttctaaaactgtgaatgatgcaatttttaggtggattgtttgacaaagttctatttggacaatatgatttgatattctaatctatttattttatattataagtcgttttgatttttttagttaaaagtaaatttatagaaaaatatagtagtatttccaacacaaaataagcatattactccctcccccgcattcaattagacacggtcaaatttagcacggtttccaaaattaatttttaactctaaatttatcatatattacaatgtttgtagcaacaaaatcataatcatataaaatatattcaatgttaaattcaataaaattaattgttttagatattgctaaatttttctatgatactgatctaacttaaaaaatagtttgaccaagaaaaattcaaaacaacttataatataaaataaaactgagggagtacaaattagtacggaaaacaatcacggacacagggacgcttgacggcttgagtaaagcaatcttgctaattaattcatcgtatgcggaaatacactggctgatatccaaggcaacgaaagaacaaggatcacatactgcaacaaaagaactggagtagtagaaggctagaagctagccctaccaggtgacacgcaactttcagtttatactgtacgtacggtgctttgccaccggcagtacagtagcctccaggtagcagagatgcgttgcttctctgtaacgagcattagctgttatgtcactcttcctaagcttgctttcatccatctcaagaaaacggcgttcctgcacctaatgcactaattaccctatactcagtagcagaccagagtgagaggccgagagcaatgccaggtgcaaaaaccatcttaaatcacacgcaaaaatcttgacttgacaggcagaatcattcatcatttcgtcaaaggaaaactcagctaccaccactgcactgtaaccaccgagacattcagaattaagcaacgaattcgatctgaaagtgcatgtctaggacaattaatcattagctcaaaggaattgatcagctggtgtgtttcaggcaaacaagtaaacaacagaattcagtagtacataaatatatatcagcgcgtctccatgtatagagaatcgattatataggtttgaataaacattatgcgaccgaagaacaggaagaaaaagagaaaaaagaaagtgtgacaagctcaaaacaaattaaaaggcgtttaacgatgacgacacattgaatcatttctagaagcaacagcgcatctgacttggcttagctagcagctaacatgtttctgaagcccttttttagttccacacatcattggatggttggccactccttcctaatctcaaagtagtaactcatctccaagtagcatttgccatcatcatcaacaaactgatttaacagaaaaaattacagccatggttagtaaggtaattacctcgattaacacatcagagctgaacttgatgagtttgaatacctttagtttagcagaataggaacctcttgcgaacatgccagctggggtggtctcctcttcaccctcatatgtgtagggctctagctggggactgaatgtccccagcatcaccttctggttctcaactgcaagtcagaatgcacatatatgacacatcatatgacattattggagttcattgttccatagataaaagaataccttaaatgcataattaaatttctcttaattaacatatttctttactgaagaatgtaggaaaatcctcgaataaaatgacctaatgatctaagatcagtatctaaaatggcatgtcgtcgttatatttatgaagagattgcagcacatacatgaagatcatatgggaaatttaatggaacgatcaatttgtgccgttgtttctagaaattcaagcgccattttatctgatctacaaaataaaatacgcaggttcaagtcgtgcgttgtgtgtcacctcttactccagtcttccagacagtgttggtgtacttgaggcctgacacgatgttgttggagacgatgaagctgaagcggaagctgtaagtgctcccgtccttgagcgcgaaggcgtagcccttctcgtcggggacgaacgggatcggcagtacaaggtccggcctatccggcgacaggatggtcaggttcagcaccttcacctccggctcagcagtctctgcatatccatgcgcacgcccaaaatgtcgttacagatcgcacatcaagaatgtgtcaacgaattcaggcgagaagcatatataatgatgaattggaaacaagcgtagatagatacctccaagctgttcagtatcaacctgcccgaggagttgctccttccacctcctcaggctctcatcatcctgcattcgcagaaaagttaaaactatattcagactcaattagcatcagatcaacaacaatggaggaatgcagtggattatattacgtaccttgtcgagctcgagctgctccttgaaggggacctgggggccgagcacgacggcacgcttgttgccctcctcatcctcctcctcctc

SEQ ID NO: 44945 - DNA, 3453 bp, Oryza sativa
tatcttaaattatacttatctaatatgtaatccgaatacagcgccctatttgttacaattaaatctctactagtacaaaatatcatgtaattatattctaataaaaaatgtttagatggttaaaatattgtgttttataccggacagtgaaatatttcaacagatattttattgtgacgttgcaattactaaaacgattttgctatacatcttacaagtgattttttcactagagagaaatcacccgacaaaatggatagacagtttcctttgatcatgtgacgtttgattatttttttttcgccactagtcagacgcccgatacctagctgcgtccaatgttttagaaaggttttcttcatggaaactgtagtcatcagatttattgtaggaaagcaattgattttttggaaggcatattatctccagggattcaaatcgattttacattagggggaggtgttaacagactggactctggagtttggacggtattaaggcctactcaggctctcggtccatattacaactgggcccaccaagttcgtgtacaatattgtactaggtgggctgagcaaagtcgagtcagctaccagattgggccgggccgagtagcacgaaaaccatcgcgtgcacgaccactccaaagttgctggaagtccgggacggcgatggtcgccacgcctgtgcggtggccgcgggtgctgactccggcgcacctcgccggcgccatccgccggcagaagagccccctcgacgccgtccatctctacgccgacgcgccgcggcgctacccgcgctcctcctaccgccacaacgacgccgtccactcctcgctcctcgccgcggcctccgcatcctcctccgatctcctcccctccctcctccgccgcatcctcccgtcctccccctccgccgactccctcctcgccgcctccatcccgcacctccctcccgctgccgcagtctccgtcttccgctcctccctcccatcctccctcgccccgtcttggtcacgatccttctccgccctcctccgccgcctcctctccgatggcttgcttcccgaagcggcccgtctctttgcggacttcgcggggaggccggaagtctctctagcgtcagaagacctcacctcgttgatcactggattgtgccgtgcgcggagacctgaactcgctctgcaggtgcttgatgaaatgtctaaccagtgcctcgcaccagagaaggacgcttatcgcgcgatcgtgcctgcgctctgcgatgctggcatgctcgatgaggccacacacgttctctactccatgctgtggcgcgtgtcgcagaagggatgcgacgaagatgttgtggtgtaccgggcattgctggtggcgctctgtgcggctggccgaggtgagcaggcagagattgtgttggataaggtgattaggaaagggttgaggtcctcaggtagccggcgatctctccgtgttcctatgcttgctgggcttagtattgaggatgcccaggaaatcattgatcaggcattggttgttcgaggtgggcgtactgttgcaagctttgaagttatggttattgacctctatgatgagggaagattgaatgaggcagacaatttgtttaaggagatgggcaagaaggggttcaagccaacaatatacatgtatgaggcgaagatcacttctttatgcagggaaggcaggttggatgaggctgtgaaggtgttggaggaggaattacccaagaatgatctcattccgaccgtcacaacatataacttgctaatgaggggactttgcaactcgatgcaatcaatgagggcactcagataccttggaaggatggataaacagcttggttgtgttactcggaaagagacattttcaatcttgatcagcggcttgtgttcagaaagccggttcatcgacgcagcacagattatggagaggatggttaagggtcatcatagacctgaggcaggcgaatttaacaatgtcattgaaggtttatgttctgctggtagaacatatgatgcattgctatggcttgaggagatgatcgaccatggagaaacacctgatgttcatgtttggtcttctttggtttcagcagctttaggattaggagaaggccttacaactgctgctacgcattaagtgggattgggccaagtacattctttaagcacaaaaacatcactggtttgagcgtacagaattagcctcttttgtatgtaagtgaagtaacatttttatcatcctgttatttatgcagttccaaaaggaatatctgtaagctaattatttctgcatgtagtaacaatatatcttaaatctactttagtcttaataatggttgcgatgaggaaaaacagtaagctgtttttatttactatacttaatactacatgttatgagttttgagtccactgcttagacgttaaacagagcattaacttgtcaatgtgatgtataaaaccatattgaaggttgattatattgttgccacaagatacgagttaaattaacaataaaattagcatgtggtattttgtacattacaaaattgccaggattacatcaaggcagaggtacaaaattgccaggtggctacatatctgatggatcaaccaagcagagtttacaaaattgccggatcttctccagactactaaaactgctggatcaatccaatctaacctacaatattatcgggtcatcgaagcagagctacaaaattgctggatcttctccaagcagagctgccggtctgacagaactgctaggtcttctccgagctgaactgccgggtttccaaaacaacaaggtcttttccttgcatcaaacctatagatagatagccccatgtccctcgcttgttggccaggaaaattgctcgggaacttggcggcggcggtggcaacatcagttgaatccggcggccatccagcgtccaaaattgccgggtttcaccgtattgcgacggctactctagaccttactgcagatcactcagtccaatagcacgtcgaagttgcatccaaagtcgaagccatcggccagatcactgagataatgcagctcctcgaggccggaagaatgctgggaggcgtcggagcactggaggagatcgtcaatggagaactccgtctcgtcgcagccggccacgttcgtgacgatgctctcgtcactgcccgtggcgatgaactggacgggcgcgtccatgaagttgtcgctggtgctggtggtttggtaatcgaacacggttgtgtcgatgtagttgccgtcgatgtcgcactcgatgtcgatgtagggtgaccagctgatggcacgatggcgttgcacggctcgccgtcgttgccccatgtgccggccggattgtgccagcagccgttggccgccggcgccggcgccggctgcatttggttgccgtagacgcaatgcccatgtaggg

SEQ ID NO: 44946 - DNA, 32942 bp, Oryza sativa
  unsure (1)..(32942): unsure at all n locations
accctggctgcatcagcgtcacgccggcgttgtacggatggaaggggtcacatgtcgccggtgcatgcacctcctggtgctggtagccgtgtacgccgacggagttggttccggcgacgtcggcgtcgcgccgccggccgccgccgtccgcgtcgtcgtcggcgccgggcagcaacccgagcgcctcccgcctcttggccgtagccagcagcgtggcgtcgatggacgcgagcagctgctgcagctcgtcctgggacatcccgtccagcacggcgtccggcgggtcgagctcgccggggcggcccttctgccgcagcctggcgagcttggccctctccttgtcgagctcctcctggaggtaagccacgtgcgtgtgcctcgcccgcttctccgccggcagcgcgcggtacctctcgatggcgtcgccgccctccggcgacacccacacggtcggcgcgccgccgtcgggcccggcgcacacgacggcgacggggatgtcgcacagcgtggcgagctccccggccttcttgatcagccccgccttccgcttcttgtaggtcgtagcgcgcgtctgcgggttcgcgatgagggctatggatgtcttccggcgagacatcgctggagacgggagtcgatcgatctcgatggcgaggagacgacgggtggattttatgtggtagtacgtgcgcattatcccagtccgattcggacttcgtatcggcgaaaatctgagtccgcattggattttgttgcagatcacgtatatggatcagacggcgccctgtactcggctccaggctcacccttgcctgtgcgactatggctcagttctaaccccaaacttcaacttcctcatttttttttgttagtttcaagcttataattattaatgcttgtgctaatgaggtttaaatctgtcttcaaagggactgcctatacatttgtcgacaaaattttcaccaaaaaattgacagatgtaattataatataatcgtagtgtaattacactataacttatatgtaactacactgtaacttacatgtaactacagtgtaacttatatgtaagtgtcacataattttgaatcgttagatctattacacgatttgttttggtgaggaagaaaacaaatcatagcacacacatatatgaaagaatttgttcccacgacctccattttaccgaaataacatgttacggagagatttttgaaagttacatacaagttacactataggtacagtgtaattacatacaagttacagtgtaattacactacaattgtactgtaattacatacaagttacagtgtaattacactacaattatactgtaattacatttgtcaaatttttggagaaaaatttgtcgacaaatgtataacaaaatcggtcttgaaaacgcacgatcgaaagcacctctctccggatagtccggtgagcccacaccaccgttaaggcgttaggtatcgtgaggcccttcctttaactttgcaacgcgtatcctattcgatctgtttgatgcctcctaattttgctatcttgacaagatttcgattaagatttataacgagctacgatcagtggaggtgcataatggaaagcgtatttattattattattatcatcatcacattcatttttttttgaacggacatcatcacattcaatcgagtccaaacagtaatcagtttccattacttccatatcagcacacaatgtacatacatctctttctaacacccaaacccttgggagaaatttattgaggctagttgtttttcaagcgatgcagttcacgccaaggcaccctcctagcaaattcctcagcaacttcttctgcagcacaaacaaaagattataattagattaggaaaaaaatcgcagtcaagttcaactagatctccctgaaatttacagtccaactttaatctcgattaataagctccaagtgttctacaaatgcactacttaagctttttgaacaaaaagggtagtgtgtgagtgttgctattatcctaagaaaagctaattgcaaaggctcagcttatctcaaaaaaggtttgtgtcaatcacatgatagtactagaaggtaactaaagtaaaagccacttggtcatcacacacaagggcccagcaaagatgcacagattttggaacaaaacacaattacagtgtactactacttgccttcttcaccctnctgggaggtgtggtgagatcttgtacaggtcctcatccactgccgtctttggcttccacttctgctgctcattcagatactgctgcttccttcctccctttctcacacgcacagcattcgcattcgcattcgcgttttctttctcccctttcactcgaacaacgcactgcattttggtcacgaaatcatcagtctaaccgtttgttcttttgcagcaacgctatgacttaaaactgaactaaactgatatgataatagttaggtgaagaagactgaagaaaagttcaagttttttttttgtcagaccttcttgtagttgtaggggttggcagggaactggggcaccttgaagaggtcctcatctttctctgcttgtgctgtgaagaagaaagtccctgactcgaagtattgggtgacgggcatatcatcccatatattccagtcgccgaacgccgggatttggcgccacttgcagtcatcgagcgcctgtcagagaatggaacaatctttactgttaacttatctctgtaagcaactcatcctacatatatgtttgtgaaaaacagaaaagatatgcaggaagcagggacgttgataaagaggcatctgagaactgaatctttgagtcaacctctcattggataaggaaaactttgaggtgatcaggagattcagaaaatcagaacagtatatgccaatgcagcagaacatcacccgttcttttctccctagaaaaggctctactattaagagcagtacaaacaccacatctctacatggcaaaaaaaaggatccaaggctagatagtagaacacaagctagttttgccacaagaagccaagaactgagatagagattagtgaagaagagaaaggcaacgaaatgcaaagcatttctccatggctcacctccataacgcagtgacagaaaagaatcagatcgcgaagaggaggaggagacgaagaagacgatcgatgactcccaacgatttcaggagacaggtgagcagcagcaacggctcagtggtcaaagctgtagtggagcttgctagctaggcattggtcagtagcaacacggccgcatgcagatgagcaagggagctggtggctgtgtgcatgtatacatagccacgcgaaaaagctcgaggaggagagggggtaaagagaatgtgggggcacacacgtaccgaaactttgcagaaagcccacaagaaagcaagcgcccaaagcagccaagcagggcagtgtgtttagctgttactgaaccgaggcaatgagtgctgcactgccagtctgctactgctgcttgcttcacgctcgtacgctctcatctcacgcaccaccctattacctattactcccacataataggtgacgtttttgactttttatttgcaatgtttgaccattcattttatttgaaaaattagtgcaaatataaaaaaagataagtcatatgtaaagtacttttgataataaagcaaatgacaaacaaaataaataataatttcaaaattttttaaataagatgaatgatcaaacattgataaacaaaaactcgaaaagacaattaatatgggacggaggtattaccccttggcccttgctttacgagtttagtgtctttagtgcagtcataatactgttcatcctgtcccatcttgctcgctcactcttgtcaaggcccatgcttacttcgtttcaaaataaattaacttttacacataaatctaaatagaaggctatacttatatttgtgtaaaacttttttctaaataaagagtattttcagcttatcagcccgatatcattacagattattcatgccatgcatataaaacacggtttcttctgaaaactttctatgcaagcattatttataccaattattataggccatttgttatatttataagatatatggtttgtttggacgatggaaaataaaaatgatttcccgccattaaaagataactttaagttctagccatccaattttaccacatcatttcatccaagccctcatttctctctttttttttttgagtaaatttcacaaaactacaggtattttgaccaaattatcacaaaactacagatttaaggagttatatcacaaaactacatatttaacaccaaatttatcacaaaactacatattttaggttaaatatcacaaaaatgcatatttaatattgaacttatcacaaaactacaacttttggagtttaaatccttagcacccttgttatggtggagctataaacattattactttgtgattaaattggttctaaacctgtagttttgtgataatttagttactaaacatgtagttttgtgatacttcatcttaaatgtgtagttttgtgataaatttagtgttaaatgtgtagttttgtgataatttagtcatactatctatagttttctgaaatttactctctttttttcatgtcccgttatcccaacagacccataatatttaattctttcctacagataagcaagtagattatccactagtttctcatcccatctgcattattttacctaaaaagagcagcactctgtgtaaacacctctctatctgttaccacctgtcaacctctgagagggagagtggcagtaaaggtggtggcttttgggagcaagtcctggggctgtatgatgatggcaaacaatgagtgtgcgtgtccgatgcttttgtcacgcactgaccgggtgatagtcgatggagggccggggcggtggtcgtcccggccggccgcccggtcggcagcgcctgcccgcggccgggctgcggctggactcgaggacacgcatgtttagcgagaaagcagcgaaaggtggccgcttttctttccaaccatggccaaatcacaatgattccttggttggccggccccccctctgcacgctttgcccgcgccatgcgcctttaatttcccacccccctgcctttttcaccacttcgccattacggtgaccaggtccaggctttgattacagccgtgacgaaacctgcgtaatcttgtgtacttttgggtgtgttctttctccctttcctaatttctatagtactagcttgctttttgtgcgtacgcttttcaaactattaaatattattataattgctttgaaatcatagtaatctattttaatttttttaattagtacttaattaattatatactgatctgtttcttttttacaagtgtgaaggattagtttataatccactatacgaacacagtattaccgtggcatttggcgcttcctaactccaaagcttgtaaacggtgattttcctaaaaagaaagttatataaaatattctttaaatactttttagaatatcttttacgtttataagagttaattattaatttgtttatactctcagataactatagaaaaatcatcaatttcagctatctcaagcagtgcctaactgcctacttacctgtggctctgggctgtcatttcgataggaaaggagaaagttctgtacttagtagtactagtagatggaagaactagtacattacttattacggaaaacaagttacgaattgctgctgattagctcgtgtgtgtatagtcgtcgtacgttgagtatgagtcaggtgcgtgaggtcttgtactcttgtgtatgatgtgtgtcatgacccttttctgaaagtcattcggtgtgccactactagtcagttcgccagagcatgtatggtggtactatggtatgatgctgaagttacatgatggtggtactcggtagtacttgggtataataatacattcttggtaaagagaggagttcatgattatgtatgtatgatcaccccattggcaccatgtattaccacgcaatcagttaaagcaactttaatttagccaagttggtattactacctgcaaatgctttggatttttcatgtattgaggtttcaaattaggctatatactgcaccacaaactacaaagtttacaaaaggaattacttctggccggtctcagcaaagcaaatggaagcttaagtttactgctaatctaatctaaagttgttcttcagaaaacaaaaatctaatgtaaagttgtctacctaaagttacatagagcaatgatccgggccatgtacatgtggatacatctatatgggcctttttgttgggccagctaagaacctttcggaatctgctttgacaaagacaggtgcttaggaacctggcgaaaattttatacttcacggcccacatatatagctacccaacatcttcttccccttctttttccactttatctttctccaaattttaacatgtcttctcctccttttgattaaaagtttacagcctctctgtttaggcttttgatgtaccctctcctaatctttttttttaccttctttttgatgggtaggcctcctaatcttaggtacagtgacagtgcagagtgtcacaagtgacatctagatctgcttttcttgccagctatagctgctgcaggcagctgtagctaacagtaattaagcttctgatggttctcatctaccctactttgtgtaggtaatagacatggtcaatttgactttcttgttgtccattccatggcagagcataacatggggcaccgggaccactgctgtgatgcaaccccctgctttcgtttttggttttctcggttctgaagtttgaacaaaagctgtagcagtgtaaccgattattaatctgcagaggctgcaatgcagttctaagtcaccaggttatcaaacagtaacagtaatagaactgcatctgcatagttagagacacaaatcctagcagtatagtacaatactgtagtggagtagtagttacagtgagcatcagagcatcagttgcaacttgcaagccaaacattcatcagttagatcagtctgccttagtaatcatgagtttgacaggcatttcatcatgccaagatatgattataataattctgtaatgcaaagtgtcacagccaaaataggacttttgtgcatattctcccactcaaacaaaagaagacataatatagtttggtgatcagaaagaacataaaaaaaatcagaattggtcacgtctaaggtggtgtttacatccagggacttaacttaagtccctgtctttagacactaatttagagtattaaatatagactacttacaaaactaattacataaataaaagctaattcacgagacaaattttttaagcctaattaatctataattagagaatgtttaatgtagcatcacataggctaatcatggattaattaggctcattagattcgtctcgcaaattagtccaagattatggataggttttattaatagtctatatttaatatttataattaattttcaaacatacaatgtgatagggacttaaaagttttagtcccatctaaacagggcctaagattataaccactagcactcaggccaggccaacaaactgtcacagcctcacaggaatgcagataggttactttttacttcacttggcccggtccatgtcccattcccggacggaaaactcttttaatcactactagtaagtggatatccacccgttgattattatatcacctgaatagttacaaaaatattttaaaaaataataaaatagatcaatatgtaatatatcactccacaaacatgtaagttaaaatttaactttctataaattgtaatgaaaataacaaataaaactcaaatcagtatagatatatttgcagttaaatttgttatttttgttaagactcttataaaatttgaatttgaacttacatgtttatagagtgatatattacatatcaatttatcttgttaatttttttaaaaattgtttcataatcatttagttgacataaaataaaaagatagacgttcactcacgtgattagaatccatctccgaccgaccgcacatacaaagaaactcctacttggcgcagaacggcggccaactccagtccaattctaacccgaggccccgccgctgcatgccaccatcggctttcccgccggtacggccttgcgcccagcagcatgcacatggacacatgcaattgcaaacgcagcgcgcatgtgcaacaacgcgagcagcaatatatgagtatctcatcaaatcgtacgcgcgcctgcatgcatatggccggagccgtgtcttcacggccggcgacaagccggcgagcacatggacgcacgtcgtcacgggtcgccacggcgcgcgtgagatcccccatgtacgtacactctctatatatacaaggacatcgattgacagtacacatcgtagcctgcatcaacgcagagatcgatcgatcacaagaacagtaataagctagctaccgcaccaacagttaataagacatggccggcgggaagaaggcggcggtggcggtgctgctcgtggtgatggtggttgtgtcgttgtcggcggtggcgccggcggccgccgcaggtgcgccgttcatggtgtgtggcgtggacgcggaccggatggcggcggattgcgggtcgtactgcagggccgggagcagggagcgggcgccgcggcgggagtgctgcgacgcggtgaggggcgccgacttcaagtgcctgtgcaagtaccgcgacgagctgcgggtcatgggcaacatcgacgccgcccgcgccatgcagatcccgtccaagtgccgcatcaagggcgcgcccaagtcgtgctagagatctagctagctagcttcagttacgagccaatagctagctagctaagctcccgacttaattaattagtttcaaataatcaatggtccagtaagatttgtactcaatatttgcttcttggtttgtcacagtatttcatttggtattgtcaaactatatactccctccgtccctaaatatttaacaccgttaacttttttaaacatgtttgatcgttcgtcttatttaaactacaacatatatatatatatacctagaatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatgatgcccgggcaccatggagcaccaaacaaatttactatatatatatatatatatatatatatatatatatcatggaactttttggtttgcagtatatatggggactgctatatcacgagatcgtgtttgaacaagataataacaactacatagactattagtgatatctattaagtatcgatacttgtgaggtattaaggaccttaataggtatcgaatgatatccatcggtactagatctagtaccccattggtacttgttgatacccgttaataccactcgatactcgtcgatatcaggatgatagcaattggtaccagacctgaggaagagagagaagaaggaagccacgacattgtcggtagggctaggtcaagagcctaggacaactcaaggatgacgaatagcctgggaggaggagcaactaggaggcgaagaggatgtcggtaatgacgaggagctcgctattgcacataaggagcggatctaccttgacaatgcgctttgcaaactacttgcaaccaacgaggagcttccccatgatctccaaccaactgcatatttacaaaccatatatatcagtattatgcctgtttcaatttgtacatgtcaaattaaacctatatatttgtagaatttgtagagtgatgtgtcattgatatgcattgaaaaccttttataaactattaagaccacacaaacgataactcatctccttaagagacaatgataacttatcaccgtcagcacccacaggagtgatagatccgcccagtccaaggatgacgggagtggcggtctcggactgggcagatccgccgccagtgcccataggagtggaagatctacccagtccgaagacggtgggtgtgatagcggtggcctcggatggcgggagcaacctcgaactaagtggatccgccatgggatagcggtggcccattggagcggttgatccgcccaatgggagcggttgatccgcccaatccgaccggcagctggaacgacgatggcggtgccggctgtgacaacgacgacggccacggtgacgacttcaggtgcaacggtaatgatggtggctttggctgtggcgatgatggtggtggctccgatgacgttggtagcttcaggagctatggtttcgactgaattagttttttggaattttattttttttcactgaaattgttttcacagacagacaacatatgtgcccacgtacgaaaaccccatatttgcacgctgttgcgcgcgctgcatatatgaaaatgtgttgattttggaatacacctaaatgcagctggctgcgcatcacccacatatgaaaatggattttggtcatctgcgaaaatcgtttttaagtagtaccctacctttttagcgatttctgctccgtcctgctgctaccgcgtacatatacagtaccgcctgaatctggtggccgccgcacgttccattcgcgccgaccatgaattaacttgttctaacaccgcgccgtccttgctctgatcgaagctctgaacaccacccagccagccggtcggtcgacgaacctgggtaaataacagccacttgatccacacaagatggcactccacacagatacgtccaactaaaattccagcctcctccgtcttgcccattggctgattggcttcgcgctgcagtcctcacatagggcatgtttgtgcagcttctaagcagcttttcatccagattctgagaagctgtagttataaaatttaaaaaatgaactaaaagccaaaagcggagaaactcagcttttctagattatgataagctggctactaatcagctgcttctcagaatattaagctctctaaatatgccgatagagtactgtaccgtaatacagacatgcatttcaccgtacgtgcctgcagtagcagacatgcacatgtacagatgtactagcgcagttgcgctacctgcatgcgtatatacgaccgtgtgcatgcatatgcatggcccgggaatccacggcgtctcgtgaacgtgccgacgcgatttgatctgagctttgcccatgagtccgtgacatagctagctaatggagacaaagctagcgcgcgagcacatgcacgtcacgggccgcgctaacttacccccacgctatataagccgaccgtatatagccatcttagctacgtaccacacaacgtacacacgacgaacccccacgacgcacttagctaagctagcgtatagtctctgatcgatccgatctccgacgacgacgacgacgatggccggtaaagtaagcgcggtggtgctggtggcgttggtggtggtggcggcggcggcgggcggcgcggccgggctgtcgatgtgcggcgtcgaccggtcggccgtggcgctgtgccggtcgtactgcacggtggggagcgcggagaaggcgccgacgaaggagtgctgcaaggcggtggcgaacgccgacttccagtgcctctgcgaccgcagggacatgctccgcaacctggagaacatcgacgccgaccgcgccacgcagatcccgtccaagtgcggcgtccccggggcctcctccagctgcaagtaatttacattaggtgatcgagatgatcactctagctagccagctgcaaaatcacactctagctagctagatgatcgatgatcgatgatcactagtgtgtttctagtggttaaataagtattgttggttggttaattaggggggggctaagtatgtgatcgatcgattgctagtagtggccgtgttatgtcaggccatcgtcgcgtcagctggatcttattttgttctgttgttttgagtagttcacgttctgaatgtcgccaggctagctgacatgtgctcgtgttgctcttgcatatatgcatggcgcagtctgcctgtctctatgtatcaatcttgtgattctcttgtacgtcattgctgtgtgtctaccttaatcgtgttctcataataaattttgctgcttgttttgatctaataattttgctatcttgtatatctgaaattggcccaggaagcattactgattaaacaatggcgagattaattggatgtttcagttggctaaaatcaaaattttcccatttttgcatgaatttatcaaaattcttgtttccatatataatttcttcgtgacatgcaacgtaagaaaatcataaggtatttagtagcagcaacataagaagaagaaatcaattccttggaatttccccaaatgtgttgtctaaaataaatttgcatggaattttcttttgataatctctaccaaattgcatgaaattcttgagatttctgatctctgaaatttcagaatgccccaaaatttggaacatcagttatgggcgaaaattcattatgtgtccatgaaattgtgaccaatcccttctatacctccaagttttgtccacttccttatatgcattttttttttttgtgcatcacttccttatatgcatttgaatgttggttttgatcccttttggacccattttgttagtagaccatttaattcctataaaactgttcattttgtccttatgtataaagaaatatgaaattttgtatagtttattgttgttggaagtatataaggttgttatagaagactattatattcatgacttcattgcacgaggtatattcatggtaatgtttatttttacatattgatagaaaaggtttaatatttattttatttctttattaaaagagtatgcgcagtatatttgtgtgatgctagttttgttgaatattatatgaaaggaatgctatccaaaactatgtttaccattttagaaaatgctctctctctctctctctctctctatatatatatatatatatatatatatatatatatatatatatatatatatatatatatatatatatatatatatatatatataatattatataaaacttcgatgtataatactttctcatacaacaaacttatgaatattacaaccacacaacaaattactatattcccaataatagatacaaatttctacatactccttgcacgtccaaggttaaaagcgatattttttacactattaaacagacaactaatggtgaattgatgggaaggctgtggaagggatcaaaaccaaaatataggagtatacaaaggagtgaagaaaattcaagggtatagaaaagattggctaagatttaagaggaattgaaggaattatctctttttctatttgttggaagcatgtaaaacacctactacttctgtgcaatcctattaattgggccagcacatggacacggggggaaggaaagatgtccccaatctcccaacatggacctattgactgttgaaaaataactcactcgtgtcctccagattaaggggatctctagaacgatgtgctatcactcgtaaccttgtaacaaattggttaggcccactatgcatgttgttcattgatagggcccatagtcaatggacaatgctacaagcctacaatggctcgattcgaagagcgtatggcacaggatttaccaggaatacatacttgcgaggtaatttataaaatgtatctctacaagtccaaagtctatgagtatgtccttcgatgtcgttgagacgttgattgtaaactcaagttgagacgttgttacatagaagtaacggactcaacatcaagcaattcataatgaactaaggccctatttgtttcagcttatgattattataatctagattattaagccagattactataagctggattataataagctagcatagaataagctgtgagttgtttgtttgtctggattattgaaggcatggattattgggtttgaaaagctaaagtctataatgccctcaactatatgttcggttgatggcataggtgggtaatttttctcaagtatgtaggggtagtgggtctttagccactcaataatctgaaaaaagctcctctagagcagcttatcagattataataatctgctataataatctacttgtttgtttcagtttactcctaataagctagattataataatcctaagctgaatcaaacagggcctaaatatcatgaaatcccttggagtacccatatgatgaaatctcctttgatgtcgactgggcactctctctcttttggagctcctctccttctctgtggcgagctatatgcctatataggtagagtggagaagatggtcggtcaatagcgaaaggctcgggctaccaagacgatatcgcctaattctagactctccttggctagatctggcaaggtggctagtagacagcgggtggggcggaggagacctaagctagtgcacaaaagtggcgacagggtgcgctggtggtcttgttggtggtaggactagaaatcagcccgcggaagggtgttggtttggtgtggtggagggcgcatgctgtgaacatttggatggtggagcctaagatagtgagtgacataccacaatgatacgattgtacagggttccaagcgaaagcctaggctgatgatttgttgggctaatagcgggtacacctttgggcatggtaatccccttgtggcactgttgaggtacctccttcctccctatcttgacaagaatttttaagtgaaaaccatgtctaggttccttggatgggtgacggcagcatccttggcatcgcaaccttcgtggtgactttttttttggagactccgctatgtggctatgtggtactgttgtaggcctaacgacaatcggccatgcatagcgatgacaggtttggtgcctgactcccctcttagtagcatgtgtttgtgtggttggcacatggttcctaggtgtaccaactgcccacgtgtgctctggtacatgaacaatctcaatagccttctgttgattacagtatttcttgaaactttttccctcgatcttaataacatttggattgagcactgataatctattagactttgttcgacaggatcctcaaatttgacaaggacctccgtggtaaccttgagttagatccagtgaagcaaccaacatttctgcgactcaactctaaatctcaattagtgccgaatccgtgaaagtagccataggaatcgttgacatgtcaagagggaagcacgtctatagaggccctagaatatgatagtcgcggcaatgccacaagtccccaacgattgcatcttttattggtgcatggttctccatgcaatctggaattttgcttccttcattcagtgtttttagaaggatggttctccaagtttattggtgtaatccttttgctaggcgatgtatcagggaatatatttcccgcttatatactttttcctcaagctttaaatacattttatgagtcctagaaaaaaaatatttggatgcctttttcttacgggttgattccgtcatcccgtaaggttacaccacgctattctagttacagaaagaatacttcgagggtctacctatagtgttcctttcttcctaaaaaaagcctcctatatatttggcgaatatttttaatactgaactgtaattaacgcgtagtgttaattagtgtaactttcggtactagatcatattcttaggtgctagaagggacacgtacctgcagggccgtgaagaaccccagttgggggaaccacagccaatcatctctgactcatcccagcaaccgtgaatcagctcagggaaaaactgcggaaaaacgtaatcacatatcaatgtcctatgctagtagcctgtggttgtgcaacatttcagcactctacgacatgcagaatcagacaaaaagggaaagaaggcaagtccctacaggcttcaacgcgtgaactcgaccataaaattcagtaacttctcacaggcagtaagaatttttacgcaccgaatgcttcattgcgtgcaaacatgccctgacctggaaaatcagaagcttgcagtccgcttgaaaaaacaatattgttgttagtttgaccaagtttagatccagttgctgtctcgtgactcggtgaccatcaccagcatctcctagtggtgactgcttcggaactgaaagcaacaagagctaaacattgcccatatccaccacgaccaacatctttagaaaaagaaatagactgatgcaccgcagatcagagcttccatcaattgctttctgcaagatatccaaactgttcatagtacggctctgatagtctgattctctgaatgttgtcccaagatccaggtgcagcccatgccgtcgtgtaacaggcggtaagtgccagtgatgaacaaacaagaggtaaccggccgcagaaagccagaaatgcaagaaccaagcatctccgtctcattgctttctcgcccatcctctgccaccccaatagtgcactgcatacaacttttatataaccagatgacacgccgtgcctgaatgcttctgcatcttcttttactgaataagttccaccgctgcttagattcgctgactgtatccgctgctcggatgttccatgattgctacaaataattgtcccctctttctacatgccctagttctgtagaacaaaaagaacaaagagggtgaattaaatggccaaaaaagcatgatatttgactattcatgttcaaaatgaagcaaataattacagaaaatacgatgcagaagagcacatgtataacggacaaggtggtgcaattgaaataatgcaagtttcagacacctctgctgtgattttatcctgtgtgcgcgtgcataccagggagatgagccatctggtggtctccgcagtccccactgctccccttctcgctatacaacactgtctgcatggtatggcacagggatatgcatatgcctggcatgagcagagccacaggggtgggcaggcacacacacaagagccattgcaccagcctccgatttatatagtctccagcatttgctccccttgtgttgcttctctaatccaggcacaccaccatcctcccattctctatccatttgtttgaagaagggttatggccaatgcttgccccacatctaccacaagctccttgcccctcttcttcctcttctgtttcctgctcttcagtcatgctcgttgcaatcaagggcaccatggcagcatctcaggtacccctttgcatcagattgatatcttgtcttttcttctgttctcctgcatctattaactgtgatttaggttgacatgataaaacctatgtatttaaatgtttcaatttcatatgatgtcaaggtacagactatggagaacaatatcctcaccaaacattacctgaagaacatatacatttgcaggagaacatcaaggtacatatgccatcttgctattacaaagtatgtaattaattgagttttgtgtttttctgttcctcaagtatgttttcttaaaactttagttttatgttttattatgttcattatatatgtcaaggaaaaaagctttcccccaactgtcagcttccttggcgcataccatatagttctggatggacttttcagtaggaagaaatggttgcatctatcaactgtgcactgcttggcatcttttgctaggatgagaaaatgattggtagcaacttgcctcccatcttttctcctaaagtagtatgaaaagacttaagaacaagaccaaacaaacatgaatgccaaagttaaatcagaaagtatgtaaatatctggaagatactatggttaagatgatcttcaaatgtatgccattaggttctaaacaaggagaggctgcccaaatatgcaaggagaatgttgattggttcgactgctccaatatgcacatacaacgagtgcagagggtgtcgattcaagtgtactgccgagcaggtcccagtggatgcaaatgaccccatgaatagtgcttaccactacaaatgtgtttgccacaggtgatcattaataattaagaggagcttctgttatgagtagtagtttgcatccattttattctctttttcccccttctacccttctaggctcaaaaggttcattttttccccttttgttttaacaagtggccagctagtagaggattagagggcattttgtattttaagatgttcaggttgtggactggtaattttggaagtaaatgttaaaaaatttgaaaaacagcttatttatactattgtgcagacaaaatgttccttgcttacgtattgcaccactgtttttagtctatgaacaaacctcgatagagttgtctgccagaatagccttggagctctcagctggatcatctggaactagtggtctgcaactgtgctagcctttcaaggcatataaatgtggtaaatgttctattgcatttgaaatttctcagtaccttcttcattctgggctgcttcagctctcatgggcttttgtcattcgtctttccatagtaacaaccatctgtacaatgagcagtaaattcatctagacaaatcacagaagaagttaaccaagagtaagggtaagcaataaagaagactttcgtgcagaccacactccttcattgaagtagacattgcattctaaattcaatcgagcagatatgtatgaggaaattgccaagactcagacaatcacatgcacactgaccttaaagttaccaagtaaacttatcaatagtattccagtaaaaagaatcaatagtagttcaaaaatatcaattgaaaccgtttcagtccaaacagggcatttattttgcaagcagagagcttgcagaggtgccttgtatttattcaacaaaatatttttagaggaattgtcttggtaagaaacacttattagctaacttcttttactggaggtgtaaggacaagagtaactcatgcttattagaggatactgacaaacgtagtcacattcagacagtactttccttttgcaagaagtgttctcttcagttttttttacccaagtcacataaattactacagtcttttataagccactgctcacccaatatactccgtagaagttttgcttgtgcatgagtgtgtgacatgactgtcaagctgcggctgcaactagagtgagacgagcaggtagcagaactatggtgatttgactgattggccacctaggatggctacgccaggtcttgtataatctatatatatggtttaccgaacaccgagatatgcacagataattatggtgttttatggtgtctgcttgaacattattcaattagtgaacaaaggaactggtgagcatgtgtccaaagaaatatatagtaatgtctcagttgactgaaaaacttcataacttcctagttcttatgcacacaaaaatcaaaagcccttctgggtgggagtgggacacatatactaattcttttattcagttggtaataggatacttgaagtcttgagctaagaaatagactgagcaactatttcaaacatggccagctcctatagtgtgacaggtgatgtgtacaagcccccagaactcaactttataaatggtcagccttgcagcaatggagacaaactctgcaagcaagtaaatcacactatttctgaccgattacatgtgaagataataacttcaacacaataacacatattcctattgtagcttcaaaaattcaagtggcttaaggaccagcattgctaatctcataatgagaaaaaaaggaaaatactagtagagtggtattctgagagtgacacaagagggaagatgcatatggtacaaggaacgaaagctgccacttagtggcctgtggctctaccgctccagtgctaccctttggaggtaccgtggtagaatgaggtcaccatttttcttaagaataggtcgtagttgctttctgtgaggtggtcctgcgtgcaaggaagaaggcattcacatggaagcaagcaggaggatccatctcgagctgttttgttttgcatgacagaagatggcagaatggtcccagtacgttggcacacgggtcatgcaccaaggttgacgtgaccacaacaccaagcatcatagccttgcaggctgtagcacctccgtatctccatggtgttcataattgttagtgccactaaaatataccctaaattagaatatgcttctagatcaggagcatacaggacaggctaattattttgacatcacgagtagatattctgggaaaagggatgtcatggaatagaagagatgtgtcatgcggaagcaaatcataggattggcgcaagctcaatggcataagaggttttctcatgtctaaatgtcagttactactatattttgcatgcggctaaattccattttcatcaacaataattagatggaatgtagaaaggaaaggaaagtaacttacagtattatatgcatattattcgacaccttcagccttaattccaacaaagtaaaaagatcaacgcagcagaggttcagactttagaggcttcttagtcaggattgaaattgtggttcagcctgaaatcatttcaaaaaatttcatgatcagaaagctgcagaaccacgctttttcaatatacccactgagacagatttcatagtaaacattagcaggatcatagcttcttagctcaaccatatgtttctagtacatatggaatctgaaaaataaaatgctatttaccatgtgaaagtaaaaaagaaacagatacgatggatcactccatggatgccaaagaactatatatgtttgggaactttgaatgagcctgcaactgaatcaagcaaaatgaaaaaaacaaagagcaccactatctgagtaactaagcgcctgcttgggctggaaaaacttatactatagtttgcttccatcagggtgcttaactacctggtacgattttcaaccttgtcgcaatctccaagttccttggcgaaaaaagccaaagttccaaacctccaaaacaacacttcatgttcctgaaccaaggaagccgggtaataatcaggagaactaactggaatacgaacacaaaaaagggcaacacagtacgtacttggataccttttcagtttgacttatcaagaaactcacaatggcaaacactcatcgttcagcttcagggggaaaaaaagcttaacaaactgggatataatgatgtttcaaaagctccctccagaattatagcgtcccatgtcaagaatgtcaaatcaatgaacagacacgataacaaaggatttggcacatttggtacacaacaaaggatcaaatagatgctgctatgttagataaattccacagcgtcaagtaaatttcctccttgtggggatgtgaactacctccattcacaaactcatgaatttgtccatccacctcaatcacactccgtccaatgttctttttcataccctcagcactcatcaacttcctaatcctgaaaacatcatcccacattccttcatcagcatagatattggacagaagaacatagactccagagtcatctgctccgagactggccagacgctcaactgatagctcagccagctccacacacctatggcttcggcaggaagcaagaagagatccccataattcaggagtcggttccatcggcattgtctctattgtgtttctagcctgatccactcgtccagcacggccaaggagatcaatcaatgcaccataatgttccaccttaggttctagtcctaaatccttctccattctgtaaaatatccccaaaccctctgagactaacccagcatgcgtgcaagaagtcaacacagcaagtatgctaagatcatccattggtgccctttcagtttccatttggttaaaaagcttgatggcatcaagtccataaccatgagttccaagtccaacaatcatcacattccaagtgaccacactcttcttgggcatgctttcaaagatcaatttggcaagatccaaacgaccgcatttcacgtacatatctatcaaagctgtttgcaccacaacatcgaacaacaccttcttcttctccaagtatgagtgcagccacctgccttgctccagagctcccagctgtgcacaagctgcaacagccccaactgcagctactctatcaggcttgataccacatcttagcatcctctggaaaaactccaaagcttcatttggctccccgaatctgacatagccatcgatgacaatactccatgagatcacattcctctcaggcatctcctcgaacagaaccctcgcttcatccattctcccatgcctggcataaccatcaatcatggagttccagcacaccaaatccctgtcaggcatttgatcaaacaactcacgtgcacgatctacaccacctgccatctctccgtacccatcgatcatggtggcccaggagaacgcatccctctgccgcatttcgtcgaacaaatcctgcgccagatccacctccccacacccaacgtaccccgccaccatagagttccaggagacgaggtcccgcacgccgtgatcgaacaccttcctcccggaacggcagtccccgatcctgcagtagaagctaatcagcgcgttcctcgtgaacaggtcggcgtccaaccccgtcctcaccgcctcgccgtgcaccaccaaccccaccctacacccgggcgcgcagccgcacgccttgagcacggccgggaacgtgtaggcgtcgggcgccacggcggctcgccgcatgcgcgagaagtagaggagggatctccgcgggctcgcggcggcgtggaggcggacgagggtgttccaggggaacgcgtggcgggaggcttcctccgcgaggtgggcgaagacggagtcggcgtggtcggcggcggagggggaggcggaggcggaggcgagggcgaggaggaggaggttggagaggcgggccggggaggcggcgaggtggccggaggtgaggaggagggcgtggcactggagcgcgtgggaggcggagctgcaggcgcggaggcgggagaggagcgtggcgagggcgtgaggaggacgacgacgagacatggcaaagtttgatttgggacgacgaggaagcagttacaaaacgactcgtttgtacatgaactctagcctcggcccctgggtcattttccagatgggccgtacctaaaatgatcagttgggccgaaaagaagggcaattatggttcattttgaatttcttgattcaaaaatggtagtggtggacatgctgcactctcatgtgtaaatgttactgctagctacttaaagtttactacatccgtcctagaatataacaacttttagctataaatctgaacacacagttgttcagattcatagctaaaaatatttacattttgggacggatggagtacttaagggcagtagccagtagattagaggatcaggttccattcagagtgtatgaatcgctgttggttcttatagaaaacaaaactgatttatgtcaaattctagtgagaatactgtgaatttcatggttccatctagagaattagccctgattataatgtgagactttgcattgactaataaaatacctgcttgttataacggatttctaattatatgtcttaagttgttagcttaaaaatactcagaaaaaaaacatatagaattacaagcaaatatccaaccaaaaagtttaagccacatgcacaaaaagaccatttatccatccttaaaaaatcatatcaactctagatgatgttagattcatcatcatcactagattattttacatagtagatatacggaagatggattgtttggtgtgaaattcttgcggaatttgtacgaaactcataaacccgcacgtttacatgggtaatatagatttagggacaattcagattaataccatttcaaatcataccaagttgtcaacgatgtacatacattaatttttttccaaactttgataaatactacataaaaaattctgtcgaaattttaataatatcatcgaggtttattttggatacaaaccctcaatgaagtcaggaatttatcgttggtttgtatatctttaagcgcgatgtccacagtgcaaacttggatgttagagtactttacggtgttcacgttgaaagacgagagaaagacgcttcgatttagagttgacggggcgcgggaacataggggccggatgaatccacagccaccccccagttatagtataggcaatgagcgcgggaggcgaccgacgcatgcagcttccctcgtcggggaagacgacgtacgaccccgacgtactacgcgcccacgcacgcacgacgggacggccggcctcctcacctcgctcgctcgcgccgcgccgctcgccggcaaatccaccacgccatggcgttccctgcaccctcctcctcctcccctcgccgccgcggccgcggcctcgcctacctcctcgtctccgtcctcctgctcgcgtcccgcgtgccgggcgccgccggcgcggactcggagttcgaggacggcgtctcgcccaagttccccggctgcgacaaccccttccagaaggtaagtaaatcgccgcgtcgatctcgtcggagaggaaggagatgacgatcgatcgtacgtgacggtggcatgcgcgtgtgtgcaggtgaaggtgacgtactgggtggacggcgacgagaggagcagcctgaccgggatcacggcgaggttcggcgaggtgctgccggccaccggctccgacggcgacaagcggaaggccgtggtccccgccccgaagaccggctgcgccaagtcatccgcgccgcttgctagctccattgccgtggcggagcgcggggagtgcacgttcctggagaaggccaagacggcggagtccggcggcgccgccgcgctgctcctcatcaacgacgaggacggtcagtacgtgtagtttttaaccgaacgactgcatttccatcgtgcattgtgcataccatgaaagtaattaacattgagaaattttatggtacttaaaaaaaatcctgagatacctaaaaatttggtacttagagatatcagtgtctcaggatatcaaattttacactaaaaaatatggtatcctccaatatttttttaaatggtaaaattatccaattaacattagggttcttcgtgtagatttgcagaagatggtgtgcacccagaacgacacggtccctaacattggcatcccggtcgtgatggtatcccagtctgccggtcgcaagatcctctccggcatggacggtggggcaaagggtgagaggctgaaaaaaagaattagtctgtcgagaagctgaattcatttcttgctgctgtttttgtgaaccatatgcttctgattttgcttaatttgcagttgacattctgatgtatgcgccggagaagccgagtttcgatggcgctatacctttcctctggctgatggccgtcggcagcgtggcctgtgcgtccgtttggtccttcgtcgtcgtcggcgacgaggtatatcaatcaatccacaaaaaatacgtttcagaagtttaattttataaattacgagtattatacgttttttgcagaagaaaaagagtgagacaaaatgcatcgatcatgtcacatcacatgcatttttcactgaaacgaatggcgcgaatttaaaatatgactttgatatggcggcgatattatttggtccaggataagaatgctcctacactgggtggagaagaagctgctgactctgaaatcgtggagctgcagaccaaaaccgcgctcgtgttcatcgtcaccgcgtcgcttgtcctgctgttcctgttcttcttcaaatccacctggtctgcatggctgctggttgtgctgttctgcctcagtggtctccaggtgcatggcaattgcctactcaatctgacatagtttggttcagttaatcagtaaactaactaatactgtatagctttgtttcatatcttctcttgacggatcctttgtttttcagggattgcactatgttgcctcgactctaattgtaaggtgtgatcactgaaaccatgcaaccttttgtatcatcgcaccattgattctgaatttctgatagtgctattacttgcttgctggtctaactgctgcaaagttgattgacagaacttgtgatcggtgccgcgaagcaaaagtagctcttcctgtattagggaacgtgacagtggttacacttgtcatcctaccactagctttgatcttcgttgtcgtttgggctgtacaccagaattcaccgtttgcttgggttggtcaggatcttatggtatggtttgttgtgtgcaccaggtacagtgcaatgatgatttccttgtcatgtttgctcatggattgttccttttcattcagggcatctgcatgatgattcttgtattgcaagtggtccatctgccaaatatcaaagtgagatcatcaagaacatatgatgccttggtttagtaaatatggcaattgtaatcatcttttgtacactgatgtacttgagattattttcaggttgcaacagcgcttcttgtgagcgctttcatgtatgacattttttgggtgttcatatcacctttcatattcaagaaaagtgtcatgatcacagtaagtttgtttctgacaaagtgcaaataatgcaaatattagtgcaaaaatatcctaatccaattggtatgggcatacaggttgctcgtggtagcgatgagggacctagccttcccatggttctgaagatgccaaaggagtttgatacatggaatggctatgacatgatcggatttggggacattcttttcccaggactacttgttgctttcagtttcaggtcaaaaccaagattttgttctctgaatccgtcaatgcattcagttaatatcagagtctactggatacttctagtgatcaactgttcattctcctgaaaatttaccgttatttttcaagataatatttacctactgttcttgagttgcaggtatgacagagcaaatggaaaggacttgactgacggctatttcctctgcctaatgatcggttacgccttcggtacgtaatattatccgcatttctgaatcacagaagaacaaaatcattgacatcaattatcaacactgtcatctcaatgcaggtttgtcatgcacatatgttggcctgtacctaatgaagagtggacagccagctctcctctacctagtcccatcaacactaggtatcacatcgattcctctgctgagattttagtacagaaatcttgagctccaacacctgtttcttctctgaaattatgcaggaactattgtcacgctaggtgcgaaaagaggagagctaagtcagctctggaatgctaaagtatagcttgtgaaatattgatacttgcttgcagtcttgcagcattgtactagttagagaagcgatcattgatctgtatatgagaatatctgatggttgttggtaaatatatcatgccaaccatctgcacgaactttggttagatttcttttttcagtgtacacttaccatgaatggtggttattagtgcgaagcagtatgctctggctgtaaatgtcatggctgtgatgtaaatgtgaacagaattatattctctgtgtcttgatgtgttcttagctgggtgtaatataaaaaatccactttgtttcagaaacttcagatgttgctcaagtatctgtactccggtgttcctttcttctcgactgtaattttaagtgtcgtcaaattgaactttacaaaagggcaagagatctgcgcagatcccaatgctcagtaggttatctgcattgcagtcatcgtacgatagcacatgaactcgaccgtaaacgctaagatagtgcatgggtgtcattacgtttgattcttagcagtttgcaagaccaagctctctacgctcccctttcgtttttcgcgcgcacattttttaaactgttgcatagtgtgtttttttaaaaaagtttctatatgaaagttgtttttaaaaaaatcatatttatccattttcttaaaaaaattagctaatacttaattaatcatgtgctaatggactgctccgttttccgtgccggagggaagtgtttcccaaccaagagtagcgaacacatacaacatagtaaatcaatcgcgatgtttaaccaacttccaaaaaagaaaaaatagagggagtacaaacgatgaacgggccaagaatattggatctatatatgctccctctactttttaaatagatgacgctattaacttttacacacatatttgaccattcgttttatttaaaaattatgtaaatacgtaagatatatatcatacttaaattacttttaatgataaaaaaaatcataataaaataagtattaattattgaaatttttttgtcaaacacgtgttaaaaaacagatatagtatgtacacctcagtctttaagaaaaagataaatgcatattctgaatagatattcaggtttcattgctagaattgagtatttcgagtaaagtccattaccggtccctaaacttgtaccgttgtgtcatcccgatccctaaactcacaaatcaaccgtttaggtcctcaaacttgtttgactgtgtcatcccggtcactcgtttaggcccttcaacttgttcagttgtgtcaccccggtccctaaacttggatttgaatatcatttgggtcaaataggacggtaaagactttatatttaaaaataattcataactttttcatgtgaactctaatgaagacaaactttatatcaaacttgtagccctcgacgcaatctacaactttgtagttgattttttttattttaagtcattttggtcccgaaatgtaattttaaattaaaatttcaaaatatataaacatgcaacaatattttgtgaccctaaacagttttatttcaaaaacttttcaactacaaagttgtatgtcgcgtcgagggctataattttgatataaagtttgtcttcattagagttcacatgaaaaagctatgaattattttttgatataaagtctttagaccgtcttgtttatgcaccgaggtaacacaactggaaaagttggaggacctaaacgagtgatctgcaagtttagggaccgagatgacatagtcgaacaagtttgaggatctgaacgatcgatttgcgagtttagggaccgggatgacacaacggtgcaagtttagagaccggtgatggtctttactcgagtattttttatggagggagtacatgtatggacagacactgtatgaatgatgtatgtattgtatgttcgtactgtacaacgcaccggatgtccagagtcgtccgatccccatccaagcgcgtggaacagcaccaacgtgaatgcgagcgtgagtggatcagtggaaatgtatgttcgcatctgcgcgtcgagtccaattttgtgagcgaaaacaacccttaagattcagaaaatagcccattttgggccctctagcagttcttccttccgttccttccctctatctatcctccgcctcgtcctcgccacgcgcgaaggcggcgtcgatcggttcccccatttttctcatcgatccctcgtggcctcctccccgccgccgcgccacctcgtctcgaaggtattctttgtcccaaaaccgcctccttcgccgacgagccggtgtagggtggagatccaacttgtatttcatttctttttgttgggatgaactcctaggccatagcatccttggattgtctagggagttctgctccggtcttgtttgtttatgttttgtggggaggaatttttgtgtcgaattcttctttgctactacgcgattaatccgtcctttcttggtttgcagatttctttgatgcgtggtggcagtggcgtttggatcttggtgccgccatgagtccgccggggaggaaggccccggccggtgcgggcgggatccgtcggtggctctccaccgtcgtcgtgtcggtggtggctcttgtgctaaccctagtagtgatatcgctatcggtgggctcgtctctgaccggggcatcgctacacgagtacctctttgtcagacctagtgattcatccaagcttactgatgggaacatgaatggtactgccgttggtgttccattacaagaggaagtgttgcagggtggcaaggaagtacccgtggagcacggtgttcagagtggcggcgtgaattcgagcgagacgggtgaaatcgataccaaagtacaagatccagttgttaccgatgataccgcgtcagtgcctgatgagagaaatctccctgtctcatcggattcatccgacaatcttcagaagactaatgaaggtgcggtgttagtacactttcctgtttgttttctcggcagcactgactaacatgaatgagatattgttttcttgctattttagtgtaatggcttgtttgattattcatgataattgaatgactgggataaaaaatggtatggtgtaattgtacaggtagctgtgatctataccatggacattgggtttttgattcttctggaccactatacacaaacaactcttgcccgatcatcacgcagatgcagaattgtcaaggaaatggtcgacctgataaggattatgaaaattatagatggaaaccagaacagtgcatcctaccacgctttgatggaccaaagttcctggagttgatgagaggcaagacaattgcatttgttggtgattcagttgccagaaatcagatggaatccctcctctgcattctgtggcaggtgctgatactattcatgattttcttttggccatatgattagttaagctgatgacaagttgcccattactatatatgacaattttttgttgacctggatattgattattaacttaaaatactaggcatttttgttattcatgtgagttaggtttgttacaaacttgtggatgacaccatgaatttttttatatagttttgtgatgttcataacaacattatttcgatttatttaaaataaatggagaaagggtcaaagtcatttgttctacatgatttgtttttaaattggtgaaatctacttattttgtagtacatctgtcagccaagttttttgctcgagatactgcaactgtattggctggtgtgggttcagttgctggattattgatgttgtctgatatcaactagagaaaccaatgctgtcctgttgcaatctgacactgtaccaatcctatggtttctagaagaaaactgttttagagtttagatttcaatcggctctttgttttctcaatgtggacaaatttaggatattgcaagattagcctattgaaaatgcctaccaaagcatcagaacagcagctaataagcagaagaatgcaaatcaatgtcctgtagtacatgatagtcttttatagataagaaactgtatgagttagaattgctttgtgaactaatagcataccttgtggtctcacgtaggaaattttatgaagattgaagcagataccatgtttattacttttccttatcatgcagcagagtcttgtttttcaaacatctgattgagaaatcttttgtcgttatatagtggaacacatctggttgggctttcctccttacagtagcagaaatgtctcacaaagatcaacctatacctcttttcctatgttaaatgattttgtaggctatgtcattaagagacatgatctgttcttttaccttctttttggcaggtagaggccccagtaaaccgtggtagccgcaggatgagcaagtggatttttaggtcaacctcaacaattatcgtccgcatctggtcgtcttggttagtgcacaggtcaactgaagctgtggggtttgctcctaagggtatcgataaggttttcctggatatcccggatgagacctttatggaatttatcccacgttttgatgtgcttgtcctctcctctgggcactggtttgccaaacggtctgcttatatcctgaatggcaatgttgttggagggcagctctggtggcctcgtaaagctggaaatatgcagatcaacaatgttgatgcttttggtatatctgttgagacatgcctaactgctctagctaccaatccaaatttcacaggtatagctatcgtgcgcacatattcaccagatcattatgaaggtggggcttggaataccggtggatcatgcactggaaagactaagcccttggatgtggtggtgaggaatggattcacggacaccatgtatggaaagcaggtttcagggttcacaaaagcagtgcagaattctgggaaacatggttccaggttgaaattgatggacatcactgagccctttgccctgaggcctgatgggcatcctggtccatatagaagtactgacccaaacaagaagacgcaaagaggtccagatggaaggcctccacctcaggattgcctacattggtgcatgccaggacctgtagatacatggaatgagatgttgctagagaccatacgaagagagttcgagggagtgagaagctgaagaaaaacactcattggctgcttgatttctatcatgtgatacgacctgcaaaaactaattaagcttctagcattggtgtatacctcattacatatcgtgttgttgttctcccacagataggaaggaaatatagcttttggttggacaaaaaaacaaattgtaggcatgttgtca

SEQ ID NO: 44947 - DNA, 2592 bp, Oryza sativa
tttcgaaaatatttggtacaactcaaacttcacgggataagaaacatatattctctccgtttcatattataacttgttttcttagttaaagtttttagtttggcctagtttatagaaaaaaaaaacttctacatcataatgttaaatatattctgatacaatatttattttgtattaaaacgttactatatttagctacaaacattatcaaatttaagaaagtttgacttaaaaaaagatcaaactgacttatgatatgaaacaaaggggaaactaaatggccccctagggaccgggctctgttcgcaagagctgttcccaacctaaacagtatgcacggaaaatggaaccgatcctctagcacgtgattaattaaatatttgcttgggaactggctcttgcggacatagcccaaatcgagtagtgtgttagttctaggcccaacgtttctacggctaaaagcctgccagaatatggcccaaatttaacaaagttctaggacgagatgggctcagttcagaaggaagtcagaaacacacctccccttccacttccacttccacttccaccgacgagagcgacgcggcggcgcggcgccggctgcccacaccacacactcctccctgctcctcttcctcctccccgcatccgccatggcccatggccaatcccttgcccagttgcccccgtgcctcgccgtcccgctcgcccgcgtccgggaagccatcgtcggagggggggtaactcaatgcgacataggtagatctgcaggcgccgtgctgggactacgaggagacggccgcggcggcggccacctttgccccgcctcgacggggaacctgctctacgtcttctccaggtcccctatgcgaactttccactactatttcgactcttcgtgtattcgttaatccttaccaagttaccgtaacctaaaattatggtaaagcatcatcatattgttttttttttgtacatacatttttcgctgtagccgttttggcagaatagattggacttgatggcattacggggtagcgaaactcttgaagcatgttcattaagcaaaacatggatgcatattgttacttgttaggtgttcactgtttgtattataatgtacatcgatatatattgttacttgttagatgttcactgtttgtattataatgtacatcgatatatcttgatgtgcatatatgtcaatgattccatgtattctatttcatggaaattgaagctaggaagtcgcatttttccactacgctttaagctggccaataaaattttacctacatttcatctttgctataggcattacagagctctgtatatttactgttttagcagaatatatgtgtttgtgtagaccactgtccttttagttagaaggacatggagaattggaggtcttacatgtttttgttgcttggatcagattggctcatcctgctgcaacagttgcattcaccatgaagccacaatacctcctacgccgtgaatcctcctactatgcctagcctatagcagaatgtgagccattcttgcttgcctcccttttcttctattctacaatggtacttgtgagtatatatatttattcatgtggtcatgtctcagggggataaattaaagattagttgttagtgacacaatcataatatcttcccaaggtccataaaatatgcaatccttttggtttctatttacagtggatgaagttgggtgcctcttcagttctttactttttttgactgaatttttgttgtcgattagcaaaggataagctttcagtatttgaattgtaatagcagtataggatttgagaccgctggctcatgatgtaaactctgtactgcaacgttctgcaggcaggattagcttttcttgatggaagtattttaaactctgaaagcttgaatacttgcgtggtaatcacagaactacttggctactacactggctgttctccctcaagacataaaaggttagggttcgtgcattgtaatcctatgtttttagttacagaaactttcctttttaattgccataattttacttacaagaagctggtgcacataggattttgtatgaactgtgcagaaaactgaaaggcactcttcgaaaagtgaaactgtcctcgaaaaacaagtctgatggaaataacctatcctataaatctgattacctggaatagttagcatcaaacgctatgccttattactcaagagaggttaaagcaaataatagggtaatgcactaatgtactagtctttcagagagtaattaacctagagaaaagatgacaggttgagttgttcaagaactgtaaagtagagaatattaatgtagttcctcatgagttatctttttgaaagggaagcaatctggttgctctctcactgctctgagaataaagtttcaattagcttgtttgttcattaggaaaagaaaaggaatgaaaagagtaggctccaaccaaattatattcccatcaagacttagaagagcttaaactattctcttgtgacccttcccgagtcagtaacgtcaattgatccaggaggaagataatatagttatatctaagta

SEQ ID NO: 44948 - DNA, 16301 bp, Oryza sativa
atgtcagtacctcggcctttccattctgacaatgaattgaaacgtgcgacgagaaaagtcaatagaagcaaataaacacacgtgcttcaaaaatactagcagaatgcgaaaactactactccctccgtcccaaaataagtgcagttttacactattcacgttcaacgtttgaccgttcgtcttatttgaaatttttttatgattagtatttttattgctattagatgataaaacatgaataatattttatgtgtgactaaatatttttaattttttcataaatttttcaaataagacggacggtcaaacgttggacatggatattcacggctgcacttattttgggacggaggtagtactactagtagtatattacagcattatggagtagtatgttattggtgcaaacccatggatttatatcacagactaattcaaacaattgtatcaaatcaagtactgtgctgcatgtaaattgtataagccggagagatcaaaggataaattaaagaaagaaaacgaaaaaaaaataaaacttcaacgcggattcacatccaagtctgaaaaaaaatgcttaatcctaatccaacaaatccactagctgaaaaacaaatatccatttgattattcccccaataagctctctttcttcttgctttctcatctctgagcactgagatttcgcatgtattttccctatctttaatcccagcttgctctcccaatgctgtcacatctagctagccacatcaacccttttatcgttgtacacgtgcctttatatttgtgttgcacttaattaaatctccctagttttgtggtagagaagagagagatatctccgtgggtatactgtatacaactcaggcaagctgtgcccagcatgagtgcttgtaatcgcagtatatcagaatcagaccaggtggtccgtggccggctcatagtctcataccaaatctctctcaattttctcatttttttaaaaaaaggaaaaacacatctctctcgatctgaatgcatgtggcttgaaacgacagtacgacaccacatttacctggccagaatttgcaaagtttggagcaaaatcacaagcaaagctggaagatgcatctagtaggagtagtagggagggagtagagatagcaacggtacatgagtccacgtgtgtactgggcgacacgcccagtacaaggtccctttcgctagccgtggcggcgtttggtggtttcaccaagaagctcaagccctcctcgttgccacgtggatatctggtccaggacgcggcgggcccaccgcagcctcgagtgacaggtctccttgcaagtgggccccacgctattatttattatccgtaataatctgatggtcctggaccactgacaaattctttttctcctctgatcgcccttttccttatccgctttaaaattaaaaaacttcaaatggtatagtggattattcttgtttgtttgaaatggaattttcggttaaatttcaagcaactcgttactcaggatttaaagagtatttcgtggctaggtgatcaagggggagcaagtatgcgtatcatatgatcgacaatccacgatgctgaatcttgaagagagaaaaaaaataacgtacgcagatcacagcaacgagagaggatgattaggctgattgtattattattgttaaacatatcgtcgccgacaagcgccattagtaaagcataaacatccgtggcaccattcaatccacgctaattcaaccacacccacccgccgcgtacatcgtttcttgctttgttttcctgcaagatcttcatattataatcttttccctagctaaagatcaagttcaagtatgctacacaataatatatcatcaccttttgcaagaacaatttgctccttaataattaatctcgaccaaaaatatctgtacaaaacaaattcgagagcaactcaaagttgaaaggaactctcgctctaattaatctctacatctacaaacaccgttaattaatgccttgattatgatgtttcatcgccgagtctacttgatcctcgccgccggagcggccggcggcggcgtgaagaacccgacggcgcggcacttgacgtccatcccggcggcggcggcgggcatcggcattgctccggcggccgacggcgaggtggccgtcgacctcttgtaggggccgagccacttggcgagcatgtaccgggtcttgcgccacggcgggacgtgcaggccgtgcgaacggagcgaccgccgcgccgcgtcggccgcgacgcgcacggcgcgcccgacggcctcctcccgcgccaccaccaccgacgccggcacggcggccacgacgacggcgtactccgccgtcgcgcgcgcgacctccagccccgcccggaagtccgcgtccacaatgtacctgctcttctgccccctcgccgccggcgcgaccacgtcgacgtactcgtacgtcccggccgtgatgccaccggaagcctcccaccgcgacttgcacacgccggcgtcgtacccggcggcccgcagccgccgcgccacggcgcgccggaacgccgccccgtacctcctcagcgccggctccgcctccatcgcggccgccacggcagcagccagcctgacccggaacgggtcctcctccaccggcgggtcgagcagctccctcacggactccgccgccgccgccgcgcgttccggaccgtcgccatcatcggagtcatacccttcgccgcccttgctcgccggcccggcgccgtcctctcccgccgcggcgccctccgtctcaagaaacgcctgcacgagcccggacaggcacgcggaggcctcgtgctcgctgccgctgctcgccgacgacccggcgtccccgcggagccgcgcgcggacggcgtcgtcgaggcggatgtagacggccattttcgccggcggcgtgcgtggatttgaggtgtctgagctcgcggtgaggggaggaggcgcacacccgggtgactcgtttttatagggtggttggctatgaggcgaactcgagagagaggaagggtttattcctttggatcattagtgattagtgggggcgcttaagttaggagcaacgaatttgaggaagttaaccatggaatatgctttcctgatgagagatggtaggcaaaagcagtgcgccaaaaaaaattacatatcaaagctaatttggtgctgccatgtactccctccagttccatattaattgaacttttaaattccatattaattgatcttttaaattctatattaattgatcttttaaacaagtttgaggttaaacttttataactttaaccataagtaactttaaaaatatttagttccaaaaaattagaacaacatatatagatttgtctttcaaaacataaacatatatttatttattatatatattataatagaaaaataatgtcaaggatatattttataaatcatgtcattgtctaaatcgttaattaaaatgaaacgggagagagtaaacagatagagcgtgttggttgatggctcgatggctgacatgtataaatgtttatctctgttttctttctaggtccatccatactgacagggttaatgttgttacagtgcattttctgctgccagaggtgacaggtgtacagtaattagcagctgttagcacgtgcttaagttgtttccgaatcaatggacgagttatttgcatcttttaaaaattatcttccatcttcaaccatgtagaatactactcacacgagagagctggcgttcgcactgtatatatgctgttttctactacagcatttgaccacgaaacgtccagggaatggagggaaatagcgtggaaaagcaagcttataatccacacgcactatacgaatatacgattatgcaaccaaatcactttatttatttttaaccttaagcccccgtttcaaacgtgacgcttttttcacctgtataaaaacagtaaaaagctttctcgaaaaaccgggtcgccgcggtgtgttggcatattgcactattgcgtgtgtgtgttgctgccgcctgcgtgcgtgccgtgcgtggcgaggatatgccgtggcatcccgaggctttgtcctatccgcactgtcacgcgggccccccaacctggctcgggcgacgtcgattgggccaagtcagcagcaggtgggggcgcccccgtgtttggcccttggcgcggccgcggggtcgccgtgggagggacaagagcacgagatggatggcgactatgctgcccattgctcgatcgatcgtctcggtctcgccactagactcgataatccatatccgtttctgtgatcgcctcttcctaatctctatctcgacgctctcttctcgccccgtctccgtctcgatctcgatcggggccctaccaggttcagctgtacgcaactgtttccaggagtatctacactgttgacggcatgacatttctttaatgaaacttttttacttgccccctggtcctgagctgacgctgaacttatcaccactcaccagaaagagaggaggcaagtatttactgtacgcttatcagctgagggaacagagttgcgctgtgcgttggaggtaaatggtggcatacgagttacagttacttttgccgtattgcggtggagacaactcaccgacgcagtggagtaaaatctcgagcggagatgggatcaaactccgaagagaaaaggtcgcggtggaaacatccagggtcaaacggccaccagccagggcgtacgtgtaaacggcgtggtcgcggtggtacacatgcataggcccccgcgcacacgggggggcgagcgagatcacgaggacaccggacacgtaccggatcggagagaggcggggccagcgttatcaaggttggttactcgttgccgtcgcgaccggcccaccacctcccaactcccatcccgcgcgggatcctaatattcctgtacagtttggtcgagccaacgctgcgctcgcgccccccgcatcgacccaccgtttcgcacgcagtctcgctctcgcgcgtgctcgcgctcgcgcaggcgcagcaaacgcaacgaccgtaggccgggtaggtaaaggcacgtactacgccgcgcgccaccggtttgcgtcgcggaacgcccgcccgcccgcctctggtttttgctagaaacggacacaccccttcgcggaagccaaaatacccaaacccaagtggacgacgcggcccagcggagctgcggagggagcatgcggccgtggagggggagggcatctcgcccattccgtgcagcacagaaactgcccctgtcccatcgttttctttggcacagttgggtgtggttgcgcgtgatcaatgtgcgtgtggttgtgtagactactccacttgcttcccatgtaaattcgggtaatgagacccagttagatgacactaaaacttttaaatccctatcacatcggatgtttggacattaattataaatattaaacgtagactattaataaaactcatccataatcttaaactaattcgcgagacgaatctattgagcctaactaatctatgattagcctatgtgatgctacagtaaatatttttaattatgaattaattagatttaaaaaatttgtctcgcgaattagctttcatttatgtaattggttttgtaaatagtatatatttaatactttaaattagtatctaattatagagttaatggaagagagagagcagctcgacgactaatttgcagtcgggtgatacgctgctcccaatgatgtgttagtgcatttttctcttgcatgcatccaagctgctactctcagccaattgtagaatctaagtgaacactagaaaaatcaaagctagctatgagaaatgtgtaggatgtactctctttgttacagaataaactaacatcgtacaagatatgtgtcatatcttaaaataacgaatctgtatatacctatatccatatttgatgtattagtatatatcacattctgcacgaaattggtttattttgtgatggagagagtatatacaatctattattatattcactagtttttagtataatatgatgtgatcacttttggagccaacaactactccaaagcggtggaaggggtttgcctgttctccaaagcgtccacgtacgtgtcgtctagatacaatgaacctgtgcgtttcaagatcacgaaggagcattgttcgtcgtggttctttagcatctggacagaagtttgggtcaaattcaaggctgatagttacacaggaaccgttggtagcatgctgggataattttatggcctggtcgcgtgaatggcgtaagtccattataagaaacatgcagtccaccacgatacaaagatatcagcaaaccaagtgggtgacgatacgcggtgcggtgaaggagaaccagagagaatgaacaacgatggcacgccaagtcgccagcgggcgcaacgtggcacgtaggtctcatcatcttcttcgcctctcgatcttcggcatttttcttgtaccaaatgtttggagctaatagtatacgcgcatgtgatttcctacacctaaatattgattttgctcagctcggtgctggactttgtggatcaggaataacccaacaaatatgcaagaacaatgcacatacataacgtccctttcgaccatcggtgcttgtgattttgtgaatcattaccgatcatattagagtcgccgaagaaatctcgagcttcctattaaggaatcaccaccaaatcccatgagatttaatttgacggtgtttattacagactacaccatcacgtgatcccgtctctgtactcccaaataaactatttccccacgtacaatcaggttctataagcaggtgttttcccaacacctctttctcgttttccgcgcacatattttttaaacagttaaacggtacgtttttttataaaaagtttctatacgaaatttacttaaaaaatcaaattaatatattttttaaaaaaataattaatacttaattaatcacgcgctaatgaaccgctacttttttttttttacttccggttgaacatgggacactgaacacaccctaagtagagtactccctccgtcccaaaagttcagattcatagctaaaaattaaacatagattaacactgttaagtgatagtactagtaagcaactgtgtgtcccctcccctggccccgcgcggtcgcgaaaagcccatttaaccccacgcagcgcggcgcacgtacgactcgtagttagggctgaaaacggtatggaaacttttcggattccggatctattttcgaaaacggaatctgtcggtgagaattttttcggaatttttcggaaataaattcggaaatattttctcggaaacggaatcgaaaatgataagggcagtttccgtcggaactcgcaatcggtcggaaacttttcggaatttttttcggaatttcaggaatttttttcagaatttccagaaattttgtaactgaaataccctgggttctttttttaagcacttaatagagaataccatggtgttttgttgttattttcttgaaaatatttgttatgcaaatctaaaattacataagaatatttttttccttcattgggatttaccaacatcattactcttttaaatatagataatttatttcatagattgtgttttgtgatgtactattaatacttaataattagacttatatgattgtgttttatgatgaatcgttgaccgttgagatttgagaattggattaatcagtttgagagttttttttattccgataaattttcgttaccatatttgcgccggttcgttttcgctctgttttcggtttcgataatattcgattccgttttcgtatccaggtttccgattccgattctgatttaaaaaaaatataaaaataaaaacggtaaaaatggttttcgtccatttccgtaccgttttcacccctactcgtacacctctactcgtagtacgacattttttaccagaccggccgcatgcgattcttcaccggtgacagcgcaatgatgcggtggcctttatccagcggcacgcaggagctgtctgtccacgctgttcatgcagcttgcagatagtagatcgaggccgtgtttagtttccctttatttccaactttctattacattatatcacatagaaaacacacataaacttttaaccttttttttaaaacttttaacttttttcaaacttctaactttttttcagaaactaatcacactctcagacacacgacgtcaaatcgtcccgggattaggattaccaccgttttttcttttgtctcgctgtcgagaatcgagatcatcgtggacgtgtccgtgctaatccacgtcgaaatcaatcgaatcatcgtggacgtgttgctaatccaagttaaaccagccgtcaaatgacggccccttcaacagaaactcagtgagatatttccagtgagattagaaatatgttgttggtttcagtctcttttacttcccccgttcttaaatataaaggattttagttggatataatatagctttatatccagattcgttgtactaaccaaaatctcttatatttagatatagagagagtaatatgtgttagtttgttagaggatacattcatgggtacatgagtatgatgactaatgtgacgtgtatactgatatgcgcgtgtgtctaccgtgtaaaaacatatcttgaaaaacaaaaaacaacaacgagtgaattacatgttaggtcaacttggttacatatattacacattgacatatttggttgtcagggctacggcatatcgcaaccaaccaaaacagttctgcaagcaacaaaggcagttgcagccacagcccttgcctgctgaataggccagttggacaaggccctcgtctggaagtgtttgctgatacatgggttactggcctaaagtgcaaaatctggtatctaaacctaatccaacgtaaaaatattgatgatccatggtgagactaggataaaaataactggtccaaaattcaacttactcataataatatcatgcatgatagatatctaagttgccattatgtcattttacgtatcataagatttgtatcctgttatatgccgatactaccaaatatttgatataaaggattactacgtttcgtatcgcagtaccatcaatcttatttatttacgacaatatactcagaaatgatgtgattatattatataattctatccagtttggaaagaacgacatatcagtctttttttcattttctacaggatatgagaaaaattccgtgttccaaggatatcaaaattaattaggtgcggacgtttgtgacgattttatatttcataaatgaagcacattattgcatctaggttttttctcttgaaccaatatacacgaaactgagtgacttcaacatcatgcgtggcgccatggatagtgaaggcagcaagatcaggagtgaagtttgatcctgtgtattattatcatatcatgcgcataacaaactagatgcaataaacatttttttctagccacaatataaacaacttattatgattgatgtccttgttaattccggcctaatgatcagcacatacctgtcattcctctaatcaggtctggcgaaaaataaagctaaatcaagttcaataatacaccctaaagtaaggactgggtgttaaagtggggacacaaacgatcaggaagatcacattgatacatctgctcctagacttgtttggtccttttctgattcgttcagatatgcactctacctatcaagtagatgaagaccacatacagtagtgatcaaccggtcgtagtgccacaagtgtaaagtgaacatcatctggataacgtggtgtgtgcatttctccgtttagtagtgtattgacttgatagaccatgaacctttcattatttttttgccgaagaaagttgagagagatatttgccactcccactatttttcatcattattcgttccagggtaatcctccaaagagagttgataatatatatagcaggtcaatatataggcatgctttttttaattatgttgccgtgcaattatgcgtttgtttagtgtgcattttgttgtcgggttagtgcgggttaaaactagtcagcctatcatttttactcctaaagatggtaactgatcgatcagctcgatcggacaataaacccactgccactaccactagtactaggttagcctagtcctagtagcatgtaggccttctaaagttggaagtttgggttaaaattgatacgatgtgactgaaaagttgcgtgtgtatgacaggttaatgtgatagaaaaagttgaaagtttggatctaaatacagccgtagcatcgcaaatcagacgagctagctagtactacaatttaatcatttccagcctcatcttttcacttatacttatcagaaaaaaatttaaaatttcaatcttaaatttgaagctgattttaaaatcttttcatcggagtttagtttttagcatttacttttaaatcgttaggaacacgtatataaaagttttattaacaaattacttttcgtttgcaaatatgatgtttgaacgatggggctgtttgtttatgcttattcgatccgcttactaacaatttaaatttgtaaataaaacatttatatacacgtccaatttaaaagtaaatgttataaagcaatctataaaaaaaccataaaatcaactccaaaattaaaatttaattttggcttctaggtataagcataaacgaaacaattggacttaaaaaaacattgtcaggcgagtttttctttagaaaaaagaaatgctgcatgacagcatcccattccgacgggatgacacctcatcttgtccaaatgtccaaatggggtatcaatcgatacctactggatatcatacgatatttgcgaggtatcatcccgttaaaatggggtatcagttgatacctactaggtatcatacgatatttgtgaggtatcatcccgtttgaacgagttatggttcaggagcatttttcgaaaaaaagaacatgggcaggagcaatcacccaacttcctggaagttgcagccttgcaggtgacgcggctagatgggcccggagggagcacgcggcgcagcctctcgtggacgaacggcccatcgcacgaccagagcccacagggatacccggcgcgcaggccggttaacagagatgcctcgaacgcaggtgcaggcctggacttgtgttgtagccctgcagcccgcaccggaggactagcgattagcgaagccgcggtcacgcacgccacgcgttcgatcgatcgatcatcgatcgcgaaaaccctgccactggagaaatcctattcattatcgcctagaaattcgattgttaagcttttatctgctaaatggagtatatgactactgcatgcgtcaccaagataagcataacgtacgtgtgccgcttcggtgctgctgcgttcgcgaaaaatcattgcgttcgtttcggtgctatgctgtgtacggccattacggtgtaccgtcgccgcacatatccacccacccagcacacagacagcagcgacacaagttacaacaatatccaggtgagctgggggccatgaacctacactccctagccactctcacgccagcgccgcgacaaccacccaagtttggctagcttcccaaccctgacgtcacgtaagcttttgccaattccgccaacgcccacgcccatgcgcgcacccgtctacgcggcaccgcgcacgcgccacccccctcgacgtgtcctcacaccacctcgtccctatccatgatcgcgtcccgcccgcgcgccgcgcgcgcgcgcgcgtccttccaaacaccaacccgcgagtccttgagtcctttccgttccgattcccccgtataaatccccgcgccaccgtaccacgggctcccgcatccatcgttctcgctcacttctcacaaacacaacaaaaaacatcgtcgcagacaaaaacatcgtgcacgttggttgcgtgtcaatggcggctcgttgtccggtcggtgtggcctctgtgctgctgctgatcgtcttggtcacggtggcgtccgcggcgtctggcgcgcgatccggcggcggcggcggcgggggcatacgggagttgcggggcggcggcgcggggaggagggtggggggaaggacggaggtgagggacgtggagggggacagggaggtgcaggagctggggcgcttctccgtcgaggagcacaaccgccggcgccgcagccgggactgcggcgacgtccggctggagttcggcagggtggtcgccgcgcagcgccaggtggtgtccgggctcaagtactacctccgcgtcgccgccgccgaggagggcgccgcgggtcagaacggcggcgagccccgcgtgttcgacgccgtcgtggtggtcaagccctggctcgagtcgcgcacgctgctcacgttcgccccggccgcggactcgccgaacgagtcgtagcacgcaggcagagagaggcaaggtcacacaggacacagctgagctggtgtaagaataaaaaatgtaccaagtttcaggtgcagttgtgcaccgaacggggtactcgtattcagtagagagtgaacaaagtaagtgtacgtgtgcgtgttgcggcaatagatgttcgaaggctttttgtgtagagagacgggagagagtggcaataaagtactatacttgttctacatcttcttcgtttaatttgcatatgcttatgcttatttttttcccactcgatcgccaatcaggctcaggagctcacgttgcttaaataatgctgagaggtgatcgcgtgtagtgactagcttgaacgaacgaaatcatcaattaataaaagccctagtgctaccgattttctagttttttttttctcctcggaatggctgtcacgaaattaaattaaaaaacgaccttgtttcttactaactgagaaccagaaccttgtcttttcgcgatgcaaaaaaaacctttgcacgttaatatattagaaaaaaataactagcgcaactgtgatacaccgaggcaatcactggtcaacagaagggcataccccattacataagaaactggtttaaaccaagcaaagcttctaagctaagactaagagattaagaagttgcgataaactaagctaagttgtgtttcgctaagcatagtcttgtctggtggtcccatgcacaaaccaggcacataagaccattcacagtgcatctacgtggctttcatccctactgcgccccacgaggattttcgtctctacgtttgcaaccctcgtacctaacatgcaaaattatagacaccacttgagctatttcttccagaaatacggctgacagtatctttcacggcaaatatcccgagggactatctatacatttgtcgataaattttaaaaatttatcaaatataaatacaatataattatactgtaattacactgtaagtatagaataattacactataacttatatgtaattatactgtaactatagtataactacactgtaactttagtataactacactgtaactataataattacattgttacttatatgtaattacattgtaactataatataacttgcatgtaagtgagatgtacctttataaaacttatgtttggcactgctcacgtaaaagagggattacgaactcgcaatgtctgtttgtacgatgcgtgtggaggccatcattcatgcatgcatgttcgggtatgccctgccgctttatctctgcccttcgtctgacatctacgcgtgcatgagccgcgccagtgccggtagccagcggccgtcgaaagaaacaaatcaaaacgtcgacgcaaaagcacgaatcttgaggttcatcaagcggttcgaaaatcgacaaattctaaggaagaaatttgtcaacagatttatagcaaaatcgataccgaaataccaccccaagctaataaatctcaacatgcggcagccagccaggttttggtgaaacagtactgtataaaagcatcgcgtttcctttctcgttccccctctctttttcttccgtttccagtgcgagtacacggcaatgatcacccctttgctacttttcatatccatgcaacatgcatacaaaaagatggaacaaactccatccttttttctagtccacaaacgctagcttcgcccgcccctcgtcacgcaacgccggacaaaggccgagcttgctgttgcgcggagcagctgcagggtccacgtgatgccgcgccgtggcgccgcatgcacacacgcgcgcgtcgctacgtggtcacgcgaacacctgcactgcagtacacaccaccctacctatatcatctctcgcctctgtacatctgtgcaaaactgcgaaatccaaacatataattagctagcaagcgaaagtacaaaactatggcctccaagctgtattacgccgtcgccccgctcgtgctggtgcttctcctcctcgcgccgctctcgtccgcgcgcctcgccgccgccgccgccgccgacgacgacgggcagtggccggcgggcggcggccgcgggaggaaggtcggcgggaggacggacgtggaggacgtggaggggaacagggaggtgcaggagctcgggctcttctgcgtcgtggaacacaaccggcgaggggggtcggccacccgcggccgcgggctggtcttctccagggtcgtggcggcgcagacgcaggtggtctccgggatcaagtactacctccgcatcgctgcccaggaggccgacgacgagctggtgttcgacgccgtcgtcgtcgtcaaggcctgggtgccgtcccgcgagatggtctccttcgtgccggcggcggagctgccaggatactgaatcggctggttatccatggacgcatgccttttgatggagatggaagatgggtgtgcgtcatcatctttgaggtgatctaatgtctaattagatatgatactgatgtaagatgcatacagcatgactgcatctaccatgtttggcgtaaattttgcttgctgcagagtccaacttgtgtaagatggtagcttatgcttctcagttttctctctttctgtagcatctgtaaatcctgttcctcaatgacacctatagctctgtacaaactaaaaaagagaaattcggaggaagatatgtccctccaaactttttaaagaaaaacttgtgaacattttttaagaaaaaaatgtaaatatgttaggaattaaacacaggaccttaaaattaaaaccacacatccattaccactatcaagtgcatccagttcagtacaaactgatcgtgtcgtcagctaaaccctagcgtgagctaaggtcgatgaagccactctaaccaaaaggctcctcctggaacggtaccagataaatgttgaaggatttttgtggaaaaaactttgggtgttctaaaagagctaattaagactcaaatttgacattagcaaatcaccgtagccgctctattatcgtctgaaaattcattgcttatgattttatcgaatcccactaatccgtaattcgcccatagctaaggttaataaccgcgacgatgaaacaattgccctcagttttgcagacttggcggtatatcatcattgacggatgcgtaccttgggaagagagtaatgaagcgggcaaagaatcgatcgctcgtttcctgcctgattttggcggtatatcatcattgacggtatatgctggcattttggaccaatcatcggaccagccacgtcatcaaccacaccaaactcaccaaactgcgcgtatggttctgtagccgccgccgttaacgatgtgattcgatggtatttacctggcttatggtctggtgtgtccgtttatccgagcaccagaaacagattaccttaagattagctacttgggcacttctggtagtgaagtcatcgcactggcaggtgctaaatgactgcatggtgccactctgtccggttcattttccccctgaaacacatttcaggagatcctggcggaatgggtggagctcaaacagcagtagccttgtgcactgttcaacgtttccatggaccgtgccaatatatcttacccgtgccttccaacttatccgtgaatgacgaacaccggacagggcgggtactgaagtttgaaactgtcgagaccaacaatttcagagaagagaacgacaacctgcaaaaacagttaagcctacaagagaaccaagtttaagggcggatgcagcaggggctgcaggaat

SEQ ID NO: 44949 - DNA, 8585 bp, Oryza sativa
atagcgttccagcttgcgcatgaaatctgcatagatctccaaatgtaattagtacttgtaaggaagaaagcaacaaaccatccacgacctgaactgccaccaatcttcaggtccacttatcacgatgacagaccagaccaacaacctgatcgcgcatacatgttgcagaagaaaaaaaaaagtatatatctattttgcatgcctttttttgactgtcgatcaattcaagaaatgtccaacaatccactcctaatattgataagaaagaatcaaccctctgatttacttgtctaatgttcactatgaaaagaatactctgcaaaactcagaacggggtgacaagaactggaagaaatatgatcccctagggagtcttaacacttgacgcaacagttttctatagaaagtcctacaagtatagtttctccccccaagatttctactagtttctcccccaagatttggacgcggacaactctttctcagtttttgtgcgttaagaaggtgaaaaggcttatgttacctctctctctgcagggtgtaactcatgttagctgtgtggtagaagccacatgaaacagcaagagatctgcctagttaactcatcttaataaacttacctcgtaatatttacacaaccacacgacccgctgattcttatctctcaaaatggaaattgtgcatcatcttctagcaccttaaaatgttgaggatgcctaccagagcaatgcaggttccacatatgtaaatatgccctctccagattctttacctgccatttttgtttacggaagtgaaaaagctaaccctgcaacagatatggacatggagttcaagactgaaaagttacccatcgagctgtatcaaacaaaggacaggtcatcctaacagccttgagcttgttggtaagagcttcgagtttcaatggattttctgctagagagactgccctttcttcatattcttccaggctggattagcaaagctgattaaaagaagagttcaaccataagggaaaaaacacaattggctgagatggctaacctattgactaccatctcttccccaattccagtagctagacacagtgaacctgcaaccctagttgccattttctctagtggaagagtgatcattgggagaccagcccataatatatctgtaccagtggtgtggccattgcacaacgggctgctcattcaatataattgagaaaataagagtatggcaggtaaataagaaaactgtcaagggcaataatggatggaaagtaaggttacgtgtcaagaaatagatctgctagggcactgcgtctgatgtgctcattttttgcagcaacatctgtaaatatgatttgatctgctcttactccctttgagattgcatctgccaaagctacaacgttagaagtggggagagatatagagacagaataggaaaatacgacattacatgcgcgcaatctcatctctccagctgctggaaatctcaatagccacaatgcactatttggtacacgcttcagaatattgcacctgggttgacaaaaagcaaaggaaaaaagatcaatacttccaacaaagcatgcatggtaggtattgtttcaacgaacacgtatggtcacatattataaatttaccataacaaacgcatatatagaaagaatttaccaggtgttgaatatgtctgggtccatcttgtagagttgattgaagcatgcaaaaataaatttgtcctctggcagaccatagtcagctcgcttgtgtgggcatacaggaccaagaacatctcgatttttctattttacaaatcaatttaaagttgattattaaactcataaaagaacaaccttattcaatctttggcctgttaagaatgtaggaatttcacatgaattttgcaggaataaagaatttctcaataatagtattatacaaaaagttcaaaggactcagtcctgaaccttatgtttttttatctctggttattttataactaaactaatcagatgagcgattatgtccccatattaatgcacacccatccaaaaaaaagaacccatcaacatcagaataggttggcccaaagacctcacatgtcaatgagaaagtcataggatgataagactattaaactgaaagttgaaaaagactatcaaactgaaggttgaaaaacagaggtgagcctaatgttaaaaagctgaatatatcttttgcaaacatctctggtaccatgtttttaacatacctgcttatagtcattcacaaagtaacagtggggaagatggacaagcttttctgagtatatatgtgaaaatttcagtggagaaacaaactgaaacaacaacaaatggccaatcaatttataggcagagcaacaatttgttgaaacaataaatggctaaaaatttcaatatttcacctcatcagtaaccaaataatcaatgtaatctgcaccagtggttccaggaaatcccatgtaagaaacctggattggggctggttgtaaagcgaatatttcattccgtgcaccctgaaacaagaagcaattttacgataagaaaaaaattccaagaacattaaaagttaatctcccacttgagacaacacatgatttgaaaactatacggtggcattcaaatatatcgcacacatttagcatgcataaagaaaatattacagtgcaatagtggcacaccaaaataacagctacatttctgaacatattgccatgcccaatattttataatttaaacttccctaaaagtgataaagttccatagaaaaactaaaggtaggattaataaaccacactaggataaagcagttatctatcacctaaaaaaactcagccccaaggggaaagatctcccctgaggccacaaggtattgcaactaagaagaagcatctaaaaccagggccgagaaaggtcacgaaagccggtcctcccaaaaatggggagtagccccctatgggttgggtcttaacccgtgctttgaggccactgccccatacacgagggcccaccctctgtaggtcaattcttaatccatgtttttagggaaccatcgagtgacctttttggtgcaaggccaggatttggatcctgttggtagcttcccgctgtaatacattatggcttttacaatccccaaaataagcaggtgattttataacaacagagaggatattgctaaatctgctgctgtaaaatactgattaaaatagaatgaacaaaaaaaaaaaaagaagccaagtgggggtttgcaaaagtgccatgatgagcagaaaatgaatagaattgtgatgggaagccttagtaagtccataccttagtatagccattaagattaataagaatttgtatcttatcctcattgataactttagcaatcatatcagatgacattgatgacacatcaatgaagtgctcagcttcagatcgaatacgctgcctccattctgtaccatcatcttggctcagggcataacagaaaacctgcaaccatatttataaataaccattccctcaaaatacatactctcggtgtgtataggctaacctcgatagtgtcttgattgtgcattccaaatatagaacccatcagatgagacaggggatgattgccaaaatcactactcacatacctaagaccaagttgaaaaattgatttcatcaggaagcaacaatcaagcacaatatgtagcaaagtagatatcataccctattctaagtcttgaagttctgccatcattgctgattggaacaggataggagtgtgtgaatgtaggaagcccaaaacgtgatgcaaccaaagagtaatgagctgcatatgttcgactgaaaaggggaaaagttgtaacatatggtctatgtagcatgattatcatcaaaacataccttataaaggttacagtgatcagtataggttaccaagagaagcctcacctgatttccagtgcaagagttgaatcaattggatatgctatagcatggaatggttgtacacttgggagagaggacatctggaacaaaatgaaaataagagcaatacatatcaagaaaagtattccttaggtaattcaggtaaacagtaatggaaataaaagctcgtgcctttatttgctgcctgatgattccctccacctccacgaatttctctgctcgatcatcccaatcacatacacactgcaaataggtgaatgaaaaaaaatgttaatctccataaaaactcaggtttcatgtgaatgagcatccatgttttaaaaataactagagaaaatttgcaaaactacgcatattctggtgcgattataagaaaactgcatgttccagttacatttcaccaagttacatatattccccagcacaatgtttcaacgaggaacatatttacttttatagatggaattagaggatttcggggtgatggtgtgttctacacccagacgcacccacacaacactagaggatcttttgtggttgtatattcatacacattagttgttgcatgattttttttttcaaaaattggcatgctttgaatatatatatatttaggtagctttgatctgatgtgatcgtctgaagtggcatgccaagaatctagagcagaaagacatgctgtggacgatggcaggttttcaactgggagcggatgtggatagtatctttcaatccacagtcaaattatgtgtgggcaatggcactgacaccaggttctggacagcaaattggcttggaggtggcctatcctttcaacttatgtaggccgatcaaagctgacagtggcacaggccatggtgaaccaccgatgggtacgggatctgcagggatcactgtcaaatgaagccatggttcaatttttttagttatgggatgagattcaggtgctacagctccatcatgaagctgacaccatccgttggaagctaactccagatggtcagttctcggtatcctcggcgtataatctcttcttcatggcaagagacatctgcccctttggggagttaatctggcacacaagagtccccctctagaatacgttttttcatgtggctggctgtgaaggtccgttgtttgacagcggacaatttagagaagagagggtggcctcacaccgacaactgccccctgtccgttgtttgaagattgtttgcatctgcttgtaactgtgattacaccaacagggtatggagattgatgcaagcctggatcaatgtcgacttccctatccctggaattgatgggctcggcttggcagactggtagatgcaggcaagcctctattttcggaccggctacagggcaacctttgacagcatcttcatgatgatatgctagctcttgtaaggaaagcaatgagtgggtgttctaacaaaggtcgagaagaccagagcagctggtggaagacgtcaaagaagaaatcatggtgtggaaggcagcaagagttttcgcggcatgtaacgattagcggaccagccttggtgctgttgttgttctttgcttgttggagctgaggctctgcctcaataccggttcgacagccttctgtcgttgtaacctcaagtttgtatacttaatgatatttggtcggccggttccttcagccgacctggcaaaaaaaaaatctcatgtgatcatgcatacaattgttagcttttttattttattttgaatcttatagtatattcatttttcaccattgtgcaggcactataatagtaattataacatgattttaaacattataatctgcttgctacacaaactgaagagttactttttttggcatgccatttacttcaatgttttaccgctacaggaatcatcaaagaatgcacataataaaggaaagaaggtaagagtctatacctgtagagtgtgcaggagattgcaagtagcttcaggaaaatcttgacgtaattgtagggcctgcttgtaactgataattgatgcctccagcaagcctctgaaaataatagaaacatgttaaacatgtagcatcagaactgatgccctagaatcacacttcaccagaaaataaatgtggtagaaaatgcaattacgtgtctttgtaagcagccgccaaatttgcatgagcttcagccatagttggtctaattgtaacagcatgaaaatagtcttgaatggcttcagtgatcctgcctgcttctttaaatgtgttgcctctattgacaagacagtcagcagccattggatcaatgcggagtacttcattgaaacatgtaatggcgtgattacagtttccctttttcagtaacgaggaagagaattgtcattgtgttgttaaatggtataaacggttcacaaaagtataacatcaatataaacaaaaaggtgtatgaaacacgtattcgccgaaatcaggagcgtttggcatcacaagtacctgctgtttgtaaatcattgccaagttgttgtaaggtgcagataatccagttgtaactgtcagtgttgccatgtacagtgaagctgctatgtccatcatgttcctgcaagtactccaaaatgaaactcttgcacaatccaaaagaaatgcacaccatcaaaaactcacctttccatatatacattcccaaggtttgtcaaagcctgagggtgagaaggctgaagagcaaggcatgtctgcaacaagaaaaggcatgactcacatcaacgtaactataacaaaaaaaaagtaaaactattgaagacaaaattcagcagtttaatcttctatggtaacctggtagcaactaatagcctcttcatttctcccagcatcttttagagcatttccctatcagtggaaacacatcatataaggtcttataccaaaaggaacaacgatttagtaggcatacaagaatgaaaaaccaaccagattattatatgcttcaacataagatgaattgcaatggatggcttgtctataacttagaatagcaagatccagttgcccttgttcatggtaggcattaccaagattccctgaaaatactaaaaattaatccacatttccacaacagagccatcattcggggtcagttagtggttgctaatatgctaatctgtcttgtacttatttttcaataaattatgaaaaggcagttgccaaaataaaaacaaacaaactagagtccaactgttgactctactacacgtgatttgatatttgaaacatgataagatatccatttgaaacttatattaaaagaagtggagttaaccaaaatcacttttttaatgaaaaaacaggtcatgatacacctaaatgcctcaatcataaccaaaaaaaaaataatcgttttacaagtgtaccattcattgcagcaaacagtacctagaaattactgataagtgcataaccctcaagaacaatacctcaaaaataagcaattattcaaaaaatactgtgtcaaaatgctaaacaacaataaattatggcaacatatcaaatgtcgtaggaagcagctttggagcatgattatgggttcaatcatatttgccatactccaaccacaacaaacatctacactcaccataagctactgcattttctggctttgccctagcagcattctggaagcatacaattgcatcctgacgcattccagtaaccttaaaagtgatatttgttgtcagaaggatatttccacaatgaaaccagaatttatgatgaaatgaaaaataccttgtaaagatttcccaagttcaggtgtgcatcgtaaaatgctggattgcatttgattgcttcctgatgtttcacaaaatcttaaaagaatcagaatattgctggacctgtcattatcctaaagtatgctataataaaagaatctgcatgctgtagaacccctgatataattgattcgtttcagaaattttttgatataatgaattctgatcatgacaaaacagcattgtcaaggctccaatgacaagctatgaatgcatcaaagcatctacaacattaataaatgtcaaagtcaatgcaaaccgcataccttgtagtagagagctgctttattgaaatctccccattgcatgagaagtccagcaatattattccatgcatttgcaaaagtaggctttatgtttagagcatccaagtagtgactgtatgcctgaataaaatgcaaatcacataaatattgcaaatgaaaataatttgaccattcatcagtcatcttattactatcatcaattcaatgcagcataacaggccagcatcagtaatttttactttgaactgaattggaggatcctccactataattagaccctattctgttagttcaacagaattgttctgaactaaaatcacaacatagtgctacaaaatatgtcatttaaccagccacttatcaagatgctaggagaaattaaagctgtcatttagcaagaaaaatcagggtaacatcaggcatctgtgggcaataaaaagtgtattaggaaacatgctagattggtcaaaatagatcatgatggatagcaaaaaaaaaaagttacaaagtaaatttgatgaagagcttgtaaaaatgaaagaataactaatgattctccggacataaacaatttg

SEQ ID NO: 44950 - DNA, 6040 bp, Oryza sativa
cctatagtcacaacacaatcaattaaaagttccacactgctgcaattaattgagaacatgtgattcatcagaatgcagtaaataaaagcgttggttaccagatgaggatttagtgcaagggcttgatggcagcactcagctgcctgactgagatttccttttcgagtataagcattagctaagtttgtccacgcatcagcaaaggtaggccggagctacagaagtagaatttgttagctcgcaagataaaaaaaaaatcagatagttacaatgataaaatgcatgtaccagcatattatgtgtgtcaccttagataaaaaggttaattaactcagacagtaaatctacctgtactgcatgcacataaaactgaatggcattatcaacatcgcctttctcctgcagcagacaataaagttgaaaacacgccaacacttaataaccccaacgattatggcctacacttttccaaaatgaaatggtctcaccctccaggcattcgcaatgctgttgaagcactctgggcaattcggctggattgcaacagcctcctcgttcttcgcgatgcacatgtcaaactctcgtagctaaaccaaatccccaaatcagtataacacccacgccagcaccggataaccacggcacccaaaattccgaggagaacctggtaatagacggcgccgagcagcaggaggttctccaagagcctcgggttcgccctgtacacggcattgcagtgctccagcgccgctttgtaatcccctgctctgtaactctgccgcgcgatctcgaggcgcgcgccctcgtcaactgaaacccaccaaaaccgcgacgggttaacaaccccacgacgaaaatgaaaatctcggcgcaatcgaatcacggaacagcgagatgaatctcgatcaatcatcagagaggggaagagaaggccaggggttcctgatcgacacgaacgaaacgaaccttcgagggggtcgagccggagggattcgaccaccgtgcgcagctgctgctgctggcgcggggtgagagggcgatggtggcgcaccgcgccgtgctcctccacggcggcggcgccaccgcctccgcctccgcagcgcaccgagagcatcgccggaaagcttctccgacgatcggagaaccaaaagtaaaaaaaaataaaaacctaacccgcgcgacggcgccgcgcggcctcgagctttcgcgtacgagtcggggagggggttggactctctcgggcgatatcgccttttcgccttctttttttttttcctttttttttcggatgcgtcgtcgcgttcgtggggattgggaaagcgtgtgacgcggtcagcgtgcggcgccgctgggtttggaaatcgggtgggtgagcggagcacaccggaacaccagtgctgcgcgcgacgtgcgtggccacgataggaggggacccagaccgtcggattgggtttcggtggtcgcggcgttttttggacggtcgtgattgagccgtgtgtggctgggctgggcttggggatgattcttctggtcaagtcatcgctgttgagcccatcaatggcacaacaagcccatttttagccttctctccctacagcgaggtgagtacaactgacaagtctgaaacccaaagaccatcacaaagatcgacctcttgagtccttgcgtgagaaagtacttcgtgtctgaggaactgagaggcagttgattgcacatcgtgcatgaggatccgtgaagctgtctttgatttttgttcggtttctattgtaaagttgattgtttttttagtactttccaggtcttgtttttatgcaaagtacgagtcggttgtacctcttttattgccctgtccgttctcaaacactcctaagtttttgagtatcgtatgaaactgaatctcatcatcttgactcattaatacatgcaagattacgattcggtatgtaaaaaatggcagtaacgatgtgtcgatgtttactttcgaaatttcagccccctaaatcctaaactatgtctgttgggaaaaagaaaggagtcagtactgtgtgcacaacaagaccagactagtagagaagcagcccggaggagaagtcgctgccaatggtttcacttcaccgggtcggatcaccacgaaaacgcgagcacgtacacggtacgtccaccgcgaaaggacggcacacacacacactgctcccgtccacacggcccacaaccaccaccacacacgacgccgcgcgcgcatggggtcgacgtttcaaatcaaatcagcgtcgtcgtcgtcgtcatcatcatcatcgcctcacctcgcctcgcctccaccccgaccgatatgatatgatacatcgtactgtacgtacctccccttactacgtgtccccggacctcaccgtgcaacgtcgcacctccccaccacagaacacgtacaccacccgcgcaaccaccgtgtcgcgcacgggaatctcgccggctcgatcgatcgccacccacccgctccctccccgagtccgagtcccctcgcgtcgtcgtgtgttcgtgttgcacgagagggcgggctactacggggattgtgtgccggttgggtgcgagagcgcccgcaataatgcgttcgttgcgtgcgcgcgcgcgggggcgcccacacgacacgacgaccccaacaccggcgtacgtagtgcgtggcgtccctccggccccgtcgtccgtctcccctcctcctgcccgatggcgacgcggcgcgaccgaacgagggggggacgactcgtctcacgactgctcaccaacagcgcgcgccctccgcgcgatcgcatactgtttcgtccccccgtctcgcgcgattgcttgtgtcgggcgaaacgcatggcaattgggaaaaacggaggaggcgacgaccatgatgacggcgacgatgaatgaatgatttagcgtaattaggagagggatctacatcacgccaactacgatccagtttgcgacgctcgcgtgggtgctagtgggcagacagtctagccattggggtcgccccggttactgcagcgccctgaaaccgatctgaaaccaccctgaactgaatgaacaaacctcctcctcatgtgggagtgctacttactacactgtctactaatcttgtttttatttttttgttcaggtacggagcaacttaattgtgctggagacctgtgtacgtacatccagttgttggagtggccaccttgcatggtgccctaccggcttagtggtggcaacgaacgccactgttatggtggatgtgggcatagcctcatatgtaggtctcaaactcctcaagcctcgttcgttttcgtgcgagacccagttgttctatgctgctgcacttaaattgcagtaatctcatccactgagatggatcacatggctggggtacaagtacatttcagagtctttttggtgttcattgttgcagttcaagatcatttccatgtaaatgcatagcaacaaaggttcaggattgaatgtccctgcaaagttgcacaacattttgatggcttttgatgatgctcgcataactactgaccttcgagagtaaaagttgtcagcaagcagacgcaagcatggctttatgattgattgcttgtgtgaatggatgctgcaagaatgatagtagtaccaccaagaaatctgcagtaatagttcagaattcaatgttctaaagaaaaaggaggtcagaaatcaataaatatttggggacacttaaagatttccagtaattccaggcgtgatgtgtgcagctagatctaagctcagcttttgacttctttgttgtggctgtcattgcatcacatctcccctttgtgatgcacaacgtacttttctctgaatgcgataaacaccggtgtttgctccaaagatataataataataataggaaaaactacatctcactccagttcccatccctggaagctgaaagaaggacgaacgaacggcaataagataatggccacctccttaacagtacacgcagcaccaaatctgaccatatcatgcatctcaccatgtcaaaaaaattataaaaatcatctttgtgtttgctaattgcagaggcatgatcttgcttgcaagatgcagtgcctactcctcatgacaaccacgatcttgcctgagagttgcactgtctgtccctccatgtacaaaccacgatctcactgtactgttccagtttcaccctttgccccccttttttttccatgggaccttctcatttgttgcagagcagtctctttcttgtacctcatgacattgtcaattcccatacttattgtgctgaaaaaatcagcaggagatgctgtcaggtaatcttgaattttcatctgtggtagtacaagagtaattatggtctggaactgagtaatccaagtgcatggatttgggattgggaccagtgaacactgttctaagatgttgtgacccaattagtcatgatttggagctacctgagctataaagataaacaactgctactacagaattgtttggtccaattcaagaaaacgagtgatcagaacaactccctccgctgattccgttttttggagcgtgatcacagcctggatgatttggacctcgctgaagtagattgggagctcgaattcttaacaataaaagggttgttcagagagagcagagaaagtgacatgcagaaataatagtagtatttcttttctgaacgtagctatagatgaacaggagcagaatagcaacgcagtgaatgccgttgcactgcctgtctgatgtacgcctagctagcatctctgcataaaatcaatctgataatatattggagttggattggaaggcctcctcagccttgtcctactgctgtctctatctctgggtacttatcatacagctcaaaagcagccacaaatccagtcccccagctcacaacttgattgttccttctgtccatgtccttttacatgaactatcttctgggataaacagattctaaaattcaacttgttttctgacccctcaagtactaaaccagaatttgcatacagtgaacttcagcatgaacacatctcttccgagtgaaaaaaaaaatgaagttcagcatgagcacaatgcacaaccaagaagctgaccattcttcagaggggaaaaaaaggggataatttcagcttaaggagatcgatccatggacaggaagaaggatcttaaagatatatatcagctacaaatataatgagaatacaaataatgatattacacgtcgtccctctctgcttgagagggtaaaagggtctgaatgaagcatcatatactgcacccgacttatgtacgatcttgtagcatacatatatatactacacccgactaccgtacatggtgcgtttcatttttgttcaaagaatcattacaccaagatgggaaattagaagctaaaacactgctagggcccaacattgttagggttgaatctcagagtgctgccgcggcaagctgacttctctgtatgtacaatgggcgtcagagctttggatcgaacctttatttggtcatgtcaaagctccattttcatgtggactgtttgcaacgatcctgatccatagcagtttacacatcagaattcagttaaggtgacgttaactatggcatcaggtaataggatgaggaaacttgcctaccattgtagctattggaagaggtggcgatctcctgactttgccccatatccatctgaacaacactttggagatcatcttgccagaaagcaccaacctgtaaagcattcattcctcatattcagcatcgattcattcgaacattttgtgagatcgagacattggtgtgcatttttacctgagaagccgcatcgctaaccccattgaggaaaggatggtgcgagcccattggccggcaaaatgccgggtccaatgggtgcatagaaccctggttgtccatgccgttcgtcaggccacaaccgagagggttcccttgctgaggctggttaatgtagggcagcggcgcacctgaggtctctagtggaaaatgtgagctctgt

SEQ ID NO: 44951 - DNA, 706 bp, Oryza sativa
ctgcagcccatacacatattagttcgagccaaccatctgaaataattcccagttcaatcacaccaccagaacaaactgaacatacaaatgaacatgtcactgagcaagataacagtgaagctcctcgaaggagtaagagacaaaggacagctaagtcttttggtgatgatttcactgtgtaccttgtggatgacactcctaagtcaatttcagaagcatatgcatctcctgatgcagactactggaaggaggctgtccgtagtgaaatggattctattatcgctaacgggacttgggaggtgacagagcgaccctatgggtgtaaacctgtgggatgcaagtgggtgttcaaaaagaagcttaggcctgacggtactattgaaatgtacaaggttcggcttgttgctaagggctatactcataaagaagacgaagatttctttgacacttactcacttgttgctagattgaccacaattcgtgtgctactttccctagcagcctcacatggtcttctcgttcatcaaatggacgttaagacagcttttcttaatggagagctggatgaggagatctatatggattagcctgatgggtttgtagttgaaggtcaagaaagcaaggtgtgcaaattgttgaagtctttttatggtctgaaacaagctcctaagcaatggcatgagaaatttgacaaaacattgacatc

SEQ ID NO: 44952 - DNA, 1204 bp, Oryza sativa
ttcctgcagccctttagaaatatttagagacttgaaccaactaaatccgagctaagatgaattagttatgaatttttaaagattaaatcgaattaaaacacttatatggattttaattgaattatgacgcaataatgaattatttttcaaaaagaaaaaggggtttgttgcgtcagcggctagggtttgcggtggaccgggcgcacggcagcggttcacgggaacgaacggccgagatcgatcctatccaaaacggacggccgagatcgaccggtccacggccggaccacgagggacgacgacgatgacgtcagcgacgacgtcaccaccggcggcggctcggcggctcgggcgcgcatgctcgccggcgaacgacggcgcgaggacgcgaacggaggacaccaaaacgatgcggacatcgcggcgaactcacccgtgaccaaagcgacggcggaggagcaacggacgacgtcggcaacgaggtcgaagcggcggagaagatcgggtcgacggcggcgacggtgctccggcggttgacagcgacggcggaggggcggacgaggacggcgacgcgacagcgaccacgatggcgatcttcccgaacgacgacgacgactggagcgacggcgacacacggctggagcggcggcgacgatggcggcgctaggtcacacggcgctagggcgctaccgacggcgagaggcgaaagcaagggtggcgacgggtagaggagacaccggggatccttttataggggcaaggaggcggcggcgaaggcccacggcgaccggcgacgcgaaggaaacctcggtgtcggtgacatgggaccgggagtatcatgacttagagacttgaggcagacacgatcacccacgtggcctaaccccctcgggggggttgggcccgagggtgatacggccgcccttctctttgtctccccgaggggtcggaccgctcccgtctcggccccgagggccgaggcgccctgaccccttgtgggttttgcgccgcgtatatggggtaggtgagcatagcggggctcacctaaccacatttattgcggtttggacgagcgcgtcacgccgcatgtaacgcagtgcagcgcgctcgtttatccggtcagtgaccagtcacagaccgatcagatcgtgggttaggtggcgacaggcggtctgacgcacgcctcgccccatcccgtcaggat

SEQ ID NO: 44953 - DNA, 1381 bp, Oryza sativa
taatgaattcccatgtcataatccttaattaattccaaccatctcctttgtctcatgttcagatccggctgagtaaagatatactttaaactcttgtgatcggtatacacctctgtacgagtaccgaaaagataatgacgccaaatcttcaacgcacgaactactgcagctaattcaagatcatgagtagggtagttcttctcatgcggacgtaactgacgagatgcataggcaaccaccttcccatcttgcatcagaacacaacctaacccaagtttggatgcatcgcaatacacttggaatcccttctttggatcaggtaagatcaaaataggagctgatattaagcgattcttcaactcttgaaaactctgctcacattcttctgaccacttgtacttcacatctttctgaagcagccgtgtcatgggcttagcaatcttggaaaaattctctataaacctccgataatatcctgcgaggcctaggaaactgcgaatctctgaaacggtctttggttgtttccagttggttacggattctacattactaggatcgacggcaactcctcctgctgagatgacgtgaccaaggaacttcacttcagacaaccaaaattcacacttgctaaacttagcatacagttgatgctctcgtagcttctccaatgcaaggcgaaggtgttcttcatgctcttctttggttcgggagtagataagaatatcatcaataaagactaccacgaacttgtctaggtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaattctgggtagcgggtacttattcttgatagtcacatcttttagtgcacgatagtccacacacatcctctgggtatgatctttcttttccacaaaaataaccagagctccccatggagattaactcggtctgatgtaccctttctgaagcaaatcgtccacttgcctcttgacttctgccaactcgttggctgccattcgataaggtctcttatggatcggagttgttcctggtaccaaatctattctgaactctatatcccttttaggcggcataccaggtaaatcatctgagaacacatcgggatactcccggactataggaatctcttccaaagttatttggttcagtattgaccttaaagactcagaagacaatgcatgaacagttacaactcgaccatcattgctgg

SEQ ID NO: 44954 - DNA, 1588 bp, Oryza sativa
ctgcagcccagaagcaactcgaaggcgaagacattgtcacccattagcaatggcggagacgttaaggccgatgaagtagaagtgctggtgatgatgtcagtgacaataatccgtcaatctgttgagaagatatcgaagctcgagcaatttccttgatgcgagcgtgtgcataacgaagattgatgcaatgccccttgatttataaagatggcagtagaacttggtgttatagctgttgtagatgcttcacttggaggaaagtagaggctgttgtacaattcattgaaactgagctgattggttgataactgtaaactcctggatatgtagattaaatctcgaactaccagctaaagtaaaatgtcggctctgaagcgaagacgaagataataactcccagagttgactcgttgattgattgattgcttcatcttgacataaaacttgtcgaattttgagtcttatatttgtatagcccccgactctttggtcagtcaagaaacaactgaacatagagtcgagaactgtagcttcttgtcgtcgagtagaattcttgaaaattggagaaccacttgtagtagtagattaacacgacgtcaaatttggtagtgcaagccgagatgtcgaggctcttgtagacgtcgtggttggtgaaataacgaagctcgtgaagtagaggcattatagtttgccggtgccaaagataataaagatgaagtcgctccaccatggtgacaaaattgcatagccgtgatgaagtaaacacgagtcggcggcaacagaagcaaaccggtagcgtagacgcgtagttgtgaagataaaaacaccagtcagcggcggcataaccagtcggcgacggaagaagtagaatgatgacaaaagcgaagacgtccttgaacggcggcaaaataggctagccatgaaagtgaagacaccataggcggcagtgaaggcaaaccggcgatgacgatgacgccagttaatgatgacgaagacgtgcaaccgtggaggtgaactagccagtcggcgtcaggcaaggcggccagaaataaagacgatgacgtccatcagtagtggtagtggtataaaccagctgtagaggcaagggcactagtcagcagtagacgagacgaccggcggtgaaaacgataaggccaatcaacactggcagaatcaggcagccgtggaagtgaagaaaccagtcagcagtagacatagacagtttgcgttgaagatgatgatgcctattagcgatggcggcgacgtagccagccgttaacacgatagcaccagttggcattatacgaggcggccggtcagtgaagatgtagacgttgaacaacggcggcataataggccaggcatgcaggcagagacaccagtcggtggcgacgaaggcaagccaatggtgaagtgatatatgcccaacaacggtggtatgaccaaccaaccgtgaaggcgagcacaccagtcggcggcggcgaaggcaaaccagtgttgaagacgtagacgcccaacaacagcgggacaataggccagccgtgcaggcggagacactagtcggcgacggcgaaggcaagctggtcgg

SEQ ID NO: 44955 - DNA, 8527 bp, Oryza sativa
ttataaatatatatttctcctgttgtcaattttgatttccccgagtagatgacttcttacgtttaaacacttagcccaactagtcatagcccccaagcaccgggagtcagcctaggcacttcccaaacatgcatatgagcgacatgagttcgtcattaatggaacaaagtttcacgaatcagaatttactactcgagtacttttgcaattgttaagagcataagataaatttatctcatctctatgcttttgatttattccgagtaatacttagcaccttgcgttactcggtccatccaacgagcccccgggtgctaggaatcggcccaaaggcaactatccgtcgacaaaccaaatggaaagcatagaaagatagaactccataactcgataggtactttatctttacttggattatatcgcaagtaatcaagataggcattatgaacaatgttgaaaaatatgatataatatctgtagcccccggctcacttgtcaacgttgatgtagtgaggcagaggaaaaggaaaataccatatataaaaaataaaacaatgatgacttagctttttagtattcccgctggtgatgacagaactagccgatgtgggaataaagtcgtccatcaatggcaatgaaagcaccaaccatggaagcaactgagtcatccgtcaaccgtataggcgaagtccgccaaccgtataggcgaaaataccagtcagtggcgacgaaggcggtcgatggtgaaatatgatgatgcccatcagcagcagcataacaagccagccatgaaagcgaggacaccagtcagcggcagacgaggcggccggtcggtgaaaacataggtgcccaacaacggtggtgtgaccatccaaccgtgtaggcgagtacaccagtcggcggctgatgaggcggctggtcggtgaagacgtaggtgccaaccgaccgtgtaggcgaggacaccagtcggcagcagataaggcggccggttggtgaagacgtagacgcccaacaacgatggtgtgaccaaccaaccgtgtaagcagaaacaccagtcggcggcggcgaaggcaggccggcagtggagacatagacgcccaataacggtggtgtgaccaaccaaccgtgtaggcgaaaaaccagttgacgacgacgacggcggccaatggtgaagacaatgccgccatcggcaacggtggcggagtacgccaaccgtggaggcgaaggcaccaatccatggctgcgaatgccacatatgtacgtgcatacgaaaataacagatcaaaaagtaattagagatctgtgaattaaatgactagaaaaatcaatagtttaatctggtttacataaaaaaaattaaaacgatagacctggtgaaggtttatgatcttgatgcacgtatgttgtgacacgtcctattttggaacttgcatgtagatggataatttatccgtaaccaatgtccggttcactgatccaatggtaacctcaatgattggaaacgcatactgtgtagcagtagtctaagcgctgtcgctgtgcgatcaggagcatacacacgtgtagataatttcttccagatttcttgacatgtggtgtgcctgttacatgtatttcatcatcggggttgatctatggtgtaaattccagattagtctgttgttgctggactccgcttcggacttcagttggagaaactcgatctcaccaaggaaattaaatcgatgagatgacaaacattgaaagcttttttcccgtagtaggatgttcgcagccattgacattagctcgtaatcaatcttgacgggttgctccgttcgaagatgtcgaggaatctgacgatgaccggatgaggttgaagtgaccttgagcccccccaactggtttgagtcccagtcagagagagtctgctagagtattcggcgacgaggaggcaaaaaatctaccaaagcgaagatgaagtgagcgacttacgaagttgattccatcgcacttttcgacaggaaactcggcgtcacccctacctggcgcgccaactctcgaaacatgaattcggcaataataaaaggggtagcgcacgagacctaaaagtagatggatgcggagacaaaggatttagacaggtttaggccctctcaatgagaggtaataccctactcctgtttagggatttgaatccaccgggtgtgtattgatctgacgatcaggttgtgtcatctaccccctagagggcctcctgcctaccttatataggacggggggcaggattataagatagaaaccttaaccaatacggtatcggtttcctaaatctactttacaatattatcaaaccaggactttaggccgttccataatatacaaggaaacgtaatacccaagtcatgatttgttacatattccatagatataagttatcccctataactaatcgataaccatgacgtgtggatatggggtacccataatctctacactaatctccacaccttaagtgtttgccatttgcgttaccctataacaaacccaacgtttttcagctttgctgtgatgcatgccatctctaacactcaatgatgccgatcgcgttaaaaagctttaccaatcgataagatgatcttactagcgcgaaaccaaaatgatcttactagcacaacactacataattaaatacatatatatatcaattgttattatattgtacttatcaatgagggaataatgggatgcataaacgaccgagatgtgtctatgggggtggggtatgattgcgatgacaaccttctactctaaaatatcaacatcaacctacagggattcttttccatttgatggttaatatctagcactactctttttaatatcatcttgatatattttttagtgcaaaacttctacatcaaatcctttcaaaagcttgaaattaaaaagaactcattagataacacacgggctataaaaaaagcatgcacgactactttctagtattaaagctaactataaaggtagcccgtgcatttgcgcgggcttgtattttagattgcgtttgaaaaacttatatagatggaatatcaaccgaatgacacctgtcatttttccaaagcattatttcgccataaattttcttcatcctcgttacttagatactatttgttagcttttataatatataatattttaatacatcgctataaataatttataattatctatgatcaattttgggaggtgaatttttcttaaagataattaaagggtgttgcgatttcgcataagatgtatccataatactgacatacttataataaacataggtttttaactgtaaatttattacataaataatctgacaacataaacttacactaccacataaacaatttattacgtaaataatctaacaacataaacttacaataccatagaaacatggataggtaccacttgggaatccgtcataggtgttcgatttcccattcggcatctaggaagcggcaaagatgagggaaatcaaaggtgcgggttccaaaaccgggaccttagagaggttttaggaatcaaaaaaaggcatcgagcagctcccattcaccccgccgagaacacatcgaagaacatccaagaacgaatgaacatgaacatcaagaatattcttcccaactactgggaaccatcaaaactactcatccccatcaagaacacaattacaaaaaacacatcaagaacaaatagatagcacaaagagccaccgctcgacaccaccgccattgccgccgcctcctctcgtgcgccgccgcctgccaccacctcccctcccgccagatctagcggagcggaagacgctgccgccgctgccgggccgagagagaggagtgcgtgtgtgcgagagaaagaggaatgcgctcgagagagagagagcgcgcgttagatagagagtgagaggagagcgagactatcggtcttatccgtgcgagagagaggggcaccgagccctctcaaccttatccgctcaagaccaccgatcggctcggctcgacttttaattatccaacacttatagtaaattaaaggtgttagttttttttaaaaaaaaatacatctagctatataatagaaaactgacacctacagtctattaaaggtggcagttttttttttttttgtattttcaacccgcatagatgggaaatggtatatatgtgccggttttattacttccagcacctataacaccgagctctatgtgccttttttaagtagtgtgatcaaatcatatatgtatgatatagttactatataaataatctaacaacataagcatattagaatacatttatgatttaaatgctatagttgcctaaatgttttttacgtaaatctctgtgtcttttttagcagtgtgatcaaatcatatatgtatgatttagttactatataaataatctaacagcataagcatattagaatacttttatgatttaaatgctatagttgcttaaatgttttttacgtaaattctgctttcttttagaagaaggaaaataggagagataaatagataatagaatgaaaagagaagaatgggaataggagcgtgcagagttcatatgtatacgtgcatccgcaagaatatataggggcccaatttagagttagattaggatggatggattactcttttttctacatcttatctaatggtcaaaaaggatgggcccacctatttaaatgaaaattaagggttagatgtttctttaccacatggcagcttaggagcacttgtagagtgccatgtggcgacatatgagcatttgtagaaagtttaatggacttttagtatataataatagatagatagatttcagcccatgcatgctgttatcactttgtatctaaaaaccaaacaaagataaaagaaaggtgaggatcaaaacactcaatttggaactacgaaatatacttatattcaatagataaagaagaagctgcaaactcttccttttctttggagtatgacaccagattgcagtagttctatcctggtagacatgaatatacactcgacttcatgaaatagtagttcccatcaaataataatttttggatagacattaattcaaatagtagttttcattttggacaatcgtcaatacaacatagtatttgccagcaaagccgagtatacagggccagtacttacccatagaaaaatgaaaccataatcagtacgtacacaatcgcatgaatttgatagaaataaaacaatcataggaaaacaaaccatccatgacacctacagttcgtgatatacccggctgaaccttgtgataactccgcatcagactcataggatggaaaccatccaaacctaaagaacaaaatacactcaaattctaacaaccgtaatgctagtaaataaataccgccacttattcttccaataaacttttaaaccgaaaatctagaattttgaataaaccggtgaaaaaacttggccccactactttaattgtaatatttgaaccacataaccaaacttagcaaataataatgccttgcatatgtactgaaaattatctgcagctttcatattaagtgaaaaatctaattttatttccaaccatctcagatttaagtaaaagaaatcagctgcaccgctagaaaaatatcgacgagacctacgacttttgcgtacagcacaaaacataacttctaatggattaataccactatttcagtctacctagaaaattaaaatcgatctatggcaacaaaattaaaagtaaaattagaagtagcaaggaactagttttagtttacccttgcggccattataattcggtaaatctttcattctcctcaaccttccctttttctgctcctctgtttttgtcagcagcagtgcgtagagcagtcgacagacgactagccaatcagctgggaaggcagcagccagcaggccatgctgggtaacaacaggcagcacagcagatcagcagagcaacatactagcgtctggcctcgccacctgtgaacaccgtcacagctaatttgatcaaatggaacaaatagtgctgttgagattataggcataaaatgatttaatctatttcataaataaatcatgacattacagatgaaaactagcatgaacgcatcattagatctacacatgtaaactacacagtataacatgaacagatcaaatatgcgcaacatattgaatacgtaccgaggtagcggaaagaccggctgcttcggtcgaaacttttcgcaggcgtctacgaaggcacgcagcacgcgagcgaagaggaagacgagccgtcgcggacaaacagggagcagtcgcgcaaagcgcttcccaaaaatcttattgccgccttctcccggtgcaggacgtcgaaggcagaggttccggagacctgcactcccgatcgcaggtgcacgccggcaagcgggatggagtaatctacgagcgacggcgcagcacagagtaggaggcaaaccctagattgattttgcgtgtgttgcgtgaagacggcgggtcggtttatatagagaagggtcacttgatcagggcgcccgcacgatctccactgcgcgtaaccgaatcggataagttgcgcgtaacttatccggactccacgccgtttgcacgcaccagatttttcggaacgtttccaaaacaaaaacgaatccgaatttgcagcaaaacaaaactacaaaaggaggctgcatctgcgcaaggtgatgaaccaattttggcggatcattcgacgcgtacgtcgtgcacgcggccgcctgccctgccaggccaggcgatgcgaggcgagcgagcgcgcgcatatgttccccctcttctctctaccacacatgcttcaagtggctaggagggcatcctcccttttaaggaggtccccctcttctagaataagcaaggtggtactaaactccacatgcatgccatcctaggaggtgggcttttgtgattttccaaagaattaatcttcgagtgggctaaggcccattcattaattccaacaatcccccaccaaatctcaaaatcccactgagatttgccttttccaatgtactgtttatataccagcggttcgatggagaccgattaagattgaacatccacctagaactccaagctacacttaatcacaacttgaacaatggactatgccttgaattgcaagtcctgtgcaagcaagtttcactcagagtcttatctggtactagaccgtctgtagactacccctcgggtggagcgtataagtcatactcctaggtctatagtaagcttcctagaagattcacccaaaatctccatagactgcgaccaacagtcaagctcacaaaggtgagttctttcaagaatgctctgcaggacaacatcttcgctaattaaagccaacagaacacattaaggcatagccaacctgccttacagctcacgagagtacatgcatcttcacttagagagggtatagattggtactctcctctagtttactaatggtttgttcttcccagattctaattcacgggatctccgatcacatagactgggttaccaccatagtataactcacatgggtctcaaacccatctccttcgatacattgtttatcacatttcgttatagtcccttcgtgaagggatttgccaggtttctagctgtttggatgtaatccaacgttataactccggagtttcttaatttcctgatagatttcatattatccttagaactattcactttaacaattaccgtttgattgtcacagtttataaggatagccggcaccggtttttcaacaataggcagatccattaatagaacatgcagccattctacctcaacagtagcagtatccagtgccgtcagctctgcttccatggttgacctcgtcaaaatggtctgtttgcaagacctccatgaaacagcaccaccacccagtgtgaagacatatccactagtggctttgatctcatccacatcagatatccagttagaatcactataaccctccagtaccgcaggatacatagtatagtgaagccccaattccacagtatctttcagatagcgcattactcgctcaagcgcacgctagtgatcatatcccggattagaggtaaatcggctcaacttgctcacagcaaaagagatatcaggcctagttgcactagccaggtacatcatcgagccaatgatttgggagtattccagttgattcctagcaattctcttgttcttgcgaagcaacaaactaggatcagaaggtgttggagaaggcttactatcaatgtagccaaaaccaattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcataaaa

SEQ ID NO: 44956 - DNA, 1617 bp, Oryza sativa
agacctaagtctttttatctttctgtcaagttgattttcaacttctgccttataaattttaaaatagtctagagcttcgtctttcgttttcaacaagtacacatagaaaaatctagtagcatcatcaatcaaagtcatgaaatatcattttccaccctttgtcaacaccccattcatttcacaaagatcagaatgtaggagttctagtggtgccaagtttctttcctcggcagccttgtgaggcttgcgaggttgcttcgattgcacacaactatggcacttagaacctttgacaatggaaaacttagaaattaaacacatgctggaaagccgagacatcaatccaaaattaatatgcaataaacgtgagtgccaaacattagcctcatcatccacactgccacaaatatggttcacagacttattgtagaaatcagaaagggaaaagcggaataggcctctgcactcataacctttactaataaaatatccatgtttagacacgactactttattagactcaaaaactaacttaaatccgtctctagtcagacgggagccactaacaagattcctgttgatagaagggacatgttgcacgttcttcagctgtacgatctttcccgaagtaaactttagatctaccgtgccaacaccatgaacagaagcatgtgacccattccccaataggacggtggaaccccgtgcgacctgataagaagaaaacaatgagatgtcagcacaaacatgtacattggccccagtatcaacccaccaataagtagactgattaactaaaaaaacagtaggtaaattaccatacccgcttccatctccagtcttgccaatggtcacattagcatacttagaagtctgccctgcaggtgccttcatccccttgcgctgtggatacttcctagccagatgaccaagttggccacacacaaagcaagtcctctcatcttgattaggattgttattgttcttcttctgcttcttgaagttggtggtctgctgagctttgtattttcccttgctcttgttctgggccttgtgcacaatattggcactggactgcccaccatcgcccttagacgcggcatctttttcccgagctttctcctcaatatcaagagacgttatcaacccctcaacggagtattcctgtctcttatgtttgagtgcagtaccgaaacttctccaagatgaagttagtttcgcaataatgcacccgaccacaaatttgtcgggtaagacacacttaaggagttcaaattccttagccatggtttatatctcatgagcctgttcgactacagaacggttgtcagccatcttgtagtcatgaaactgctccatgatatacagatcattgctagcatcagtagcaccgaatttagtattcagtgcatcccacaactccttagcgtcggtcatatgcaaatacacctcgaccagacgatcgccaagaacgctaagaatgcatcccacaaagagagtagtggctttctcgaattgcttctgtggttcagcagtaagaactccttcaggtttgccagtactcacccagaagcatttcatagctgtcagccacagagtgaccctgatctggcatct

SEQ ID NO: 44957 - DNA, 9330 bp, Oryza sativa
cctgcagcctttttctaataactctataattaaaaatatgttaacaacagcttaattaacatcgactcttagtgtttattaaattgaagtttgatgcatgaggaaggataaagaagagaaaggtaacagaaaaattgctagagcatctgtcgtctcaactcttatatgagggtaatctctttgtagactaaaagtatatatcagcttatcttaataaatactagcaatggaaatagaatccgacacataaatatcttaataggtgaaagcagcaagcctctcaaacagcgatatgcctcgtcatctgaaatatcagggacctttaggagatgggagttgaaacagagatggaccgttggatcatttggagtggagtccaaccaggaggcttccagaccaggtcccaatgcagattactaataaagaaataagggagcgtagcagagtaatgcctaaagcaggggattaaaaaaatctcatcagatgtttttttcagctttatcactttaataatcaatctatttacatctatacatgtacaatacaataggctacaagtaacaagttcttcgtataaacgtccaaaaaataccattcaaattatgatagactttgcaagctatatatgttataaatattgttagtattctctctaggatcacctaggtttagatctagtcgggttggttctatttgattgaatgattgaacaataatagagattaagggaaaacggtttagggatgtgaccggttgacgttggatgaggagaaagtgccggccatcgtcgttgtcgtcgctcggcttgacgaggacggcggcgacggtggtcgtagtagtagaagtcataggcaacgatgaggcgtggcgcggcggtggtgtcttcccatcactggctgcaccccctctcgatcggattatggtttgtgggtgtagttggcgccggcaacgaacctcatgtcgtgcgccgctctagcctccatccctctttatatggcgcatggtgacggggcccaccagccattgggctaggtgcccctgatcagggcgtgggtccccttgagcccaacggctcaaagggagggagatcaatctaacattctcccccttgatctcactatttcttttagcctttttctattccatcacagatttgcacatagagcatgtttcatcgtcacggtcaatcaccaatggattcgacatccactatacacatctctattcaaatatagatactttaacttttgggccctgtagtccaggattcataaggcttcccttaaacccatgccgactacatgtttcttgaacacgttgagtgataggcctttcgtgagcggatccgcgagcatcctttctgttctaatgtgctcgagactaattgtttgatcccagactttgtccttcacaacatagtactttatgtcaatctgtttggcagcaccacttgactgattgttgtgagcgtacaaaactgcgggttcgttatcgcagtataactttagtggtttctcaatactatcaaccacctttaaaccgggtatgaacttctttagccagttcacctgcctagtggcctcatagcatgctataaacttggcatacatagtagaccctgcagtgataatctgttttgagctttttcatgaaatagctcctcctgccagggtgaacacgtatcccgatgttgactttgtattatcttttgcaaagtcagaatcagaataccccactatctggagcgattctgatcttctgtaagacagcttgaggcctttagttccttgcaaatagcgcaagactttctttaccaatttccagtgctctgagcctagattactctgaaatctaccaagtaacctggtaccaaatgctaaatcagggcgtgtgcacacttgcgcgtactgtaggcttcccacggctgacgcatatggttttgttttcatttcattgagctcatactgatttgtgggacattgtcatgccccatacttttccgctttgactataagagcaggtgaagcactgcatctgtacatgttgaatttcttcaacaccttttctatatatgtcttttgataaagtcccaatgcatactttgttctatctcagtgaatctgtatgcccaaaacatatgaagcctcaccgaggtctttcatgtcaaagtttgaggacaaggatttctttgtttcctgcagtggactgacatcactactagatggtagaatgtcatccacatacagaattaggaaaatgaatattccattcttaaattttgaataaatacagttgtcctcgacattctcttgaaacccaaatttctttatagtcccatcaaacttcaagtaccactgtctcgaagcttgctttaatccataaatggatctctttagacggcatcccatatttttgttccctttcatgacaaaaccttttgtttgtgccatgtatactttttcctctaaatctccatttagaaatgccgtttttacatccatctgatgtaattccaaatcataatgtgccaccagtgccattattatcctgaaggaatctttacaatagactagagaaaatgtctcattgtaatcaatcctttctcgttgcgtgaagccttttgccacaagtcgcgccttcaaattttctatattccctctggagtcatatttggttttgtagactcatttacaacctactgttttggctcctttaggaatttctttcaaatcccaaacatcgtttagtttcattatttcatttcatcttacattgcttccaaccattcagatgagcgagcgcttctcatggcctcttcatatgaggtgggatcagcctccatatgcgactcttctatactataaacttgatagtcatcacgaatagccgatcttctaactctttcagaccttctaggggcctgctgttccggcacattatctgtttgaggctgttgcagctcctcctctggtgtggcaataatttcggttgaatcctgtagaacaggttcctcactttcattcattgttgccacaggagaggtaacaacaggtgttggtaccgcaacgtcatgcattgcaggcacaacatcagcaagtagagagaagaaaggctcttgaatcgacggagcaggtacagacaccccctctcctcaagatcaatttctcgaacaaccgagctccccctaatcatttcgtcttccaagaagacagcgtgtctcgtttctacaaactttgtataaatgtttggacagtagaaatcataaccctttgatcttttaggatagccaaaaaaatggcaacttattgtcttgggatctaatttcccaaggtttgggttaaatactttagcctctgcaggactcccccacactcggaggtgagctagtgagggtactcttcctatccatagctcatacggtgttttgggcaccgatttgcttggaacgctgttgagtatgtattgttgtaaatctgagaactccaatggaggaagaattacactcttaactagtctctcaattctccccctcgaaatatggcctaaacgacagtgccataatttcgatgagacatcaggagttcgctttcttttcttgttttcttatatcaacgaggacacaacattcacattcttagaaagagataacaaataaagctcgccgacgatgatctcgtatacaagccaacacatgccccccggcatatcggctcgaccgacgacactcctgcttcaaggcttcgtcgatacgttgaccgatgccttcgagctgggtgctagcgccattcagccacgagatatatccggccgccgattcctcgggatccccgcggggtactcggagctctttacagactctcgacatggatgtgcagcaactcttcagatacgagttgaaccacacctcacgaccccggagtgtctctacggcctggtcctttctcacttccagcatagtcctcttgagttccgcgacctcaaacttcgtcctccagtactggatgcgatgatcctggtcagcaagtgcactctcgagatctgctcagcatggaaacgactaagtcaagttgctcttctctcccgagaacacaacaaatcaagtcgatccagacggaagggcaaaggaaatgataacaaagacaaccaacctaagggagtcgtcgccatgctcgtttcgatgggcgaattttgagctacatcgccctccggcacatgtggctcgaacgcaagtaatggaacgactaccggcaactcagactgcccgtgctactggacatcctcgacatcaacatctctacaaacgacaacaaagttctcaagatcaaaatgctgaaaacgctaaggtgatgactgcgcacacaaaggcggttggaaccaataaaagttttacaaagcatggccaaagagtacaagagagctaagaccctactcttcaaaaagagggaggacggactctcccaggtcaccgacctcctccatctcgtccttgcgcacatcgctggccgccccctgatccaagatcttctgcagatcgagttcaggatgccagcctcacacacgcaaggacatggcacgccccggtatagatcccgttggacgtctcctctccgaccctggccgcgtgtttggaggggatcgcctccatcgccgctgccagctcctcaagtgaggacgtcaacgagaactcgtcggggttcgccgggatggtggccttgacgccgtattccccggcgagctggtgcaggccggtgtaggtgacacgcagggagccgcggatctccgacaagcggttctcgagctctgacatacggtgctcgagcccctgccgttgtcgctcattgccagccaccagctcctgcatcttctggaggtcctcgcaaacctccgctaagtcgcgcgccagccggtcggcgcgctcattcgccgacgacgctgccgccgcccttgcctccgcgagcactagcctcgagaaggcgccccatctcgacctggagctcctcccaggtgagaacggcagctggcgaaccccgaccagcggcaagatcgctgattgggccgctaggtgtcgcctcgcgactcctgggcacgaccacgacatccgtcgaggccatggcaggagacgcgctggaggtccctccagacccgtcttgcgccaccttcgcccgtgccgccctgcgaaaagatggaactgagacaggctgcaacagtttgatgaagtgacaagatctcaaaatcatccacttacttctcgctaagcatcactagccgctgccgtcgcggaggtggaggagacgcgtccgaggcctagagtacaaccgatgcgatgtgaggtgcaaatctttcgactacgtaataaaagaacagggaaacttaccgagggggtgggtgtcttccgacgatgtccgaccatagaggagaatttcctcccctttttcggaacattgccgccactcgttgtggcagcggcagcagcagcgtcagacgcctccttggcaactttctccttcagcaacgccgccacctgatggtccacgagcggcccgatgatatcagtcagagggagagcctacgtgtcatgaagtcacaatgcaatcccggaagaaaaaaggaaaaggaccgctgagtacacttacattgatggcagcatcacgctcggccgcccccttctcgcaaagggggacggggacgttgctcgccgttgtcgggccactgatcaccagttgactgacgcggcgctccacggttgcactgtccaagcctgtagatccagaccagaatccaataagtcgggaagaacacgcgcataagggggtcaatttaactaaaaaggaaaataccccgaggagaaacccgggtcgcgtcctccggcctagaataatcaaaggctggatgggctcgagcgtgaagcggctgaatccacctaccaatgaagtcggcagtgacttcataccccgacaacccctgttctcgaaggtcattaatgacatcgatgaaagactgaagggaggagatcaaagcgggtttggtggtccaggatggaatcttgtttggttgttcttcaggaacaatgaagaccggatccgaatcctctatctgaagatagaaccacctcccccgccatttgctgcaagatgaggggcactggaaggggatgtatcgtgacttcaggccatcccgatgtcagaaaccaacacacccggacacttttttaggttctatctagcgcaactcatagtagaagcggaaaaggtcaagaaacggctctaccccaatgtaggcctcacacagatgagaaaagatactcagaaaggcgatggaattggggttcaaatggagcaaggaaagaccatagaaattcaacaccaatagaataaatttagacggcggaggaagaaaaccacagagaacaaagtcctcgatcgcaaccatgcgacccaggacaggctggggttcagtacctcctacttctctttctgtggtcccgcgaccgggaagggcgccatcctcctgcagtttcttcagtgacgcactggtggaggttgacttaccgccggggatcgccggagaaaggatcgagatgagctagctagggtttttgcgggagcaaagaagacgagggatgcttggaagctggagagttccttcaacaggcggacttcaaatgggatccccaaaactcccttaaatagacgtacttccgacggtgcgaattccaaggaaaggagagagatggccgccgaaaatttcggggtccattatgcgcgacagtttttcggacttcaatttaaattcactcatgaccgttgagcttcacccgacgttgtcgatcactccttgtctctcggtttccacatcgagaacgatgacaacatcagaagtcgcgatcggtctcacaagatcatttaagtagaagtcgggggctactgtccgagttacaggtaaggtataccctccacccttcgatatacgtcacattttgatatagtatgtttgcgcatatacggacgttctcagcaaaagttaagaaagtccagcatggagtctacagatggaaagagtcctactcggatagaactgggtcatcattgtatcgtgtcgggtccgatgtctccgagtccaacctggagaccagttgacctgcggtataaaagggaccccccgggaggacctaaggcattgaatctcagagccaacacatccactacagcctacgaagccagagcttacaggagcagaattgccgggtgatctagttgaatcaactcgattacgatctcgtcggtatcatcgagttccactatttcctttgtaatctgtggtttccatcatataatcccatatcaactggattagggctattacctattaaggggcctgaaccagtataatttttgttttctgcttgctcgatgtcgtattacgtagatgctcgtaccagcgtaccccaataccctctatatctggtctacgggtatcccccgtcgacagggggtttctaaaatatgtggcttttttgttgcactggaatatttcagttcactgcaacattagatcgatgcatagtgaaacattgtgagtaatctaggtgaaacctttttggtggaacaaaaaataaaccaaattcatttaatagagggtttccaaaatatgtgggtgatttgttgcaacaatacgtttcataatataaaaatccactgcgacatttgattcgtacatagtgaaacatcatgagtacactagctgaaacgttgtaaaactactggttgaaacatcagaagagaccacatgcaacattaaaaaaatcaataaaaaactaatgtgtggtcttgttgtaaagatttaattgtaacgaatttagtggtacaattagatcgtaaattagataaatagtttacgagaaaaaatcttttgaagaaataagagaggggggcatgtaataaaagattcgttgcatgtctgcatgcagtggcaggggacaaaacctgcgtccgatttttctccaccccgctggtcgccggggtgtgagcattttcggtataatcatgtaaaaccggtaaaaaatatttttttcaatatttttgtgacttctatgtgtgaaagactgagggtggtagaatgagaaggccctatagcatcttatactttggtttttgcccaattaattattgtggtaacataacagacttgccaataatttgtacccatgctgccagtcttagaaatctcggtagatgtgcccgttatatataaatctacaacggcaattttgctccatgtgatcaaaacttatttttccatacggttgggctactcatttgccccaacatatatatgcaaggagatgaggggaggccatcaatggcagtggttcaccagagattgaattcgatgattaaaggctgaatcaagaagggtaaatatgggggaattgatgatgaggaggagagagaatgattttttattcaattcggagtgtaatcatccggggagggaggtcggcgtgccggcgacggtagggtttggtcgggagggagaagaacggcggacttgaggtaggggacgcgcctggcacgtgggccccatctgccagcgcgtgaggggaaggggatgggaaggtggccggtcaactagaccaggacaggccgagggggagaggggagagatgggccgacagctggagatggcccaagagggagggagagaaagaggaggaggtgggtggacaaatacagacttcgctcatcggctggggagaggaggactttgggccgaaaatgttatggcccaaagagaaggagagaattattttatgtttttcatgttaatataaactctgatattggttgttgttgtattaaaattatttttgttgctctgaaaattcaaataaaaatttagggaccaatttagagcatggagaattcaagaaaaatactccaagccagatttcaattcttcttgatgtattttaccttttaataatttatattattccttttaattgggataagtccattttacactgtcgaactctttgctttgtctaaagtgcacacccaaactctaaaaccgggtaaatgatgtttaatttaccccttccattcaaacaagggtggtttttcttaaattatgctgacgtggtgatccaatcaggcaaaaaaattaaaaacaaataattggtaccacatgtcagatgccacctatctcctacccaatatctcttccttttcactctcttctctccttccactacgagaacggtgctggcgataagatcgagttctacctcctcgtctcccccctcagtgccggcgagctccccgtcccccg

SEQ ID NO: 44958 - DNA, 8723 bp, Oryza sativa
tgtggatcgttggtatcagggtatatgcgagattaagataaaagagatggagacaaggatttctatataggttcgagccccttatctgacaggtaatagccctactcctgttggccgaaaccggtgttgcttttattcatcataatcacaccaatacattaaattgggataacttatctagctgtcatcaacttggcggcatggataaccaactcgtagtggacgacatggtagtcttccctcgaatccgcactcggcgaaatcagagatagcgctagatccctcttgttggcctccgcagacaccatattgtgtttgtctagacttatctctgatatcgatatccagcgacttatcttggcgtgtgttggcttctattgatctatgttgatctgtatgtcttttggcttgtcccctctcctcctaggggggcttgtatttatacccatacatgcccccttgtccaagtagaactagagagaccaatatggatacaatccgagtagtccttgtcgtttccatgtagaactctatttgtccttccttatccataactccttctatatacgaggtttgtttccgtataaaacatgttatgtggtgggccttgccgagcttagtcaattagtgttaggtatatagtatccataaccctgacagtagctcctgacttcaatgcaaatgaacgagttcatgtcctgaaccgaagactttggaataactattgtcgtgctcacctgaccattctcggtgagatcagagatatcgctatattccccttatcgacctccacaggcactatattgggtttgtctaggtcccaatgcctactcagaaggtatggagtttgcgactaagtcccccatcttgctataatcgagaatttggattgaagtcaagaaattccatctcggcgggtacaccatcgcttcattccatattctttgttgagctccatcaaccgttctcgagtaatcgagtgggcatagagactgcgacaaagccttgaaatctgactagactgttataatgtctgactttcagaaatttacgtagatgctaagacgaccaccacattgggcaatggccaggtgtatagttgtagtcaacaaatcacagaagtagtgagagaatcactacaccgcaggtcgaagaccagttatagtcataactcgaccacttgaagtggaggtacgagagattgctacgacctacgagttcgagaaccaggagtaggagtctctcaaccgtttgaaattgaggtgcgaggaccgcaacgtagtaggtcgaagaccagtcgtagtcgtacatggaccattagaagccgtggtgtggagatcgctacgttgctggtcgaagaccagtcgtagtcgtacctcgacaattagaagtcgtggtgcgaggatcgctacgtttctggtcaaagaccagtcgtagtcgtacctcgaccattagaagtcctggtgtgaggatctctacgtttctggtcgaagaccagtcgtagtcgtatctcaaccattagaagtcgtggtaggaggatcgctacgttgttggtcgaggaccagtcgtagtcgtacctcgaccattagaagtcgtggtgcgaggatgtcatgtcctgataaattcatcttgaaaaaaaaaatcattctctaaaaggaataatagaattaattaaaattcgaaaaaaattggttaacattaaaatgcgtacaagaaaaattcgaatgtggcccggagaatttttgtttaattccccttggtctaaaatgagccctcaaattttacttgaattttcagagcaccaaaaaaaattattaagcaacaacaaccattataagagtttattaaaaagaaaacctgaaaataatcctcctttgggccaagcctggtccaaagtctccctctctccctcagcccgctgtcgaagtctctcttccatccctctccttttcctcccttctctctcgggccgcccctccctcctctccccctcccggcctgcctcggcccagccgccctctcccgtggccgcctccctcacgcgcccctcacgcgcgttgcacgcgcgctgaccgcaccccacgtgggtcccacccgcgccggtcgtctccttcctcccgcccggctcctctctctctcctgtgaaaccctatccgtttcctccctcaaatccacgcgattcaagcattggattccaaaattgattggggggaattaatcccccttccatcctctttgatttcccccaatttcccccttgaatggcaccctccattgcccggaacgcccgcgccattcctggccaccttccatggccgccgggcgccatttccgccaccgttccacgcctctcccgtggcccgttcattcccctctgctataaaatggaaccctctccttccgttctctcgttttagcctcctcccgtgtctccccgtggccgcagcacctctccccgtcgccctcatctctctcctgtgccgccggccacctccagccgcctctgccgcctcgcccacgtgccggccggccgtgccatcaccatcctcggcgcctcagctgcatcctcttcccccggcgttgcctccgtttcgcgcggatatcaccggaggcgcatcctcgccggcaaacagtggcgttgccgccactgtaccgcctccagtcgtcccggtcgccgcgccaaagcgccggccgacgtcgccgtctccttcgtcgacgtcgtagcatcaccctccgccccggccgctcctcggtttcgtccgaccggaaataacccaacgggtgttccttacgtgagtgtattattccttgtcccaggagacaaggtacacaaaaagttgatacatttcggagtttatcaagcggaagcgtaaatagttactttattacatgggcggcgaaggcccagcacacacaaagacaaacgggaaacagcgtaaatagttactttattacatgggcgacgaccacaggcgcttgacggcaggcacgagctaaacaccaaagccttcatcatccaggcgctcctcttctgggtttgggaaaaattgagcaagactgattacaaccacagtacccaacaagacacacccataagtgcagaataaatgcaagggagtacaagggggttataatacaaagggttagggtttgcagtaaacagcattaaaagacacttagttgctcaaagctattttgtaaacacgatcctagagctatacaatactattaatcaaggccgtgaacccacacgaacctgccttaacccaaggcctacgatgattcagaccgaactggcaacccgaccctgggtcccagctcgtcccaagccaacccaggccaaccattccacattttagttgttaagcaggtttcaagaactaaaacactaacataggtacattgctcggcttgcccataaccgagggcgcggctattcgaataggttatactctgatcagaggtgtacatctttacccacaagacacatcttcctcacgtgtaaccacgtgccacataccaccacggcatacagacggaagacatgacatagtttccaacccatcctagccatagacaaaagtaccgacccaaccccacctacggccggaacccccgtgtcacaccctaaaaatcctaaatgtataaattgttgtttaattggaatttttagaaatgattttaaaagtctagaacagaagatctaattttaattaataaattccaatataaaatggggccagataaaatttcattaaatactttgctttattctataattcctagatttttctgggatttatttgagctaaggaagtatttttaataaatggaattgcatttaatgaataatttaaattgaaaaatgtttttaaaagtctcttttggctttgggccgaaagtcggcccaaaaccttctctctctctcttcccggcccaagtcggcccagtccagtccgcagccgcgcgcgcgcgctcgctgtcgctgacaggtgggtcccacctgtcagtcttcgtcttcctcgcgccgccgccgccgcccgaaaccctagcgtgcgccgccgctgtctctttccaaattcggccgcgtctttccttctccggtgaaatcaatagaggggaaatgtttcccgagatctcctctaccttttctcttttggaatcatcggctaaaatcgcttggaaagtgtttgattcgaggtcgattcggatcggtctctctctctccgagcccgagtgacggagcgtggggctcctcaccgggagaccgtgcaggtccccctttgccggttcggccgggggccatgggtgagattctaagctcccagtctgtgtgtggaaggttcgcgagaatggaaacacacaagacacgggcgatgtatacaggttcgggccgctgagaagcgtaataccctactcctgtgttttggtggatctatgtatgaagaagctacaaaagagctggagaaccagagagctcttactctctccctctctgatcgttctggatccgaaaaatcccccttctaagtgggcaaggtcctccttttatacctcaaggggataccacatgcaccatctctctcttttttgtggggacttatcctatcttttcataaacagacggagacttgtatggttaccgtccgaatgaccttctgatgggacggcccatacctacctccacttccgccggaagcaggcgcgacgtgggaacatggctgtctgctgacgacatgaccagtgtcagaccggtcacaaatcggtcattcttgtccaccacgcgtcagtttatcaatctgcatgttcgcccctcttcatacaatgtcttgcttgtaatggttaggatgaagcctggtatatatctgaccgggaccaacgtgccatctccaggagctaacacgctggctccggctagggacgagtgcttggaggctctcatcctgacgggatggggcgaggcgtgcgtcagaccgcctgtcgccacctaacccacgatctgatcggtctgtgactggtcactgaccggataaacgagcgcgctgcactgcgttacatgcggcgtgacgcgctcgtccaaaccgcaataaatatggttaggtgagccccgctatgctcacctaccccatatacgcggcgcaaaacctacaaggggtcggggcgcctcggccctctgggccgagacgggagcggtccgacccctcggggagacaaagagaagggcggccgtatcaccctcgggcccgacccccctgagggggttaggccacgtgggtgatcgtgtctgcctcaagtctctaagtcatgatactcccggtcccatgtcaccgacagtagcccccggcgttatgccagggcgatcgccctccccgagggaagcggtcgggcgtgacgccacttctaaggcctggtgacaggtggggccggttcctacaggtgccgtcgaactacatcacccagagggcggtgtgaggcagctgcgatgggctcgagctggcctcgggggcggagacgagctcaggagctggggtccactccaccacaaagtcggcgagggcctggctcttgatcgcgtggcttggttcaaagcgcaaatcgaattcagagagttcgattgcccatttcaccaccagtccagtaccctctcggttatacaagatttggccgaggggataagacgtaaccaccgtgacccgatgcgcctggaaataatggcgcaacttcctcgaagttatcaggatagcgtaaagcatcttctgggcctgaaggtatcgggtctcagcgtcccggagggcctcgctaacgaagtagacgggccgctgcacctttcggcggggctgatcttcttcgtcaggggccacatctccagggcgctctccatccgagaggccacgcggggcgcactcggcttctgtgccgacgacctcggggtcagagggcgacaggcgcggccttcccgcagtggcctcggggccatcctgggggtcgggggcgcctggcaccgtcggacaagcaggcggagggccagctccggccgtcgggggccttgggccaccgttcggctcgggggcctctcctccctgctctctctctcttcgggcagaatcccggcggtcgcaagtcgcgcgcatcagcaagggaaaaccgaccgacaataatgagcggcccctcggcttcgcgtttgccttcaactccgacaaggagtgcggtgacgacggtgcggacgacagtgacggcgaggccggctacccaggcacgtcggagtgagcccccaggcctccgccaatcttaatagcttttccttcttcttccgaggccttcgggcccccttcttgttataggctgatttaatctgcaatcaaataaagaggaaatttttgtgtcaatttcatttgttctgtgtatgagacgaggatggtctgtgccacggtccttctgtgtcttggcttgaacaagggctcgtgcccaggtcccagcctcaaacggcgcgggtcaaggctagtgcctggggagatccacatgtcgagactggccaggccgggagcgtggtgaccgagggttatgggtgacccgattgtgggtttttgccgattcccccccggagttcaccacgtcccggggcacggctcggttctgggccccttttggcgattttagccgacccgagccccctagggtaggattgagcacgagtgacctatttcaagtcaagattcttcaaaaggaaacaaaagcacagacacagcctttaggaaatcgaaaatgcttttattgaaatacgaaagagaaaaaagataagcccccggccaaccctgcacgcccgggggggtgcggggttggcccgagcccaagacctgacacccgacccccactaggggtagaagcgacgaaggtgttcgatgttccacgggttaggcagctctgtgccgtcgcccgtggccagccgaacggagcccggccgggggacgccgatcactcgatacggaccctcccacattggtgagagtttgctcagtccagcacgtgtttggacacggcgtaggacgaggtcgtcgacgcagagtgatcgggcccggacgtagcgctgatggtagcgccgcaggctctgctggtagcgcgcggctcgaagggccgcgcgccaccttcgctcttccaagtagccgaggtcagggagcgtcggcttccttctttttgtcgctcgcaggcctcccctttcgggtggccagcgaaacgccttcgacggcgaggacatgaccctcgtcgtcggaatgagccgacctcttcttcctcctcctgtcccgccgccctgaccgagcggcggacccgggggcggccgaagtggggctctttggaggcgatattttcgagcatgcggttgtgccgcacaccccccctgaacgcgtagatcaccgcgtgtgcagggatgcatggtatggtgttgcggacttgacagaaccgctgaatgtatgagcgaagtgactcatcatccctttgctggactgcatgtaagtccgcttcttcacctgggcgcggatatgtgccttgaaagttcatggtgaactgttggcacaaatcctcccaagagtggacggacgcgggtggcaagttcattagccaaccccgtgcctgttccttcagggccatgggaaagaaattcgccatgaccctgtcgtcacccccggcggcctcgatcccggtcgtgtagacctggagaaactcggcggggttgacgctcccgtcatatttttcggcgatggtgggctggaaccttgggggccaacggatgttccgaaggctcgccacaaaggctctacagctgacaccaccaaccgggggcacggagggctgatccccgcgtccgtgttgatgtgacactccggacgaggaggcgccctccgttgcgtgggcagcacgtcggccattacgccggcgctcgatactgatgcgggcatccggccccccacgcagatcttcctaggtcggaggcgctgacgaaggagtggcggccaaatggcgagcaacagccgccgctcgccgcgccctccgccttgacgatatggagccggtggtagcagcgccagaggtcttggtggcggaggaccgcccaccagcacctaggcgctgccgtaccgtcatgaccaagttggccacgtcgtccagccaacgttgggctggagactccgggtcagggacaatgggcgggtgacgtaggagcgcgcccgcagcttggagcgcgccctgaggcgtgctgccgtcgccgtagacgaggaggcgacgctccccatctcgccgcccttccccatcacccgtggatgttgaagtcgcggatccttcgaccctctcgagcgcctcctcccgcctaggactttggcgtggagggggcgatggagtacgagctcgacggcgtgggttcggctccccgttgtcaccgctaacactcggagagaggttgtgcgcctttgcttgttcggccattgggctgaacaggaaaagcttggcgcacacgaaagaatgcgagagcttagaaaaacacccgcagagccccctacctggcgcgccagatgacggagcgtggggctcctcaccgggagaccgtgcaggtccccctttgccggttcggccgggggccctgggtgagattttaagctcctagtctgtgtgtggaaggttcgcgagaatggaaacacacaagacacgggcgatgtatacaggttcgggccgct

SEQ ID NO: 44959 - DNA, 12462 bp, Oryza sativa
cagtagaggtttcgttgcagccttagaagcgaagcccactctaattgatcaaattagagaagcccaaattaatgatcctgatattcaagaaatcaaaaagaatatgagaagaggaagagctatcggtttcttggaggatgagcaaggaacagtatggttgggcgagagaatctgtgttcctgacaacaaagatttaaaagatgcaattctgaaagaagctcatgatactttatattccattcaccctggtagtaccaaaatgtaccaggatctcaaggaaagattttggtgggcaagtatgaagcgtgaaatcgcagagtacgtagcagtatgtgatgtttgtcagcgagtcaaggcagaacatcagaaacctgccggtttgttgcagcctttgaagattcctgaatggaaatgggaggaaatcggtatggatttcatcactggtctacccagaacgtcatcaggccatgactctatttgggtgatagtcgacagacttaccaaagtggctcatttcatcccagtaaagacaacctattccggaagtcggttggcggaattgtatatggcaaggattgtgtgtttgcatggcgtccctaagaaaatagtgtctaatcgaggcagtcagtttacctcaaatttttggaagaagcttcaggaagagatgggttctaagctgaactttagtactgcttatcatccgcagacagacggacaaaccgaaagggtgaatcagattttggaagacatgttgagagcttgtgctttagacttcggtggaagttgggataagaatctaccttatgcggaattctcgtacaacaacagttatcaagctagtcttcagatggctccgtacgaagcactgtatggtcgaaagtgccgcactccacttttgtgggatcaaacgggagaacgtcaggttttcgggacggatatcctgagggaagcagaagaaaaggtgaaaatcattcaagaaagattgcgtgtggcccagtctcgtcataagagttatgccgacaatcgccgcagagatttgagtttcgacgaaagagattatgtgtatcttcgtgtcacgcctcttcgaggagttcatcgttttcacaccaaaggaaaattggcaccgcgttttgtgggaccttataagattgtcagtagaagaggagaggttgcttattagttggagttacctcaatctttggcaggagtccataatgtgttccatgtgtcgcaattgaagaagtgtttaagggtacctaccgaagaagctaatcttgaacagatagaagtccaagaggatctgacctatgttgagaaaccaatccgtatcttggaaatagatgagagaagaaccagaaatcgagttatccgtttttgtaaagtccaatggagtaatcactcggaagaagaatcaacttgggaacgagaagatgaattgaagtcagctcatccgcatctgttcaccagttcttccgaatctcgaggacgagattctgtttaaggggggtaggtttgtcacaccctaaaaatcctaaatgtataaattgttgtttaattggaatttttagaaatgattttaaaagtctaggagagaagatctaattttaattaataaattccaatataaaatggggccagataaaatttcattaaatactttgctttattctataattcctagatttttatgggatttatttgagctaaggaagtatttttaataaatggaattgcatttaatgaataatttaaattgaaaaatgtttttaaaagtctcttttggctttgggccgaaagttggcccaaaaccttctctctctctcttcccggcccaagtcggcccagtctagtccgcagccgcgcgcgcgcgctcgctgtcgctgacaggtgggtcccacctgtcagtcttcgtcttcctcgcgccgccgccgccgcccgaaaccctagcgtgcgccgccgccgtctctttccaaattcggccgcgtctttccttctccggtgaaatcaatagaggggaaatgtttcccgagatctcctctaccttttctcttttggaatcatcggctaaaatcgcttggaaagtgtttgattcgaggtcgattcggatcggtctctctctctccgagcccgaggtttccttcgcgtcgccggtcgccgtgggccttcgccgccgcctccttgcccctataaaaggatcctcggtgtctcctctacccgtcgccacccttgctttcgcctctcgccgtcggtagcgccctagcgccgtgtgacctagcgccgccgttgtcgccgccgctccagccgtgtgtcaccgtcgctccagtcgtcgtcgtcgttcgggaagatcgccatcgtggtcgccgtcgcgtcgccgtcctcgtccgcccctccgccatcgctgtcaaccgccggagcaccgtcgccgccgtcgacccgatcttctccgccgcttcgacctcgttgccgacgtcgtccgttgctcctccgtcgtcgctttggtcaccggtgagttcgccgcgatgtccgcatcgttttggtgtcctccgttcgcgtcctcgcgccgtcgttcgccggcgagcatgcgcgcccgagccgccgagccgccgccggtggtgacgtcgtcactgacgtcatcgtcgtcgtccctcgtggtccggccgtggaccggtcgatctcggccgtccgttttggataggatcgatctcggccgttcgttcccgtgaaccgctgccgtgcgcccggtccaccgctgacgcaataaacccctttttctttttcaaaaataattcattattgcgtcataattcaattaaaatccatataagtgttttaattcgatttaatctttaaaaattcataactaattcatcgtagctcggatttagttggttcaagtctctaaatttttctaaaattgagatctacatgttaaaaatatccacatgtactgttcatgcttgtttatgtgctgttttggtttttttttgctcttttctatttagattccgacgtttccggagagtccgttttcgcaggagaagaatttgaagagttccaaggccagcaaggcaagtcacacagatcccaaacaaccctttgagcatgttgatcccgtttaaagctattgtttctattcaactattgcatttattttcgaatgtcattgggtggaattaacctattgtttgttatagcccttttgttcttgattactttattcctagataccttgggttattataatttgactagttgggctttatatattggttcagctagatattaggtgtgattgcttagccatgcttagaaacattagcacactattgggataacttatgattcattattatttaatgatggcttaatgatagttcacgatggtcaatcgtgattggctaattaattacttgccaactaaaacctgataatggtgggttgtgaacacatggttttgagagtcgtgctcatggcaattaaggaccggttcacgagtttcggttgtgaaacattaaccgtgccaaccacaagccagcgtgggcaacggctttaccttttgtatagcgtggttcattgcagagcaccagactgagaagtggcggagataagcccacaggggtcgctggggagtccatgccttgtttataagggggtgattatgatccaggaaaggtgcgctgtagtggattgtgttgtgcgaggggtattgtcacagctcctttccgaggtaccgtggtggtattgaggcacatggtgacatgatgtggggctgtgtcttgtgggtacagtggtacacctctgatcagagtaaaactattcgaatagccgtgcccgcggttatgggtgggtctaacaatgtctttcgtgattagtttcacacctctcatcataataacagatgctataattggtaataatttgattagctcctggtttggaatagtatattcctggtttgaagatagaactgtgcagccgggatggttgttcagaatggttgggcccatgcaacagggtatgttgtgtagcgttggattaatactgtttaattaatacttaactgttttattaaattctgaaatgtttattaaatgttgtttatgcaaatgaaaccctactatgccatcctttgttatcttgtgcgcttgcatatttgctgcgtggcttgctgagtatgtcatatactcacgttgcaatcattcatcagaggaagagttctacagtgaagctgatggtgtggaggattaggtgtaggcctggtcaagctgcctgtggagtggagtcgtctgcgccgtttatcttattttccgctgcttagatctttattgattgagaggaactatctacctctataatgacattttattcgcttattaattagagtaataattgtactatattatcaatttgttattgtgtgcctcggctgattcctgtacgagggttcacacacatgtaagcgtttggaattttggatagaaattccgggcgtgacaccccgggacaggtaggcaggactgagcccctagcagcaggacaccggccctgtgccatcacatctcgactaccgggccgcagctcgtgtagccttcatttgccctagagatgtccatcgacccccgactttgtccatctccatccgtgtacttttgtttataaccagactgagccacaaactaagccttacccactagacatgtggaagtatggtagtactttgcaacagaggcccgaagaccggtccttatatgaccgaggtgctactatcaaaaccatgcaccccgagcccagcctaaaaccattttgagggttttgaatagagggggaggtgtgaatccaattccacaataatccaaccattccatagtgtctaggtgatatgaatattcccaaagtctagagttgtaaaaccacctaatgttacctaattaagcggcgaagcatctacctaaattcatactagtggtaccatgagtagagtgtccactagttggggttttgtttattctagggtgaacaaggtaataataacaataacaataataaggtcataacaaaggtaaataggcatggctagataaaacagtgacaacgcgggaatttaaataaagcgataatgcaataatttaaatcaaaataattttataaactaggattcaatatgttcaaggatgatgtgacttgccttgctcgctttcccaaacatcggcttcaacctccatgaagagaggatcttccgaagctgcagcgtctacacgaccaacggaaaataaaagggcttttactctaataaactccatataacaagcaggaacaaagcacaaaaatgggttcttgacttcttaaggaaaaattagagacttgaacagtccaattccgagttcaaatggccaagttatggccatttgaagtttatatactcttaaaataaatatttgcgaatttcttcatttaaattttaatttaaaaagggtttatcgcgtcagccgaggggagggggcgcgcggaccgggtccatgggagtggggcccacgtggcagcctcacggtccacggtggaccgggtgcacccgggctcacaccggccggtgccgtgggccccacacgtcagccgcacccgagggcgcgggcggctgacggccaggccccacacggcagccactcggcgcgcccgagggcggccatgccggcgcggtcggcgagaggcggcacgcccgcgccactatggtcgccggcggcggccatagacgcggcggagcagcggccgagagagcggaggaaaaggggaaaggaggcgacggtccacggctcaccccggggcgacggcggcgacggaggaggcggccgaagcggagggaggcggcggcgtggctcgggtcagtggggacggcggcactccggcggtcggcgaccgaaacggagaggtggacgaggtcggcgaggatgtggtgaagccgaagtaggcggcgccgaggtgggaggcggtccggggcgatgacggcggcggaccggagctcggcggcgacggtggagagagagagtgacggcgtgagctcgattccagcgatgagaaggcgcgacaaagggtagaaacatgcgaaggaagtgcggggagggtttaaatagggttggaagggggagagagcggccggaggggcaggaaactggcgcgggaggtccggccgccatcaatggcgccggcgagatttgcaggggcaaatccgcccatttgaacgcgagagagagtgggaaaaatggggggaaagggagaggggatcacggggagtatttccccccactttgttgcacgcggggacggcgggatgcggcggattaggcggcagcggcggcgcttggcgcgggcggggcggcgggagcggtgggaggacggggatgacggatgggccccacacgtcagcgagggtggcgggtgggcccgcccgtcagcggcgcgcgcgcggggagggaggccgaatgagccgcgggggagaggagagagagagaggtggggggagagggagatgggccggaccgtcccatggaagggaagggggacttttagggtttttcttttttttaaaactttttcaactttgtttatttcttcttaattattatttgtgctctgaaaattccactaaaatttatttacacattttaggcttttaggaaatatacaaaaatcctccaagccttatttgacttttactttgcacattttaatttttggaggctttcacacatggattttaattattctaggcataatttaaaggatatattttagggtcgttttgggacgtgacactatccttcctcctcgtcgatgtctcctccggcagcccctaacgccgtgcccgtgcgccagccgacgtcgccgtctcctccggcatcaccgcggcaaggttgccctcgccctcgcctccccttcggctgaaccccgccgatgttcgtcgtcgtcgtcgtcgtcctctcatcgttcccggttgtagtggcgttcgttccgccgtcaagccgtatccgttcgtcgcctgcgtttcgtcaaggttgctacggccccgtcgtcatcttcgtccatgcctccgcgtcgtcaagcgttgcgccggtcgtgtctcgccttcgtccaaagatcaccggcgcaatgtcattcgttcgtctccgtcgttcccgtctgactccgccacgcccgttcgtcgtcgtcgttcccacgcctcatcgcgtggtggtaagggcctgaaagtgcatctaggcccttaatgattttgatgattgattacaatgcgattagagaggactaacacttttattcaagcaaatgtgaaggttgttatgtcctcgacatgttgtaatgagatgcataccccatgaatgcgacatcacgatgcaatgcggcaatgatcaaatagtatattgtaccttttaccttacattgtgtcgtaggaatgtcgtactattaagagggataccacatgcatattattggtaaaatactagtgctcaaaatgcttcatctttgtgtgagttgaaaaacctaagtcaaaattttaatcacgagttgtttcacttgtcacaacacttacaccgggtttctttgcaagtttttcaaaatctcttgaaggttttggaccatgttttatgttgggtttgatagcccacgaaactagctttccatagagtccaagatcttcgaaatcggagttcagagtaaaaagttattgcagttttacttgagcaacatcataatatccgatttgaaatcagactatccgatgtatcggactatccgatttttcatataacttcactctctgtcttgatttgaaaaaatcctatcgagtgagtttttctatgtatcggagtatccaatgtcggatcagatagtccgatgatacagagactccgaaatttcatagaactcgagtctctgtatgaggacgaagtttttgcttctaaaatatcagatactccgatttaacatcagatagttcgatgtctcggaaagtccgaaatttcatggaacttcgttctctatttctcgttgccttggaggtttaaaatatcggactatccgatcttgtatcggactatccgacgtgggctgaaagattcccctcacacggccacatttttggggggtctataaataccccccacctaacccttttctagggttacccaactcatttcattctcattcactttgggttgagcttggtactaaggtgctttggatctttgagctctctctccctctctcaaatccctccttgttctttgtgtggtggatcttggtggttgtggatttggtgtttgagggcctagtgtgtgtttcactcgatcttgagcgctaaggtttgaccaagagttgtgtggtgtttgttactcttggaggttgagaactcctagatggctaggtgtcactcccgagccaccgatctacgtgtggttggctgggagaagtttgtgaaggccggatctcgcctccgcaaggaaagagataccccttagtggaaggaagagtgcttagtgcaacctcttgaggaaagggttagcaaagactcggctcttagtgagctcctcaacggagagtagaatcccctcaaggatttgaactccggggacaacttcgtgaacttcatcattggtgatctcccttcatcctccttttagctttgcttaattgtgccgctatagatctagtcgttgtttgtgctttactcttgtttgtgtgatatatctacttgttgtgcttcattggtggatcagacagtctaatccaacatcagactatctgatattttcggatagtctgactgtggatcagactttccgaccttatttcagttttagcttccgcataaagttttaaattagcctattcacccccctttaggcctaattgaccctttcaattggtatcagagcctaatctcctaattaggcttaaccgcttggagagatcatgtcgggtcaaacggggaatggcaaggatggtgataagggagctacgtttccttatgactatccctccacatctgcatcttatgtgagcacctatagcggcaaagctccgtacttcaatggtacggactatgccgcttggaaacataagatgaagatgcatttgaaatctattaaccctttgatttggagaatagtcgaaaaaggctatgttttgcagaatcccgtggaacccaccaaggaggacgacaagaacgagcacaagaacgctcaagccgctaatgcaattcttagcgccttgagtggaagtgatttcaaccgtgtggacggcattgagagtgccaaagtgatttgggacacgcttcggagtttgcatgaagttacggatagtgttagcgagttcaaggtggagattctcaaggggcagtttgagcggtttgtgatgttggatggtgagagcccaagcgacatgtatgatcgattaagcaagatcgttaatgagatcaaggtacttggctctaaggacatgaccaatgaggttgtggtcaagaagatggttcgggcaatcactccaaggaactctaccttggtgaccatcattcgtgagcgtccggactacaagactctcacacctcatgacttgctcgggcgtatccttgcccatgacatgcttgagcaagagtccaaggaggtcatccaatacatcaaccaaacctcaaccacaagcattaagaaggaagacttggcattgaaggcgaaggaagaagaagaagagagtcgcaagagcaagagcaagagcaaggcggagatcgatgatgaagagatggctctcttcgtcaagaagttcgacaagttcatgaagcaaagcggcttcttcaaggaaagttcgtccaagtattcctccaacaagtcaagtggaagacactccgcaagggtgtgctatgtgtgcaaagagcccgagcacttcattgacgattgcccccacatcaaggattgcccccacttcaaggaagacaagaagaagcttgagaagaacgagaagcacaagcatagcaagcatgatcgctatggccaagctcaccttggggtgatcttcggctccgacttcgagtcaagctcaagtgatgaagaaggagttgccacattcgccgtcaagccttcatcaccaccgagactcttcaactactcaagtgatgaggatgctcccatttgcctcatggcaaaggagcctaaggtaccctctcccctcaagtcatttaatgttgatcttgttagtgatgaggaggaagatgttgaggatgaggttatggatgacgagttgttcaaatccatagccaaggaatccataccacacttgagtgagttgcttgggagaattgagaatcaatatgcaaaccttgagaggcaagaggaattgctcattcgtgagaaagagcggtctcatgaactcaagagtgaacttgctaaggagagagagaaaaatgaggctttggtacggctttacaagcaaaccaaagagtctcatactaatcttgaggtggcgaacgctcaacttcaagagagagtggatggcttggacaaagcttacctctctcttgaagagaagttcgaaaccttaaagaatagtgtctctctccctagcgaggcatcgtgctccaaaattgtcccaagcaacgaaccatgtgtgaggtgcaaagatattgatattgaagcttgtagtactaactctacttctttgagtgctttacaaaagcaaaatgagaagcttatgggactccttcataatggcctacttaagtgccatatgggtagtaaggcgctaaaggagtacctaggctatcaaagggacaacttcaaccatgaaggtcttgggtatgtttctccacctaaaggaaaggtggacaagagtgtgatgatcaagaatccccaaggtcttagcaactttgttaaggccaaatgtatccttcctaatgattatgcttctcattgttcttttgatacatcttatgttcttaggaaaaatgctaatggtcgtgctgttgctaagtatgttggcccaaggggcaaaaatatttctatcaagagagtgctttgggtgcctaaggcacttgttattaacatgagaggacccaagcaagtatgggtacctaaaactagaaattgatctcttgtagtaatatctctccgatggaagaagttgggtgattgatagtggatgcacaaatcacatgaccggagaaaaatcaatgttttcttcccttgatccaaatggctcttcgcaagagaacataatcttcgggggacgatggaaagggaaaagtaatgggattgagtaagattgcaatctccaatgatctttccatctccaacgtcctcttggtaaaatctctaaactacaatctgttgtccgtttctcaattatgttccatgagctacaattgtctttttaccgatgttgatgtgaccgtatttagaagggatgactcatccgtagtctttaagggtgttctcgagggcaagctttatcttgtggattttttctcaactaaagccaaacatgagacatgcttagtggctaagtccaacatgaggtggctttggcatcggaggctaacccatgtcggtatgaggaatcttcacaagcttctaaagcacgatcacatccttggactaacaaatgttcaatttgagaaagatagggtgtgtagtgcatgtcaagccgggaaacaaattggagcacatcaccccgtcaagaacgtaatgattactacaagaccgttggagcttcttcacatggacctcttcgggccaattgcttatctaagcattggaggtgacaaatatggtcttgttattgttgatgacttttcacgtttcacgtgggtgttcttcttgcatgacaagagtgagacacaagccatcttcaagaagtttgaaagaagagcccaaaacgagttcgacctcaagatcaagaacattcgaagcgacaacggcaaggagttcaagaacacgtgcatcgagagtttccttgatgaagaaggcatcaagcattagttctcggctccatactcaccttaacaaaatggagtagccgagaggaagaatcggactctcatcgagatggtgaggacaatgttggacgaatacaagacatcggaccgcttttgggccgaagccgtcaacaccacatgtcacgccatcaaccacctctatcttcaccgccttcttaagaagactccctatgagcttcttaccggtaacaaaccaaatgtctcttactttcgtgttttcggtagtaagtgctacattcttaataagaaggctagatcctcaaagtttgctcctaaagtggatgaggggttcttgcttgggtataggtcaaatgagtgcgcataccgtgttttcaacaaaacctccggtattgttgagatcgcgcgtgatgtgacatttgatgaaattaacggctctcaagtagagcaagttgactcacatgtgttaggtg

SEQ ID NO: 44960 - DNA, 7927 bp, Oryza sativa
tgaccaagcgttttgagatgtccatgatgggtgaattgaagttcttcctcggccttcaaatcaagcaactcaaggaaggaactttcatttgccaaacaaagtatttaaaggacatgctcaagaagtttggaatggagaatgcgaagccaatccacactcccatgccatcaaatggccacctcgacctcaacgagcaaggtaaagacgtcgaccaaaaggtataccgttccatcattggctcactcctttacctttgtgcatctaggcccgatattatgcttagtgtgtgcatgtgtgcaagatttcaagccgctctgaaggagtgtcaccttgtggccatgaagagaattcttagatatgtgcacacacctaatcttggtctttggtatcctaagggagcgagttttgatctcattggttatgccgatgcggattatgccgggtgcaaagtggataggaaaagcacattgggtacttgctaattcttgggtagatcccttgtttcttggtcttccaagaagcaaaaatccgtcgccctatccaccgccgaagcagaatacatttcggcggggaattgttgtgctcaacttctttggataaagcaaaccttaagagactatggcctcaatgtgtccaaaatcccactcctatgtgacaatgagagcgccattaagatagccaataatcccgtccaacattcccgaaccaaacatatagatattcgccaccatttcttgagagaccattccacaagaggcaacatagacatccaacatgtgagaaccgacaaacaattggcggatatcttcaccaagccactagatgaagctaggttttgtgagttgagaagtgaactaaatatcttggattctcggaatgtggcttgatcttttgcatgcatttgtttttatttcctagtataagttgctttccaccttgtgataaattaaacattcaattcatggatgtacactagtcacacttttgtggatattttgaatctatgtgtatggggatctcatttttcaatgaattttggtccttgcacaatttgcaatagattcgtacattccctctttgagggtgaatcatcatgtctcatgataattcactctcatttgatctttggatcatccatttgacttgtggctattgttttgtgtggttgattgtgtactagccattaactaaaatggggcctaaatgttcgactattcctttctctccaacttccatcaaaattttgtgaaaaattgaatctcttcaaattcccggtgcgattcccttaaaaaaattcatttccaaaagtttgcaaaatattttcatcaatattccggcgaaaatcttccctttttggtgcttagatgccaaagggggagaagatctatccttttattatggtcgaacatgagtggtttttatttgtatgagacatgtgtgtttcttaaattagtttaatgctttgtaagacattattgtttaattatgaatgcttgggatgtaatggataatattgtgattgtgatgagcaaaatgtgatatatttattttctcgtgagcttcaatgtggatgcaaagatttagggggagatctctacttgctttaatgcacacttttaggggggcttttactaaatctttgcaccaaaatcatctattatattcattctctcttgtgatctaatcgtattgtcatcaatcaccaaaaagggagagattgaaagtgcatctaggcccttagtgatcgtcaaggttgctacggccccgtcgtcatcttcgtccatgcctccgcgtcgtcaagcgttgcgccggtcgtgtctcgccttcgtccaaagatcaccggcgcaatgtcattcgttcgtctctgtcgttcccgtctgactccgccacgcccgttcgtcgtcgtcgttcccacgcctcatcgcgtggtggtaagggcctgaaagtgcatctaggcccttaatgattttgatgattgattacaatgcgattagagaggactaacacttttattcaagcaaatgtgaaggttgttatgtcctcgacatgttgtaatgagatgcataccacatgaatgcgacatcacgatgcaatgcggcaatgatcagatggtatattgtatcttttaccttacattgtgtcataggaatgtcatactattaagagggataccacatgcatattattggtagaatacaagtgctcaaaatgcttcatctttgtgtgagttgaaaaacctaagtcaaaatttcaatcccgaattgtttcacttgtcacaacacttacaccgggtttctttgcaagtttttcaacatctcttgaaggttttggaccatgttttatgttgggtttgatagcccacgaaactagctttccatagagtccaagatcttcgaaatcggagttcggagtaaaaagttattgcagttttacttgagcaacatcagaatatctgatttgaaatcggactatccgattttttacagaacttcactctctatcttgatttgaaaaaatcctatcgagtgagtttttctaagtatcggagtatccaatgtcggatcacatagtccgatgatacagagactccgaaatttcatagaacttgagtctctgtatgaggatgaagtttttgcttttaaaatatcagatactccgatttaacatcagatagttcgatgtcttggaaagtccaaaatttcatcgaacttcgttctctgtttctcgttgccttggaggtttaaaatatcggactatccgatcttgtatcggactatccgacgtgggctgaaagattcccctccaacggccacatttttgggggggtctataaatatgtcacaccctaaaaatcctaaatatataaattgttgtttaattggaattattagaatttattttaaaagcctagaagagaagatctagttttaattaataaattccaatataaaatggggccagataaaatttcatttaatactttgcttaattctttaattcctagatttttctgggatttatttgaggtaaggaagtatttttaataaatggaattgcatttcatgaataatttaaattggaaaaggttttaaaagttctcttttggctttgggccgaaagtcggcccaaaaccttctctctcactctccccggcccaagccggcccagtccgcccgcagcagccgcgtgcgagcgccctcggacgctgacaggtggggcccgcctgtcaggtcgttgtctacctccggctgcccgccgcccgagccctagcgtcgcgccgccgccatctccatccaaatccggccgcccctttccgtttccgatgaaattaatagaggggaaattatccccgggatcccctctatcttttctcttatggaatcatcggctaatttcgtttggaaatccatggattcgatctcgaatcggattcgtctctctccccgaaccctagaccttccttcgcgtcgccggtcgccgtgggcctccgacgccgcctcctagccgctattaattgacccccaagcccgccgctacccgccgccaccctcgcctttgcccgctgccgtctgtagcgccctagcaccgtgcagccgtgcgccgccgtcgctccggtcgtcgttgctgctcggggaggtcaccgtcgtggtcaccaagtcgtcgccgtaggtcgccggagcatcgccgtaggtcgcagatctcgtccacccctccgtcgtcgccgtccgttgatcttccgccgctgttttggtcaccggtgagttcgccacgtcgccctctacgtgttggtgtcctccgttcgcgtcgtcgcgccattgtccgccggcgagcttgcgcgcccgagccgccgccagtgatgacgtcatcgccgacgtcatcgttgccgtccgtcgtagaccggtcgtagaccgttagatcttggtcgtccgttgtggataggatcgatctcgaccgttcgtttccgtgagccgccgccgtgcacccggtccatcgcgaaccctagccgctgacgcaataattcccttttccttttcaaaaataattcattattgcgtcataattcaattaaaacccatataagtgttttaatccaatttaatctttaaaaattcataactaattcatcttagctcggatttagttggttcaagtctctaaatttttctaaaattgagatctacatgttaaaaatatccacatgtactgttcatgcctgtttatgtgctgttttggtgattttgctcctttctgtctagattccgacgtttccggagagtccgtttttgcaggaaaaaaatttgaagagttccaaggccagcaaggcaagtcacacagatcccatttaaagctattgtttctattcaactattgcatttattttcgaatgccatttggtggaattaacctattgtttgttatagcccttttgttcttgattactttattccttgataccttgggttactataacttgactagttgagctttatatattggttcagctagatatcagatatgattgcttagccatgcttagaaacattagcacactattgggataacttataattcactattatttaatgatggcttaatgatagttcacgatggtcaatcgtgattggttaattaattaaattgccaactaaaacttgataatggtgggttgtgagcacatggttttgatagtcgtgcccatgacaattaaggaccggttcacgattttcggatgtgaaacattaaccgtgccaaccacaagccagcgtgggcaacggctttaccttttgtatagcatggttcattgcggagcaccagactgagaagtggcggagataagcccatgggggttgctggggagtccatgccttgtttataagggggtgattatgatccaggaatggtgcgctgtggtggattgtgttgtgcgaggggtactgtcacagctcctttctgaggtaccgtggtggtattgaggcgcatggtgacatgttgtggggctgtgtcttgtgggtacagtggtacatctctggccagagtaaaactattcgaatagccgtgcccgcggttatgggcgggtctaacaatgtctttcatgattagtctcacacttctcatcataataaaagatgctataactggtaataatttgattagctcctggtttggaatggttaattcctggtttggagatagaactgtgcagccgggatggttgttcagaatggttgggcctatgcaacagggtatgttgtatagcgttggattaatattgtataattattacttaactgttttattaaattctgaaatgtttattaaatgctgtttatgcaaatgaaacccaactatgccatcctttgttattctgtgcacttgcatttttgctgcgtggcttgctgagtatgtcatatactcaccttgcaatgattcatcagaggaggagttctacaatgatgctgatggtgtagaggattaggtgtagccctggtcaagctgcctgtggagtggagtcgtctgcgccgtttatcttatttttccgctgcttagatctttattgattgagaggaactatctacctctgtaatgacattttatttgcttattaattagagtaataattgtactctattatcaatttgttattgtgtgtctcggctgattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccccttctcttttaattaaaccaaactaatggcacatgcacttcataatctcttttaatggtcctcattcaaaatttattccagtgttattagtactgtacatctattactgtactaatggctcattttaccagcaaaagttttacaatattgttttatttaatcttgctgcaagaaaataaatttagcatgttgattttataactttcttttatctctgttggaacctgttgttcaaaagtacaaaatttgtgaccttatttccaactgtttcaacttatcttgcaagcttggtttactttatttacttaccttttactttgattttctaactttattcaaattaatccaaaaacttgtgctattaattggataaatgtcttaactccctcctttcacttgtctttagatgccgcgctacaagcctgagtacttgtttggtgttgagggatttgtccaggagttgcgtacgatgtcctttgccacaggatttgggactgcccctttttatgcctagattcctcatgatcgtcatgaagagaagtgccgagtcaaagtcactttgaacagtaatagtgaagatatcccctcagtgatgttcgaagctggaggaagaaactacatccatgcatgtcaggaggtagcaaggatcgccataggcgagctccgcgatcgctacagtgatcagttggccgacactgagtatcgctaccattctcgtcaaccccagggaagtgaccgtggcagctaccttgagactgagggaattgagaatgatgctaccacaaggcatttggttgagatgctgtgggctatggatgaaacccgtgcagagactgtgttagcagctcaagatcgtgaagatcggaatcgaggtaagatttgcaagctagaggacaaagtggatcgattggagaaggaactagccgcgttgaagggagaagcaccaccgcagaaggccaggatttgtcttaccgcaaggaagagagctctatttgtccctcgctatcaattggcaccaaaggtccgtgtggtggaaaaagaagttaccccagccctagcggatcctccggtcgtcaacgtaagtgatgatgaagaagaagaatcgaagcgcacccattccaagattgagtggggagcaacttaagatgatgaagacgagccgaacgagccttcaatcaactccgatgctcggaagaactagaatgccttgtcaagccgttgtcttagatcgttgtattagtttgcttgttttaagtttggttgtgtgtgtctcgcatgtgattacatcagtgatgggatgtaagtgcatgcgtttgtttgctttcgagtgttaggtagttggtgagcttagtggtgtgagagtcttcagtttgtaataatgaaactcacttaagaccaataaaagtcaaattaattctctgtcctaagtagtttcccccggtttctcttcttgtgccctgtccatgccagatggtggtcactcgcagcaacgggaatggccccaacaacaacaataacaacaacaacaatggagagaatcccacacttgcccaagtcctggctcaacaggcacagcttatgaacatgatgatgcagcaactccagaaccagcagaaccagggaaataaccatgcacctccccagaacaagttagcagaatttcttcgtgtgaggccgcctactttctctagtaccactaatcctgttgaagctggcgattggctgcatgccatagagaagaagttggatttgcttcagtgcactgatcaggagaaggtctcatttgcatcacaccagttgcatggccctgcctctgaatggtgggatcacttccgcctgaataggactactgctgaacctatcacttggcttgagttcaccgctgctttccggaagatgcatataccatcgggagtggtgtctctcaagaagaaggaatttaggtcgctcacccagggatcccgctctgttacggagtatctacacgagttcaatcgtctggctcgttatgctccggaagatgtgcgcactgatgaagagcaccaggagaagttcttggaaagacttaatgatgagctttcttacccactcatgactggggattat

SEQ ID NO: 44961 - DNA, 1613 bp, Oryza sativa
aattgaccctttcagggcccctccccccgctgccccgtcctcgtcctttcggagtcgccccgtgcctgttgtgcggttgtcaatcccggtacccgtgtaccggtgtcgatagttgttcgtgtgtgcatgtggtgaccgtgtttgtgtgcccacacggtagccacgtggtttccacgtgtgtagcccgcgtggtgtctagtggagtccgtttgtcggccactcgcctcggttgacataaggggtctgcttccgtcgacccgtggaccgtctctgtgtactcggtccaccgtggtcctttaggttgacatgtggggtccgcatgtcaacagcgtagccttcctgtcttttccaggctagcgctcacacatgttttatagttgcaaagcctaattataataatccgtaattctccatgtaacagcattaaacttcggatgatcatatcttggtcatacgaactgcgaatcgacccgttcaagtctcttaatgtttgttataacctaaagaaccctgtgctttctttttatgtattgttattgcttctttataggcttgtagctttgcttgtgtgcttcgcgtagcttctgtcattctgaggttcccgaagcatggttcgcggtcgtctccgaaggttcggaaggccattctctctgagcaaggcaagtcacatcatccttgagcatattgaatcccaatttataaaattattttgatttaaattattgcattaccgctttatttaaattcccgcgttatcactgttttgtttagcacttgctattaatccttgttatagccttatcattgctattgtttattactaccttattcaccctaggaaaataaaaccccaactagtgggtactctattaatggttccactagtatgaatttaggtatatgcttcgctgattaattaggcaacattaggtggttttataattttagactttgggagctctcatgtcatttggacattatggaatggttggctataacgtcctgaaaattaccgacaataaaaatcactaaaattttgaactttttaaaacttttgcatcatgctggatgttatgattgttattgctcgccaaactataaaattgtcacaatggaaaaattaaactaaatatatatacatctaagtaataatcacaataatacattatttattattaaccacataaatatttatgcacatgatagcaagccaaataaaacacaagtcaattattaatttctataatgtaaattacaaattgtatgttaaatacttgaaccatatcgacaagtgtcatgacatctaagtaattaggaaatagtcaccactacaacgaccctatatataaaggagtgttccactagaataattaaattaatatttataacttttatcgagtccctcatggaataacattgactcacataagataattggtcatgaaaacgaataaagctttatatataaaatacatttatgtgagtgtttaattaagcatttagaccaatattgtaccaagcctcaatttacttttatgacataatagattgaacatgtccatgtaaaatacattgttatacaaataaactcgaccaatgtgctatggtattat

SEQ ID NO: 44962 - DNA, 8143 bp, Oryza sativa
ctctgctgtcgcccatgtgcgtgcgtcccgtcgcccccattcgcgcccaatggataaaacggagcctcctgccacagctagagctagaacgcacagactttaggctttaggtacgatgatggagccaggaaaccttaattgagaaggaaatcaagctttatcccgtcatccacctcattgttcttacccaatcgccattagggctctagctcgtccaggcatgtgttggcaatcttatccccaacgtttccttacacgctaagctaagcccccaacaaaatccccatccctctctgccttttcctccaatacatttcgtcgaacaccttgggcgcgtgctgcagcttcttccctgctccaccaccgcgacatcgaacttcgtcgttcctccttccctcggtaattcctcgctcctgtgactcctcctagtcccctagggattaaatcccccatcaatttcgttgattaggtccatagcagtgccaagccgagctccaaagctccacccatggaggtcaccgtggacatgctatcccgggggctctcccttctattttactggaaaaacggaaccctcatgcgccatagatgctcactctctcaccaatttggtcgcaaaccatcccgttcgccgtagctgcttgcagccgagcttggccatggcgttgccgtgccgcaacgctcgcccctgcccctccttgcaccgccgctgccggtggagggccgctagagctcctccgcaaaccccctgtccaccgccgtgccggcctcgcgccgtaccggctgcgctcggccgagcccagccgtgccctgggtgctgcctcccgttcggctggaggtagaagaagggtaggagagagaaacagaaagagagcagccggacccacttgtcattagctccatcctatttccctttagaaaattaatcctgtgaaaaagaaaatcaaagcattgaccccatatgtcatcagctgttagggataaggatatattttggaataaacataaatgaattaggaacagtagcttttcgtaatttctcggattaattcgaaattgaatctttaaactagtataacttgctcattttaactcggatttgagtgaaacttgaacctaaattcatataaattcataatctttccaatggtatataattcactaattaataaaatatatttataattataaaataattaataccaagaaattagatactagttaacttaaaaatgtgctaacaaataaaactaatattttacagtaaagtagatgtaagaatatttgtctccaacatgtcttgtcactgtaacaaatacacaaactaatttaaatgatgtctcatattaatgtatatattaatgtataggaagatagtactatttaatggttgtataattaaacccatgacttacgaattatttacataaattttagcctcatatttagtaactaaaatataaacacataaagatgaatcattaacttgtttaggagaataataacagagctagatgtgaaggaatcaccaaataatttaatcaatgcaataccatatagaatagcatgtatagacctaaattggttaccacttattagtaacccaacagaaccagtgcttaaacttgccccatcacatatataatatcactcatagaaactagctaatgtataatttaactacaatatattcaggaatcacttggggcattgggtagtacactttctaaatggctcatgtacagtaggcgaccaaaaccatatatgttgttgcacacacatataatgtacattccattataactatactattgatttaccttttccatacattaaactggggagtatatgacaaacatgtatattagataaacactaattataaatttcgacctcctgtaattgatcgttacgggaccacaactacaaataatctgtacctataacctcacagatctaacatacaaagcatggataattattaacccttttataatttataatgacaagtaaaatatgatcataattaaaataatgcctcattggaaaaatgataatataaattaatcgatgtaattatttgtttgaccctaaatccatccaacaacagaacctttagtataagaccatttatagatgtatgcgtagtcgtataaccctcccataaccctgtagcttgactaaaccacatattagctgtatgtacctcattcatattatactggttagctcccaaatgaactgccatgacaatagaatgattaagaaatcttagccctagcatgattggaatccattagcaagcacgaataatatgaacaaccctaggttcgacaccatcattatattttgcttgtgcacatttgattgttgtttgaatattggtttttatcgcgtattacagaatttgtatatcggttagtcgtgaggcaacgtatgcagcttccaggaggtgaaggttgatcaagattatatcaagaataagaattatcctgagcaggcaagtcatcaccccatcccttgagcatgttggtcctaattgtgaaactgttttgtttacaaataaaattgcatgcagtgatgcatatcctacttattattatgccatgcctttgattattgcttatctcattattcccttggacccataattacgtatgagtccctagtcacttatgacaaatgcttagtaatgctaatttaggttcatgcattctcatatttatcaaatgctttatgcttaggcaactaccttggggaaggtagttgagacatgagcgccacattgccatgacattgatgagataatttgtgaaagaaagttaaaactaaagaaatgttttcgactgggatggctggaggacttaggtggtgtccggtaaaggctagtgctgtccctggtcagttaaggaccgagccatgaagttaagcatgaaacgacccccgtacaaccgtacttctcgtgtgggtatagacctagcggagtaaatagccgagcggaggtggtacccaagccgtagtggttttcttgttgtgtgtgaggtagggcctacggtggggcagccattggtaggaccgcatggggcgggtgcctacagtggtgtcgccatcggtaggactgccatgtgcaaacctaaacttaactataacttaatgaatgtgtgagtctttccccctcgggagcaccagaactcctctcactgctagaaaccttggacacctagagtgcatgaggactaaagttcatggagcgggtactgccaatgtgaggttattgaaaggctttgccgtggcaagtctcattcgttgagatgtaggctcatgtgttgggcaagtcgcggagtacgggtaaagtgtacatccactgcagtgtgagtaaaccaaatctattcaaatagctgtgctcacggatattgagcaccgtgacatgtattacacttggctagactctgaattcttgaaatgatgggtgggatgttgcatgatgattttgtactggtggaacaacttctcgagaggcgagaaggggtagaccccagaaaaccatgacgaccagtggcgggaagctatccttgggaacacaatggatggtggatagaaccgtcgctgtttaatgaacaatggaactaaaacttgaacagtttatgctaggtcttaggtttgtgaaatgatatttgaaaactcagctttacgcaaagtaaccatagccactctttgtaatacccttacattactgcattttgtgtggtggcttgctgagtacttttgtactcattgttgctctatatatatcttttagcagagtgttgaagagaagcccttgttagtatgcttgcgtacctagcaagatgatcggagtgcggttccattctaggtctcgttccccagtcgactgcttgtggcatgtcaactgtcacgtcctgataaattcatcccgaaataaaaatcattttctaaaaggaataatagaattaattaaaattcgaaaagaaattggcaaacactaaaatgcgtacaagaaaaatttgaatgtggcccggagaatttttgttaaattctccttggtctaaaaggagccctcaaattttacttgaattttcagagcatcggaaataattattaagcaacaaaaacaattatcagagtttattaaaaagaaaaagctaaaaataatcctccttttcttttgggccaagtttggcccaaagttccccccctctctctctcccggcccgcggccaaagtctccctctcctccctctctttttccttccctctctctcttgggccagcccggcccatctccctcccctctccctcctctccccgcggcccactcggcctctccccgcgcgcgcgccgctgacgggcgggcccacccgccaccctcgctgacgggtggggcccacctgtcatccctgtcctcccgccgctcccgccgcctcgcccgtgccctaacgccgccgccgccgcgaatcccgccgcctcccgccgtccacacgcgcaataaagtggggggaaatattccccgtgattccctccctctttccccccatttttccctccctctctccctcggattcgtttggaaacctctcccctaacctcgccggcgccatcaatggcggccggatcttccgcgcccgtttcctcctcgtccggccgctctctcccccttccaaccctatataaaccctccccgcacctcctccgttcgtttccgcctctcgccgctctctctccccgccggaatcgagctcgcgccgtcgctctctctctccgccgtcgccgccgagctccggtccgccgccgttgccgccgagctccggtccgccgccgtcgtcgccccggaccaccttccccctcggcgccgcctccttcggcttcgccgcgtcctcggtgacctcgtccacccctccgtttcactcgccgaccgccggaacgccgccgtccccgtcgacccgagccgcgccgccgccttcctccgctccggctgcctttccgtcgtcgccgtcgacctagggtgagccgtggaccgccgcttcttttcccccttccctccccctctctcggcagccgctccgccgtgcctatggccgccgccggcgaccataggggcgtgggcgcgccgcctcctgccgctgcgccggcgtggtcgccttcgggcgcaccgagcggctgccgcgtggggcccggctatcagccgcccgcgcccttaggtgcggctgacgcgtgggacccacggtgccggccggtgtgagcccgggtgcgcccggtccaccgtgggccgtggggctgccgcgtgggccccacccccgtggacccggtccgcgcgcccctcccctcggctgacgcaataaatccatttttttaaattaaaatttaaatgaagaaattcgcaaatattcatttaaatagcatataaccttcaaatggccataacttggccatttgaactcggaattggaccgttcaagtctctaatttttccttaagaagtcaagaacccatttttgtgctttgttcctgcttgttatatggagtttattagagtaaagccttttcttttccgttggtcgtgtagacgctgcagcttcggaagatccactcttcgtggaggttgaagccgacgtttgggaaagcgagcaaggcaagtcacatcatccttgaacatattgaatcctagtttataaaattattttgatttaaattattgcattatcgctttatttaaattcccgcgttatcactgttttatttagccatgcctatttacctttgttatgaccttgttattattgctattgttattattaccttgttattattaccttgttcaccctaggataaacaaaaccccaactagtgggtaccctattcatggttccactagtatgaatttacgtagatgcttcgctgattaataggacaacattaggtggtttttatagctttagactttgggaattctcacatcatttggacactatggaatggttggcttatggtggaattggacatacccctctcttcctctttcaaaacccctaaaacctgttttccggtggggtttgggtgcatgccagttgtgggaagtagcaccccggccaatataaggattaagctcgggcctctgttgcaaagcactaccgtacttccacatgtctagtgggtaaggcttagtttgtggctcagtctggttataaacaaaagtacacggatggagatggacgaagtcgggggtcgatggacatctctaggacaaatgaaggctacacgagctgcggcccggtagtcgagatgtcatggcacagggccggtgtcctgctgctaggggctcaatcctgcctacctgtcccggaggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctgggttggcttgggacgagctgggacccagggtcgggttgccagttcggtctgaatcatcgtaggccttgggttaaggcaggttcgtgagggttcacggccttgattaataacactgtgtaactctaggatcgtcttataaaatggctttgggcaactaagtgacttttaaatgctgttttctgcaaagcttaacccctatattattaccccttgtacccccttgcattaatcatgcatctgccggtgtggcttgctgagtactgtggttgtactcattcttgctcaatcttttccccccccttcagtaagagaagcttgggagaagaagtcttaggtggagtcctggcttataccccagttgagcgcctgtgaagatggagccgtaggcccgcaagtccgctgctgtttatttttgtttgtcaggcctgaggtgcctttgtaataatgtaaatattatcgatataataaagatgtgtcttttatatcatgtttgtgtggtgtaccccggcttttcctgggacggggattaatacactagcgttcgggaaaaggcaattttctagggcacgggcgaggcggcgggagcggcgggaggaaggggatgacgggtgggccccacccgtcagcgagggtggcgggcgggcccgcccgtcagcggcacgctcgcggggaggaggccgaatgggccgcggggaagaggagagagagggggagggatgggccgagccggcccaagagggggagggggaaaaaaggactttttaggatttttctttttataaaatcattttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagaaaatgatttttaatttcgggatgaatttatcaggacgtgacacaatggtctgtatatcatggagcagtttcatgactacaagatggctgacaaccgttctgtagtcgaacatgctcatgagatacaaaccatggctaaggaactcgaactccttaagtgtgtcttacccgacaaatttgtggccgagtgcattattgcaaaactacctccatcttggagaggtttcggtactgcactcaaacacaagagacaggaatactccgttgaggggttgatagcatctcttgatgttgaggagaaagctcgggaaaaagatgccgcgtctaagggcgatggtggacagtccactgccaatgttgtgcacaaggcccagaacaagagtaaggggaaatacaaagctcagcagaccaccaacttcaagaagaagaagaacaacaacaatcctaatcaggatgagaggacttgctttgtgtgtggtcaacctggtcatctggccaggaagtgtccacaacgcaaggggatgaa

SEQ ID NO: 44963 - DNA, 3362 bp, Oryza sativa
  unsure (1)..(3362): unsure at all n locations
attcgcatgacatggaataaatttttttgtgtatttaggtgacatggtagatgaatactaatatatgaggtccacatgtcaatcaaacaaagaagatagtgggacgtcccactacctccacctcaccctctctacctctatctcctcgatctctccgccggtgagccaaagtcagtggggaggttggcgagcggggtagggaggctggcaaggggggcggagaggcctccccatgtaaatccaagtcatcaccgtcatcgtcaaccgtggtcaaattggacggtggtgaagagcttgggagaagaattaataagtggagccatcagagtagtgtgtggccgtgggtttgcttcggatggcgacggccatgtccctccccgccagtggcgacgacgacgtcgtcaatgagaaaaaggaggaggggaaggggaaggccttctgctcctgccggtggcgggcgtgtgtagttgcgcggcaagcaactgcagtagttgcacaagatctttctccggtttgacctcgacggcgacgggagcctcaccaagctagagcttggcgtgcttctccgctcgctcaagctccttcgcttgctcagcctccgcctagccgccgaggatgagatccatgccctcctcgccatcatggagctcggcgcattccttcactcactcctcctccgcccggctgccagggatgagatcaatgccttcatgtcggcatggagttcggcgcgctcctccgcttactcggcccctgtctggcaaaggtacatgctgaaatataaagtaattgcccgtctttcctcatcaatttaaacttttgggttgaattggtcgacgcatgtaactcaatgggatatcannnnnnnnnnnnnnnnnnnnnnnnnnnnnnnnnnnnnnnnnnaaataaaaattgcagcccacttctaataccatcgagttcgacgtgggttccgtcgagtttgatcgacgtgctcgcctccatactcacagaactcatcgtcgggccttgctgccccatcatcaccctcgaccaggcggaggtcaccgaggccttcagggcctttgactgcaagggcaacggcttcatctctgccattgagctcacacgctccatagctgacacggcgacaccgacagcctcatcatccttttatttgactgtgggtcccatcacccactgacatgtgggtcatagtattttttttcttatttgtttaactgatatgtgggccccacatattttgttttaaatttgtagttttcaattttgctcgttttattttttcgggatcaaactactacgtaagcgctacattaatgccacgtgggacaaagtcctcgtcaatcaaaatcagggagcaagaaatctcgtttgactggttttgtaagttgagagacgggatgaaactggtttttcggttcatggaccaaaatcagactaggacaaatttctagggaccaatgtatcatggaacgaccagggtttcaaaaaccgccgggggcccggttaccgccacccggcggtacggcggttaccgcgcggtaaccgcggtaaccgccaaaaaccgcgacaaattcacttttgaaatttttgaaatcaaaaccgcggtatgagacgcggttaccgtgcggtttgccgcggtaaccgcgcggtttggcgcggttaccgcgcaatgttggggcaaatgaagaacaaaattaaaaaaaaattaaaaaaatagaagaaacacctaaaaatttatagaattttgggataataattaaaaaattttggcatgatattttctatattacggacttgaaatcaattgaacaatacatgtaggtataaaattaaaaattttggcatgatctttgctatattacggacttaaaatcaattgaacaattcataacataatatttcgacaacaacaatcaacaatctgaagatatcgcacaaggtgtccacatgttcacatgtcaagacgtccacaatatagagttcacaagtgaaatgaatacagtcgacaatatagagttcacaatatagtccacaatataacatccacaatatgatagttcatatgaaaagcaatatgcaaatagaagttttgttggacgatgaaaggaaatagagaaggacgtaccaacatagagccagctataagttccactgattatatgccatgttgtactcctctgtggacatgagcatcaatccatgcgactgtagcaaccctgccttgtattcctcccaactttgacctgtccatgatgctgttgtttgccattgagcatacaattgagcgtaccactggggctcttgccactcgtacacccatgtaggagggggataatcagaaggttggggacgattatacgcataccttggatagccactttcaatgctagaggcactgaatgagctgtagctatcctgtggtatgtcaagatgttgtcgttgttgttggtcactcggtgaaacggtagttcgttgagagcttggagcaccgtgatcacggtcctgagtcgcgtgagtgaagtcggcctcacctgcaaatgaaattgtaagaagaaaattaatcaatagtgaaatgcatggtaaaggtctaaatagaaaatgaagcacattgcaccagtgaattggatagggctgtggtgacccccagaaggcacttcagtggttccttctcctccttcaccaccatcgtctccatcatctgtatcagttcttgagctactatcattggactcttggtagtctgggctatgttcggtctcttcatcgctatcaacattgcgagactgtggacctgtgcccttagctcttttggatgtaggtttttttggtggctgtcgagtcttcctttttccaatatgagtgtcagctatattcacatcagcccactctgcaatagtagaagctcccgtggttctgcgcaggtcagtcaagtccactaggttggctacaagtggactaggcacgggagcatcactttcagttgagtcttcatctagttctgggttggcattggaccgagcattatccatccattttttaatctgattgttactttcatagaatgataggtccgatagtctctgaaggggatcgtcgtcctccttcctaacttgggcatttgattgctgaattcgtaggcgaaggttgtagttcacataaactagtttgttgagcttgttgtgggtaagtttattacggaccttggtatgcacgaatgcgaatgtgctccagttccgttcacatccacttgaagagcaacattgaccaaccatgcgcaacgcaagcctcttcaaattcggcgtgtctgaggcaaacatagaccaccattgtgctgcacatgccagggctgcaggaat

SEQ ID NO: 44964 - DNA, 4742 bp, Oryza sativa
cctcaagcaaagcggcggcggctgtatcgatgtccgtcatccactcaaaggcctgacggaggtcttggaagacgctggcacttggagagtattggtagtgagtcatagggtttaatgccgcacctacaaatcatgaaacaagatcgatgagagtcgtacaataccaaatttttcattatgtaatgtcggttactcactggcattgattagagtttgattggtgaggtcgtgcattctcctattgacaatttccatgtatgcttcgaatttatccctttcactcgcaaagagactgtcatattccattctcaacaactgatatctcagaagaacctcactcaaattggggttcttgtcctcgtcagcaaatcgaaggaaggagtacatcggctggactgagttgaccacggtctgtaagttctcccaccaagacatgctagataggcatgcgtgcgcatacctgccatccattgtgccactgaatttgctttgcatgaacccagaagaagccatccactgcatgaactgatctcgcctcctaaggaagctctgaaggaacatgtagtttgtgccgaaccgtgtagcattccacttaaccagttcaccacctatagcagacaccatcatggcatgcagcttggaatggttgtatagccatctgcaaattttccttgcactctcaatcaccatttcatggtccggcatttttccaacctccttaagcatcaagttaattgtgtgcgccacacaaggttgccacacaattgttggatactcttggcgcaacagtctgcaggccttcttgtagttagaaccattgtctgtgataatctgaacgacatgttgcgggcctaattcgcgaaccacctttcttatctcctgcatgggtcaaacacaaaataaaacaagacctcaaacactacacttgatgttatcaaatgagactaaagtgttaatggaacgtagttacctttagtacgaagttagcatcttggctatggccggtggcatcaacggagttgtggaaaaacatgattccattgcaatatatcaaaaagttgatgaccgccatacccgccggtcctgtccaagaatcacacattagagtaacaccgtactcattccaatcacgcttgaacctgtcgaattgcttcttgacgtccttctccgtagcatcaaggtacttcccatgaatctccgaaccgcttggggaaggtatgttttcacctacaatgtacaaatacaaataattaatgcttggaacggttagaacaatgtaaattcatatgaaatgcatacttaccccacttctgtgtttctcgaacggcgctgacaaaatatgaattatcagcatttcttgcaggaatacccgaggtgtagaagaaccttgcccaggactcaccaatggcctccctagcttgccttcccttctttgtgaagaatcctgtatcgatgcgtgtctgcacaggagacttggcagatgctagattgtaatctctcacagaaggtgactcctagtgagatgtagcccttcgcaacaaactggcaattgggttgcttcttcctttccgtgcctcggactgagcggatccactgccaccgccatgctcataagtgccacctcgttgctccacacccctcctaaaactcgcctcttgccgtgaggcttccatggctgcttccatttgttcctcctcgtcggcatcacctgataggtcataatagttgaccccagccgcttcaacccttcttgccctctcactctgacgagtatcacctgcatcttttatcctgtccaattcgcgcctgaagaattcgcgaacatctggaggcactgaattgcaatacgtaaccccttttccttttccagccaaatgaattttaagtcgagttgctccaccaccgccctttctttgatgacaatacttacaacgccatccaggtgccatgctctccccgtgctcccacactggatccctactatctgccatatccaccctgtatgtaacatacgcgaaaagtatagtattagaaattaaatcaccaaggccgcatttctatttcactaatgccatacgtataaaaattcgacttacacatagacttacacatagtcgcatatgaaatccaaattacactcaattacaaattacgctcgcacttgtacgctacgttttgttatggacttattttactaccattccactacttttactttttatctgagtgtttcataatttgtagtgataacaaacaagcaagacaattgcattgcgaaatcaaaattacaaaaattcctagctacggtttaccggcgatttgctcgcggtaaccacggtttctacgcggttaccgctcggtatgccgaggttaccgcgccctatagccccctgatgctaaaccctaaagccacggctaccgcttaaaaccgcgcgataaatcgagcaaatcgcgcggttaccgcgcaataccgagcggtaccggaggacttaccgtgggcgggctggcgtcggcggttaccgtctcgtaccgcgcggttaccgtgccctaccgcgcggtatcgtcgctcgccggcgcggtggcggcggatctggggcgcggctggcgtcgccggggcgttggacagagagggagagacagaggagagatggaacgcacggggggacggtagagatggggttagggttagggtcacctcgtttgggcctcaatgggccgtgtgcacagtatcgggctggcccatttttttttctttttccaattttcaagtttttcatccgttttgctctcaaatttaaataaatattgatctttttcgacaaatttcttcaccataaaacactacaaatcaagcactaccgttaccattttttttgattttttttcttttttttttttgaatttttgaattcggatgaaattcggcaaaccgtaccgcgcggtacgggtaaccgtacccccgcggtacggcggtaaccgcgcggttgccggtttttgaatccctgggaacgactcaatctttcactgatatacgggcctcgaggaatactcacgggcccactttcagcccagcccgtaaaagttatagccgaccgtccctccccgaacctgaaactgaaagcaacacgagaccgcaacgaaagcctaaacgcccacgcctcttcagggcctcctctcgcctccgcgcgccattccggaagccctagccacgccgatgccgtcgccgccgccctccggggagctccccctcccccgccggaggctccgcggccaccgccgtccgccgtgacgccgcgatgccccccacccccgccggtgggcgggggcgggggcggccccacccaccaccacgacgccgcctcgcgccctccgacgcggccgcgcgctgcccagggtcggtgcggcgcggggcggggcggggcggggcggcctatataagaaccggatcgcaaccccgcgcgggggtaccacggggagggagagatagagagagggaggctgtttcgcgtgaggaggaggagcgtggatttcggcgactccttccctcttcgttcttcggcgtagttctcccgatatcgtggcggcgagatcgaggggggatttttttgttctctagagatcgaatttgatgctggtgatcgtcgaattctcgccagacccggatttctgcgaggtatgtttacgatcgacaaccgttgctcttgaatttctgtggttttgatttctggcgtgctagattggacttgttcgtcgctctaggtatcaaatccgcagattgatttcgtcggattaatcttgataaaattgcgattatcatcgaattcagcatataagaaaatcgattctccgaacacctgaaaaaaacgaaatcttcttctaaaaataactgatgaatttgacagctaaattagttgtataagcaaaagattttgtgaacaccggaataaaaagaaatcctgctaagaaattattgataaactcaacacctgattttggtgtagcaaaacgattctgcaaacaccaacaaaacggaattcgcaaagaaaattgttgatgaattcgaaaactgagtttggtgtataggaaaaacgattatacgaacacctgaccaaaaccaattctgcaaagaaattactgatcaattcagaactgcatagtttgcaatcttctactccatgtctaggcagttggtgaaagattgttcatttgttactagattcatcaactttttactatgattgatcaacgaaatacgaagaaaacatgaattgccatgtataaacatcaatcgcttactatgattgatctatgaaataagaacaaaggataaattggcatgtataaaaatcaatgagaaaatttaggtcatcaagacatggcatctgtgatttatgtaggttgaatacaattaatatgaagagtttctgtcctttactgttgtttctgatactgttagcttattgatgtttttaatgattggatttaacataaaaagttactgttatttgtatcgaatgtgtataatatgaaagtgttaaaatatcgttgctgtcaatccttgtttctctattgttcattaacacatagaattgggaattaacagtattaattttattgagaaggggaacatgatttatcaaatagtattgctgataatagggttagatccaaacacaatagatatgaagagaaaacagattgaactcaatgcattagttctgttgtgagcaggaactttctga

SEQ ID NO: 44965 - DNA, 8541 bp, Oryza sativa
  unsure (1)..(8541): unsure at all n locations
ttttcccttaattgtgtacttgtttctgcaatgtatttgctggttcctatcttttgcactgaggttgatgaccatgctcactttacgtttgttttgaaggcactgcagctgtagaatggctattcttgaagcactccagcaaacatcgatccctgttactggatcttcttctattgcagtcagtccagaaaactttatcaaatgtttgaagaagttttaccatcattggaaggaagatggatcaaacctttggggatcttcaactgcaattgccattgctactccaccaccttctgatgacatccgatataagaaatcattagccctgagcatgtggttttttaatcgtgagctccctgaaaccataatggttttcacagagaagcagattcatgtcctgtgcaagcagaaaggttgtgatgctcttaaacctttgaagatgcctgtttcaaaagcagtcagcattgaaatcgtgttgcataatttggcaaagggtgacaatggttcttccttaatggatgaaatccttcatgctgtatgttcccactttgaatcaaaaagtgctgttattgggcacttagcaagagagaagcctgaaggtaagattcttgaagtatggtctgagaagttgaacggatcaaggctaaggctttctgatgtgtcaagcggcatctctgatcttctttctgtgaaagatgccacagagattatgtatgttaaaaaggctgcatatttaactgcatcggttatgaagaagtatgtagttccaaagctggagaagattatagctgatgaaatgaaggtacaacattcaaaactcacggatctgatggagaagatattgctttccccaacaaagatagatgtcaaactgaaagcagaaaatgttgatatatgctacccacctatttttcaaagtggaagcaagtatgatctccggcctgctgctgctagtaacaatgataatctgtactatgattctggaagccttattgtgtgtgcgatgggtgcaaagtacagtaactattgctccaatgttgcaaggactttcctgattgattgtgctggggaaaaatgtaatgcatataaggtcctctgccaggcacatgacgctgctattgctgctttggtaccaggtagcaaggctagtgatggttaccaggctgcggtttctttggtgagggataaagctcctgatcttctccccttttttaccaagtcagctgggacaggaattggcattgagttccgtgaaacttggttgtctttgaatgagaaaaatgacaggatactaaaggaagggatggtttttaatgtttcccttggtttccagaatctcccagagaagactggcgattacaagaacaaagaattctctctattgctggctgacagtgttcttgtttgcaaggaaaagccacatgtcttaacagcttttgtctccaaagctgatggtgatgtcttttattcatttgatgaagaaaagacaggttccccttctgtgaaaccatcgttgaatgcaaaagtgatggtcccagaaaaaccagtgccaaaagcagagttgatgctgccgttgaaagaaaacctgcgatcccacagcaggacaccaaaggaggaccttaggaagcagcttcaggcagaaattttacagaagagaactgctgaaattgcaatgaatagtaatgcctccaatcataaattgctggagggacaaggccttagagctatgcgtgaacctgttgcatacaagagcacaagggatattccctgttccaatcggttggagattcaggtggataagcagaatgaggctatcctattaccaatatatggagttattgtccccttccatgtttgtactgtaaaaaaagcagaaatccgtggggatagcaacagaggagtctatgtctgtattacatttaatgtccctggcactgcttccaatctccaagatccctgcctgaagacaaatgcaaatcgcattttcttaaaagcagtcaccttcatttcaaaagacagaaagcatgctgacgaggctattcaattaatgaggattattcaaagaggagtattagaaagagctaagagagctagtttggtcagtcaggaaaggcttcaactatgtgatagaatgactagggacaggattcagttgatggacttgtggatacgcccaacttttgctggtcgtgggcgtaaatcccctggaattttggtgctccatgtcaatggttttcagtattccgcatctaaatctgaaaaaattgaaatcatgttctgcaatgtcaagcatgcgttcttccagccagctgagaaggagatgataactctcctccacttccatctttacaatgatatcatggtgggcaacaagaagactagagatgtgcagttctacattgaagtgatggatactgtagattcagttggtctgaggcgccgaacagcatgggatcctgatgaaattgaagaagagcagcgggaaagggcacggaggagcggaataaacaggcagtttgagctctttgtgaaaagggtcaattccatttggtctcagccaaggtttgagcagctcggcttgcagtttgaaactccatcgcaaaagcttgggttcaatggagtccacggcagaacaacatgctttattgttcctactccaagttgcctggttcaactggttgaatcgccgttccttgtaacttctctgagggaggttgacatcgtatgcctggaaagggtggcgctggggcagaaatccttcgacatggttttcgtgttccaagacctgaagcgagatgttatccgcatagaggtcattccaatgacctccattgatgggattaaagattggctcaatggctgcaacctgaagtactacgaaagcaagctgaacctcagttggcgtaaggtcctgaaggaggttatgaacaataaagagtcagacgagaacaataggtgggagttcttgaacccagatgctagcgactcggactcggagagctcacagacagaagatgatcagtatgaaccatcagatgccgactcatgctctgaatcggatgacgaagacagtgacagtgaatctgtggtggattctggtgaagacgacggtgccatggatggttcagaagatgatggtggtgatgctgccgaatcgtgggatgagatggagcgcaaggcgagggacgccgacatggagatgggcagtgagtcggacagcgaagacgagaggcagcggcgaagggagaaagcactggccaagtctcggtgtcctagtcatccacaggccaagggtgctgcgcacaagaggcagcgaattaactagttctcagataatggaagtttagcttgttcttgtggcactttattatgcatctgtcgctttttacctgtcgttagtttcggtggtgaacttttgatatgttcttctaggtactttgcataagtacattactttgtcagcataagtgactcgaagaatgttcagttttctattatagcaacattatctcgttttactgcacatggtactttttattgtggccaaattacttgagcaactcgttttgtccattgatttgcacatggatagtcgggattagggttaatgctcgttactgtctcctctgctatgacggaggatctcgttccccttataccaagaatattcttgatggtagaagcattggagctgtgtgtggagttattggtgcatagcatgacttcatccattagggtttaaattctgatgccctagaatgttacgtatatgtaagcgggcttttaatatgttttagtgagattggatctgttgctagttttcgtcttcttaagcagttttcaataggctttaatgagattagatatgtcgctagttttttgtcttcttaagcgcatattaaatgagattaagatgtgtcgatttgaacatatgttgtttggggaaaaatggatgtgttagtgtggtgttgtgtgtatagtgtgcgtgggtgtgtctttgctatataatcagaaaaagaattattgttgatagctaaagaatttcagttttgatctaacttatgaacgacaccattgccttttgcaatttgactaaacataagttttttttttaaaaaaaaacaggaactggaaacaggagcttccattaatcacaggctcaattctctttttattttgaattgcagtagactcctgcgcaagttttaggacaggatgaagtcgaacaggaagtaaaatgagaagacataaacgatcgtatctgcctaaacagagcagttaggactccgatccaactcttcgtttgtgtagtaaatgccgcttctagacagtagcatctgtttccaggaagattggagtcattcaagttgtgctgctctatccagaaccacaccaaacagctatcgccttagggtgtgtttccacgtcaaaattgaaagtttgactaaaattagaagcttgaagaaaaaagttaaaagtttatatgtgtaggaaagttttgatgtgatggaaaagttgaaagtttgaagaaaaagttagaaactaaacaaggagttagtctagagatccttcgcaccataaatcaccatccaccttttatgaactcccatgtttcaagacattaaggctgtgtttagatccagaggtgtaaagttttgacgtgtcacatcggatatacggacacacatttgaagtattaaaacatagactaataacaatacaaattacggaatccgtctgtaaactgcgagacgaatttattaagcctaattaatccgtcattagcaaatgttactgtagcacaacattgtcagatcatgaagcaattaggcttaaaagattcgtctcacaatttatacgcaatctgtgtaattagttattttttttcatttatatttaatactctatgcatgtgtccaaacatttgatgagacagggtgaaaaattttgccagacgatctaaacatgtcctaacatttagagttggttcggtttacggttaggtggatgagatatggtcatcttcttttttgttgtatgaatcgatctattttcttttttcttgtattctctccgtccccaaaaccctaacttttatgggtggatttggacgagtgtttgtccagatttacttctaagttgttatttttcaatgatggaaaagtaagtctcagctgatgggggtattcattttttaataggccttgacatcattgaaaaataacttgaagagcaatacttttgttaagaaaaggacagtttaccaacgttcttacaaggatcacacccccaaccctagcacctcacgcgcacctttttaagtaaaaagagggacctagatgacgtcttcatggaaagaagcgacgaaagcactaccgccgctgtccaccaaaggtctcaaaagagaaccgagattgggttttcacctagctgccccactagaggcggagatggcacggcaacgctctcaggaaggagagacgctcgaacatcatcattgccagccctaccaaggccaggctgggctttcacctgccgcctaccgcctgcctatccacaactgacgcaccatttctccatcgccatctaaattttttcaacgtgtgagcaccactgcaccgatgccccccgccggtcagcctccaccgccgcaggcttgccaagcggctgctttcccgcgcctccctccagccacctgctaccttcgctacaagagtcgcacgtccttgcgaccttcagccttctttgccaccggccactgctttcgtgagcctctgccagaccgcgtctccagggtcgcgccaccgcgagctcatcctctcccgattccggctattccgggcttgccagggcggccattttgggcgctgcctcccacgccgaggagaagctccaccgccgccttccgggccagcccctcgggctccgctggtagtgaagcggctagagggacgaaggtggtggtgcgggctgctagggtttctcccccgagccgccctcgtgagagcgacacaagggacctctactaatgctacacgtaaagtgcaaaattcaaacacataatatgggcgtaagagaaatacaatatctttgcctaatgtgtggtacaaaagaaagtatgaacaagaagaacgtcacacaagtgaaaacggcgcatcatctccttgtcatatactacaaaggatgtgcaccatggtggcggccttgggtgcaatagagccagcctcaaccccctgcagaatgggaacacaagtgtggtgggaaagaaaaacaaaagaatcttccaccttgaaagagacaaaactttaattgtaaattcttccaatattttcctacaagtaaattattttttgtgaaattcgcacacattaccccctgttgtttagcaaccacagttgcaaattatcgattccccaaataagattagccactgtcagttattatagcaaagctgcttgtggtcacacatattgactgcagacaactcaatttctctcatagtaagatttgccagcatgagtttttagttaggaacaactgcttttggtcacagattaacaagggaaatatttacatctccagtgagtaaaatcgttggtttctgtctgttctattattacctaaattattctgtacaatatgatactgttcatgacaatggcttgacatctttgacagaacgaccacatagggggttatcttctatcccaacgctggacatggcgtacttgatgatcaccgtcttcagttcaactattcaacactcttctaaggacgtcggcgttccacccgaatacagaatcagaagagctgtcaacacgtccaaggaaaaggtgtcacctggagattcagatattgatacagaatcttcaacaaacttacagaattcatctgtcatcagagggtacccaacgaaatgttcagtgcaattagatatgtaaatgaaaatatgcacctggggatcgagatctcgtgattgaatatcctatcggagattggaggaatatggtcttttttctcattggcgaagttgatgatctggaaaaggacttcctggatcagcaaccccagcgcagcacgcttggagctggcctcttccaacgctttccctgaggggaaatgtcaacagaaattagtttgccgatgatttgctatatacatgtgaaataatacaatcctgaagaatgagctgtaagaaaaaaaacctcgaatacttgttgatgctttggagctacgtgattttccatgtcctttagggcttatgacatgcaaattgatgaaccactgttcccagtaaatcctctcagttttgctggtgaaccagcttgggtttttgttcttttcgtcaaagaaggacaggcagacctaatatattgaactcccccagtattaaaaccaaataacgcaaatgtgtaaacggcagagtataatgattatgaatatcaaacaaacctggcttcttcgatttggatgcttctccacccaagcaatgaactggttgatcttttcatccacctccttttctaagtcaggaagtccgcattgaacctgggggcagaagcatgcagaaagaacaagattatttgtttggaaccaagtccagcaaacgtcatcagatcataattccttaaattggaaaccttgcaaaattgtttgcaacatcaaatagacagatgaaatgggctgtaacatggttcttcaagaaagaaaacagtactcacataggtgatctcaaagagatcgcagtcaacatctttaggccgaacaagagtaagagttcggtggaagaagatcgtatgtaaaatgcctgcaacatattcatacataacatcactaccaacatagcgtggacagacataagaataacacatctggatggaagctcaacttgaaaaaagtaatgaaatcaggaaaacaacatctaagttgcgactaattagattcttgaaccatatatcatgttatgtcacagaagtgctgcagatagaataattagatccagatataacattgcattatggaatacagccagatccccatctctccctctaccatcatagacacttcacacaagatgcttctttataattagggatggactaatcttaatggttgtaatccttattccactaccacctgctagtattcaccatggtcgatgcttcctttgattcactgaaaaagggacttttttctttttttgcaatatacgactccgaaccaaacaatcactagtttgtccctaaaagaaaaaaaaaatctgaattttcgatctcaagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 44966 - DNA, 854 bp, Oryza sativa
atgggcaataccagagcattatgttttaaatttaggagagaacattccgaaaataataaccataatatcctatgaaattctcgaataaaattgcatctaaaattagacatttggcaaaaattaatgtatttggtgttgtatgtattatttattgtgttgcttcattaggtcaatatagtgaaacaaaacaagcatgtccgccgcaagtttctcgtcatttggatcattttgcatgacatccaaacggataccaattacttaagcaaaaagtaacaatataggttgtgttatcatatatcactttataaaaatttataacaaaattagacacacaacataaaaaataaagcttgcgcgattttgttctttacggttaaattaacagtttaatcccatgtcgacttactttattttataaaaaacgaaggctattttctatcatattcttactcatgcaagtcatccaaggccatctccacacccaaggtcatctttgctggtgttctgaattttaatgaaattaattgagacattgaaaacaagataaggttttcttaaaaaaaaatcaaaccaacaccttgaaaatgcaccagtcaagcacaagtggcagccaatagctagcatgtggtctggcaacgagcaacttgccaacgatgcaaaagctcagtgacgactcatggcttagcacatcctggcgaagcattatatggcagcaggagaacaaccagcgatgtacatagtgtagatggatggccaaagggtgctcaccagcaaccatcgcacatgaaaaaacgctataggaccgaaattatcttcaatattagaagctctaactgctcgatcggaaggatgaa

SEQ ID NO: 44967 - DNA, 6582 bp, Oryza sativa
aactattcattattccccacgagggccattagctgagtgcttgtgctagtcgggattcaattatcacatctactttggtattctccatgagggataattactcggatcagaagccactcagatgagatatgcatgatctacatcacccaagatatttatcactcggggtcatattaattgtcgtgttctatacgtcatatttaagggtatcggtagacatactttaggtctaggcctaatatgtctgcagcccatatttttaggtgtggcctgtcacgttcttttagggacttaggcattttttgcttaggcaaaagtgcacgtgattatatgcccaataccttcaaatccttttataccgcagttactcaactttttaggagttggtgtaatgcattttaaaaggtgccaaccagtaaagctttaaataactgcccgctgacttttttatatagtcaggcggctgttttgttttatcaagcaattgataggatacaatattgttgctttttgccatgtaagtgtgcatttttattgaccaatattatggcttaggctgattatatatttggtcattttccaagcagtagatatatcacttggatcatgttattcgtggattcacaccgcatatgctattaatattaagttacttggttgactataattataaaaaccgctcggttggttggattatttactccttgactatatgtttagtttgttcaactaatcacatagtcgtgggctacacctattaggtgcatctagtcgatgcacctaagtctatattcaatttttttcagccctccacagtcttcagatttggtaaaagtactcgggagaccattgcaaagatgattgaagcactcggctttagagtaatctggttcaagagaagattatcttttcgactgtgaaggtctcaggggctactgtggagattataggtaccccatacccacacggcatggttatccgactagttataggggataacttatatctatggaatatgtaacagatcatgacttgggtattacgtttccttgtatattatggaacggcctaaagtcctgatttgataatattgtaaagtagatttaggaaactgataccatattagttaatgtttctatcctatataaggtgggcaggaggccctgtaggtggcagatgacacaacctgatcgtcagatcaatatacacccggcggattcaaatccccaaacaggagtagagtattacctctcattgagagggcctgaacctgtctaaatcctttgtctccgtatccatccacttttaggtctcgtgcgctaccccttttattatgaattcatgttgatattttagagtagaaggttgtcatcgcaatcataccgaacccccatcgacacatctcggtcgtttatgcatcccattattccctcattgataagtacaattttataacaattgctatatatatgtatttaattatgtagtgttgtgctagtaagatcattttggtgtcgtgctagtaagatcattttatcgattggtaaagctttttatcgcgatcggcatcattgagtgttagagatggaatgcatcactgctcagctgaaaaacgttgggtttgttatagggtaaagcaaatggcaaacacctcaggtcaaccagaatgttagcagttcataagcttatctggtgcatgtattgctatctctttttctcctgatggggacatcctcaatatatccttcatatgctttgatcaaaattttctcacgttggctaattgatctttatttatttttctggtggtttgtttctttatttacaactatcaaagatttctcttcttttttctttcctcacggaaaagctaggttcaacccatggaccagagtggataaaattcatagtactctctccgtattttaatgtatgacgccgttgactttttaatcaacgtttgaccattcgtcttatttaatttttttatgcaaatataaaaatacttatgtcatgcttaaagaatatttgatgataaatgaagtcacaataaaataaatgataattacattaatttttttgaataagacgaaaggttaaacgtttatcgaaaagtcaacggcgtcatacattgaaataccggagggagtagtttgttaggtgatcgagctgctcttgcaggttgcagcaggccttggctcatgcgtgtgtaggcgcgtgaatcatgatttgtaatctagaagggcagcatgaccgcgtgagaccgaccgtgcgtgcatgactaaaaatctagaagcacaacgacttcgctatttcggcatgtgtcgcacgattatttggccctccactcaaccaatgatatatatgtgatttttttgttggatgatttccatcgagcatttatctgctagggggaaaaggacacgtgatccaatcggcagcggcaaacaagccgacttgagattaatagataagaagcactagggataggaggatggggcaaatgaaatatatattgcttgggtattatagaggtttgttttacattggttgacaatgaaatactccctccatcctaaaatatttgacgccgttgatttttttaaacatatttgactgttcgtcttattcgaaaaatttaagtaattattaattcttttcctatcatttgattcattgttaaatatactttaatgtatatatatagttttatatatttcacaaaagtttttgaataagacgaacgattaaacatgtttaaaaagtcaacggcgtcaaacatttagggaaggaaggagtatgtatatttggcagtggtagcatggtttatactggggaagagagagggagagagagtgatatagttcgagagattttaattgatcatgagcagctagagggatgagtcctctactgtgaaagagagcgtgaggtgatctggattgtcaaagaatgaaactaataagcaaagcaaaatatttctgttgaatacgcattatatttggatctatgtgtcacaccctaaaaatcctaattatataaattgttgtttaaatggaattattagaatctattttaaaagcctagaagagaagatctaattttaattaataaattccaatataaaatggggccaaataaaattttattaaatactttgcttaattctataattcctagatttttctgggatttatttgagctaaggaagtatttttaataaatggaattgcatttcatgaataatttaaattgaaaaatgtttttaaaagtcttcttttgtctttgggccgaaagtcggcccaaaaccgctctctctcctcctcggcccaagtccagctgcagccgccctcgcgcgcgctcgctgccgctgacaggtgggcccacctgtcaggcccgtcgtctacctccggccgccgccgcccgaaaccctagcgccgcgccgccatcgtctccttccaaattcggccgcgtctttccgtttccggtgaaatcaattggggggaaacaatcttccggatctcctctaccttttctcttttggaatcatcgtctatctcgctttggaagttcgtggattcgaggtcgaatcggatcggtctctttcctccgaacctcgaggtttccttcgcgtcgccggtcgccgtgggcctttgccgccgcgccctagcccctttataaggacccccggtgtctcctctcttcgctgccaccctcgccttcgtctctcgccgtcggaagcgccctagcgccgtgcaacctcgagctgccgtcgtcaccgcagctccagccgtgcgccgccgccgttccagccgtcgccgtcgctcggggaggtcgccatcgtggtcgccaaatcgttgccgtcctcctccgtcccttcgccgtcactgaagatcgccggagcaccgtcgccgtcctcaagccgaagaccgtcgccgcttcttcctcgacgccgccgccgtccgttcatcttccgccgacgttttggtcatcggtgagttcgccacgtcgcgctctacgtcctggtgccctccgttcgcgtcctcgcgccgtcgttcgccggcgagcttgcgcgaccgagccgccgagccgccgccggtggtgacgtcgtcgctgacgtcatcgtggccgtctgccgtgagccgccgtagacccgatcgatctcggccgttcgttttggataggatcgatctcggccgttcgttcccgtgaaccgctgccgtgcgcccggtccaccgcaaaccctagccgctgacgcaataaatccctttttccttttcaaaaataattcattattgcgtcataattcaattaaaatccatataagtgttttaatccgatttaatctttaaaaattcataactaattcatcttagctcggatttagttggttcaagtctctaaatttttctaaaattgagatctacatgttaaaaatatccacatgtactgttcatgcttgtttatgtgctgttttggtgattttgctcttttctgtttagattccgacgtttccggagagtccgttttcgcaggagaagaatttaaagggttccaaggccagcaaggcaagtcacacagatcccaaacaaccctttgagcatgttgatcccgtttaaatctattgtttctattcaactattgcatttattttcgaatgtcattgggtggaattaacctattgtttgttatagccctttttgttcttgattactttattccttgataccttgggtcattataacttgactagttgggctatatatattggttcagctagatattagatatgattgcttagccatgcttaaaaacattagcacactattaggataacttatgactcactattatttaatgatggcttaatgatagttcacgatggtcaatcgtgaatggttaattaattacttgccaactaaaacttgataatggtgggttgtgagcacatggttttgagagtcgtgctcatgacaattaaggaccggttcacgagtttcggttgtgaaacattaacagtgccaaccacaagccagcgtgggcaacggctttaccttttgtatagcatggctcattgcagagcaccagactgagaagtggcggagataagcccacaggggtcgctggggagtccatgccttgtttataagggggtgattatgatccaggaatggtgcgctgtagtggattgtgttgtgcgaggggtattgtcacagctcctttccgaggtaccgtggtggtattgaggcacatggtgacatgatgtggggctgtgtattgtgggtacagtggtacacctctgatcagagtaaaactattcgaatagccgtgcccgcggttatgggcgggtctaacaatgtctttcgtgattagtctcacacctctcatcacaataaaagatgctataactggtaataatttgattagctcctggtttggaatggtatattcctggtttggagatagaactgtgcagccgggatggttgttcagaatggttgggcctatacaacagggtatgttgtatagcgttggattaatattgtttaattattacttaactgttgtcatgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaaacaataaagatctaagcagcgaaaaataagataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaaggataccaaaggatggcatagtagggtttcatttgcaaaagcagcatttagcaaatatttcagaatttaataaaacagttaagtattaaacaatattaatccaacgctacacagcataccctgttgtataggcccaaccattctgaacaaccatcccagctgcacagttctatctccaaaccaggaatataccattccaaaccaggagctaatcaaattattaccagttatagcatcatttactatggtgagaagggtgagactaatcgcgaaagacattgttagacccgcccataaccgcgggcatggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttataaacaaggcatggactccccagcgacccccgtgggcttatctccgccacttctcagtctggtgccccgcaatgaaccatgctatacaaaaaataaagccgttgcccacgctggcttgtggttggcacggttaatgtttcacaaccgaaactcgtgaaccggtccttaat

SEQ ID NO: 44968 - DNA, 6154 bp, Oryza sativa
atcagagccgaccttgaccgtaggacaagccaaatggaaaaacctaagagccctctgaatccttttcattgcatatgttctttgcaattggatttgttccgggaaaattgggatctgttcttgtggttcaagggaaaaatcttggtcgctcgtttaagtgagatttttcaaaacgagtcagtctagggttttagtaaaactattgggatttattcgtcagtcagttgggatttgatgggtgaaatgcattaggtcctagctcaggaacatgggttgcaaggtatttatgctttatttgttattattagtatgtatctaatttctcattattttatcgttatgtgagtctgtcttttttattcgctctcatgcaaaatgatctatgcataaaaatttcgctcttattcgattcccttatttgagtcttttattgctttatttaaatttggatttgagcatgcattgatcctacccctttgtcttctctagatggccggtcacccacccaaccaccgcggagaaggcatgatcaactttgtggcagagttggcacgcatgacactggtggtgggctaccccaacgcgccagagtacacgacgattccaccgctcagtggcgagcttcctcaccgtgttcgcttggaggtccacggctacgtgggtacctgcctagctaacatggtggttgaggcatccggaggctcaacagatcacgcctgtcaggaggcagcatacctgatgatggctagactacgggagcgccacaactacatcttccacgacacggcgtaccgatttcaccctcgtcgagccagtggtgatgatatcagtaccttccgtccgacagccggcgagaacgacaccacctttagtcacatgtgtgctgtgatgaggggattggataggatgcactcggacctgcacaaggcgaccaaggccttgaacgatgggaagctcatgaggatcgtcactctgaaggacgagatagcgcgcctgaagagggagaatgctcagttaaagggtcttcccgcgccaggaggagtccggatccgcactacgcccgcaagacgacgacggcacccgtgcgcatccagcttgcgcccaggaacccacctccatcagcagctcccgcagcacctccagttccgcccgcagttcctgcagctccagctccagctcccgcgtccgctctctccttcgctccagcatcagccgccagaggtccagccagtggcaccggaagttggttgtctgctactcccagtggcagccgcgatctcagtagcagcagctccagtggctcacagtcaggcagcggcgagacttacctgccaggctccgggagtcgctcagaggtaccgggtgacgagcaggaggacgccttcgactccaccgaccgaaggagccgttccgagcattaggctcgttttccattagtttatcgactgtctagcttctgcttgttagtttgtgtgtttaggttgcttgtttggggtcagtcgacggtcgatatcatgtgcctatgatatggctgtcttaataaggatttttgcttgctctttaagtgttttaattcagagcagaacaattgcagtttaaattcctatgtaataaagcttagtttctgagcatctgtttttcttcttctccccgtatgcttttcctccagatggtctacaccaggaatggtagccgcgcgacaggcgagggcagcaacggcgaagagcgcactgatggggcgcatccccacagcgattctggcaatggtccgccaccacttcccgagaatccgacgctagcccaagtaatggcacatcagacccagatgatggcagccatgatgcagcagatgcagcagcagcaccagcagatgcaccagcggatgctgcagcacgccgaacagcagcatcaacagtttggtccccctccccctcagtccaagttgcctgagttcctgcgtgtcaggccacccaccttttccagcaccaccaaccctatggaggcgaatgactggctccatgccatagagaagaagctgaatctcctgcagtgcaatgatcaggagaaggttgctttcgccacacaccagcttcaaggtcctgcgtcagcttggtgggacaatcacatggccacccgcccaccaggtactgaagtcacttgggcagagttctgccgtagcttcaggaaggcgtaggtgccagatggggtcgtggcacaaaagaagagggaattccgggcgctccatcagggcaacaggactgtgacagagtacctccatgagttcaatcgcctcgcgcgatatgcaccagaggatgtccgcaccgacgccgagaagcaggaaaagttcatggcgggtctggatgacgagctgaccaaccaactgatatctggggactacgctgattttgagaggctggtggacaaggcaatccgtcaggaggatcaacgcaacaagatggacaggaagaggaaggccgcacagttcagggcacctcagggaagtcaccagaggccgcgcttcactcccggacagcagggtggacctaccaccatgatcgtccgccagtaccgcccgttcaatcctagcaactttcctcagggcgccagtggcagtcagaaccaccatggaggtcagcccaaccgcggtgcagctccacgcccaccaatggcaccggcacagtcaggcccgcccgcgcaagccaagaaggagactggagcaaaaccagggtcctgcttcaactgtggtgagcttggccacttcgctgacaaatgcccgaagcctaggcgtgctgggccaaggtttatccaggctcgtgtcaaccacgcatctgcggaggaggcacaagcagcaccagaggttgtactgggtacgtttcctgttaactcaatccctgcaacagtactttttgattctggtgcaacgcattcgtttcatttcaaagaagtttgtcgggatgcatgggttaaggaaagaagagcttagcacaccaatgagggttcataccccgggaaatagttcaacctcagtcagttttagcccttcagtgctaatagaaatccaaagatcaccatttctagccaacctcattcttctcgaatccaaagacctagatgtcattcttgggatggattggctgaccaagtttaagggggtcatcgattgtgcgaatcacacagtcaccttgaccaacgagaagggagaaaccgtggtgtacaaatcactagtctcaccaaagcaaggggtctctttgaatcagattgagacggaaatcccagtcgacaccgtggagaaaaacttgaggaaattggaatatatacccatagtctgcgagtatccagaagtgttccccgaagacctcactaccatgccacccaagagagagattgaattccggattgacttggcaccgggaaccgctccaatttacaagagaccgtacagaatggcagccaacgaattagcagaggtcaagaagcaggttgatgagcagctgcagaaagggtacattcgaccaagtacttcaccttggggtgctccggtcatttttgtggagaaaaaggataagacgaagaggatgtgcgttgattattgcgcactcaacgaggtcaccatcaagaacaaatatcccttgctgcgaatcgatgatttgtttgatcaactgaaaggagctgaagtgttttctaagatagacctgcgatcaggctaccaccagttgagaattcaggaagaggatattccaaagacggccttcaccactcggtacgggctatatgagtgcacggttatgtctttcggacttaccaacgcacccgcattcttcatgaatctgatgaacaaagtattcatggaatttctggacaagtttgttgtggtgttcatcgacgacattcttatctactcaaaatccgaagaagaacatgagcaacatctccgtttggtactcgagaagttgaaggagcaccagctatacgccaagttcagcaagtgtgacttctggttgacggaagtcaaatttctgggccatgtcattacagctcagggtgtggcagttgatccgtcgaacgtagagtcagttaccaaaaggaccccaccgaagaccgtgtcgcagattcgaagttttcttggacttgcgggatattaccgccgattcattgaaaacttctccagaatcgcccgacccatgacttagttacttaagaaagatgagaagtttaaatggacagctgagtgcgataagagtattgaggagctcaagaagaaattagtatccgcaccagttttgattctgcccgaccagatgaaagacttccaagtctattgcgatgcatcccgccacggacttggatgtgtcctaatgcaagagggcagggtggttgcgtatgcctcgcggcagttgcgtccacacgaagggaattatccaactcatgacctggaattggcagcagtggttcatgctttgaagatctggaggcactatctgattggcaaccgctgcgaagtatatacggaccataagagtctgaaatacatcttcacccaaccggacctaaatctccgacaacgaagatggttggaactaatcaaagactatgacatgagtattcactaccacccgggtaaagccaatgtggtggcagacgcattaagccggaaaagttactgcactgccctatgcatcgagggcatgtgtgaggaattgcggcaggagtttgagcatctcaacgtgggaattgttgaacatggttttgtagccgctctggaggcacggcctacgctcgtggatcaagtcagagcagctcaagtaaatgattctgaaatagcagagctgaaaaagaacatgagagtcggaaaagcccgggatttccacgaagatgagcatggcacaatctggttgggagaaagattgtgtgtacctgacgacaaggaactgaaggatctgatactcaccgaggctcatcagacccagtactccattcatccaggcagcactaaaatgtatcaagacctcaaagaaaagttttggtgggtcagcatgaggagagaaatagctgaattcgtcgcactctgcgatgtttgccaatgagtgaaggcagagcaccaaagaccagcaggtttactccaacctcttcaaatcccggaatggaaatgggaggagattggaatggacattataacgggactgccccggacatcgtcaggtcacgattcgatctgggtagtcgtggatcgactcactaaggttgctcacttcataccagtacataccacatatacgggcaaaaggttggcggagctttacctttcgagaatcatgtgcctacatggagtacccaaaaagattgtatctgaccgagggagtcagttcacctcaaaattctggcagaagctgcaggaaaaattggggacccgtttaaatttcagcacggcctatcacccgcaaactgatggtcagaccgagcgggtcaatcaaatcttggaagatatgttgagagcttgcgctcttgattttggtggagcttgggacaaaaatttgccatatgcggaattctcgtacaacaacagctaccaggccagtctacagatggcaccgtttgaagctttatacggccggaagtgccgcacacctctcttctgggatcagacaggcgagcgtcaactgttcggaacagaggtattagcggaagcagaagagaaagtcagaatcatcagggaaaggttgaggattgcccagtctcgacagaagagctacgcggataaccgtcgaaggaagctcacttttgaggcaggagattacgtgtatcttcgtgtcactccgctccggggagtacaccgttttcagacgaaaggcaagttggcaccacgattcgtgggaccatacaaaatcctggaacgaaggggggaagttgcttatcagttagaacttccatccaacatgatcggcatccatgacgtgttccacgtgtcccaattaaagaagtgctaaagggtacctgaagaacaggctgattcggaacacattgatatccaggaggatctaacatacgtggaaaagccggttcgtatacttgataccagtgaaaggagaaccagaaacaaggtcacccgattttgccgagttcagtggagtcatcattcagaagaggaagcaacctg

SEQ ID NO: 44969 - DNA, 1475 bp, Oryza sativa
ccgataggtggggcccacctgtcgggcccttccccaacctccggccgcccgcccacgtcgccaccgccgccgaaaccgccgcaccccgcctcctccggtccacgtcggccacgcccgtgcgtgcgccgcgcctcccgcacccactccccctctctctctcgccgcgccctcaaccgagatggccgggattcaaatttgaatcccgccgctctctctctctctctccccacctccaacctcccacgtcgccggcgaaatcgggctcgcctcggccacgtccgtctctcccgagcccctataaagcatgcccgcactcccctccactttttttctttttccaccgctctctcccgtgccctccattgctcccgcgccatgcgcccatccgccgccgcctctcccgctactccggccgcctctagccgccgctacactcgccgccgcaccgcgccgtcgccgccgttgggttcgcgcggccaaggtccacctcgtccacccctcctccgtcgaggttcgccgccggagccccatccccgtcgtgcgccggtgagtgacgccatggccgccgccttcggccggcgccctcgtcctctcgcactctcctatctccctctaacccctctccttttgttcgttaggaggttccggagctcgtcccgccgtcgtcatcgtcctccgtcgctcgccgtcgtcgatcgttgtcggtgaggtctctcctcctctttctctctctctcccgcaccgtttagctctccaccgccgcttagccgcgtagctgccgcttcgccgcgacgccgccgctctccgccgccggtcggtcgccgccggccgccgtcttgtgccgctgccgcatgcgcgccgcgccgtcgcgcgccatggccgccgggccggtttgcgccgtgcccgcgcgcaccggccgcgagctcccgccgccgtccgatctacccttgggtagatcggggccatcggttcggctgacgcgtggccgccgcgtggtgcgccgctcctccccggtccgtggacccgatccgccgtggaccgccctccccgagtcactgccatgcgggtcccgcttgccggcgccgcgccccgccttgatgacgtcagccctggaatatattgcgcaataaatgatttaaggtttttcttttatagtaataaacacagtgaatcttctaaaattcataactaattcatccgagctccgtttaagcccattcaagtcttagtaaatcaagaaaaatgtgtagaatccattaaaaatggttttgttctctgtttcagtagtcttatagcttgtttgcaatgtttgccttgtatgtcgctagactccggcccctccgacgctccggtgtacttcgagatagtcgccgaggttcctccagcagcagagcaaggcaagtcatgcttgtcatttgaacatgttgatcctatattgcaaatgctctaatgttttctttcaaatattgcattgt

SEQ ID NO: 44970 - DNA, 1008 bp, Oryza sativa
ataaatttatgttcacaaggaacaagtattatgtgaagaataaagagtatgcaagtcatttcaaggaaaatcatataccctagttaagacgtcctagtttattgtaatcttgagtttgattttccagatatttttcaatagtaagaaccatttaaactaaaaattctgggaggttcagtgaggaattgtgcaaaccattgctcatgggtggttcggccgaccacatcttagtcccgatcactttgtcttttcttgtgtggttcccaaatcatgttgtagcatagatatgggaatctcatttgcgtacgtgactggaagcctgcgagatttcccccacactgtacttggattagaatgaatgcctttgcctttgtaccaagatttcccgcaaacttgcctttgcacgcctttcccctgcaacaaaatagtgaaagcaaaaagactcaagcagtttgcgagccggaggattgtaaactttatttgattgaattaaaatggataggcgcattacaatggaaataaatgaaaataaatgaaatgaaagtaaatgcaacttaacttgtgtctttatcttattggaggattagaaggaggcctcctggggactacgtgcacgaaggctgtgtaggggcggcccaacccatgggtcgaacgaacaaggggttcggccgaaccatggagggctcccttcttcctcagctcaggagtcatgataactggtcttggtaaatgcgtcaaaattgactaaatttaccacgtgtaattttttattttggttttcgagcaattaattctaggaaaacttttaaacgatgaccatttgcattaaagattgtgtcagccgtcttgaagcataactactccatgtgcagaggtgtcaatgatggtgaatggtcccatccatttgcttcgaagtttttcgtgcccgaagagtttcacatagaattgaacagcatcactttatctcttgccatgaactccttcccttttattatcttaccatgccat

SEQ ID NO: 44971 - DNA, 2941 bp, Oryza sativa
ggagccatcggtgaacttcaattgtccttcatctatggccgattgaacctatcgtcgaaacacattgcaatcattagtagaatgagaatgagaatcatgccatttacaatatactcgacgtttcaactcttcttgagatggtatgacatggcctttaggtaatctaatttgtttctcttgtaaaagataatcaaaaatcttatcacacttggccacatcaaaactatatttaacctcactttgtcgatctttgcgaggagtcggcattaggttagagcaaacaaaaggcttatttttattagtccatgaccattcggcaacatatatatcatgatcaccctcctcctcactatcactagcctcagggtaatcaaccacattaacattaggccttttgtcatatggtctaacaagttttttattatccttaacctggctttcttgagccagagccctttgcatgagttgactaacatcaagaaattgttggctatctagtctttctctaagaggagcaattaaaccattaaaagcaagaccagccaaatctctatcagttatattcaagctataacatcggtttctaacatccctaaatctcttaatgtaatcaatgacagattcattatacttttgcttaaccgatgtcaaatcacataacctaagctcagtttctccagtatagaaataatcatggaatttttcttctaattgaacccaaatatgaatagaatttgccggtaaagaagtaaaccatgtaaaagcattaccggacaaagataaagaaaacaagcgcaatttaaaagtatcactattagcctcaccacattgcgccaaaaattgacctacatgctcctatgtggtcttaccatcctcaccactaaacttggcaaattcgggaactctataattacggggaaacggcacattatcataataatcaggatacggctttttgtaaaccctagcacgattcctagtttcgatcccgaatctatccataataatatcactaattatatcctccatattattaggcccatgttgattcagcggtggatttggtggcctaataggttgtgtttgtggcacaatatgattatattggccttgtctagtatcgggacgataccccctagcaacatcattataagcattaggaacatgtgggggaacttggggattagttgtagcagtagatataggaggatcaaatgtcctaagatgatacaaataactagcattagtcattggatctatccgttgtatcggtataatcgcgccggtctgaccggcccagggcccggtcggactggcgtccagaggcacggtcggaccggcctgagtcccagtctgaccggccgtctggccggtcggaccgacggctaggtcgcggtctgagcggccgtcaggcccggtcggaccggtcgtgtacaccgttccatcggttctattacccgtttgatctaaaaccgagtttaaaaactcgagggtggatgaataggcggttttaaaacttttggctaaaaccgagttttgtatgcggaaacgtaaatgaaaacggttgagaggaagaagctagcctatgttgaggtttgcaagcctagggtggtaatagcacaaataaactctagtatgtaaacttactcaaagtaaatttgcacaaaataaaagagacaggtgacaaaggatttttccaaccgatatttggaagtttgccaacttcctacatcaccgttgaggtaagaccaacttcaccgctcaaaccacgaagccaccacaagcccccatcgtcaaggggtgggcaaggtgggagccaacccacgaagtggtctcccaagcctctctcactatggttgttctttctccactccggagatggcgaacaccaagccactcataatcaacactgggcctcctccacaaccttctcggagaggtcaccgggcaactactccaaaccatctaggaggtggcaacctaggatgcttgccgaggatgatcaagtgtcacactagctctaacaattaagcaatgcacttggattagcttaacttactctctaatacctcactagataaactaagtgcacaagggtgtgtgagtccacatcagtagataatgcaatcgagtaccaaaacattacccatactgctggggagtgggtatatatacccccaaccatcaaaactagccgttggagtcgaaatccccaacttttgtgctctgccggtcaaaccgccatgggatggccggtcagaccggacatttctagccgttgcagtgcattaaatgcactgacacaagggggctggtcagaccggccacgactcggtcagaccgccaacatctcggtcagctggcctcggctctagcggctctggatcaccaagacgagacctctcttcaaattcagggcagcggtcagaccgctatgggagctgcggtcagaccggacaacacactccggtcaaaccaccataagggttgcggtcagactgcaggtcacttttcagctcaattggacgttagtaaaacgacgatatctcttgactcgggtctcggaatttgactttcttggactctatggaaagcttattcaaagggttatccaactcatgaacaattaatccaagatacacaacttaatttagggagaaagggctcacactccaaaggatatccatcggacatacccacaagatgtcgctcactccttttggacatgcatgcccacttctctctttgtttgggacttgagaaaactcatcacacttggataaacatgcccaccaaatgcacctacatgcatataaactaatatggcacaagatcaatgcgttcgcttcatagacccctcttgatagaatgacgcctatctagcaagtcaggtctacaccaaacactaacccggggaaagactatgaaaacaatattagtt

SEQ ID NO: 44972 - DNA, 3421 bp, Oryza sativa
tggaagaattttactcaactgcataatattggcaaggaatgaaaatgatgagctagtgttgggttgagatgatcaagagatactaccatttgttgagaaaccacttgtatataggaattcgaatttgggatcaaggaatggtagttggctttggtagcaaggatcaacttgtatttctaaaaatagatcatgatttcagcaccatcctcattaatgctaaggtataacgtttcagcgccaccaatattagcgttgacatatagttggacatggcatgatttgctaggtcaaaagatgctcagcgacatatctcttggtgttgatctctttatcatctagaaaacaaaaaacagcttatggaaattatcaattgaagctagccaagtggtaggtatagaaatgtgatgtttctatctagaggacaagggttcgattccctacacctttttttatttgttttgaaagttcacgtgctttgaaaaattaattaatttcttttatagttttgaaactagtcacttttattcatttcaaaatgcaaacatataattattgagcgaaataatttcatcaagattaacaatataatttaaattctcgaatttgttggcttcaaatttaacataatactaatttacaatcaaaacctatgtttttttggaaataaaaataaaacaagcattctaagaaaaatcctgaaaaaggtcattcccctcttgaaacaaagccatcttcggttttggattaatttaaggttgttcctttttcttctttacaacaagaaataccactgacttgatagcactatcatgcactggttttagcacgtgtttaacaccacgatgtataaaagaattgtaattagtctggccctcgtgtgttgcattaagatcaaattgccatggtcttcccaaaagcaagtgacaagcattcatcggcaccacatcacattctactttatcaacatagctcccaatagaaaatgtaactctcaccttatgagtaattttaagcgtgcttgcttgattcatccattgaatataacgcggcgtaggaagcctttgcatagataaagataaagcatgcaccaaatctgagctgaaaactaccaccatcaattatcaatttgcataccttgtcttgaattttgcgctctgactggaaaatattgtagcgctgcccctttgcatcaacattagagccatctcattgtactgcgcgtgcaagcatagataaaccattcttttgttcggcaccatcatccatagatgaatcatcaatatctcgaaaccctgcagttagaatatgatcaagctgtacaccttctgaatttcctaataaactctcagaaacatagccttctttagtcatcaacaccttcttccaattatgacaatctctcatataatgtccaactatatgtcaacgctaatattggtggcactgaaacattataccttagcgtcaatggggatggtgctaaaatcatgatttatttttagaaatagtttttggcaatgtttattgttgaaataagttctataagggcatgtacaatggaggccacaagcaccagtggtctcaaaacgccacgtaggatagaaccacacaaaggtacccacggtggaaaccactccaaaacatattttgcatgtcagcccctatctatttatatgccagaccttgtagatatcttattatcaaacctattaaaactttatattttgaacccgatagtaaccaaaagaagtatatgtacatcctcaaacacattgcgacccactgtcagcctcttcccatccccctcgcttttttattcccccctctcaatctctctctctctctctcttcgatttcttctccaccgagagcctctccgccatcgctttcttcccttctcccctcccctctctggcgcgatttcgccggctgctcccctcccctttccggcgtgagctcgccggcttctcccctcctctcttaggcgcgagctcgccagctttgccccttccttctctggcacgagctcggcggcggggagcagcggtggcagcggatctagcgccggggggagcagcagtggcgccggcgatgtgctgtcgacgacgcgcgcctgctggcccatggggacgacggtggggacgaggaagacggcgaagcggcacgagtctggcctccgtaccggcggtgacggatctggcggcagccaggggcggagccaaacgaaaatgaaggggggtgcctgctttcatcgtttttagcgtcatatacagttgtattactaaatacttgtttacccaataacaatagagaagccaagtaataatatttttgttaagtagataaaaagtcagaaattgtgtacctattctttgtcaaattaattttcagcaaagaataagtcatgaaatgatttgatataaataaaaataagtatcttctttatcaaatttgcaggtcgttgtcaaattctctaaatagtttcttcttaccatgtatcttacgttaggatggtaatcatcaataagcctagatcatattccatcatctcttctcacttggtaatcattcagtacagtagaagggctgaacttccaacattgttagtataatctagtacttatcatttaagatatttcttcatagcaacctattcaagaccaaataaatttgttttcaagatttatgttcgtgcaaatgatgagacttgagagaaagagcacacatgagggacgggactataggaggcaggttgctcctatatacacaggtggcaagctccagctgttgatggcttgccgtcgtcggctatctgtcctctacatctctgcaactgggagccctagcttgatcaaggcgtgtgccacataatgaaaaaattgggagcagggaggaaacggaaggggaggagggctgaccttccgattgggggcttaccggcgggcataggagtgtcacggcagcgacgagcgagaaagattgaggagtcgcctcagagaagaaatggcgtcacggaaggaagacgaatcgataccgctgactgcgtcgtacgttgtgcaaggcttctagggaaagcggtggctgttccccagtattgggccggggggtgcctctatggtggagataggaggggataacttgtttcatattttgtgccgggttcctgggcaacccctgggtttattgggctccgcccctagcggcagcggggagcagcgacaacgaccacagcggcagcggcggatctgacaaggcgacgtgagcagcgacgacgaccatggtgagatggggatttggggtaggtgcacgaggggactggatgaggcgacgctcggggctccgactcctccaacgcgaggcttcggctcgtggcttcgcggctccccagcccaggtgtggcgctttgagcggttcctctgca

SEQ ID NO: 44973 - DNA, 14604 bp, Oryza sativa
aggctcaactatcaggctgaagcactatttaactatctggagtaaccagttgcacaaaatccacagaagatcccgttcccgtgctctgttgccaattctcccccaccaccatgctcctcgccgcgcgcggccgccgtcaccccttcgccgccgcgcgcctccttccgatcccgctttcctccggcccctccttcgcctcctccaccaccaccacgacctccaatggcgcctgttcgtcctccgccgcggaccccgacgccgtggccgccgaggtggccaccctcctctcccgctgctccggcgactggaggctcgccgtctcctcctccgacctcccctcccgcctctcccccgccgccatctcctccctcgtccgacgacgcccgtccccctcctccccgcgcctccaccctaagctcctcctcgacttcttctactggtccagcccccagctcgcgccgtcggcccccgcccccgatgccttcgcccacctggccatgtccctgtgcgccggctcactcttcaacctggccaacggcctcctcatcaagatgatccgcgcctacccgtcacctcccgtcgtcctcgcctccatccatcgcgcgctatcggattctggccaccgttcgccggcggtgctcgacgtcctcgtggatacctacaagaagtctgggagggtgcaggacgccgcggaggtcgtcctgatgatgagagatcggggcatggctcccagcattcggtgctgcaacgcgctgttgaaggatctgctgcgcgcggacgccatggctctgctttggaaggtgcgagagttcatggttggcgctgggatttccccggatgtgtatacgtactcgactctgatcgaagcctactgcaaggtccgggaatttgatactgccaagaaggtgcttgtggaaatgcgtgagagggggtgcggcctgaacaccgtaacctacaatgtgctgattgctgggttatgcaggtctggggctgtcgaagaggcgtttgggttcaagaaggacatggaggattatggactagttcctgacgggtttacctatggcgcactcattaatggactgtgcaagagccgtaggtcaaatgaggcgaaggcattgttggacgagatgtcttgtgctgagctaaagcctaatgtcgtagtttatgccaatctgattgatgggtttatgagggagggcaatgcagatgaggcgtttaagatgataaaggagatggttgctgctggtgtgcagccaaacaaaattacctatgacaatcttgttcggggactatgtaagatggggcagatggacagggcttctctacttttgaagcaaatggtcagagatagccataggcctgataccatcacgtacaatctcattattgaaggacatttccgtcatcatagcaaaaaggatgcttttcggcttcttagtgaaatggagaatgctggtatttcccctaatgtatatacttatagcataatgattcatgggctatgccaaagtggtgaaccagaaaaggcaagtgatctccttgaggaaatgactacaaaaggattgaagcctaatgcatttgtttatgcgcctcttatctcagggtactgtagagaaggtaatgtttcattggcatgtgaaatttttgataagatgacaaaggtgaatgtactccctgatttgtactgctacaattctcttatatttggactatctaaggtgggaagggtggaggaatctacaaagtactttgctcagatgcaggagagaggattgctgccaaatgaattcacatacagtggcctcattcatgggtatctaaagaatggtgatctagaaagtgctgaacagttagtgcagcggatgcttgacactggactaaaaccaaatgatgttatctacattgatctcctagaaagctactttaagtcagatgatattgaaaaggtgtcctctactttcaagtccatgttagaccagggagttatgcttgacaaccgtatctatggaatcttgattcataatctgtccagttctggaaatatggaagcagcatttagggttctttcagggattgagaagaatggatctgttccggatgtgcatgtgtacagctcgttgatatcaggtctttgcaagacagctgacagggaaaaagcttttggtattcttgatgaaatgtctaagaagggagtagatcctaatattgtatgctataatgccctaattgatgggctgtgcaagtctggtgatatttcttatgcccgcaatgtcttcaatagcatattagctaagggattagtgccaaactgtgtgacatacacaagtttgattgatggaagctgcaaagttggtgacatcagcaatgcattctatctttataatgaaatgctagcaaaggtataacaccagatgcttttgtctatagtgtacttaccactggctgctctagtgctggtgaccttgagcaggcaatgtttctgattgaggaaatgtttcttaggggacatgcaagtatttcttctttcaataatttagttgatggtttctgcaaacgtggaaagatgcaggaaactttgaagttgttgcatgtgataatgggcaggggcctagtacctaatgccctgactattgaaaacatcatcagtggacttagtgaggctggaaaactcagtgaagtgcacacaatttttgttgagttgcagcagaaaacttcagaaagcgctgcccgccacttttcctcattgtttatggacatgataaatcaaggaaaaattcctcttgatgtggttgatgacatgattcgagatcattgtaaagaaggaaatctggacaaggctttaatgctgcgagatgttattgttgcgaaaagtgcaccaatgggctgctcgtcctatcttgctatagtggacaatctatgccggaagggaaaattaagtgaagcgttgaatttgctgaaagaaatggacaagagaggtatttgtcccagtgagaatcaatgcttgatactattaactaatcttcatacatctggatatatccaagaacacaatacggtacttgataatatgttgtgtcacaagtggttacagaaggacagcaaattctgtaattcagctggtgataatctggaatctgtcaatgcagaataaacatagagcagaatccttcctataaaagaaagtctgattctattattcatgttgcgaatgcatgtcgtagccttgtttttgtttattgatgaggaattaaacagattaattttttcaagaaaatgctcttgtcctgttagttaattgttacacagggaaccttcagccaactttggttgctctgcttggcatcttctggttcaggaggcatcatcatatattgaacaaggtgagctctcattagcacatagccatttactgcgaaaaattggtattaattgtctctggctgatcttgttgagatttctgacaggttgttttcactgtcttcgcaccatctctcatgtttgctagcctggcgaagacggtcacgttttctgacaggttgttttcactgtcttcacaatgcaagtgcagttactacaaaatctgcccaaattccatttccacattctaataactgccaaaatcaacacaatatgtatagctcagccagactttctggattttttgaactgtaagctctttctgaaatttataaggattcttgcagaagtgagagactctctttctgaagtagtagacaagctttacatatctagctagttttctcattcagaacacttttcgaatatctgggcagaccatatatacaatatccaaattttgtttgctgggtaactccactgcactaacaaaagaattctatcatgtaggtggtttatgccaattaacatagggatcacattcatggctggtggcactctaggctggatagcatgtaaaatcttgaaaccaccacaacatttcagaggaatgatcattgccttctgctcagctggtaactttcctaggtggattgcatgtttttaccctcatatttttgctgaataatcctaatgttaggagtgtcatcaactgacaaaaaaatgcaggaaatcttggcaacttgctcctgattgttgtcccagcagtccgtgacgaagatggcaacccgtttcggaaaagacagcagccgctgccactctcttgggctctcctattcatcattgtccatggctgtaaggaaaaaaaaatctcattcactgaatgatcagctgaacaaaagaactgacacacactgtatctgcagcttggtggcttgtacatatggacgcatacgtacagtcttatgaagaagaagagaggtcaaatgtatcaccagcctaacagcattcagggcctggacgacagcaatgaagaacatcatgctaagaaattcaaagcaaatggtgaagctgcttgcgccgatgaggaggcaactcttctggtgtcagctaaactggctgaacacaacgaggagaaccaaatggtaggctgaacaaaacttagtactattaacttgtctgaaattcaggaagctccattgctgtctggagagagtgagattgctaagaaaggctcgtggacaacaacaaacttgaaggacaccatccaccatgttgtcgaggagctgatggcaccaccaactctatctgcggtgtgtttctgacaaaaccagcacaatatttcatctaatcaaccctgtcttggactaaatttggttattcttgcttcagatacttggatttgtttttgggctagttccatggttgaaatctcttgtcatcggtgatggcgcccctctcagagtcatccaggactccatccaactgatggggtaagttagtatttacagtgttcttcttcatagagtatttctgtctatttttcagtgtttatttttcttgtcttgcagaaatggcacgattccttgcgtctccctcatccttggtggcaatctgataaaaggtaggatgtcaattactcatgaagctgtgtgttttctgaacttgctctggatgtgcatgagttttctgaacctttatctgaatgtttgtgcagggctaaggaagttggagttcaagcatacggtgatcattgcgatcgtctgcatccgctacatgatccttcctctagtggggattgcagtagttcatggtgcatactgggtcggattcttgccacacgacccgctgtaccgctacgtgctgatgatgcagttcgcgctgccacctgcaatgactattggtaatctttccctataacagatgccattttcttcgtactatctgtatttaaatatatgatgctgatgattttatttggtccttaatgtacaatgttgacctctattttctgttacaatacaacattttttgtagctaacaaaattataatattgtaaaagtacttagcatgaagaaaaaaacatacctatatgattttttatgtcttacactaaatattttgagagctgttgtgatcaaagttttataaaagtataataactgaataaaatcaacggtatcatatatttaaatacaacgagagtacttattttgcgaggcaataccatttcgttctaaagcatttatctctgcttccagtgagatctcatctgatcatacctcttgcatgtgtgtgatctaatccaggaaccatggctcaactgtttgatgttgcccaggaggaatgctcagtgatatttctgtggacttacctggtttcttccatttctctcaccacctggtccatgatattcatgtccatcccgtctttaggtcaaagtgcaatgatttcagcatttcagctaactcaaagggaggaggttgaagacaataatacgcctctagaaaagagtcgatccaactgaggcttgttcgtgtcaccgtttgcaccacctgtataaaagaagttgagcagtttaggcacacggttttttttctatcccaatctattggttcatttaattggaatggttttcatcttttaagggatattcaaattcactgtttttacatgtcatctaatagtcatgaaaaatttaaattttttagtaagatagatcaatatatacgggtatatcacttcagatacatataagtttattaaaaagttgatctatacagattgaaaaaaaaaaggctatgaagtgtgtgtattcacaaacatattttagatagatcgaatttaaatctatgtgtttttgaagtgatatatcatgtattaattaatcttatcgaatttacattaccatctattttttcaataactatgtggatggcttgaaaaaacacactaacggataaaatgaattttcctatttaattatttctacatatttgtctgttagtatatgcccgtctattgagaggtaataaaaccaccacatttactttggagttctataattcatcaccatattaattaaagaaaacaagaaataatactattaaattatggttggctagattatagctttaactagacgatacacaacgcgttgctgagggattccgaatcttaatgcaagttgaagtgtgtgcttgatataggagtatattagaatgtgtgttacaaagtatggggcatagatgcgtacagccaaacgaaaggaacgtgtaaatctaagggggcagcacgatgcataagtagtaaagtagatgctaattcatttattgttgtcattaccatcttcctggagaaattgagaatgctttggagccttggaggtgttgtactctgtgcttatttgtagtataacactacaccacgacataggtacagaaacgcttgacctgttgggataagtacttaggctgtgttcgcatgcaccttttcccatcccctcttcttcgttttccgcgcgcacgtttttcaaactactaaacggtgtattttttgcaaaaagtttctatacgaaagttgcttaaaaaaatcaaattaatccatttttgaaaaaaaattagctaatacttaattaatcacgtgttaatggaccgctccgttttccgtgcacaggagttaggttcccatctccctcatccgaactcagccttataagagaaatggtcgtgtgggctaagctgtgtaactggtggtgtgggctaagctatgaagctctgagcctctcactgtgaaagaaaccaatacatatgcatcgagacaggagccaatccaatctatttcagaactaacatgcgtatctgacctctttcttgatgtggagtatcttaaataacatttaactatggatatattaattaatataattttatcatgtaaagatcgtgactgaaatactaattagaaaatatcatccgcttaacatgcccatcggtgtaaagtgtggcacttgttgagttatattctaaggctgaaacggagccgtgtttaacgcatgattaattaagtattagcttttttaaaaaaaaaattggatcaatatgatttttttaagcaacttttgtataaaaactttttgtaaaaaatataccgtttagtagtttgaaaagcgtgcgcacggaaaacgaaaaagaaaggttgggaatgggcacttccgaacgcagcctaagtgatattgtttgccacatccttcaatggcaataaccaaaaataacatgtaattccgggcaaataaacgttagatagcaaactgggaaaataattctactaagtatgaaccatgctgtaaacattgaattcatatggtaacgaattgaaatggtggttttattttggagaaaacattaaatcagtcgaccaaaaggaaagaggacgctggcgtacactgacctgtgctagctcgctggagcgattgaagaagatgatggtgaaagggtggtatatgaatccagcgagaacaaacttcagcagcaggagcaaaatgaactggcctagtagatcgacgattatttgcgagaattatatgaatatataggtagaatggaaagagggaatctgaaacataaatatattcatccattaaaattgacccttggctacctatcatgatggtatctgttctcagaagcaattgccttcgctgccaccatcgagggttgtgcgtgtgggagttcacttggagtctcagactgctcgcatgcctcatcgatttggggaggctgggggatcggatgctctgggccagcaagttaagttgggctggatttgaccagtaaccgagcttttcgacataggtggacaggtaactaaaaaagcttggacatgtagatcgtatctaacggctgaggatttattgatgacgtggctctatgagaagctgctgataaggacacaactagctcggatataaccataactaccttatgtattaatcaaccaaaggtgcatatattctacattagatttactggttatatatttaaacaaacattgctacacaatgaattttgtgtgttttcgtttgcagaggtatttgcttaggcgaaagaaaagagaccgagtgtaaggaatatatggatgattaaagaagttgattggggaccaaaccaagaccttctccaagtccacttctacctcaccacatcacttttggtccatagaaaacaagagacaaagttctatatgttttggattcggattcgggtctcctgacagcatcaacttcaaacggacttagccgcttatctaaaaggaatttcggtgtccatgagtacttaatggaaagcttatggagtctattttcagatggttttggtcccacatcaaaattcctactgagctaccgggattctgcaaaacaagccacgtatatcatccagttcgaatctgatttgggttttgggctttgtaattgtgtcgtgggcttagcccaagggggtgtgcgccctagggcaactctaggacgtccctaatgatacttattcagtagccgtcatcgtttagagtcgggttttgcttagattattctgtcaagaatagattcgccgctagatcggtttgtgaaactccaaattcgactacttaatcattcatatgcaatttggttgcaatctatcttgttcttgcttgtgttctttgattcatatgcagggattagccttctcggcgaggtcaaccgggtttcagtacggttgataactagagaagacgtggtgctgcgattgcggggctcagtagcatgttcattcagaagccggatcgagttgtgtcgcgactccgcccaaatcaactgtttatcaatacctatcggaagatcgggacctaacatctctcattagctgttttataggagtggattgcaactatatagaaaagaaggatatgcacaaggaggttaatgcagtagtgcgaaaatggtaatataatattctttgcctgcttatgatcttcacactggttttagatttcttcacactgtttgttgggcactagttatttctggggaacttttagcatcagatgcagctaatacattgcacataactaaatggtgctaattcctgccgtatactccatccattctaaattgatctacatatttcatagatacaccaagaccaagaaaaactaataactctctcatactatatttactctagcaacaaacttgatgcatgcaccattcccattattttctagccaatatcaaattaagatattgcatgtgggttataaatacttatgtgcatggatatatacatcaatgtccatttactccaatgcacaaataacgaatagacttaatgaatgaacacaaatatgtaaattatttaggaataacctcaaaaaaactatatgtagatcgatttggaatggagggagtacaataatacaatttattattgtaggatctgttagtgtttggctattatttattttgaatgcttttagcctcttgtacttatatcatgaagctctttttgttgttacagcagtgtgggaagtatattttcttcctctgacggaatggataatttgttcccggtggaatgctttctagtgcacctagcatgttctcatggcaaaggcgacactatatctctggaatacgaacatggcaaagggttcctgctctatcagggctcatttggcagcccggcctattcccagggcggccggtccgggcggaaaaatttcatgggcccattttctggaccggccagatccacgtcccaagggaaaaatcccacgtgtcgggaggtcaggaaaatttcctcgcgtcgctcgtgtgccgcagcgacgattcccctctcgcgaacgaaggtcgccggctcgccgccgctccccttgacgtcgccgccgccggtccttccccgagaaaaatgacaatacgccactcttatggtgtggtcctaataaaataccattcaatataaaatgtacatgataaaataccatacaatacgcagacttcaggatattttgtcactatggagagttttacctattttattttattttcttcatgtttctttttctcccttgcacgtgaaataactgaaatgcccttggctgatccaaatagatcagatcgatctatacttcagcagtcatatccaaaagtttcagattcgtagtaagcagacataaaaataacaggcatagacaaaatagaatcaaactcaacttttcagattcatagcagcagaagaagttcttgtccaaccgagttccaaggcctgcggctcggctgatggggaccgaacgagtgagctgcgctggggagagagacagggagagagacagagggacaggggagtgcgggcgcgggcggcggcgctagaggagccgcgcggtgggtgggcagcgctgcggaggtggcgggcgagcggcagggcgtggtggatttttggatcgacaagggattgatctcatctttgtaaagaagacgagggcacttcagtcattccacgtggagaaaagaaaacagggcgaaaataatataaaataggtgaaattcttcaaagtggcaaaatatcttgaatgtaatgtattaagtggtattttatcccgtgtatcctattgagtggcattttgttgaaaccacatcataacagtggcatattgtccttttcctcgtccttcccctccagcgagatgcaacgccaagcctccctcctccaagatctgggttgagctgctcttcacatcctctcctttttctaggttttttatgtgatgcacgagtttgtggttgagtcccatctttactcccggcgctcctatcgtcctctccttcttcgggattctgcctgcacatcacccctagtgacagttgtgtgggtgattggatctccccagtgaggtgactctattactactctttttcctttcatctccctcttcaactagggttcttgtagattttagcaagtcaaatttggacgttaagggacaataagatctgtaggttgcagggtggattctaattgaacttcatgcaacagatttgaaagttcatctctgaaattgcatcttttttctctataatcatggattgacaaaatttggtgtacatatagcagctaacagctcgttttggtgtacatatattcagcttactcatcaatgttcctgtaataaaaataataatatgatttgcagtgttgcacttcccattgcaatgtaaacacctgtgttctgtagctctccttgaatttttatgttgttgtctgaagactaaccagccaatgaaaatatatcttttattcttgcccaaatgacagtccagtagcttgctgttttgttatcagatacatttatatgcatgctacattgttttccgtgctacattgcccaaacgacagatggatttaaatatttagtttaaggcctgcactgcagagtgctgacaacgctattcctctccttgcgagtcgcgcccagttgcaggatgccaattctcaggatccccgctttcgcactcttgtgcaagttgattggtacaactccgttttcatggcaagaccccatccagtggtagagatgaagtatgtggactggatattcatgaggcacaagaacaatgcagtctttaatgaagtaatcaaagtgtgtcaggcaaagaatcttggggagatccttgctcttgagtatgattggaatgaggagattattgggtagttctatgctacagcatattttggcaccaccaagaagggcactcatttcatcaagtgaatgactatggggaaacaatacagagtctccatgggtcagtttgctgctgccttagagcttgatccagaggatctgacgacgcctcatctctttgatttggaagccttattgatgcacaggactagcttcatgtatgagaaaggaactccttttggttgcatgggtaccactcgaggtatgcatcccaactataaagttatctattccatttccaggtggtccttgcttccaaaggttggggatgccacaactgttcctaccaagcatgctcacctcctttgctctatgcgctaccagtgccctgccttcagtgttatgaagctcatttggtttgagattcttgagaccatctatgatcctaagagaggttgcatttatacccccatacattatgaagatgattgaggaaatgataggaatttacttctccaaacaacgtgattagaaggctttccaccctcatgctccttcctcttctgctgcggctccccctcctccatcccggtctactagaggtttagcttcagccgctccttcagttgctcctcagcgctcgagctcttcttctaccatcaagaaggcacttcaagctatcttttgtatgggcaccaagatagcaaagaaagtcaagaagattgagaggcatcagaaggaagattggaaggctgcaggcaaggatgtgtcagatgtttctgaggatgaagcttttgaggacccatttgctgcatatgaggctgctagggatgtggctgccggtgagggtccctctcactccttctgtgagaactccacgtctagtgatgatgatgatgatggggatgaggtgccaaatgttgagtcagaggggactgatcctgaggctgctgtggatgctgctgtataggagagtgatgctgcgactgagaaggttacttctgatgatgcctctgagtggattccctctaatgccagcactgagattgtgcctttcgatggagacgaggattgatctccttcatcccttgtggtttggtccctttttggtgccttgatgccaaagggggagaaaattgcaatcgaaggaggtcaagttatctttttcagccttgctgccattttgacagtttgtccggaagttccggacctttggtcttggaagttccgggcagacttctttgcccccctttcactcctctatctatatggacatgtaaaaattctatgtgtggatgtaatgactgttaggtgctaagtataatccctgcatcacttcatgctatgattgccttatttcttgttttgtgatgtgataattttatctttttcggtgcttctcatgtcatttgcttttaatgtcatatttatttatcgctcttattacatcccatgaatgaaaagggttgaaggaaactctccatgtttgctcccttcctaatatgcatatgagcttcactcatattttccatatgcatattttaagggggagtttcattcacctctatcgattcaaaacttaatcttatatcaaatcctttgtgagctttaaccttattgtcatcaatcaccaaaaagggggagattgaagttgcatttatccccctagtgggttttggtgattaatgatgaataaggttaaaggactaatgagtttattgagttactcaggtgattagtcccaaggtgaacttaggtgatcaagagatgcttggaggacccccccccccaccaaccatcattcaagcggatttgaaactcgaaggacaataggatagtttaatatttgaaatcgagttttaggaaaaaccgtactattaagaggggctccaagtgtggttctgggatataaaaagtgctcttagtgagatccaagtggtagaatatttttgggagctatttttggaaatggctctggcccggacagagaaagctggccagaagttccggtccctggacccggaacttccgaaccttgtgagttgtccgaaagttccgggtgtcaggaagttccggactccttccagttcaaaaatgtgagtaacggctagatgacgttacctagctgttatatatatccagatcacacctagttcttttttttttggccatttcacttcagttctttcataccctaggttcttctagcctctcccaagatctctttgcttcctccatcaaatctagagacattcttgtgagattgagagaattgatgagagtgtaggagtgatttggagaaggtttgaagattaggtttgattgagcactttggatatattgtgggctgtcacttgggcttattactcttggagatcttctcctatacggttaggtgtcgcccgcgagcttccaaagatcttgtagatgtcctgggaagatttgtgaaggttttcctcacctccgcaaggaaacgaggtaagtgagtaaagattcttgtgctgagatttcagaggttctcctaagtaaagcaa

SEQ ID NO: 44974 - DNA, 3511 bp, Oryza sativa
tctttggagcacctcaacggagagtaggattgcaagaccaaacttcgggaaaaaaatcgtccttgtcctctttgtgatgattctgtgcatgttgctatagttgtgtatctgctctgtcatcctgtagtttatttcgtacaatttagttcaagtccctgttaaatctttaggttttactatcgcccggaagttccggtagtaagaacaccggaagttccgggcattctgagcagaccggaagttccggtgttcccgggcctactgaattttaccgttgcgaatttgtttgtaattttcaggaaagcctattcacctcccccctctatgctatatctttgcgcgttcaatatggagtcgctaaccacctcaacctagcaaaaactagatcaagatgagttttgtaagattaaaccggcaagcggagccgatttagatggaacaaaagataaatatccgtctcgtgagtgaacggaaggtttacaggacaaacctacaaaatagttttgcactaaactaggcaaaaaagatgtcatattgaaaaaaagattcttggctaattgggttgaaagtagattgtctctaattgaaccggtcttgtctcttataaaggtgttggtcttgcctccaatacagatctctttcacatcaaattcaaggtagagatcaattagaactcgaaaatcacctctctatgcaaggaaacccgagacctgacaaaattcgacatgaactcgcactctaccggtctggctggtcacatgccgccgatcaaaccaaccgtacacatcggtcaaaccggcctatatatggtggtctgaccaactccatgaaagaaacccgacgacgccttcgaaatttttacaatatttctctttcgcatctaggtgtcaaatttaggtgtaaacatatgccccttacctttttttgtacttgtgaacctaaatgcacataacacatggtctttgggcgataatctaagacaaatttttctacaagacactcaaagtttgtggtttttgctgtgagacacccaataaaagtgtatcttctcatagagactgaaaaatatggtaattagctgctggacacctgcctcattattttattatattccatggtcgcggatctccgcctcccacttcccccacggcctgcgccggattccccggtatagcgtcctccgctcccctcgccatcgactgctcctcctcgtccgccgctgcacgcatagcaatcagtagttcagttcgtatgcatgcaaaatcaggtagttcagttcatatgtatgcaaactaatggtaatcaagctgtattactatttaattacattgctatttctatttaattaccttgctcggccggtggagctacagcggtggtggtggtgaattggtgaagtcgtcgtcgctggcgtgctgcggcggcgccgcggcggccagagttcatcggctacggagaggctagctcctcttgccgccagggccgtggctgttgatcagcgggatggcgccgccgcacatatctatcttcactagctcgatcgatgcttgccgcgaagcaacggcgaacggcgagagcagcaagcaacctagtgcgtgggtgagtgcggaccgtgtaggaaggaaggaaatctaaaccgatggccaaaaaaatgcaacaaaattaagaaaaaaatcaaatcaaaattgttgttcttattttcttaatcgatttcgctttgcgcatccttgttggtggaggtgctggagctgggagtggtggtgcactcgctcatcatcgcgatgtcgcggagcgcctccgacttcccgagcacggtgcggccgctcgtgccggcacaccacgcgtggtgctggacatcgagggcacgcggtgacggggacacgcgacccacacgcgtacagctgggaagctatcgtgccgctccccgtggctgcagccacccacggctgctcgggaaggcagggtgagatgagatgaaagaaaagaggaagtagaatatttctaggggtatttcgatactttcaaggctctttctctctctttttttatctaaaataataaaataatgcctcggatatccagctgctaattatcacatttttgcagtgtccataggaagtaacacgttctttgggtgtctagcagcaaatgccacaaactttgagtatcatgtagtaaaatttgccataatctaattacggaccatataactcttcaagcatcctgccaaacactcggtaaatatttcttcaagtatttctcatagatcgatctctgaaatttgaattcattctccttgcaatgtctcaagaatcgaataattccacatattcgataagacactcccaactaagtgaccacttaccgaattccttagatctaggaccctctcaagattccgagtctatatgagaaagttatgctgttttaagaaagaacactcgaatgtaaaaaaaaaatagcaaacaataggaagtctcttaccaataaatcttcgggagcaattgctcaattgaccctgttttgaagcttaactatcaatatgaccttatttttttatgtttgcttatttgaccccattttttaaaattgaagagcaatattgaccttattctgtgaagattggataacggtgttaactaaagggcaaattatccatctttccgctttctacatacaaattaaaagaagagaaataaaaggaaaaaaagaaatggtagcaaagaaatccaagcatgcccaaactaacatatgatgatttctccttgccatgtacagcacttccttccatcattcaacgattatttctcccaaccacatgcaaagcactagcaatcaaggggaaaaggttgggctgggatatggcgcctggatttttcagattttggtacttatgaaaaacttatttcgcaaatagacccctagaaaaacttatcctagaaatggtcctttttggggtgccacagtggctggcgcggtaccggcgctagcctctctggcgccgtcctcctgccaccatggcacacgcgaaccgacatggcaggaggagggtaccagcatggctggcgccgccctagggaggagggccagtatggctggcgcccccccccatcccctacccctagcctccattcctgtttctctatatggagttacaacctttttatttttattttattttttcagatgtttattcacacttaggatcacgatgcaaccaaccacaaaaaaaattaaactcgaaaataatgcaatctaccactaggtgaaatataaccacataaaatgagcgtaactttctcatacggactcagaatcaggcaaataatatatccacggacatgtacataaaaagttacatccgattctccccaacttcaccgggttcggcgatattaaaacctccaaattccgcttgcaagattgtgttctcgaggagagaagttttttggtagagctttggaaagttccacatgccacatatttcgtccgtttgagtttatttttttat

SEQ ID NO: 44975 - DNA, 16425 bp, Oryza sativa
tccccccaacgtcaatattgggctatcgcgttgtcacagtggcaaggggtggtgccgtcccattggacgatggcgctggctactctggcacaccaaaaaggacttttttaaataagttttctcaaggatatatttatataataagtttttgaaaaggaccaaattgtaaaaaaaaatcccgtctcttccgttccccctcaagatctaggatttctttcaggcctaccagccacagttctccgacttataacgccattcaccgttcaaattatttcgagaatataaagcaagtgtaatgcacatgctatgttagtttttgtcagaaactaacgtgcccaaccacacaagcacttggcctgtgaatgtggacattttgcaaataggaacgggtactaggctactagctccctagcaattacttgctctgcaaagaatggtaacaatggtagtatgcccattttggtagtaaaccagagccaactagaatactataaaaagccggaattgctccttccctcctacaacattgggtttttagcctgagaacgatcagattctgaggctgcaaatggtataactacagtacaacataaggattaaacttctgactaatgcctgtaaactgtgccattggaatgtgccacagagtcgtcctgcagaatatcattgacttctggcaagaaaccactctcaaagaatgctgagtggagggcttgaacgcactgctttgcctcactgtcatggaccaccaaggaaatgttcacctgtttaaggatgataggtttctttcatcagtcaggaatcacacaaaattgcaatccatcatcaaaatcaaacatgaaagaaaatataagcaccttggatgccccttgtgagatcatctgaacattaactccatttgtacgtaaaacgttgaaagcctgacaaaatgagaatggatatcaaccatgtattgggaagaaaaacaaaagctgtgttccatgctgcttgagcaggatatttctgagatgtttcccacaagctagcattaaacagatattaaccgtagctgaaattggaacttcagaacaacattatggatgtagagacagttaaagttaggggacaagcatttaccttttcaagaatcaaagatgacctctgcacatttccaattaacgaaattatcgatctatgctgcagtaggtgaacaactgctatcttttcaagttcttcgatgacatgatcaagttcctggcacatatcactagagatgaactacaagcacatcaagctggaagatgcatcattaattggaacctagtaacttgttcatttgtgtcgaaatatgctagagtcttcgaagattatcctcaaccaataatttgtttttataatttcaagatttcatcaaaggcacaactaccactttttttttactgagcacaacattcaatattccttatcttaattcttgaatgattcatagttctagtatatttacttccttatgcaatataatgcctgcggttgaggtcctgagcagatttaaatatggtagtggcagtttttttttccttggtacaaaataaaaaatgaagaagactgctcaacaagatcccaaaaaaaggcagcttggacaaaaatcaaataatcatgagaaataataaagaatggattcaggtccaaacatttgcctgcttgatcaattcacgactccagagttttgatggatccagggtcaaagatatgctgacttcacttgtagctacacaatcaacagagatgcccaaatcttcaaaaattgaaaagacctgaagaagcaatacaaatattacaactaaaagaataaaatacaagattaaacttaagaatgtgtaagctctagctgtaccttagctagaaaaccatattgtccaagcatccgtgtgctcactatatcaagcattgtaatatttgatttaagtacaatactagtcaaaacagtctgaaaaagtcatccaagactcaataagttgcaaccaacaagtagatgagtccaatattagaaaatagtcaagcatcaaaccttactcatatctctagctttagtaatgagtgtaccaggggctcggcggttataagagtttttaaccctgacaggtatatcaccttctctagctggtcgcatcgattgtggatgcaaaacctagaattagttagtaaagggatttctgtaagcagataacaaatggatatatagaagacaaccaattggtcactaaattattaagctaaaaagtaaaccatctaaaagggaaactgttttactaaaagaaaacccactgaaaaaataacattgacttttacaaatggatagataaataaaagtgataaaaatcatgcggtacctgtgcaccaaaataggcaagttcagctgcctcatcaaatgtcaagtatggcacaggtttcgcatttggatgaatattaggatcacaagttaaaacaccatcaacatctttccaaacctattaggatttaggaatatgggaagaaatataagttcactgcattgagaattaaaacaaacaagtaaaacaggatgcttagtaggaaagtaaatttgagcaagttctgataattacaaacatgagttggtgatggcgatggagagtatgaagctctctctatgctgacattacacttccaatgattaaatggactttttgcatggggctaatggagtgcatttgacgaaaggctaacgtaatggcaacagggaacaaaatgggcattttttgtccttactgaaaatagtaattgtcaatggtagaggttaccagaggcaaaataatctaattgcaagatatggtatcaactgtaaaacaaacctggatttctcttaatcccaaggctttgccaatggtagtagctgtcaggtcactaccacccctgcctaaagtggtgattgcaccagttttccatccctacaagttcacatgtgaacactataaggacagatggagacatggagtatcggtaccattcaattaaaatgtgtaaaatgggttagatggccaacctttccgagaaaaccagtgactattggaatagcaggaccagtaacccagtccccatgtagcctctttgcaatggcaggataagttgcttccagaatatcagcgtttgtgaaatcatcagtggttataaagcctatttcaaatgcatcatactgcaaaatatcaagaatcaattaattatagctgtatcaaaattctgggtttagctaaagtatcattggtataacttcaaaaaatacgttgggtatttcttatctaaagaagcacctgttggatagaaaagaattaatataaattcagaacacttgtacatttgtattgttttcggtacataaatgacttttgctggctgactgctaggctatacgaactaaaataatactgaaaatagcagtaagcactggctatattcagagatgtcaaacaagaaggaatatttaaatcaacaaggtagagcggataaaagaaattcaattgaagagaatatacctgacgtgctttcaccccaagtttattcaaaagtgccgcaaatatccttgttgacatgcattcaccgaaggaaacaagatagtctcttgtcctaagagtaagctctttcatcatagcaattcccttaagaagttgctcaagctcatccgacaagcctgcaatatttcatattgactatggtaatttctatgttgcgtctatcaagggtaattgatgtaccaaagaaaatggaagctaatgtaacattacagcccaataatgatctaacaatgctttccacaatcactctagacataagcaatttatactaaagcaataaacaccatacatttagcatagtataataaagcaatgccagaaactagatagagattaatacattatgagtaaatttcagaaacctaactaccctttgtgaaactaacacagaacggcagttgtttttacacagaatttcattaaaccatactttcaagtatttccatcatattcaacagttttcttgataacaatgataggcttctgagatcgatgaatgggtgcaacctaacaaataggaatgaagtttgagaaatcatgctacatgatgcacgcatgttgtcatttcatctaccctatagttcaacaagttgttttactcattcatcatgtgacacatccaacgattgaaaatcaactgatgagttccatccgacagcgtcacacctccctcccgatccagatcagatcacgcacctccctccccacccagatcgcgctcacccctcccaggtcacgagcgcctcttcgacacctgcctccgacgttgacaccggaaaccgcaccgccctcttcctcctcgacctccgtcgattcgtactcatgctgccatccctccgccgccgatttcgacacctcaccgatctccgacaaagcgacgccgccgctgcgtcctccgcctcaggcgccaccaccgccgatacatagtcacgtcgacctcaaggtccgttcactgcacacaggtaagctcctccccttttttccaattctccaggaccacggtgcctaaccctaatcgcgcccctcgatcaacctctctcaagattcgccatcatcgccataaaatcgccgctgacctcgactcctcccgtcgtccactgactcgtcgctgcaggggggctggcaactcagccaacaagacacaggctcgctatccactccgtggcgacggccgccgtacccaaccttctgcggcctaatacaccggcgctccatctgccgacgcctgattcctgaagcagtggccactccacctccacgaccgaacagagtgacagccatcttcattgcttggtggaatgcctctaatttgagctggtactggtacaggctgcctataagtatatgcagtaagttaatttgagcttcataaacattgtactacagaggcttgcaacagttggggacaggaccaatttataaggatgacacccttacattgccactctgccatccgaaaataatcaggtacccttcacttgattagttgatttttgcatcaacaagaattatagctgctaatgtgttcattttcatttatctgcacactttgtcctcggaagtcaaaactgtaaattcactaaagtatgcattatgttgatctgttgtttaaaaattcagtaaatagaaacttgtttagcatctgccaaaatgttgtttttcagatagcttacacttgctgcagtagttactattatccagtgatttgctgctattttggcagtgttcttttaggtaataagatcactgttcattcttgcttcctacagctgcagatgttcttcaagccgtgcagttgttgatcaagttcttcggacctactggacactggataactgatgccaaatgtccttgttaaattgttatatagttcacgatatactagagtacaattagcactatctgctaggtgcttatttctaattgtatagtcagtggtaggtaataattgttgcattgataaacaggtgcattagaatcttcagttctccgtaagatagtcttgaataagtaaatatgccttttggtctgtggctctatgctgatgaaatcttccttctagatgagcttgtgtgttgttttgcaaaataaactttgagtgcaaacgtacaatttattgagatgtcaactttgtgtattttgtagtttgcactactaagtgttctactgttccacagatgggtgtagctgctgccaacttatctagcagagggattttcagtctcttatttactactgaggatgatcaggtccatttgttcttacactggggtttacagattgtgcattagatgaacacaaatcacattgctaaaagctgtttcttagtggttcggcaaacctaggcagctagatggccggggttggccggggcatgggtgtgtgttttcacggtaggagggctttggtctctcctactttgtttttttttcctttattttcttccccttaatgaaatgaaacgcaattctcttgcattttcgaggaaaaaaaacattgctaaaagctgagtacctctcatgtggaatataattgtttcttttcctttcctttacaattatcatgctgattagaatagttaaagcttgcttttcattgtagtgcagacattttagacataaagaaagaaggtaaacagagataaggtaacagaagcatccatgttcttccaaggtcacagcacactgaagtatattttttctttcccagatcacatagccttaatgtccagtttctacttatggcagcttattgggatgtgcgattttatttatctcagtatttctcatcagttaaccaacaagctcttgtattatttgtcttgctttattctgtttttttttcagaaagtaatgggtctttaacataatagcataatatttatgttgccttaaattttgcagcgatggttgcttagtggcaaaatatggttggttctcttttccttttgcagttgaacttagattttaattatttgttgacattaaacgaatgaaacgggttcaaatattgcaatctttgttgtaaagtgctacttgttcattgtattatatgtactgttgtgtaagcaactaataagtatagatataatagtgatagtggcctatagctaaatcaagcatacaaagaaaagtctatactagaatgtactatctgctatccatttagaagtaccaatctgataaattttgccttgtagacagcaggagcttcaattgctgcttcaaggtatacaaggcaactatgactcctccatcaatcataagtcgaggcattggctgacaggtaaatgaatccaattaatatttatacatttgagtttgtcctatctttgatttgaaacgttgaccatcctaaaacataaccttcagggtatgagcatcttgattgattcttttttggatggccaatgaaacctcagtttcagtgtaaggcttagttttttcttcaacttcctcgttttccgttagcacgcttttcaaactgttaaatggtgtgtttcttaaaaaagtttctatatagttgtttaaaaaaggcaattaaatccattttttcaaaattataatagttaataattaattaatcatgtgctaatgaggtttctcgtttcgcgtgcgtgaaaaaatttacctccttttggaagcatcgaacggggcctaagtataacattagaggataaatagaactggcagatcctagattgctcagataatttgcctgtacttggaaaacacaatactcaatttatgtgtgtacatggacagcaatactttaaactgttcaatggataagacatgggatgcaactgatgctttcatggctggtaggttgatttctctttcaaaaatacatgcttaatgtttatgttctaaatgtacttattagcgttggtatcgtactaagtatttttattatctatctacgttaacatctcaatatataggtaaccatatggtaaatcctcgatgagggcgttgatacaagtgcattgggttgaatgttgaagctggccagtgcctccatatggaactatgggagagatggatttgccgatttataaaaagaataacaacgttactcctcctaacgtttaactgggtgatgtgagcagataaaatagaaggaaaattatgtttggtggcaggtgtatagaaaaagctatatttttatgatttctaaaaaaaaatgctagacatcttatagcagataataaattttattgtaaacgaggtattcatcaaacattagatggtgttggatacgcactgattgtgaatttatatattattaggattcagatggtttcaaaagatgaaaaaactgtgatgttatttttactagtgtggctatgtatttaacaatataataacttataatgtcacttttttagtattaaatctatattattttatttttatgcttgattgtcaaaagcatatatattctttatattactaaatgctaccgtagcattagcacggccaaattattagtagtaatagtgttgcaaaggcaaaatgacccatgcagcatgcagtgcacattctactgaccaatttgaacttaacatcctgtattccacttcaattacaacaaaaagaaacaaaagttccctgtgcacatgtttcatgacctcaaagttctccaataccatagatgagacttaaaccttatatagtcggaaaaaaaatgctaaagcaagtgtgaaatgtctttaccggaaacaattgacctatccaatccaagttgatcaatggtcctagataaagaaaaacagcaagaaattaggtaaagcgtttcaaatcaatccacccaatgaaagtaaagcattttgaatcagaatcacacccaaaatgcaattccttaataaaggtgagctcatcaagctccgacacatttgttgcaccacagcccaccgctttctccccagcctagaagcaaaatcaaggagtcagtgcttgagacttatcaaacacctctctatcacagaaccaacgcgcacgagtattcagggtaacaacagaactggggttctggtgcaaggaggtaggtataccatcagaagcttgttggtggtcttccccatggcggagagtacgatcaccggccgctcctcggggaagctgaggatgagatcggccacctcccgcatccgctcggccgacgccactgacgacccgccgaacttcatcaccacggtgagctccgactccgtgtgaccggcattggccccctcccgcgccggctccaccgcgcgactcttcttctcgacgacgaccgcgctggcagccgcacttcgctggcaccgaatccccgcacccctcctccggccccgcaggcaaggctcggtggcaccgaccagcagctcgaaggcagcctcattcccgacctgcggggctgcggcggcaccgcggagagcaaccgccgcagagggccgcgggttgcaccggagagccgccgccgccgccatgtggagagagagtagggagggaaggaggcgccgggtggccgagggcgaggaagagagaggggaacggacggcggagaagggtctaatggacggcgcggatgagaaccggcgattctgcgtttgaacgtttggcccagaatcctccgaaaagaagaggcactgtggaagtgaggcccacgcagccggggagcaggggcggcccgcggctgatcgcgaccaattgccacccctctgatctctttgagcaagtttaatagtatagcctagtactaactccaatacatctataccaatttatacaatagttacttactatactgttaatatatggtcccacatgtcatacacacgttgcgtcttagagtccgtgctgcagctggctacagatttgtagcccgctgctcttctctctcatcttttatataattaaaatatgtttatagctggtgatgtgaccatggttactacggatacaaccgttgctcacatcatggatgaacaagatgctatcaagatcaagtcctctaagtgctagaatccgattcggccacttgctacactgctgatttcaaacggccgccgaatctgcatacgagctccgttttcggcccgtgagtacttgatggaaagctcttggagtcctctttccaacggatccagcctcatcaccaaattccatcctagtcaaccgcagatgaagaaacaagatgctgcatcacctgtcatgggcctttgggcttgtaactatgtttgggaccccggcccatgtagggcccatgtggggtgcgtcccaactaggtggaggaaggcctagaggtcctcccacctccttaaatagttaggtaccactctagattttcttgggttttgtttagattaaaatttagctttgctactttgctgtgtaatcccgtgatcggtttgatcgccagtttactcgtgacggaaccacaacctatcatttgtattcaattcctatctacaattcagattgcttttatcttgttcttgcttgtttcttcgatttgcttgcaggaataaggttgatctgcaccggcaagatcaacaacccacggagaggtgtatcgatcgctaaggcgcaacacaacaacgtcttgtacggttgtagtcgggtcgtcaacgcttctcccaaatcgtagttatcatcaactcaccgaaagatcgggccaaagaacagccttgagtctcgagtggagctcagggttcatcagttggctattactctgctattgtacctgctctgcgtcccagttgttcccaactccccctcctcatttttcacgcacacgcttttcaaactgctaaatggtgtgttttttacaaaaagtttctatacgaaagttgcttaaagaatcatatttatctatttttgaaaaaaaaatagctaatacttaattaatcacacgctaaatgttgcttcgttttacgtgcttagtgctgcctccgtcctaaaatataaaaatttttaggattggacatgggtattaagaaagtgggtagaattaaatgagagaaggttgtgattggtagaaaagtggatgtaggtaagaaatttgaatggtgaagggttatgattgattaggaagagaatgttgatgaagaaattgttatatttttggacaacccttgagggctagggagtatagccttgtttagttcgcgaaaagaaaattttttggtgtcacatcggacgtttgaccggatgtcggaaggggttttcggacacgaatgaaaaaacttatttcataactcgcttgtaaaccgcgagacggttcttttgagcctaattaatccgtcattagcacatgtgggttactgtagcacttatgggtaatcatggactaattaggctcaaaagattcatctcgcgatttccatataaactgttgtaggatcgagatgtcgactagaggggggtgaatagacgatttaaaattaaatgacacctaatcaaaactaacctaagttgctaggctcggtgagggacaagtctaactaagcaactaagttatattttgcaatcctagggtgaaagtggctcaagtatatcactaggaaagtaaatcacaattcctaagtctagtttagcaatcctagggtgaaatgatctcaagtatatctctaggaatgtaaattgcacaaatgtaaattgcacaaatgtaaatgcgacaaataaaacagacaatgagacaaggaatttttcaccgaggttcggaaactcgccggtttcctactccctgttgaagcgtgcccaactccaccgctcaaccatgaaaccaccgcacgcccccttcgtcaaggggtgggcaaggcgggagccagcccacggagaggactacccaggcctcgatcacttggggtagttcttccttcactccgaaggtggtgaactccaaaccactcacaaccggcgccgggcctcctccacaatcttctcggagaggtcaccgggcaacttctccacaagccatctaggaggcggcaaccttcaagagtaacaagcgatgacccggctcggagatgataaagtgccacactagctctacaatggaaagcaatgcacttgactcttggctaaatcaaccctcaaacacattagatggatgaacacaaagctccagtgggtgtgtgagagatgcaaggggtgtatgcaattgaagtgggtgccaagagactccccttggtgctagtggaggagtatttatactcccaccaaccaaaactagccgttgggggcgaaatcccccaactcagtgtactgccggtctaaccggtggtatgtggccaatcagaccgtgctactctacaacggttagttttatagccgttgcagctctatcagagggccccatcggcctggccggtcagactgatgttgagtggtcggtcagaccgcccatatctcggtctgaccgaatacggctccggcagctctgtatcgggcatcccagaacgcaccatcccggccaccagggggccggtcagacagcacaagtgccgccggtcagaccgacattcatgccggtcagaccaccacaagctggccggtcagaccggcttagcgcacgcggttagaccggccctggtaaggctgaacacagtgaatagaatgtgtgtgttgtgaaatgtgagcacaagtctaaatgcataattacctaatgtggcaattaaaatcatctatttgctaggtcattacccctcttaatagtacggcgaagctaaaaataaactagcaaatttgatcgccctacacctcgatcaatttaaaactaaagcactagttttaccatcttcttttttcgcttcgcgccaacaaattttaatccattgataatcatccatgtgcacatatgacgtggtactaacacacaatatataacttaaagagaaacggttagtccacaattagcgcttgtcattaattaccaaaattaacaacgagggcctagatgcttcaatctccccctttttggtaattgatgacaaacaccataaatatatataatcaaacataaaacacatggacattttgcaatgaaatgaaaatgctccccctaaacatgtgaatatcaatcacaaataacaaatatggaacaaatgcactttcattcacatttcaacatagcacaaacacatatgaaacatacaatgtgaacttcacatttggatcaaccaattgcataagatggtcacaaatatatcaatatcacatcaaccatctatcatagcacaagttcacaacaataacaatccaaattatagaagtttatccatatatcatccaactcacaaatttgtccaaagagggctcacaaataatgatctaggctattacatgaccacgaagggtccaaatgacatagagttcaacaaaacgaaaaagaacacacaagatagagtaatagcccatatccatacataatatagaccaaacaccttaacctactagataggaggtagctaacctcactactcctagtcccatcccacaaaataaaaaagcaagctagaattcttctcccccttttggcatcaaggaccaaaaaggcttcactcttgtggaggagaaggaggacgaggcagtttagccaacacgcgcgctgcgagcaggtagcaagtagctatctctatcatcaaaacccgagtgttcttggcagcaactagaggtataagaagagggaaagaacgaccatagggtcgtgctccaaccctaggacgcgcccctaatgggcccaacttggatacacagcccattgggccaaaagaggtgacgcagcaccatggacagaaaacagtcgggagtaaaatgacaattgcggccgctccagaacagatatggacatgtggctagatccatttgaaagtagacttgataagctttccatgaagtacttgcacgcccaaatcggagttcgcatgaagtcgtggcggccgtcagaaattggcgctgccctgcagtccgaatccaccccgcgcgaatcctctcccctttgaatcctctccattgttcctgagtaaaacacgagtgcacgcgtctccggggtataaagaagaggaatatgaactcaagaaagaactcacctgataatttagttggcgtgcacgagcatgggtaataggaccatcatgctgtacttggggggacgtggatgtattgatggtgtttatgtcctcatcatcctctccttcttgcatttgagtcgtcctcgactcaagctcatcatcttctcccaaatacggcttcaaatctgtaacgttaaatgtgggactaaccccgaaatctgcaggcaaatcaagcttatatgcattctcattaatctttgctaacactttaaatggtccatcagctctaggcatcaatttagactttctcatatcaggaaatcgttcttttcgcaaatgcaaccaaaccaaatctccaggttcaaaattcaattcccttctacctttgtcaccagcaaacttatacttagcattcatgcgctctatgttttctttagttgtctcatgcagttttaacatcaactcagcacgttgcttagcatcaaaattcagtttttcaaaagatggtaaaggcatcaaatcaattggagcacgaggcaacaaaccatacacaatctgaaatgggcacatttttgtagtagaatgcaaggaacgattataagcaaattcaatatgaggcaagcattcttcccacatcttgatatttttcttcaaaacagccctaagcatagtagacaaggttctattcaccacttcagtttgtccatcagtttggggatgacaagtagtagaaaacaaaagtttagtccccaatttagcccacaaagttctccaaaaatggctaagaaattttgtgtcacgatcagaaacaattgtgtttggcacaccatgcaagcgaacaatttctcgaaagaacaaatcagcgatatgagaagcatcatcagttttatgacatggtatgaaatgtgccattttagaaaatctatccacaaccacaaaaatgctatcatgccccctcttggtcctaggcaatcctaacacaaaatccattgaaatatcttcccaaggaatagtaggaacagggagaggcatatacaaaccatgtggatgtaagcgtgacttagccttttgacatgtagtgcagcgagcaacgaacctgccaacatctcttcgcatctgtggccaaaagaaatgaccagcaaggatgtcctgtgtcttcttggcaccaaaatgtcccatcaaaccgcctccatgcgctttctgcaacaacaacaagcgaacggagctagctggaatgcatagcttgttagctctgaaaacaaacccatcattgatgacgaatttgttccatgttcttccatccttacaatgcagcaacacatcattaaaatcagcatcatgcgcatattggtctttgattgtttccaggccaaaaatcttgtagtcaagttgtgtcaacaaagtgtatctcctagacaatgcatcagcaatgatgttctccttccctttcttgtgtttgataacataaggaaaagattcaataaattcaacccatttagcatgtctacggttcagtttcccttgactacgaatatgcttcaaagactcatgatcagaatgtatgacaaattccttgggccacaaataatgctgccatgtttctaaagttcgcacaagagcatacaattccttatcataagtagaataattcagaacaggcccactcaacttttcactaaaatatgcaacaggttttccttcttgtagcaaaacaccacccaatccaatcccactagcatcacattcaagttcaaaagtcttattaaaatcgagaagttggaggagaggtgcatgggtcaacttatctttcaacatgtggaatgcgttctcttgtgatgtgccccaagtgaaaggcacttccttctttgtaagcgcattcaatggtgcagcaatggtgctgaaatcctgcacaaagcggcgatagaaccccgcgagtcctagaaagctccgcacctgtgagaccgttttaggagtcggccaactctgaattgccttaaccttggcttgatcaacctcaatcccctgcggagttacaacatagccaagaaaagatactcgatttgtgcaaaaggtgcacttctcaaggttaccaaataaacgtgcatcacgaagagcattaaaaacagcacgtaaatgattaaaatgttcacccatagacttgctgtaaatcaagatatcatcaaagtagaccaccacaaattttccaatgaaaggacgcaaaacctcattcatcaacctcatgaaagtgctgggtgcattagttaaaccaaaaggcaccaaacgtaaatataaaaactaccatcatgagccttcctaagcatataatgagaatcaaacatgcatgtcttagaaggcttaccactggggcaatcattcaccaaatgcccaacctcacgacacttggagcaatacttaccattactcttgacaaaacgagtggcacggtgagaaggttttttacccttctttggaatgaatctaagtccctccttgttaacgatgcaccgttgctcactcaaaatcttgtcaagagtgttcttatccttgaagcatccctccaaactcttgttgagtttggccatttgctccttaagctcattgttctcaacaacaagtgaggcatcacaaatagaaacacaagagctagagctagagctaggcatatccataaaatcatcacaagaggtagaaatgctagatgatgcaatatgaggaatatgacaagaagcactatcatcaagcaagtcacaagatatgccaacatcaatgtgagctccatgttgagtagtgaaaaggaggttgtca

SEQ ID NO: 44976 - DNA, 12318 bp, Oryza sativa
ttagaagagtcattggccatgagacaaagtggagcgaagagtgatggagcctccttgatggcaacaacggccatcttcttcttcttggagcttgcatcatcatcaccttcttcttcggacccggatgaggtggagctctcctcatttgagtcccattgcccaatgaaggcctcaatcttcttcccttccttcttgagcttcttcatgagcttgtagcctccactcttcttcttggatgacttgtctccatcattagccttggaagggcacttggaagcaaagtgtcccttctcaccacactcaaagcacctcaagttggagagagtcttgttaggtattatatttcttctcctattggagttggagccccttcctctctcctttcttcttcccaagagatcattgaaccttttagcaagaagggcaatctcttcctccaagtcatcattggcttcattcaccttgctcttccacttgtcttcaacttcggcttggagagcaatgcacttcttagatggtgaggcttcctccatctccttcttcttcaacttgtacatgtcattggtgttgatcttccccaagaggcttgcgggtgtcatccttgacatgtcggagttgatgagcatggcgattagggtctcatacttctccggtagagcactaagcatcttttgggcaacctcaagatcggtgtaggttgccccaagccccttgagatcattcacaatgacattgagcctcccatacatgtcattcacactctcatgaggcaacattgagaatgtctcatattggatcttgaggaaatgaagcttggcatccttgtactcacttgtgccctcatggatctccgccaacttgttccaaatctcatatgcgatcttaaggttgctcactctatcgaactcctcttggctcaaagagttgaacaaagcattcatgacttgagcattgagtaggaggttgctgtgatcaatctccgtcaagggcgtgccggtgagatagcaaagcctacatccacaatactccaaatatggaagcttatagctttgaggtgagtagacattttaattttccaagtggagtagtttgtggtattgaacatgagagccttccctacatggttcacctcgttcgacatcttctctctaggcggtgaagcccaatcaagagagaccaagctctgataccacttgtaggatcgagatgtcgactagaggagggtgaataggcgatttaaaattaaatgacacctaatcaaaactaacctaagttgctaggctcggtgagggacaagtctaactaagcaactaagttatgttttgcaatcctagagtgaaagtggctcaagtatatcactaggaaagtaaatcacaattcctaagtctagtttagcaatcctagggtgaaatgatctcaagtatgtctctaggaatgtaaattgcacaaatgtaaatgcggcaaataaaaaagacaatgagacgaggaatttctcaccgaggttcggaaactcgctggtttcctactccctgttgaggcgagcccaactccatcgctcaaccacgaagccaccgcacgcccccttcgtcaaggggtgggcaaggcgggagccggcccacggagaggacaacccaagcctcgatcacttggggtagttcttccttcactccaaagatggtgaactccaaaccactcacaaccggcgccgggcctcctccacaatcttctcggagaggtcaccgagcaacttctccacaagccgtctaggaggcggcaacctccaagagtaacaagcgatgacccggctcggagatgatcaagtgccacactagctctacaatggaagcaatgcacttgactcttggctaaatcaaccttcaaacacactagatggatgaacacaaagctcaagtgggtgtgtgagatgcaaggggtgtatgcaattgaagtggatgccaagagagtccccttgctgctagtgggggagtatttatactcccaccaaccaaaactagtcgttgggggcgaaatcccccaactcagtgtattgtcggtctgaccggaggtatgtggccggtcagaccgtgctaccctacaatcgctagttttatagccgttgtagctctgtcagagggccccatcggcctagccagtcagaccgacgttgagtggccggtcagaccggcctcggctcgatcagaccgccctcagcttggtctgaccgaatacggctccggcgactctgtatcgggcatccaagagcacaccatcccggccaccagggggctagtcagaccgtacaagtgttgcctgttagaccggccattcatgtcggtcagaccgccactaggtggccggtcagaccggcttagtgcacgtggtcagaccggccctggtcaggccgaactcagtgaatagaatgtgtgtgttgtgaaatgtgagcacaagtctaaatgcataatgacctaatgtggcaattaagatcatctctttgctaggtcattacccctcttaatagtatggtgaagctaaaaataaactagcaaatttgattgccctatacctcgatcaatttaatactaaagcactagttttaccatcttcttttcttcgcttcgcgccatcaaattttaatccatcgataatcatccatgcgcacatatgacgtggtactaacacaaaatatataactcaaagagaaacggttagtccacaattagcgcttgtcattaattaccaaaattaacaacgggcgccttagttttttttattttttctatatttaatgctccatacatgtgtccaaagattcgatgtgatgtttttgggaaaaaattgggaactaaacaaggcctatatagacgtatctcttctcttctatactagcaaatatgtccgtgtgttgcaccgggtgaatatcaactaattatgaatggttaagattgcttaggtacttataacacatatgcataaaaatcttgaatttgtacatacctcgcaaatatctccaaattatactgggaaatataaaaacatatttcatattgtatacacattcagattcatgtcgcacatgcgtgagatattccaaattttctacacattcagaacatattccaactttcacaaattttcacaaacgggggcagttatagctctggcttcaccttcctctgcaaaagagaaaaggtaaaggcatccgcaatggtaaagaaacatgcactttgtaatattgaaataaaattcactcaaaaatctttagcggaatatgttcaaattctagaaataatttaatatttaaagaaataataattatcttttcattggtttaatttatctaaaaataatttaccgagtgatcaaataattgatcataatttcccagcaatttaaaatgtaaatagtgccaaacaaatttctgtaaatctaaaactaaaattaaatcagttgcttaaaaaataaattgatttcggcctaaaaggctcaaaccgacatggcactctgtggcatacaagcgtgtgtcatggcggcctagccaggctagaaggcctagcgaacagtgcgggcagcccaatgcaagagagatgatggtcgtctgagattctagccgctccgctgaaattgtggggaaaacctagcccagattcttctcgatcctctttctccctgacgatgagcaagcgagagagaggaaacggcgatggtggcggtgacggcagtccagcgaggtggcacccgcgcggcggggaatccatcgcgcggctccaaccttcggtcgattgccgagggacaaaacccaaatcccattctcttctccctaatccccttctctctggcacgttcgagcaagcgagcagcagcgatggtggtccggtgaggtggcgcgcgcgcagcggggaatccgccatgcggctccaactcttttccggctgggggcgttgcggagaacggcacctagccgtgcctcttcccgtccttcacgcgacaatggcgcgctaggtcagtggggtcatgacggcgggcatgtggcggagctggtgcaactgcgaggaggaggtggcaagcgcgtgtcgaggcacgcgcgggcgaagaaaacgcccatgggacgatgttgtttcccagcgtagggccaactgtgtggctcccaccggtggattaggcctccccgaattgaaaaaaaaagattaatttgattcaaggatttgggggtttacttaggtttttctcaatttggcatttcggggaatttcccccctatggttcgattatgtcggtttcaagctatctatccctcctagatatttttttttattattgagttcgattcagattccatgactaacacagatgtcacacctggagttttcccctttcccgtagttctaattcatcaataaatcgtctatagaaattactttggttaaccagaagaaaaaccttaattaacaatgtatttaataatcggaattgttagggatatttttttttcaaattctctttgctctaaaatcattaacatgacttaacccagaatatttagagtatcggagttaatgttgataatttaatttgtcaagatttgaattaatgataatctttctctcccgcctttagtcgtgaatcgtgcccgattcactcccctcactgtccgctgtttcgttttgcatggcgagccgtgtccgttttcgttcttttcctaaaacggcactgcatttattttccaatttgggaaagtcctaatcctattctccatatccctattttccctccccctctcatcctcccactcggccgccgcctccccctctcccctgcgcgcttctccactcccttgtccgattctctcaccctccttgccggccatggcttccctctggccccacctcttttattccacccctatataagccatcatatccctgttttttttttttcctattttccaatttattggagctctagccctagccgccgcctcctacaccaccgccgctagccaccaccggccgccggtgagcagccctcctctcctggcagtatggtttgtcgtcgtgcgttgtccctagggtttaatctaacctaatccctcgttgtctagtgttgttgttgtctccgccagatcgtcatcgccatctcctcctcgccaatcgtcttggtttggtgaggctcctaatcatgatcccctggtttaggtgtttattcccaggaagtttgcattatcatagccaccatgctcattgaaacagttttcttcacccgctttttgctagcccaccgtacatttgggctaatcgacaacaatgctagtccatcgtacatttctgctaatcgacaacaatccagtatatttctgagataaatatcgatgaacagtatattaaaaaaaaattcctctatttgactaaactgcttttgtgaactgccaatggtgccttagcacatatctgattttactgttttttccaacacaagagaagcaaattgcagtacatacaaccaagtataaaataagatggtctggacaaggtaggaaatcactgatactaaactaacctaggtatacaatgatactgttagaggggttctcccttcaagaaaggcaatattttgctgtcgaatatttggcctactccaagcatcaaaacttcagaacgcaacgaagaaaagaccagcaaatgttgctagtcctcatcagaatcaccaaacgtaatctttgttgatttaggagcatctgctttgatttctttgaaatgagatccatatatttgcgattcctgcaaatgaattgttagcaataaggtaaggtcatttctcagtcatgtcatgcaaagtccttagtgtttatttcttagaacttgcaacgttagggcaaggtgttacagcatttctaaggattaatgtaaaaaagtaagtcgctaagctttctgtagcataaagcatcagcatatataacagtattttcatagattgaaacgatttctcgaggacatattcctagttaactagcacggtagtacctatagacatgaacaaagcactctacgaatgagaatgtaacaagatctatttcacagttaacacaaacctttttcttgacgtgtgtgccaaattttgtaagtgcaggaggaacgacctgaccagcctcccgcaaaacattgacaagttcaccagcaagtccctgtatatagttttgaagtgacaataagtacaacttaagttgtaaggctaaacctaagggctaacgtgtggcacataatctccaataccttgttctcttgagtgaagaaggtatgtgcaacacctttcttgccagcacgaccggtcctcccaatcctgtggacataatcctctgtagtcaaaggatagctatagttaatgacaacttcgacatctggaatatcaagtccacgggatgcgacatcagtggcaatctgcaaaatatacaaaagaaaaaaaaacaagtgttaacagatgagaataaaagtgctacggatgcaatgataaaaaggaaataaattcataaaaacacaatattttcagacaacggttgcagacaactgtacatttctgttacaaaacctcagtagcatattttaagtgagactatcggttaaatgatttcacatactccaaaatttatcatacctcaactcttggctcggtttgatttccaaccgtcaactcaaaaacttgataaaaccagaccctcagctcccaaaaccagctagaactcatttctcttctagtttatgtacttggcatccacgtgggatcctaggtggcacaggactcatttgtcatggtatacatggtttcaagagttgagggatggtatttacttggtttaggagttaagagatgaaaattaaaccgagcaaagaattcagggatgagaaagactttttccttaaattaataacaatgttgcaagcaagtagttgaacacttccaactctcaaagtatcatcgatcaggaaatagtagcagaataccaccaagcccaacaaaatcccttaagggataaataacgaaaccacaactagatttacaagggcaaagtctaaaaactagatttacactaagctcacaaataagcaagagagagtagccattaaaaaaccacaactgaactatcaatgcttataagcagccatgtagaaattagttagaattagcgcaccatcaaaggacatgacccttctttaaataaagataaagctttcgtcctgtcatgctgtgccttatctccatgaacagaaacagcactccaaccccttcacaacaagcatgtgtagattagcgaaagtagagcataagtttcacaaatatttaagtcgcacactggaaacaaatctgctaccttctttgtaacattgtttctactcgcgtagcttctctcttgtacaacacaaaaaccaacaccctgtttctgttgcacaaaacacaggcacaatctgcttagatccatatgaagacaaatggtgattaattagtttgttgaagcagatattagtataatactaacatgtgcagaggttcaattaaaacctaacattgaatatatttgtttgtttggtgttgaaaatgttgttatgttttatataaacttggtcaaaacttaataagtttgacttaggaaaaagttaaagcgtcttataatatgaaacggagggaatacttccttagtttgccaaactgagatagcctacaaatagaattgaacaatcagctttggtatgtgactgaatacaatccaaagtagaaaattttgcaagacgagacgaatgacatgcaatcttatacataattttctaagctgctcagcttaaaatcttttgttatcctcaagagcatccagcatgcatgctgattgcaatgcttttgcctatgattttcgaaagtgagactttcatggagactaatacagcaacaagtaaaatccgtactgcaatacctacctctgtgctttatggtatttatcgagcaaagcaactaatcttgaatcccttgacctgtcatccaatacttcaacaatttgcatcacatcatggttagcagcaagatcttctgatccaataacaacctacaacaaggtggcataccacatacggaaggtcagcattaccgcattagcaatcagatattaacaagagataagaaaagagaaactatacctttattggatttggatccataaactcttgggctagctggtggacagcaggaggccatgtagcactgaacataaccgtctgacgtactgcacaggaagaattatatggccatggttgcagatatattcagaaaagataactaggtgtagtaacacataaaataaatggcagtgtcaaattgacatgaaaaaaatgtacaaatgtattccacctacgcggtatattcatcacaatttcaatatcatggtaagtaaaatatgccaagagttatgaatgccatgaggctaaagtggtttttttagcaacgtgatatagaagtatgaaaatcttgagaacaatatttcttgctcatttctgccgtcactagtggctattaacttatgagcacaagtgtgctgaataaggtattaaaaactatggagcaagagggcacatgcaacagactttgtggataagtccaaccagataaaaagggatgaaaggaaaagaatacatgcgatgcaaaggtggacatgcacatacacatgccctgaaaggaagagagtaatggagacaaaccagatgcagtttggcttaaaattgctctgacttcaggttcaaaacccatatccagcattcgatcagcttcatctagaacctttatcagttaccagacacgtctgtgttagaaaggacacttacacttcaaatgagcaaagcaattaaacagaatgaaaattgaccagcgcaaaataaaaaatccaggtaacatcacaggtgtaacttattgaaccaatatttaccattgactatgaccatcctcacgagtcaagtccagttcaacaaaggggagtaggggacagaggagagagggcatggaagagacaagaggaaataccactcaaatcttaaaatgccgaatctgttagtgctggtaggttccacaaccctgatcttgtggatgaaaatacatatacattggtgtgtcacttgtattgtcttctataaatgactacattatctgcttatgtgtatatgcactgtggccatttaacccaatatgaactatgtacactagaaaccagcatagttcctcagccatattattcttaggtaacagcaaattcaagttataaaaatgatataattcctttcatgttgtgcattattaattttatgaaacaatcattgaccagtcaacccaactactcaaatttgatggaaccaggtgagcctttaatgccaaacttgtggcgttattatcaagggggtaacaccaaaaaaaaaaaaaatcagcgaacaaagcaatcttgacatgagtgttgctacaacaccaccgaaagatcaatcatgcacctgcgtttctctctaagcttgtcccatgttaagaatcttagggtctgtttggttgttgcctaacattgccacaactcaatttgccataggtgtggcatggcaaacaaagtgtggccaacaatttgttaggtgcaatgaagttctccggcctccaatgtaatacaacaaatagattcaacaactgcacaaacatattgtttgttaactcaaagtaacactcaaacatcaatgacaaacttcacaaataaataaaattatatatatatatatatatatatatatatatatatatatagagagagagagagagagagagaggacatatcgatgaaaatgatctaaatgttggaaactcgtgaaaatcatacctaaaagttttgtaaattcatgaaaaaaaattactagagattggtgtagatatgaaatacattctcaccaaatctcaaatccaaactcaacttcatttaagagaaacaaaaaagacaaatttcgggtgaatagtgtcatgttactattcacctgaaatttgtcttttttgttactcctaaacgaagttgagtttgaacttgagatttgatgagaatgtatttcacctgcaccatgaatcacaaccattcaatcattccaagatgcgtgcttcctaaatggacattactttcacaaatgaagagttactataggagaaaagatcaaggaggtacatgatgcatgtgtagctctggcatgggacatgtagttctgggcagagatagaggaagttgaccacacatcatgtagtatttatccttcatttgaatattgtttcttttctcttgttatccatggaatttagcatatataaccatttatttaaatgtttaggtataaacattaacttctttactaactagtccatataagtttgaacttaatttgaatagtttttttgttaaattttgattctaggtatataacatccatccaaacttataattagttaggtatgtaataatggattgtaaaataaagttgaatttgagttgtttgttgctaggtataggtatgaataaaattcttgtacctgggtatatactcagaagttgaaaaaaattcaaaaatttgagtgaatttgtgtattacataccttggtgcccgggcaccatggtgcccccatatgggtgtatactaattcaaaaccatagacaacaacacaatgaaatgcatagttaacttaccacaaaagaaacatcattaagacgacaaatacccatttcaataaggtctttcatacgaccaggtgtccctatgacaatatcctgaaagcatataggcagaaaaaagggggggggtcaggaatatgagtatttccgtgtaactaacttctggataattgatacaaaacaaaatccaaggcagcgagtctgctgaatcttcggaaagtaaacaaaattattcaacaatacatttaaagagaacttttcaaatcaatatagcaaattgaaatgtcatcacaatatgatgaatgtctctagaaattaacattcattggtcatatatcataatccagaactgagatagagtaaaaaaaatattgtgtaagtctcatcttaccactccagatttaagggcagaaatttgtggtcctttggaagttccaccataaaggcacactgaacttatcccacatggtgcaccagcttcacaaagtacatctgcgatctaacatataatacaaaatgaatcattcatgtgtattaaaaagcagtagtttttgcagaccatcagatgcctatcttacaagttcatatcatcagtatatgacacctgctgggccaaacaaactatataatcccatacaaccatagaaaaaggtaaaaaatctgaacatgcaactctttcacttcaatttgttcgatactaaaggtccttatcaattagttcgatactcaacgatcttatcatcagcaaaatataggttgtgagctgagagactacacttataaattagagtaaatttcagaaaacctacgtgttagggtcagagttacaaaaccagggtattgcaacttgtggcacataacctaggtcattaggttctaaggttcaaaaaaaaccaccgccctcaatttaatttccagatgatacaacatattggcagatattataaagtgtctatgaaattgtgtattacgaatttatcaagtaaattgaaaaaaaatactattccaaaaatctcccccttttatatgtgaatcaatttctcctatccccactggaagttgcatacatcccttatacttccctaaaagattgagttcaggggtttacctgctgagcaagctctctcgttggcgatagcacgaggacccgtggcacccccttcttagcagatttctcccccattttcctcctaacgtgcatcagagccggcacaccaaacgcaatcgtcttccctggcatcaacaaattacgacgaacaacaaaccatcagcagcaattcgagcacgatgcagcagtactaaccaattaacaaaaagaaactaactaattagagaattttttcagcaccagatccggtggcggcgatgccgatgaagtcacgaccgtcgaggaggtaaggccaggcgtacgcttggatgggcgacggacgctcgaaccccttgcagcagtcgagcacctggggaggaagcgcggtggcggcgaaggatgacagcggggcgtacttggcgtccgcggagcccttcccggtcacggccacgaccttcccaccgccgttctccgcctcctctccttggcccagatcgcccttggccctcttcttcttgctgct

SEQ ID NO: 44977 - DNA, 15501 bp, Oryza sativa
cgtgcacaaaacaaatagatctggaccatccattttgagggtacaaatagaagcccacaacactgcgggtcaggttccccttaccttttttgagtggttaccaacatatagcaggccaaacgggcggcccggcccagcacgacacggcacgccgacggcacggcccactagggcacggcccgttaggcacggctcctgtagcgggccgtgccgtgccggcccacgtgccaaggccacggcccaagcacggcccaagaaggtgctgggccgtgccgggccggcacggctactgtagtggcacgtgggctagtagccggcccactagtacatgtggcccataaaaattgaaatttgaggggaaaaaaagaaaaaaaggcagaaaaaacataatataaaggaaaaaatgataaatataggataaatgtgaggaaaatttaggaaatatatcataaaatatatggtacaaataggataaaatgtggaaaaaaaataaaaaatatgagaaatatatgggaaaaattagaaaatcgtaggaaaaataaatgggccggtgggccgtgccatgcctgggccgtgccgtgccggcacgctacagtaaacgtgccgtgccgtgccagcccacgggctgaggcatcggcccaaacacggcacgggataacgggccgtgccggcacggcccacaggctggcgtgccgtgccgggcctgggccggctacagtactgccgtgctcgggccggcccggcttgacacggcccatttggccaggtatataccaacaccacacgggaagatggttaccgcgaaaatccgcacaaaatttgttttcaaacatttgaattcaaatttcactctttggccgcggttaccgcggtatatgaatggttaccgcgagatattagctagaagaacaaagtgaagaaaatgcaaaaagaaaatgcaggatgtgtgtagaatttggggataataacaatatatatatatatatacacacacagagagacacttatatggggcaccatggtgcccgggcaccatggtatgaaatacacaaattcatccaaatttttcaaaattttcaaattgtgagtatatacctagttataagtattcgattcatacctatacctagcaacaaaataactcaaatttaactttatttcacagtccaatattacatacctaactaattatatatttggatactatatacctagaatcaaattctaataaaaacatgtttaaattcagtttaaacttgttttgaactagttagtaaagtaattaatgttaatacctaaacatttttgaaaaattcaaactcatttgaattgagtatatactcaatttgaatcatggagcccgggcaccatggagcaccaaacaaatttaatatatatatatatatatatataagatacctgaaaacttgtggttatacaatagaaaaattcagcatgaccttttctatattatggacttgaaatcaattcaacaattcatagcataataattcaacaacaacaatcaacaatctcaaatttgaaagaataaggacattcacatgtaggtgaatgaatagagcccacaataacaatagagtccacaatataatgtccatgattacaattctagtttcaatcaaagaaaataaacagtccacaatataatgtccatgattagtccacaatataatgtccatggtcacaattctagtttcaatcaaagaaaataaacaaggacatactaacatatagcatagttatgcgttccactactaacatagagcatagttatgcgttccactgattatatgccacgttatactcctttgtgaacatgagcatcaagccatgtgagtgtgtcagggttatggataccacatacccaatagtaatcgactaagctcggcggggcccaccatatagcaagtcttatacgggatcgtacctcgtatatagaaatagaattctatatggaaacgagaaggactactcggattgtatccatactggtctccctagttctacttggagaaggggacatctatgggtataaatacaagccccctaagaggagagggggacacgctacaaagccacaagccaatataaaccaatacaccgccagatattgacgttagagattagtctagacaaatccaatccggtgcctgcggaggccggcaagagggatctagcgccatctctgatctcgacgagttcatatttgaggaagactaccctgccgtcgactacgagttgattatccatgtcgccaagtcgacgatagttagataggttatcccaaatattgtactagtgtgattatggtggataaagagcaacatcggcttcggccaataggatgtagtgctattacctatcagataaggggctcgaacctatataagaatccctgtctccatctcttttacctcaatctcgcatataccgaccaacgatccccatactatccaaataccctagtcgtgactatcaaacatcgacagtggtgcgccaggtagggggattttggtgctttaaggtttcgacgagatgggttcaagagatggattctccaacaacaagctacttgacgacttcggctgtggggagatctaacccgaccggagtatacattccattgagatcggaatcatcatcgccaacaattcgatctattgagatcgtccaggcttcaagacctttgtcaccgcggagaatcaacaatattcgctgcatgcggaactgatttgataagagcctatcaaatagtgctccatctttcttcatgaagaattgatgaccaagcccttcgctcggcgacatcagctggtatggctagtgcgcaagcatcagcggactaagtccaggccgaacacgatgccgtctccaaaccgagcatgcgacgcttcacgctgcacggggattcgtccgagtacctgtgcccttgtgttaccgtgtcctagccagagatggtcaatagagagtatttgcctaatcaagtcacatacatatacacacacgtgtgagtgtatgacaggtcggcatgctccacaagaccaacaaataatcaagtcccagtttactgcatacatatgtctcctactgcatacatatgtctcctacagagtgtagtagacaataacaaggtaattagtagattaattaatttaattgacctactaatttcgtagatacatccggcatgtatctacaaaggtatgcaatattttatatacaatttaccgtacctatttttcagatcatacaatattatccatgatttattatgttcacctagagcatgtgttttatacaacacctactgtgcaagtgtgtccgatgttaggctgacgacagtttaatactgggctcgccctattttcttcagtataaatcatgtttgtttacagtttacataatgtctgatatttaatctgctcgttatatcctgataatactagaagattcatgcagtcttttgagtacatgcccgatattctctgctatatatcttgtcttctagaattttttttttcaggaacaattgatcactcgagtaggttgtggtcgagtacacccaattattgagaaggttcttgataaatgctgagttatcatacccaacctaccaacgaagtctgacgatctatctcatgtatagtgacggccacggctagactatttgggaataggttattaacggataattcttcacgaacgttgtcggcctgattactcgacatgattgtgaacagacgtccggatatgctataagttgggtatgtgagtcatgctggccacatgagatgcatatgtaatatccaactctagcgcccctataggtgattaagagatgcctactcctggttatcaaccagacagttgcagcgacatatcgccgcctataaatttaaattcacttgtggaccgttgaactccatctatcgttgtcaaagactccatgtctctacaccgggatcgaccaagtgagtatggcaaatattgataaaggaagtcgcgggtaacaagagaagctttcgcgaatacggtttgtttccgtatgcctatcagttgcctataggtgatcgagatacgcctacacctggtcctcgaccagtagatcgtagcgatctctcaccacctaaaaattcatcttcagatgatcgagatacacctacaccttgtcctcgaccagtagatcgtagcaatctctcaccactgttatagcaatctctggacatctaatgcgacaatcaacattgtcgtgatagcgacaaccaggactgactagatcgccgttgtcaccaggacgacaacgtccaggactaacgacatcaggacgacaaccccggacaaggttaacgacatcacgacatcatacaacaacgatgaaactcgaaatccccatacttctagagggcccgaggatgaggtagtcggtccaggagctgaacctccgactacgataattcctcattgtcttcgtcgtcatcaggaggcagttctcgcaagttgcgaggacgccgtccatctattactctagattccctttaggtggtcgaggtacgactacgactggtcttggaccagcaacgcaacgatcctcacaccacgacttcaagcgatcgaggtacgactatgactagtattctaccagcaacgtagcgatcctcgtaccacgacttctaatggttgaagtacgactacgactggtcttctaccagcaacgtagcgatccttgtaccactacttctaatggtcgaggtacgactacgactggtcttccaccagcagtgtagcgatcctcgtaccacaacttacaaaggtcgagttacgactacgactggtcctcgaccagcagtgtagcgatcctctgtaggatcgagatgtcgactagaggggggtgaataggcgatttaaaattaaatgacacctaatcaaaactaacctaagttgctaggctcggtgagggacaagtctaactaagcaactaagttatgttttgcaatcctagggtgaaagtggctcaagtatatcacaaggaaaataaatcacaattcctaagtctagtttagcaatcctagggtgaatgatctcaagtatgtctctaggtatgtgaattgcacaaatgtaaatgtgacaaataaaagagacaatgagataagagatttttcaccgaggttcggaaactcgccggtttcctactccccgttgaggcgagcccaactccaccgcttaaccacgaagccaccacacgccccctttgtcaaggggtgggcaaggcgggagtcggcccacggagaggactacccaagcctcgatcactcgggatagttcttccttcactccgaaggtggtgaactccaaaccactcacaaccggcgccggccctcctccacaatcttctcggagaggtcaccgggcaactcctccacaagctgtctacgaggcagcaaccttcaagagtaacaagcaatgacgcggctcggagatgatcaagtgccacactagctctacaatgaagcaatgcacttgactcttggctaaatcaaccctcaaacacactagatggatgaacaaaaagctcaagtgggtgtgtgagagatgtaaggggtgtatgcaattgaattgggtgccaagagagtccccttgctgctggtgggagagtatttatactcacacccaccaaaactagccgttagggtgaaatccccgaacttagtgctctgccggtctaaccggaggtatgtggccggtcagaccgtgctactctacaatggctagttttctagccgttgtaggcttgtcattgggcccaattgccctggccggtcagaccgacatggggtggctagtcagaccggcctaggctcggtctaaccgccaccagctcggtctgaccgacttcggctctggcggctctgtatcggccacccagagtgcaaccatctggccaccagggggccagtcagaccgaccataggccgccggtcagatcagccagggacctgcggtcagaccggcatagatcttacggtcagaccggccctggtcgggccgaacacagtgaacttgcaatgatgtgaaatttgagtctaaatgcataattacctaatgtggcaatttaaatcatctctttgctaggtcattacccctcttaatagtacaacaaagctaagaaataaactagcaaatttggtcgccctacaccttgatcaatttaaaataaaagcactagttcaccgtcttcttttcctttcgctttgcgccgtcaattttaatccatcggtagtcatccatgcgcacacataatgtgaacctaacttaaaatatatagctcaatagtgtttgtcattaattaccaaaattaacaatgggggcctagatgcttcatcctcgcaccttaatttcaaacggttgagagactcctactcctggttctcaaaccagtatgtcatagcgatctctcatacctccacttcaagtggtcgagttatgactacaactggccttcgaccagcggcgtagcgattctcccactacttctgcaatttgttgaatacaactatacacctggtctttccccggtgtggtggtcgtctcatcatctacatcaacttctgtaagttttatatgtgcaatatttgtccgttgatcccctcttcttatatcgcctcgtcttgaaggcggtcctattgtccttttacgctttccgacaaagcctccgagaaacctaaggggatttcggctggagacgcccagagcagataaggctttgttagatgctaagagccgaacgaccatgtaaaatctggtcatgtaagagtgctcaatggatgcgtattaactaagccgtgtaatcgggaattggttttcccaacttcacgtctaggggctaggatctgtcaacttcagcatggtttgttataagatttaagttgcttttgtggaaaatggctttcccataaaaacagctgggggctaggaagggtaccaaactccgtttgctgagggcaactctagcgaacgtactcttttattgtgacacacagattcaacttattttcaatttttccatacatattataacatgttaccctttaagcattcgctcgggggctatttctatttaatattatgttctgaataatgatttcaggaaagttccattcagcgttgtcgaggactccatgtctctatggttctacacggggatggactaagcgagtacgacaaatgttccaagtgttgatttcaggaaagtcagacatcagaacaatcaagtcagattttcaaggctttgtcgcagactttgcaccttcttgattgctcgagaacggttgataaagctcgacaaggaatatgtaatgaagcgatggtgtacccgccgagatggaatttcttgacttcaatccaaattctcgattacagcaagacgagagacttagtcacatgctccataccttctcggtcgacatcgggacctagacaaacccaatatagtgcctacagaggccgataaggggaatctagcgctatctctaatctcaccgagaacagtcaaacgagcacgacaatagttgttccaaagtcttcggttgagaacatcaacttgttcatttgcattgaagtagggggctactgtcagggttatggataccacatacccaatagtaatcgactaagctcggcggggcccaccatatagcaagtcttatacgggatcgtacctcgtatatagaaggagttccggataagaaaggacaaatagaattctatatggaaacgacaaggactactcggattgtatccatactggtctccctaattctacttggagaaggggacatctatgggtataaatacaagccccctaggaggagagggggacctgccacaaagccacaagccaatacaaaccaatacactgccagatatcgacattagagattagtctagacaaacccaatccgatgcctgtagaggctgacaagagggatctagcgccatctctgatctcgacgagttcatattcaaggaggaagactaccctgccgtcgactacgagttggttatccatgccaccaagtcgacgacagttagatagggtatcctaaatattgtactggcgtgattatggtgaataaagagcaacatcggcttcggctaacaggatgtagggctattacctgtcatataaggggctcgaatctatataaaaatccctgtctccatctattttacgtcaatctcgcatataccctggtaccaacgatccccatactatccaaataccctagtcgtgactatcaaacgtcgacagagtgtaacaaccccgccttgtattcctccaaactttgacctgtctatgatgatgtaagtgtgactatatactggcaagtgtaaactaaagatgtatgtatactacaagtatatgattgaattattttcttattcttcctccacttagcttaaattatattttagtgagagtatcttagttctttcttctgtgtgtcacctttatcctaccatttggattacttatgccctgcatagaccttgatgtatacaagtaatatatataaattattagcatagttctctcttatcatatcttctcgtgggattaaataaatatgataccttaatacttcagggtgaaatgctacaatggtatatccgtgcacttgcggattatacctgtaaccataaatatatcatgaatatttctacataattggttggaattatatttctagtaatgtcgttaagagataccaacaagcatttctaacgccgttatcggggaagattattttatattcacctctgtatgatcactgtcctttgtaggaaaatcttgtttgttttctcttttatgtgaaaacagggtagtacatgactggttctgatttgccgaccaactccaaagaaaatcctaagtcacttgtgaggcaaatctgaccccgtgtcattcctcctcaagtaactcgtggcaaccagaccagtcatctccgcgccaccagagttgaacgatatggctgggaagaccctacacaagtttgctattccctctgctgacaacgtgcctattggacccccaagtcaacatgggagatggtgactttgatttgaaaaccagcccaatcacaatgacgcaggctagcccgttctatggcaagcctaatgaggatgcaagtgttcatctgcagtaattcctggaaatctgtagcatgtataccatcaaaggagttagccctgatgttatcagactccaactgttcccgttccccctcttcgggagagcaaaacaatggttttacaccaatcgtgcaattgtgaatacccggaagaagcgctcaacggcattcctctcaagattcttcacgatgggcaagatcaacgctcttcgtggaagaatatccagcttccagcagacgagggatgaaaccattcctgaagcttgggaaagactacaagaatatgtcgccatctgtcctcatcatgggatagacgagtggctcatcctgtagagtttctacaacggattaaccccctcgtcccgagatcacctggatgctactgctggaggggcattcttcttaaaagacggtcagagatgccgctgacctgattaagaagatgatctcaaacatgggttggagcaaggaacggctccaaacccatcaacgcggcatgcacaccgtcaagtggacggaaatgctcaccactaagttggatctccttatgaagagagtggacaacaatgagaaggacgccaagcagggtaccgttaaggccctgaactctcacatgacatgtgaggtctgtggcaatgacggtcactttgggatggattgtccggaaacccataaggacgtcatgttcatgagcaacaataacgggtatcgtccacaagaaagccaaggatggagcattgctccatggggtagatcaagtacggaccaaacccacagaacattaaggaggtcaaagtaaaaccccgaaggacggatagcctcatcgatttcatgatggacttcctgagcaagaagaaacgaggaaccgtcagtaccttaggctggcatccaataagccggggacacaggccggtcaacctgtgttcctagttacgaagaagccactgaccataccaaaaataaagatggtgtggcggattaaggagaagacacccgttcccgtacttccagaacaaggtgcctcgtcaagttgaaacattggaggtacagtcgtgctcgtcggatgtcatgtcctgataaattcatcccgaaataaaaatcattgtctaaaaggaataatataattaattaaaattcgaaaagaaattggcaaacattaaaatgcgtacaagaaaaattcgaatgtggtctagaggatttttgttaaattcttcttggtctaaaaggagccctcaaattttacttgaattttcagaaaaccggaaataattattaagcaacaacaacctttatcaaagtttattaaaaagaaaaactaaaaataatcctccttttccctttgggccaagtcttcctctctctctctcggcccgcggtggaagtcctccctttctccctctctttctctccctctccttctctcccttcttctcttgggcctcccctcccactcccggcccactccatcctctcctcctcccacctgggcctgccccggcccaagccgagccgcgctcgcccgcgccctcacgcgtgccgtacgcgcgttgaccgcgcgcctcccgcgtgggtcctgcctgtcaggcgcgtccccgacctctagccgccggcctccttcctctctctcatgtgaaccctagcgccgttcctccctcaaatccgctcgattcaaatggctaattccaaaattgattagggggaattaaaccccattgattcctctctctttccccctaattttccccttgaatagcaccattaatcgcccggaacggccacgccaatcccggccaccttccatgcccgccggccgccattcccgccgccgttccccgctcctcccctggccggctccctcgccgcgcctataaaacggaaccccctcactccgttctctcgttttagccttcttccgcgtctccccgtggccgcaccacctctccccatctcctcctcctctttccccggcgccggccgcctccagccacctgtgccgcctcgcctgtgcaccagcagacgtcgccaccacttccctcggctccgtgacgccgtcctcatctccggcctcacctcctcctcgcccgaagctcgccggagtggtctcctcgtcggcgtccagtacctcccctcctccgggcggctactgttcctcgccggtgagccatcctacgctgccgtctcctccctcggcacggtgacatcgcccttcaccctggccttccctcggtttcaccggaacgctgccgccgcgccggcctctccttcctcctcatcgacgtctcctccggtagccccttccgcagttcccgtgcgccggccaacatcgccgtctcctcctccggcatcacagcggtgtttgttcccggtcgtcgttgtcgttgtcgtcctctcgtcgttcccggttgtagtggcgttcgttcctccgtcaagctgcgtccgttcgtcgcctgcgtttcgtcaagttgctgcagccctgtcgtcgtcttcgtcctcggctctgcgtcgtcaagcattgcgccggccgtgtctcgccttcgtccaaggatcgccgccgaagtcgttccctcgccgttcgcctccatcgtccccgagccatctccgccgcgcccgttcgtcttcgtcgtgccgcgccttttcgcgtggtggtaaggatccctcttctcgctgccccgttctcgtcctttcggtgttgccccgtgcctgtcgtgcggttgtcgaccccggtacccgtgtaccggtgtcggtagtcgttcatgtgtgcgtgtggtgaccgtgttagtgtgcccgctcggtagccgcgtggtttcgacgtgtgcagcccgcgtggtgtctagtggagtccgtttgtcggccactcgcctcggttgacacacggggtccgcttccgtcgacccgtggaccgtctctgtgtgctcggtctaccgtggccctttaggttgacatgtggggtctgcatgtcaacaagcgcagcctttctgtcttttccaggctagcgcttacacatgttttatagttgcaaagcctaattataataatccgcaaatctccatgtaacagcattaaacttcggatgaccatgtcttggtcgtacgaaccccgaatcgacccgttcaagtctcttaatatttgttataatcaaaagaaccctgtgctttctttttatgtattgttattgcttctttataggcttgtagctttgcttgtgtgcttcatgtagcttctgtcattccggaggttctcgaagcgtggttcgcggtcgtcgtcgaaggttcggaaggccgttttctctgagcaaggcaagtcacatcatccttgagcatattgaataccagtttatgaaatttttttggtttaaattattgcattaccactttatttaaattcccgcgttatcactgttttatttagcacttcctattaattctggttatagccttatcattgttattgtttattattaccttgttcaccctaggaaaataaaaccccaactagtgggtactgcattcatggttccactagtgtgaattagggtagatgcttcgctgattaattaggcaacattaggtggttttataactttagactttaggaattctcatgtcacttggacactatggaatggttggcttatggtggaattggacatgcccctctcttcctctttcaaaacccctaaaacctgttttccggtggggtttgggtgtatgccagttgtgggaagtagcaccctggccaatataagaattaagctcgggcctctgttgcaaagtactaccatactaaccacatgtctaatgggcaaggcttaactcggtgctcagtctagtcttgaacaaaaggacacgaatagagatggatgaagtcgttgcaacgatggatatctctgaggcaaatgaaggctacgcgagctgcggctcggtaatcgagatgtctaggcaaatgaaggctacacgggccggtgtccgttagtcgagatgccatggcactggactagtacgcgggtggtctcacccctatgtgtgtggcgcacccggtctagatcctgttgctaggggctcaatcctggcctgcctgtccgggataccggccgtaggcagggttgggtcggtacttttgttcacggttaggatgggtaaagggttatgtcacatgtttacgacgggttccaaggccatggaatgcggagtaaagatgtgtcttgtgggtaaagatgtacacctctgatcagagtaaatctattcaaatagccacgccctcggatatgggcaagcctagcaatgtacccaagttagtggtttaattcttaaaattttcttaacaactaaaatatggaatggtaggcctgggttggcttgggatgagctgggacccaggtcgggttgccaattcggtctgaatcattgtaggcctttggttaaggcaggttcgtgagtgttcacgaccttgattaataatattgtgtagctctaggatcgtatttacaaaatagctttgagcaactaagtgtcttttaaatgctgtttactgtaaaacctaacccctattattatccccttgtacccccttgcattaatcatgcatctcccggtgtggcttgctgagtactgtggttgtactcattcttgctctatcttttcccctccttcagtaagagaagctttggagaagaagtcctaggtggagtcttggcttatgccccagtcgagcgcctgtgaagatggagccgtaggcccgctagtccgctgctgtttatttttgtttgtcaggcctgaagtgcctttgtaataatgtaaatattatcgatataataaagatgtgccttttatatcatgtttgtgtggtgtaccctggcttttcctgggactgggattaatacactagcgttctagaaaaggtatttttccgggcgcgacatcggacctaaaacgacgacgcccttgccttgccaacaggtaaattggtggttatctcatatttaatttccgcattgcattagagcatgtttcccttttcaaaattttttgcattcaaatgatttttgagacaacaaatttaaaataaatttttgagcaataataaaataaaattctcaaccagaattcagtgggtcccactccaactagccgttgaatccacaccacgaaatcctgggccagtaggccccaccaagaggttggctaacccaggaaggtggccgttgggcctgtccttttgtggtgcaacggtttttgtgtcccacatgtcataaatggccgttatggcccctctgtataaagaggatggctggggaagagacattcacaccaatgcaactcattttcaacactccctcccaaattcttttgctctcaagtttgtttagcctatctcaactttcatttgctgcaattagctaaggcattttgcatatacaagttttgctttagttcggtgcaagtttaatcagctggtatttgcttacccccgctcgagtagtcttgtacccttgctctttgttgtagccatgaagaaatgattctcgggcatcttcaagagaggatcgagctcgaggacgaaccgacacgatgaaccaagtacaccttcctccgcggatgcatccatgattgatttcgtgtatgttgcgagtaggcaacggctcggtttatttatatggagatatcaggatgcttgcaagatgtatggattgatttcgtgtatgttacgagtaggcggcggcttggtttatttatatgaagatatcaggacgcttgcacgatgtagggagatatcaggcgtaagggtgcaaggggtgaggatgtatggatatattaggtgcaaggtgcgcatgtcgtgagcgcaagtgtgttcctcctgttgtctccaccacacatgacttaagtggttaggagagcaccattcccttttctataataggcaatatggtactaaacatctccatgcatgcgtgacatcccacgaggtgagttttttgtaatttttcaaagaattaatcttcaaaagagctaaaaccaatctattaattccaataattatgtaatcatcccataattattttcgctatcaataagcggtgtctcagtatctttaaagttgaactaccaaatttcatgcatttagcagagccgtaggtgacggcgcatttcttgcatgcaccctggccggttgttcagccactgtcatgctatcgtgcttcgaggtcggtaatggtcaggcgcccactatggccgcaggtggttgtctgctgcacgccggacgacggctgctggcgatcgtctcatcggtgtgcaca

SEQ ID NO: 44978 - DNA, 15855 bp, Oryza sativa
tccagctcgctggcggtgcactcgccacgcacggcggggtccaggagctcgaggttcctgccgtcttcccatagcctccatgtctgaaagaaaaaaaaaagaatatattttctatctattatctatctatctattatatactaaaaatacattaattaaacttcctataaaccctctcaaatcatcacgtaggactcctatgaactctcctaagtcaacatgtggcactgtaataaattaaaataatcatataacttaaactggtgggccaattcgatttatctcaacaaaaaagctatccttcctctcctgccgtacgtatgcatatattactcagtgtgttgtctcgtctcatttcccctagatcccttctccctgtttcttcccttttcgctgtatggtagttaagataacattccgtttttacttaattttactcatatctatttttagtttgtttgaactgttatttcattattagacatgtaaataatttaaggtcaagattaccaatattttactataaaaacttaaaatacgttatttgaactgccacctattctttacatgacaaccaaataatatccgatttttaatttgtttgaattgttttctatttataaatacgtgagtatatccggatttatattactcatattttactatgtaaaatttaaaatatgtaatttcaacatagaccaacaaccaaacaacagtgaaacgctacaaaaattgacatgtatatgccatcatgaatcattctacataataaaaattagaaaatacaaagtcgccatgtgtcaccttttagagccctccacgtgtcacattttaaaaattagaaaaatcttataaaatccaaagaaaaacaaaacatctagccaatggttttcacttagatcgatgacctattgatattattttcaaccatcaaatatacttttagaaaaatcttaatccgcgacatgtcacatattttaataaaaatcttacaaatcctagggaaaaaacttctaataattggctttcaattaaaccacttagagaaactaaaaaaaatgccccctccatatcgccctccatgcatccatcactatatacccactccatcttctcctctctagctcgagctctatgctcttctttcctataaatagaaacaatctataattataagctacacgtctggtttataatcacataaacgatataaaattcatatgcctatattttgttatataacaaatagtacgacatttcgacacaattgacctattacttataagtatatcaaacgtagcctacgatgcatgcccgctcattctggccagctaccttcttagttttatcaaaagtttaactttgtttgggacgtgcatcgaaatgtctgaaactcttaatttcggaaatcgagttccgacagttcaggaattttaaaaactcagttctgaaaatgtaaactgtaaaccctgcacacaactctctcatgctttgttcaactaatcctgaagagggagaaattggaggggattgagggggaataattccacactacaataggtgtgcaataaatccaaatccccctcaatccacttatatatgaaagggattagttgaacaaggcctcacggaaattaattctagctaatatatactacctccgttttatattataagactttctagcattactcacattcatatatatgctaatgaatctagacatatatatgtgtctaaattcattaacatctatatgaatgtgagaaatgctaaaaagtcttatatatatatgaatgtgagcaatgctagaaagtcttataatatgaaacggaggaagtattttctattcaacgtatgcccccaaatgcatgcaggagagatgtgctgcttacatgtgctataaggctcgaagttccttggttgtgcttgccactgatgatctccagtagtagaacgccgaaactatacacgtcttgcatgaatgacaacttaccatccattgcatactctggtgacatgtatccactacaattggaggataagatcggtcaataaataatctgatgaaggtttggaagatatttagagctttttcagatattgagatctgaaaatccagccactacatctatcagatgtacacacaaccaaaaagaaatttcgagctaaaacacatggttatttttatccgtaattaattgtctatatagttgcattgcttacggtgttccaacaaccctgtcagtgatcgtgcagtcctgattgccaccattgtggctgaaaagccttgcaatcccaaaatccgatatcttagccaccaccttaagatctcggtggatgatggtgtgccttgagtccttgtgaaggtattgcagcccactagcaatatctaagattatgtccattctcattttccagctcaacatagcacgcccactctcatctgtttgcaaattccgaggtcagacaattccttttcttttcgataatggaaatctatctagcctctacattaactcacaatttcttaatctacaactatttaagcatatgcatatatattgtgctctttttttcattgccttaagttttgggtgatgttaattattgaattgacaaaatgcaatcgtagcactaatgaaatggtgaatggttttaaaagcaacatacgaaagataaaggcgtctaggctcttgttgctcatatattcgtagacgagcagtctctcggaacagtggatgcagtagccgagaagatggacgaggttgcggtgttgcagcttacagataatgtcaacctcattcatgaactctttcagtctttgaaccgtgttctcctttgagagcttcttcacagcaatttcctgaccgtttggcagttggccctgataaactcaatcagaaattcgtcagtgagttcaaagctgttctttttattagttagttttcataaaacggatttggcaggttcagaatagaaatagctaattttacggctcctttgaaatgcagaagttttacaggattttagggtaatttatctagttccgatgaaatcctaattaaaaaaaaatcctaaagagccttatcaagcacacatacgtgtagaaaatcctaatacaagtgccaatacttttgaactgtagtttgtacgacaatatacttatttgtttttcgcacttttggcattgatgcatgtttcattaaagatttgtagagcattatgaccttgtaaacaatgccaaatccacctcgcccaatttcgttctcctgagagaatccattcgtagctgctctaataatctcgaaaggataagtaggacatccggtgatgaagtcacctgtctcatcaagcaccctgactgcaaaatggagaagccatatgagcaatatggagtataagagagcagtcaggatttggatcctaaaacgttttgtctgttagatactgagaaattaagtataattacaaggatcagttaccttttttgcagcgccgtgcctttctccacataagaaatccaagcgactgtatagccaagacgaaccctgtaatcaccagtgcaatgactaccacaaagttggtgtttttaatcgcgtctgaacatttgagtgcagctttattgagggttaaattgaccaaatatttcatatttcaatcagtagacagaaaatcatcacggcatttgtaggaataatcagcaattaccacttttaggctaaatccacgtaatattgatgtaaatactgctagtgcttccttcgatcaattatatatttgatttcgggagtaccacaaactaatactcccgcgtcaaatgtaattaaccggaaaaaaagacaatagaatggctgagtccaatatatatactatattcctaagcttgacctggcctggttgtcactttaggctattgaaaaggacttgtcagtggctgaacacaagtcatgcatgcatgcatggacaagtctataattcccgatttcaacggaaagttcaaacttatcagtatcaaactcaggcctaaggctgtgtttagatccaggggtgtaaagttttggcgtgtcacatcggatatacggatatatatttgaagtattaagcgtagtctactaacaaaacaaattacagaatccgcatgtaaaccacgagacgaatttattaagcctaattaatttgtcattagcaaatgtttactatagcaccacattatcaaatcatggcgcgattagacttaaaagattcgtctcgcaatttacacgcaatctgtgtaattagttattttttttgtttatatttaatactccatgcatatgttcaaacattcgatggtagggtgtaaaattttgccagggatcgatctaataaacaggccctcagtattttagcttcatggaatttccaaattctctctatcaggacttggaagttgccatcagggcaaattctatatcaggaaaagatcttgcctccaattatttgacctccaaaatatattattagtttttttcccacttgtttgtttttaagatagtattctcaattatttatgtacagtccaactcacggttaaactgacgtagttgacttcagcctcacatgtaccaccgcatatccatgattcgatattactccattaaacaaaaagatcacaaaactaacatgccattttcatctagtactaactgtactaagagttcactttacaacctgaactttcgtgaaagtttgaaacttaaaattatactgtaaaaccagatattaattataaacatttaatgccgtctacttgccaattaagttgccaaccttggcccgaatattatctatttgtaaaaaaagtaaatgcttaaaaacaattaataatgtataaataaggttaatgtagataaaaactacttcaaaatgtagataaaaaccattttttgtgcatggaatagatttagttttgccacactaagtttatttaggttttaaaattcaaatgcacttatgctttccaactgagattttttttcaacaattgtttgaagtactttgaatattttacaatttcaaacgcatgcaatttcacatgtatttcaattctacaaaattaatccctggactatattaaaactaaccccaatatcgataaggttttattcagatataagaacattttttccctgccaagtatagcatattttatggtaggaaatttattcaagttgtaaatgttggttggaaagattatacttttgtaaaataattctttgaattcaatactgtttttatttaaaaatttgttctcaaacttacaatgcattgccacgtcatccactacaagcgcatggtaaagtttagggttagatagtgtgtgattataaagttcaaatatgcttccgaaaattgtaaaaggattttccgttgccagctcgtacattagcattttgtttttattatggtctaatcatgagcttgacttgtgttagaataaatgggctaggcccgatttttctattaaatctcaaaggcccataataaatgttaaagataataataccaccctgggaattaaacgaggagtatctcaacttcaatagggagttattggaggctccctgttgaccggttgaggtggggattggaaagccacacgctcgctggggcgggcgttgcgcctgcttctatccttttgcaacggatcagaatccaaccccgagattgcctccgtaacttgcaatggatcagaatccaaccccgagattgcctctataacttgcaacggatcagaatccaaccctgagattgcctccgtaacgggcaggcgattcaatacccattgatcgcgtcgttactgcggcaacgggcggatctctctcctgcgccataaggaaagggggaacccgatcagatccgctcggttactttccaaacaatgtccgctcggttactttccaaacactggtgttcttcctcctccgcacgccgccgctgggtattgatcgcgtcattactgcggcaacgggcggatctctctcctgcgatataaggaaagggggaacccgatcagatccgctcggttactttccaaacactggtgttcttcctcctccgcgcgccgccgctgggtattgatcgcgtcgttactgcggcaacgggcggatctctctcctgcgccataaggaaagggggaacccaatcagatccgctcggttactttccaaacactggtgttcttcctcctccacgcgccgccgctgcctgtggtgcttctgtctgcttccccggttctgatcgcttgcacgcacgaaagatcggaacgagcagggcctccggaaccacaccttcgcctgagatctgcactgggtaggcgggtgatcaggtttttggggagtgctttcgcactactgctcctcgtcttcagttcgtcgtcgaccgtacgtctgcatcaccatatctgccgcacctgcacctggagctggagcaccaggagctagtgcacagaactacaacaccaacggaggcagttctgcctcacaatccagcagagggactttcacagggtataatcctctactgttattttagtttttgatatttctgttagtcgcagtacaattgcgttctatgtatgatgatgatgcttattctaccttaagcatgctcctgtttatgtttgattttatcactagatcacctcacattgttcatgccatgattattgtcttaatattttggattaaaatatgccgatatatgactatatttccaacaatccaaaaacctgataggtcattttcggtagttggctttgctgctgcactgaaaccacatgcttttgattgttctaattataaaaggtggaaagcacgtgcactactgtggttgacagcaatgcaatatttctatgtttcacggggcaaatgaagtgaaccacctctctctcctgaggaagaggttaagttcgaggcttcggattgcctgttccgtggagcattgatcagtgtactcgctgacaatatagtggacgtgtatatgcacatgctttcagggaaggacatgtgggatgcacttgaggccaagttcggagttctcgacgccggcagcgagctgtatgtcatggagcagttctgtgactacaagatggtcgatgaccattctgtagtagaacaagctcatgagatttagatgctggctaaggaacttgagaacaacaactgtgagttgccggacaagtttgtggcgggtggcattattgccaaattgccaccttcttggttggactttgccacttctctaaagcacaagagacaagagttcagtgtttctgatctcattggctctttgggtgttgaagagaaggcgaggataaaggacaaccggagcaaaaaggttgagggaggttctagtgccaatatggtacaaaagaagaaccctcatgcatcccacaacaacaagaaagtcaagcctgatgtcaaacccaaggctacaaccaattttaagaagaaaggcaagggaaaggcaaagggtgactactttgtgtgtggcaagtctgggcattgggccaaggactgtcctgagcgcaaagacaggaagtctaccaacatggtcattagcgaggagggcggaggaacatcggggtacggtaaattattacctacagttctctctgtttttcattcacctgattggtgggttgatactggtgctaatattcatgtatgtgctgatatttccctgtttttttcttatcaggtcgggagaggttccttcttgttgatgggaaacgggtcacttgcggctgttcatggtgttggtacggtcgatctgaagtttacttcgggaaaggccgtgcagctgaagaatgtgcagcatgtcccttcaataaagaagaatctagttagcggctctctactgtgtagagaaggttttagacttgtgtttgaatccaataaatgtgtcgtatctaaatatggaacttttattagaaaaggttatgacaacggaggcttgttctgcttttctttggatgacatgtgtaataataataatgttgtgaaccatattagcgagaatgatgagtccaatgtgtggcattcgcgactctgtcatgtaaatttcggttgtatgatgcgcttggctaatatgagtttaattcaaaaattcactttggtcaaaggttccaagtgccatacttgtgttcaatcgaaacaacctcacaaacctcacaaggcatctgaggcaagggatttggcacctctagaacttgttcattccgatttgtgcgaaatgaacggcatgttgactaaagggggaaagaaatatttcatgacactgatagatgattgcactagattttgttatgtttatctattgaaaacaaaggatgaagcattgcattactttaagacctataaagctgaggtagaaaaccaacttgaaaggaaaatcaaacggttgaggtctaatagaggtggggagtatttctccaatgagtttacatccttttgcgaagagtttggaattattcatgagaggacgcctccctattcaccccaatcaaatggggtagccaaaagaaataactgtactctaactgagatggtgaatgccatgttagacactgcgggacatttcaaggaatggtggggtgaggcagttttgattgcgtgtcatgtcctgaataaaattccaatgaagcataaggaagtaataccattcgaggaatgggaaaggaagaaattaaatctctcatacctatgaacatggggctgtttggccaaggtaaatgtacctatagccaaaaagcataaacttggaccgaatactgttgattgtgtgttccttggttatgctattcacagcgtgggttatagattcttaatagtaaactctggagtacccgacatgcgtgttggtacaattattgagtccagagatgctacattctttgagaatgaatttcccatgaaaaatacacctagcacttctagtcaagaaactgtcataccccatgagcactttgcaccgatagaacacaatgatcaaacgcttgagggaaatcctgaggaggataagattgtagatactcgtaagagtaagagacaaagggttgcaaaatcctttggagatgactacattgtataccttgtggatgacactccaagaaccatagaagaggcatattcatctcctgacgctgactactggaaggaagcagtacgcagtgagatggactcgattatgtccaatggtacttgggaagtctttgagcgtccatatgggtgcaagcctgtaggatgcaaatgggttttcaagaaaaagcttaggcctgatggtacaattgaaaagtacaaggcaaggcttgtggccaagggttatacccaaaaagaaggcgaggattttttcgacacctactcactagttgcccgtttgaccacgattcgagtactacttgctctggcagcctctcatggtcttctcgtccatcagatggacgttaagatagctttcctaaacggagagctagaggaggagatctatatggatcaaccagatgggtatgtactagaaggtcaggagggaatggtgtgtaaactgttgaaatccttgtatggccttaagcaagcacctaagcaaaggcatgagaagtttgacaccacacttacatttgcaggctttgttgtgaacgaagctgacaaatgtgtgtactatcgctatggtgggggagaaggagtgatcttgtgcttatatgtcgatgacatattgatctttgggaccagcctcaatgtgattgaggaggtcaaggactttctgtccaagagttttgaaatgaaggatttgggagaggctgatgttattcttaacattaagctactgagaggagatgagggtgggattacacttgtgcaatcccactatgtggacaaggttttgagtcgctttggatatagtgactgcaagctagcttctactccttatgatcctagcgtgctattaaggaaaaactgaagaatagcaatcgatcaactgagatactcccaaatcattggttcattgatgtacttggctagtgcaacgaggcctgacatctcatttgctttaagcaagctgagccagtttgtctcaaatccgggagatgatcattggcaggctctaaaaagagtaatgcgctatctaaagggcactgagctatgggcactgagctatggaattcactataccgggtacccaaaagtactagaagggtatagtgactcaaactggatatctgatgctaatgagataaaagccacaagtggatatgtgttcacacttggaggtggcgctgtttcctggaagtcttgcaagaagaccatcttaacgaggtcaacaatggaagcagaacttacagcactagatactgcgacagttgaggccgaatggcttcgtgaactcctgatggatttgccggtggttgaaaaaccagtgccagctatcctaataaactgtgacaatcaaacagtgattattaaagtgaacagttcaaaggataacatgaagtcatctaggcatatcaaaagaagactgaaatctgtcagaaagcagaaaaactccggagtgatagcattggactatgtccaaacggctaaaaatctggcagatcagtttactaaggggctaccacgtaatgtgatagacagtgcatcgagggaaatgggcttgatacccacctaaggttgcacaatagtggaaacctgtccattgtgatcggagatccgtgaatttggatggcgaaacaaactattgtgtggttgagagaagagacccttgaaaagggctcattttcatgatgtacttctcttctactctgcatggtaggatggcttattccttaatgtgatccgagtggcttttctaagcaaagatgttgacctgcagaacatctcagaaggaacacacctatatgagttcgactgctagtcacagtctatgagatttgggtgatctctagatactcatgaaagggcctggagtttgacttatatgctccaaacagaggggatgcaaactgcagcccaataccaatcaagctgatattgataattcaagttgccccctacgtaattatgaaggttcggctggatgttacatactaagtgctcaggaatgacttgaggcattactgtgccatccggccgtacgtggtgaaccaagtgttctagaacaacttgatataaaaattgttgtataggctgaccgccaggcgttgcaaacccggccgatgcacttattgaaccttggtgctgaatcagctgaacgacttgctgtcttaacggcgtctgccgaatcggctgcagaggctgctgccttggtggtgtttgctgagctggttgcatgacctgttgctgaatcggttgtacaacctgttgaattgggggtgtctgctgacttggctgctgctgtattggatcaacaataggttgaggtggtagaaacatggcagcaaccggatcttgggtcagccgattcgcaacctgcctactatgctgtggctgctctctcgtcaagaaccgaggattcaccggctagcctggcgtcatcgctgacaacgcaggtaggggagttgatgctggcgccgtcggctgagctgttggtgtaactgagggaaccgcctgaatggatggctgaacatcggtgatcaaggaccgataatttggaaagacacctcctttcaaataaactgggcctgcagcctgatgctcagctactgaaccatcggctattgacttcatcatgtttgataaggtattgactaacaccccagactgattgatcagagcatgatgtacggcgtagtcaacccggtcttggaaattgttgaaacaatcttgtgccacatcactattccgattaagatctcctccctataatccttgagcaccatcaccttgatttccgagagatccgtcggtagcaccattgtcactcggttgagctgagccatctggagcttgcttcccatctccatccttagaagaatcagttccagaatcatcagcaaccacttttaatttgtacttctgaacaaatgttcccttgcgagtctgtgatgtgaccatggctaccacggatgcaaccattgctcacatcatggatgaacaagaagatatcaagatcaagtcctccaagtgctggaatccgattcggccacctactacactgctgacttcaaacggctgccgaatctgcatacgacctccgttttcggcccgtgagtacttgatggaaagctcttggagtcctttttccaatggatccagcctcattgcgaaattccatcttattgagccgcaattgaagcaacaaggtgctgcgtcacctataatgggcctatgggcttgtaacttcgtctgggaccccggcccaggtggggcccatgtggggtgcgccccagccaggtggagcacgaccctaggcacccctaggtcgtcctcccacccctatttatatagctaggtaccccttcagggtttctgggggttttgtttagatgaaagtttagccattgctacttccttgcagcgcgcgtgtcggctagaccgtccgtctgcttgtatttgaaaccccaacttatcttgtgtattcattcctatttgcaattcagattgcttttatcttgttcttgcttgtttcttcgatttgcttgcaggaataaggttgatctgcatcggcaagatcaacaacccatggagaggtgtatcgatcgctaaggcgcaacacaacgtctcgtacggctgtagtcggatcatcaacgtttcttccaaatcgtagttatcgcaactcaccgaaagatcgggccaataacagccttgagtgtcgagaggaactcagggttcatcaggtggtatcagagctttcgttgctcggtgagtttttatcttcctataaccagaaaatagccatacaaaaaaaattcgtatcatttacctagccatattgtgccattgcattgttcttttcagtttttgctttgttgaattttgtgttgcatcgtcacgtcgtgttgctggtcttagcgtctagttcgtttagagtttcgagttctggtcacgttttgtaccacagtcgtcgctgccaccgtgtctctgttgttgtcgggacctacgaaaacggaatcggctcgctgccacggttctatttttgtagttttcagaagtttctgtcggttagttttggagttcttgagttgcatctagagtttgccgatccttgtgtgtgtttgttttggccgtgcctgtgtcgtgcacgagaggaggaaggtgaattaccatatctgattttggaagtagtcaagtttgttttggaaagatatagtagattggattggttaaaaatcagtttcctttttatcccatacaccaaattcggctgccatccactccacctcctggccgagtcccactcgcccctttggccgagtccgactccctccctctcttccacggttccgagttgtgtcaaacaccttggcgaatttttgtttggtgtcggtttcgagatctttttggaaaaacggaaccggcataaattcagcattccatttttgtataattttaattttggtgtggacttttacatttgagtccctgtatttttcatatttacatttgagtccctgtgatcttacattgaggtccttgagtctgtttttggtaaaaaataatcaaaaagtgagaaaaaaaggcagaaaggtgcaaaaaaaaagaaaagaaaaaaaaccgcaccaaaaaaaatagaaaagaaaaggaaagaaaaaaaaagaaaagaagaaagaagaaagaaagaaaagagaaaatactgttatgtttgagctgaacttcatatatcagagttgtgcatgagttgttcctagtgctatcttgtggtatcgtttgtgtctaggctcgcgtctctagtacgttctagcctaggaccagcacggtacttgactttgaacaattattcaactttgcattatctgatttgagcatttgctattcctttgctacatatttaagcctacccagagctccacatatttgattacagccgtaccgcaagtgtttgccaaggcatcgatacatccaaccttcattggggtgcttggttgagtcggtgtatgtcaccattccacttgcattggtaagatcttgtaagagcttggttaaaagcttgagtgtgtgcgatttttgagctgccactacctagtagttaataggaacgcgcatatttttgtgtatgtttcttgttttctactaacaatggcagggatacgcaagataattggggatagctgtgctcaacatcgacatcttcgtcgagacatgaggagggatcaacatgaccattatgaggtaagtgatgatgttctaggtaagatcaaatctgcactgccttatttcgagggaaactatgatcctcgtgcttacattaattgggagctagcggttgatagtgaatttcaaaagcatgtcttgtcggagaaacaaaaggttatgtgtgcctctagtgttttaattaaacatgcttctaatgattggaaacatctttgtaggcataacaaaataccacaatcttggaaagacctgaaacgatatttcagagatgtttatgttcccatgtattatgctgacattttgttcaacaaactgcaatgtttaaaacaagataccagaactgttacttcatactatcatgatatgcaagcttgtttattacgttgtggtttagatgaatgcgaagaagctaaagaattgaggtttttatttgggcttaacaaaaaaattcaggacatgcttgattgtcaaagatatacatctctttctcatttgttacagcttgcttgcaatgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggtacatccattatctgaagagggcatcaaaggtaaacttaatggtgctgaaattaataaaggtgagtgtgttgttaatgaattgaattcgtccactttttatgctatagcagagcaaccattagtggaaccaactgctggaattcctttgtcacaagttgatttactcgctgttccttgtgataaagaagagttgtgtgataatgcttcacttatatccatgccacaactagtgaatgaacatgctatttctagtgtttctttatgtgctgattttaagcatgttgttcatattgctaatgaagtacaggaacgtgaattgctatcttctttaaatactttgggctatgttcagtttgatgatttttgtgagctcgataatttgaagaagaaattatttgctaagtctgatttgccttgtccaactagtgctatttttcatatatttggcgaatctgataatagaggaatatatttggtgcatagagtttacatatgttcagatttagaacctcctatacatgtggataaaacatgcaagctagagcgaaatgttattgctaaccaaattgtctcgagtttgccttattttgactggaagaaacaggttgttgtaaatggactacgcaaagagcaccatatggaaaaaccgaggacggttttctgtgaagaaggggaggatgatgtgacgatggctaccacggatgcaaccattgctcacatcatggatgaacaagaagatatcaagatcaagtcctccaagtgctggaatccgattcggccacctactacactgctgacttcaaacggctgccgaatctgcatacgacctccgttttcggcccgtg

SEQ ID NO: 44979 - DNA, 35384 bp, Oryza sativa
cggatcgtcaacgtttctcccaaatcgtagttatcgcaactcaccgaaagatcgggccaataacagccttgagtgtcgagaggaactcaaggttcatcagtctgcataaacgaattcaggaactgatctcgtgcttgctgcatcattgcctcaaaatctttcttttgctcaggagtgaacttttctagatcaataagcacgacgtttgcctcatggacgtcggtcaatcctaacttctggatcttttctttgacagtgcccgggctagccgaggatggtgactgtggtggtttctcagccatgaggaagaattgcttgctgacttcttacttgtcctaccgggcgtgccaaaagcgtgttgatagaaaacacgaggcctaggagatctgcttaactccagtgcaggtccaaagctcgccttcaaatgtatgagcgtgccagttgatttgatcctgcaataaacaagagatagaaacaaaggaaccgcaattaaatctataaatgatagccgattggctagatgccgatgtcatatcatttatctttgagccgatgtcgtatgtgaatcgatcggcggttgtaaataaacaataaagaactagatctattcgatcagctgtagatattaacgatatatagttcttatatcgatatatttggacagtatggggatcgtcggtgctaggatatacgcgagactgaggtaaaagagatggagatagggatttttatacaggttcgggcccctgagttgtcaggtaataaccctacatcctgttggccgaagccggtattgctcttattcaccataatcacaccagtacaatatgtgggtagcctatctgactattgtcgacatgtcggtctgaaggtctgactcgtagtcgacaacatggtagtcttcctcctcgaatccgtgcctggcgagatcagagatagtgctttcgtatctcctgacggtatccagatacaccgtaggggaataactatgcctatccctgaagtcgatatccggcggcgtgtcttggcttacgtagggttgtatgttgtggcttctagtgggcgtgtgttgattgtcatgggtgtcttccatggtccttctaggggggcttgtatttatacccataggtgtccccttgtccaagtagaactagggaaaccaatatggatacaatccgagtagtccttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacagtagcccacgacttcgatggaaatgaacgagttcatattctccaccgcagactttggaagaactgttatcgagctcacgtgaccgttctcggtgagtttatgatgaggacatcaacaccatcgatacatccacgtcccccatgtacagcatgatggtcctattacccgcgctcgtgcacgtcaactaaattatcagatgagttctttcttgagttcatattcctcgtctttataccccggagacgcgtgcactcgtgttttactcaggaacgatggagaggatccaaagggaagaggattcgcgcggggtggattcggactgcagggcagcgccaaattttgacggccgccacgacttcatgcgaactccgatttgggcgtgcaagtacttcatggaacgcttataaagtctactttcaaatggatccagccacatgtccatatctgttctggagcggccgcaattgtcattttactcccgactattttctgtccatggtgctgcgtcacctcttttggcccaatgggctgtgtatccaagttgggcccattaggggagcgtcctagggttggagcacgaccctatggtcgttcttcccctcttcttatacctctagtcgccgccaagaacaggcgggttttgatgatagagatagcttcttgctaccggctcgcagcgcgcgtgttggctaaaccgcccgtttgcctgtaatcggaaccccaccatattgtgtttgatagtgaaactttcatctttatctagcaatttcagtgcttgtcctacttgttcttgcttgttcttcgattgcttgcaggacgagtgccctcgtggccgggttgacgcgcaccacaagttcgcggcgaccattggagacggtgtatcggttgctaaggcgcagcgtctttggacagttgtagtcgggctgtgaacgtcgtcttcatctaatcgagttatcccttacctatcatcgaaagatcgggccacaaaccctagtgggttcgcatcagtttagagataacgttagacttcctttatcagcctcgtgcgggcaccgaaagggtttgtctaagtcaatctctgatgtcgaccgagaatgtacggagcgtacgactaagtctcccgtcttgctgtaatcgagaatttggattaaagtcaagaaattttatctcggcgggtacaccatctcttcattccgtattccttgtcgagatccagcaaccgttctcgagcgatcgagaaggcgtagagtctgcgacggagtcttgtcgacatttgtcgtactcgccttagtcgatcttggtgtagaaccatagagacatggagccttcatcaatgtcgaatagaattttcctgaaatcaatactcaaaaaagaatatcaaatagaaagagcccccgagcgaatgctcaaagggtgacatgttataatatgtatagtaaattgaaaatgaattaaatttaccgaccaatgttttgtgtatgagcgtcttctctcttaccgacttcgatcagtcagtttgtagagtcatacattctccctagcccccagccttatcgtcggagaatcgttctcagaggataaggctcttggatccttgaccttccttggttgaataagcactgatcctagcccccagccgtgaagttggaaaagtcaatttccgattacacggcttggttaatacgcacggtgagaaattttacccgaccagatcttacatggtcttttgtctctacaggatccgacaaggccttatcggctctgggcgtccccagccgaagatcccttaggttcctcggaggccttgtcaagacggcgtaaagggatagtaggataggtttcaacgctaggtgtcgtcgtggtaagggatctctgggtaaaacacttggcgatattgtgtacctgctatcaactttgttgaagtagaggcagtagtcgtaactcaaccactagaagcaaatgtacgagagatcactacgatcaactggttgagaaccggtgagtaggtatctctcgatcatttggagtcgtggtacgaggaccgctacgctgccggtcgaagaccagtcgtagctgttcctcaaccatctaaagtcgtggtgcgaggaccgctatgctgccgtagtcgtacctcgaccatctgaagttaaggtgcgagagattgctgcgtactggtgcgagaaccaatgagcgagcggatttatctctcgaacaccaatggaagttgcggtgcaagagattgctacgtactggtgcgagaaccagtgtgcaagcagaattatctctcgaacaccaatggaagttgcggtgcaagagattgctacgtactggtgcgagaaccagtgtgcgagcggaattatctctcgaacaccaatggaagttgcgatgcgagagattgctaggtactagtgcgagaaccagtgagcgagcagaattatctctcgaacaccaatggaagttgtggtgcgagagattgctacgtactattgcgagaaccaatgagcgagcagaattatctctcgaacaccaatggaagtgctagagttggtttattgcaagtgtatctcatgtagccagcatgactcacgtacccaacttatagcatatccggatgtccgttcgcaatcatgtcgggtgatcaagccgacgacgttcgcgaggaattatccgttaacaaccttttctcgagtagtccagctatggccggtgctatgaggtaggtcgtcggtcttcgttggtaggttgggtgcgataactccgcatttgtcgagaatgttctcgataatgttgtgtactcgaccacaacctactcaagtgctcaattgttcctaaaaaatattttctagaaggcaagacatatagcagagaatatcgagtatgtactcaaaaaactacatggatcttctagtattatcaggatacaacaagcagatgtaaatatcaagtattatgtaaactgtaaacaagcatgatttatacagaagaaaacagagcgagcccccagcgttagaccgtagttggcctaacatcggaagcactcgcgcaatatatattgtataaaaaacatgctttaggtaaacgtaataaattatagatctgacaatgctgtatggtctgaataggtacgataaattgcatataaaatattgcgtacctgtatagatacatgccggatgtatctacgaatttagtagatcaattaagaaattaatcttactacaataccttagaatttgtaatgtggcctgatgggcaggtgcactgttgggttattgttggggccacatgtacatattcccgtatatatactgatttgcttttgtcttttgtcatcgggatgagcagccaggttgtcgacttggaattgaattccagtgtccgactacggtacaggccaatgaacagatcaatgcggcgctcaactccaggtcctcagagatttgtcggcagatgatgaacacacgagcaggcctgccctcttgggaatcacgcgctgcaagtagtcgtgcgtagtggatgccgatcctgatttgatccggttagaattctggcaacagatgtcaatttcggagatggtcgattggggatgaaatctcgcgatcgacgatcttgtattgatgtcttccgtcgcggcgatgtcttgatagatcgagttactggtgacgaattccgatcttgtcggaagacatgctccgatcgggttagatcttcacagttgaagtcgttgagtagcttgttgttggagaatccatctattgaacccatctcgtcgaaatcctagagcaccaaaatccccctacctggtgcgccactgtcgacgtttgacgtctcgactacggtatttggacagtatggggatcatcggtgctaggatatacgcgagactgaggtaaaagagatggagacagggatttttatacgggttcgggcccctgagttgtcaggtaataatcctacatcttgttggccgaagccagtattgctcttattcaccataatcacaccagtacaatatgtgggtagcctatctgactgttgtcgacatgtcggtctgaaggtctgactcgtagtcgacaacatggtagtcttcctcctcgaatccgtgcccggcgagatcagagatagtgctttcgtatctcctgacggtatccggagacaccgtaggggaatagccatgcctatccctgaagtcgatatccggcggtgtgtcttggcttacgtaggcttgtatgttgtggcttctggtgggcgtgtgttgattgtcatgggtgtcgtccatggtccttctaggggggcttgtatttatacccataggtgtccccttgtccaagtagaactagggaaaccaatacaatccgagtagtccttgtcgtttccatgtagaactctggttgtctttccttatccggaactccctcctatatccgtaggttgtttccgtataggacatggtatgtggtgggtcctgccgagatttagtcaactactattaggtatgtggtatccataaccctgacacaagtaattgggatagatcggtcgtcatgccgagacagtataaatcgctcagattgaaacatatactaataacaagactatatgtgtttatagcatagccgatcagatagatctagtgtgtatcggctaatactccgatacaactctatgttaagatgttaaagcaagtaggatataccaaacagaagcttaatatacttaaatacaataatatcttaacataaagggcagatttaacatgtcaactaagcatgtgaagtaaatatagctaaatcagataagatcggctgaaaccccgatactaccctaatcggcaaccaggaggcaggctagagattgtttttctaagcacgacttaatagaacaaacttaactgatgcaacattaagtatgaaaagaataacaatatctagacaatcaagccgctggaagtttcatagagtggtagatatcttatataatctagatcaatgtcgctatttaacctaatcggctgccttctgttagccggttgtaaattaaatgacgatactgtcaaagattagagtatcataaagatggaagcactaatcccaagagcataatccatcataacaagttttacctcttgtagaagatcgaaaacgatgcaggtcaacctgaaagcaagaactcgttgaaataaaactaaagcaaaaaggtggcgatgtgccgaaattatattgaatgtgtgttcttattttacatagggctcggggtctatttatacccgagaattacaagatatgcccataccggacacaactattatctctaacaaacactaagataacataagtctttacggcggacttttgcccaagcatatctataatgaaattacataaaacatcctaatttaatagatacaattgccttctcaggactctatccatgtgcggcaatcatcttgaagtacgtcaattcaacccgatatcatacatcaagttgcattgtcggaatcggctgcatcggcttacctagtccgactcagacccagccgaccctaatcgcagccgatctggactccagccgattcctgctctgtttccgaactcgatctccgcctccgacctttcctcaatctaatcttctttcccaatgccgatattaacaaatttggttgttaacacatgccccccaagtccgggatatttggtaatgttccggatttgccgtgtgccgactccgagcaagtttcgcactccgccgttttctgaccgttattctagcgctttaaatactaatcgttgcccccgaggaacctcacaccgtgacttccgttttcaccgcttaagcgaaactctaccttttctctctccggcgattcctccgacgcaaagcgatctccaggtgatttcacctccggcgagatctccgcccgcagcgatgtcatcctccgccagcccatctgccgcaccatcagccgagtatgctgaggtaagttcccatcggctagatcccctttcttagcagcatatcaattttcttctgtcttaaattgcttttctcttctcagtcgctttggatttgtagcatctctccaacctagtcgcgattcccagtctatcgtacgaaaactactactttctcggcccagttggcaatcccgatcccaccgagttcatcattggtgaaaccaataggatccctttcagattaaccaacctagatctaggtcattggaagaataccttcaaatcctagccatccctcgagaaaacttctcccgagaaaagttggatcacatggtttaagcgcatatcggctagcaagagagttcattgggatgagatcagaatcggccaggcacttgatctcaccatagccaattcagctaaggatgagcccctaatggcagctgcttcctatttttggtccaacaccatcaatgccttcttgttcaaccaagggccgatgaccccaactctcatagaaattgtcatgatcacgggcctggacgtcacctcatcggctaaccctatgagcttgaacataaagaaccaatatgacttcaagaccaagagcataggcggttggtcaggctatgtagcagcatacatgggccagggttcagtcaccccccgagaacatgtggctttcttgttaatgtggttagaaaaatttctcttctgtggatcaagctgtggccctacaaccaactggcaatttgtagccgaagccctagaaacaaaaagacaatttcccttgggcaaaatcctccttggctatctataccaaatgttgatcaatgcatcggccaagatagctgtcggctcaatggttggagcaggcggaccatggtggttgctgcagacttggctaaacctgatagtcatgaaagttgtcaatcggccatctgtgttagaagccgaattcccaagactagagccgattgtagaagatgatgaagaagagcgcactcatcatagatgtatgtcatatggagaatatgcatccgcatcagccgatgctggagcaaaactatcggctgagctactcaaggattggttctgcagctcctatgagggctttcagaaagatgctcgagtctagtttccttatgaagattcggcaagccttgagctcccatcagactttagattcgaagacatcaatcatgaaagataccaatcgtccagggaaattttctcagctgcaatcagcccatgcatccttcctgtcggcattcatcagggaagaaacatccaagcttcttatgaattctatcatccaatgagctcggctagacaacttggaatgggccaactcccaattggcttattctttgctgacaagatcctataccgaggagaaatttcatcaaccttgatgatggatcggctgctcaaccttcaagggcctcctctgggcagtattgaaaatatagaactggcaatgttcagaagcaaaaactttgacagatggtggggtgaatggaagctgtatctattccaccaaccagcctcaatgtatatgacagacctctttccagatgtagtccctcaagtaagtcttaactcacttgatttcatttgaataactgcttagccgattaatcttaactaatcttccttttgatttgtagacaacagaatcctctcctcctcgtcaaagcaacagtggcaaagatatcatatatgccccaggtttaattcctaatggaggtggactatctccccccgttatcggctaccatgcccccaagacttcaactctccttcacggtctaaccagggaaccagccgacacaggccaaaagaggaaaaccagatcatcggccgtgagtaccctggctttagctcccaagaaaaaggccaaattcaagaaaactaagccaactgataagccgattgatgatctgcccgccttggatccaactattgaacaagctttagatgaagaagacattggtgaagatgttgaccaggctgtagccgaaatgagtgacacagaaagaacaccatcggcttcacccaagcaaacgcctccaactccttctgccccgttcattttacaagagtaagtacttctctttgacttctcctgaaattacttccctctttggctaattactcataggctttatggttgcagaaaaagaaaactactgtgaagaaaaatccagcagcaacgattatcaagtcggctccacaagtaagatgtccttaattcttttactaaatcaatctcaaccgactctatataacacttgtctatttcgcagcctcctcctccttcccctcctgtataacaatcgtcaagtgataagactccatcggctgtggggaatcatcacatcgaggaggaagaacaaccagctgctcctgctatcccaataagtttccctttgtctcaacaattagatcggctataatttacccagctcttattctttccaaaattgtctctgcaggttctagccgatctcttctcttttgacatcagagattatcttgatgaagcagaagaagacacctcaagcaaagccttagccccgttatccgatgatgtgaagaaaattctggaagatatttctcattggctagaggcatcactagacaacttggtgaccaactgtggctcaatccgggcaaggttcacagacatccaagctctactcccagatgaactagccgatgcccttactccagccgtttaccttgagcaacaccgattcaagctggagaaggctaggcaaaggttaactgatcaccgggagtgccaaaatattgaagctacaatccagcacaatcagcagcttgtgcacgtagagaaatctaaacttgatcaactatctgaggacctgatcaactcaaatattgatcggcttgaagctcgtaagattgatctcatggcacaactccaagaatggagcacaaaaagctagccgatctcctgcaagctgttgaagaacagaaggcaaggctgaaatcggctatcaagaatgtcgctgatatgaccaagtccttgaaagttatccctggaactgacgctcaagatgcccaagccatagaagaaatagaacagattaggtagaaggctatatcggctatccagcaatacttgtctcgatgactttccatgtaataagccttagaaaatttttgtaatcggctaaaatactttcgatgtttatcctgacaatccgtatgccgattaatcgaacttccaaatttgctcaaaacttcgctaaactgtatctcgtgcatatatatgtgcgcccctaattttacaatgtcaaaagcattgataaaattataaaaacaactaagggcgatataactatatcggccattgtacatcggcaaaccatgaccgattacaccaggaaaaacaactaagggcaatataaccatatcggccatctcaaggcgatgtaaacacatcggctgacatacatcgaaaatactagccgatcatgcgttaacccaaacacttgggtaatatttcttcaaatactttccattgagcgctcgcccatagacttcaccatcaagcccttgcaacatatatgctcccttagacacaaccttataaatttggaacggtccttcccaattcggtgaccacttgccgaatttgttatcccgagttccaatcggcagaatcaatttccatacaagttcaccttccgaaaaagtcttaggcaccactttcttattatagtgccgagcaacccgttccttatctctagtcaccttagcaagagctcgcaaacgtgattgaaccaagtcctccctttcatcggccataaggttataatactcatcggctgtcagaccatcttgtaactctattcggcgtgagccaactctaacttcccatggcaaaacagcttcatgcccataaacaagcttataaggaggaaattggattgatccatgacaagccatccgataagaccacaatgcttcggctaaacgagtatgccattgccgaggataatcagaaattttcctcttaatcaacttgatcaagcttttgttagatgcctcgacctgcccattagcttgtgcataatacggtgaagaattcaacaatttgatacccatgctatcggcaaattgaacaaactcatcggacacaaatattgaaccttgatcagttgcaatagtttgaggaataccaagtcggtagattatatgctcttgaacaaactgtattgcatccccagaatcaactttcctcaaaggaatcgcctccacccatttggtgaaataatcagtcgccaccaatataaacctatgtcctttacttgatggtgggtttatcataccgatcatatcaatcccccaacctctgaatggccatggcttaataataggattcatagccgatgccggcgctctctggatcgctccaaatttctgacagtcttgacagcctttataatatctgaaacaatcctctaacattgtcggccaaaaatatccagcacgtcgaagtagccatttcattttatgagccgattgatgagtaccacatatcccttcatggacttcgccgattgcaaccttggcctcatcggcactcaagcacttaagtaacactccatgatgaaccctgagttcctctcgacactcaaggctgttgttggcccgatctttcggtgagttgtgataactacgatttgggagaaacgttgacgatccgactacaaccgtacgagacgttgtgttgcgccttagcgatcgatacacctctccgttggttgttgatcttgccggtgcagatcaaccctattcctgcaagcaaatcgaagaaacaagcaagaacaagataaaggcaatctgatattgcaaataggaatttaatacaaatgataagttggggttccgaagaacaagcagacggacggtctagccgacacgcgcgctgcaagcaagtagcaatggctaaacttcaatctatcaaaacccgagaaaccctaaaggggtaactatctatatataggggtgggaggacgacctaggggtgcctagggtcgtgctccaccagcttggggcgcaccccacatgggccccacctgggccggggtcccaaatgaagttacaagcccataggcccattacaggtgtcacagcaccttgtttcttcaattggtgctgactgagatggaatttgcaatgaggcttgatgcattggaaagagggctccgagagctttccatcaagtactcacgggccgaaaacggaggtcgtatgcagattcggtggccgtttgaagtcagcagtgtagtaggtggccgaatcggattccagcacttggagtacttgatctcgataccttcttgttcatccatgatgtgagcaatggttgcatccgtggtagccatggtcacatcactccatcgatcgttcgataataaagctcatcatccaacagtgtatacttcaatgctttataccttaacttcctaaaagccgattgagatggatcctgtaaataccgataaacatcatatctccaatcatcggctgttatggtagcaacctcaatctgaacatctttgatcatcggcttatatcccgatgctccttgggctaaatcattagcttcaatgttctgttctcgagatacatgctttaaagttactaaccgaaattccttcatcagttcttggcatttctcattatagactatcaatgtatcattcttgcactcatactctcctgccaattgactgattactagcaaagaatcccccatgatctcaatggtatcggcttaaacttccttaagtaattgcaaccctttgagcactgcctcatactcaacttgattattagtcgcataaggtttaaaattataagcaaactcgaaacatgcccccctaggggaaattataactagaccgataccacaaccatgagtacacaccgatccatcaaagaataaagtccatggcacaatcgcaactgagccgattgaatcatcacgatgatcaacaataaaatcggctacagcctgccctttaatcgccttcggtgactcataccgcagatcaaactcagttaaggaaaatatctattttccaacccttcctttcaaaattggagccgataacatgtacttgacaacatcggctttgcatatgatagtacattcattggacaataaataatgccttaaccttgtgcatgaaaagtataaacacaggcataacttctccacaggggaatatctagtctccacatccatgagccaacggcttaaataaaacacaactctttcttttccttcgaactcctgaatcaaaaccgagccgattgacgtctcactggccgacagatataaccaaaaaggtatccccttctgtggaggaatcaaaatgggaggagagctaagatactccttaatattatccaaaaccttctgttgctctgccccccaaataaactgctgatcggcttttaatctcaacaatggtgtaaaaggttctaaccttccagacagattggaaataaatcttctaacaaaatttatcttgccgattatctcttgcagttttgtcttgttttccggaggctgaatcttcttgatcgcattaacactcctttgagtcacctcgatccccctctcatgaacaagaaatcctaaaaactggccagccgatacgccaaaagcacattttgtcagattcatcttcaatccatattttcttgttctctcaaaaaccttcctcaaatcggctatgtgatcttctatttgtttagacataacaaccacatcatcaatgtacacctcgaccaaccagccgattagatcatgataaatataattcatagctctttgatatgtagcgccagcactcttcaagccgaaagtcatcacaacccactcaaacaagccgatcgcaccaggacacctaaaagctgtcttatggatgtcttcttcggccataaagatttgattatatcctgcatttccatccataaaactcaaaattttgtttcctgacgcagcatcaaccagctgatcagccactggcattggatattcgtccttcaatgtagctttattcagatctctaaaatcaatgcataccctcacctttccgttcttcttgatgacaggaactatgctagaaacccattcaacatatcggcaaggacgaataaaaccagcatcatacaatcgcttaatttcagctttgacaggttcgagcatgtcggctttacatctcctcggaggttgctggtgtggtctaacccctggtttgataggtagccgatgttcaacaatcgatcggttgagtccaggcatctcataatactcccaagcgaagcaatctctagactctttcaagagctctatcagcttagttctaaactctggagacaaattcttactaataaatgtcggccttggccgatcgcctggacctatatctatttcttccaaatcatcagccgacatgaaaccttgaccttgcttgtcatcgagatcatctaccgcgtccttggtgtagacatttgaaccctccacaacgccctcaaagtaatagcttgggttctccatcttcaagtggctgtatatcagaagcagatacttttagaaaatctccatcccagactttaccagacaaacaatcaaggccatcgatctcccaaagagctaaatcggcactggcgacattaactgacctgtcggctagcacaatctctatcttgtcgccttgccactgaatcaagcattgatgcatagtctaaggaatacaacaattggcgtgaattcaatcccttccaagcaacaagctgtaagaacccttcccatcgatgacaaaaaacgtagtaggaatagtcttactgccgactgtcagctccacatttagaacacctttagtttccgatggattgccacccaagtctttgagcaccatatttgtcttgatgagatcctcggcatttctacccaacttcctgaacgtagcataaggcatcaaatttaccacagctccaccatcaaccatcatcttagacatcggcttcccattgacgtagccgttcacatacaatggtttaagatgccgattctctatcccctcaggcttttcaaaggctgcctgttctggtgatagaaccaacttagccgactcctcttccacctcatcaacatcagcttggtcgatccgaaattcggctggcaaagtgaaaaccatgttaactgacgccgttacaatacttttcccttttgccaacctttttgcctcatcggttgcaacatcatcggctacaggaatctgactcttaactcgccactcctgccttggttttgctttcttcaaccgatgattaatttcttgctcgacctcctggaaatgttccctactcctcaacctttgaacccttcttttctgattctttgtaaaaatacccgaagggcaccactgattcttcctgattacattgtcctcttggccatgatcgtgattcaccggacccaatctttgatggacagaaactcttgtttgccttagcggattacccctattatatgattggcttgagctctcgacgatgtcactgcacccagggcagttttcaatagatggcagcctcataccttcattccagcagaatttaaagaactcacaaccccaatgaggatcaaaaccatcatcgtattgctcatgatgcttctcctgctgcttgtcatacctcctctgatatttattaataatcttagccgaactcacctgaaaaccccttgcacgggccctgttggctgtttggccagctgtatgcaccatattaacaggaaaaggattaccatccaccttcatcggcctcttagaatcatcgaacttaattttgcctccctcaatggccacccgaatctgttgtctgaaaaccttgcaatcattagtagaatgagatccagaattgtgccatttgcaatatcttttcttgcctaattcctcagcagatggaatcgtatgaccaggagggagttgaatttgcttctctcggagcaataagtcaaagattttatcagccttggttatatatcaaaatcatacctctcctcttttccagaactttttacccattggcatggtatgacctttttacttctcacccattcggctgcagctatttcagaatcgtcctcatcatcatccaacccatacatgtacggacaaacatgattaaccttcttggagcttttcctgacttccgcagacctatgctcgtgcaaagttaccttctgtatcagatgtgacaagctaccaaagtcttcagatgagaatttctccctgatcggagcaatcataccctgaaaggctagatcggctaacagggcatcagtcaaactcaagctgaagcatttattcctcatctccctgaatctctgaatatactcgtgcacaggttcatcataccgctgcttaatcgctgttaagtcagataatttcatcccgtggacccactgtagaaatagctgtggaactgcttctccaaatcggcccaactattgatcgacccatacggcaaagatgaaaaccaagtaaaagccgatccagacaaagataaccgaaacaacctaaccttcatagcgtccacagccgacgcttcaccacattgagctaagaatcggctaatgtgctcataagttgacacaccatcttgtcctgaaaatttagagaagtccggaactttaaactgattgggaagaggaactctctcaaaccactcaggataaggctgctgatacaagcttccagtctctttaggtttaagcccgaactgttccctcattacgtcagcaatcacatcggcccacggtcgttgctgagctgctccctgtgcctgttgttggatgggctcgaactgaccatactgagaagcaaactgaggttgagttggccccctgaggctgatattgataattcaagttgcccccttggtaattatgacggttcggctggatgttacgtactaagtgctcaggaacgacttgaggcattactgtgccatccggccgtacgtggtgaaccaagtgttctgggacaacttgatttaaaaattgttgtacaggctgaccgctaggcgttgcaaacccggccaatgcgcttattgaaccttggtgctgaatcggctgaatgacttgctgtcttaacggcgtctgccgaatcggctgcagaggctgctgccttggtgctgtttgctgagctggttgcatgacctgttgctgaatcggttgtacaacctgttgaattgggggtgtctgctgacttggctgctgctgtattggatcaacaataggttgaggtggtagaaacatggcagcaaccagatcttgggtcagccgattcacaacctgcctaatatgctgtggctgctctctcgtcaacaaccgaggattcaccggctagcctggcgtcatcgctgacaacgcaggtaggggagttgatgctggcgccgtcggctgagctattggtgtaactaaggaaccgcctgaatggatggctaaacatcagtgatcaaggaccgataatttggaaagacacctccttgcaaataaactgggcttgcagcctgatgctcagctactgaaccattggctattgacttcatcatgtctgataaggtattgactaacaccctagactgattgatcagagcatgatgtacggcgtagtcaacccggtcttggaaattgttgaaaaaatcttgtgccacatcactattctgattaagatctcctccctgtaatccttgagcaccatcaccttgatttcctagagatccgtcggtagcgcctttgtcactcggttgagctgagccgtctggagtttgcttcccatctccatccttagaagaatcggttccaggatcatcagcaaccacttttaatttttacttctgaacaaatgttctcttgcgagtctgcataaacgaattcaggaactgatctcgtgcttgctgcatcattgcctcaaaatctttcttttgctcaggagtgaacttttctggatcaataggcacgacgtttgcctcatggacgttgatcaatcctaacttctggatcttttctttgatagtgcccgggctagccgaggatggtgacagtggtggtttctcaaccatgaggaagaattgcttgctgacttcttacttgtcccactgggcatgccaatagcgtgttgacagaaaacacgaggcctgggagatctgcttaactccagtgcaggtccaaagctcgccttcagatgtatgggcgtgccagttgatttgatcttgcaatcaacaagagatagaaacaaaggaaccgcaattaaatctgtaaatgatagccgatcggctagatgccgatgacatatcatttatctttgagccgatgtcgtatgtgaatcgatcggcggttgtaaataaacaataaagaactagatctattcgatcggctgtagatattaacgatatatagttcttatatcgatatatgcttaaatcaagtaattgggatagatcagtcgtcatgccgagacagtataaatcgctcagattgaaacatatactaataacaagactatatgtgtttatagcatagccgatcagatagatctagtgtgtatcggctaatactccgatacaactctatgttaagatgttaaagcaagtaggatataccaaacagaagcttaatatatttaaatgcaataatatcttaacataaagggcagatttaacatgtcaactaagcatgtgtagtaaatatagctaaatcagataagatcggctgaaaccccgatactaccctaatcggcaaccaggaggcaggctagagattgattttctaagcgcgacttaatagatcaaacttaactgatgcagcattaagtatgaaaagaataacaatatctagacaatcaagccgctggaagtttcatagagtggtagatatcttatataatctagatcaacatcgctatttaacctaatcggctaccttttgttagccagttgtaaattaaatgacgatactgtcgaagattagagtatcataaagatggaagcactaatcccgagaacataatccatcataacaagttttacctcttgctgaagatcgaaaacgatgcaggtcaacccgaaagcaagaactcgttgaaataaaactaaagcaaaaaggtggcgatgcgccgaaattatattgaatgtgtgttcttattttacatagggctcggggtctatttttacccgagaattacaagatatgcccataccggacatgactattatctctaacaaactctaagataccataagtctttacggcagacttttgtccaagcatatctctaatgaaattacataaaacatcctaatttaatagatacaattgccttctccggactctatccatgtgtggcaatcatcttgaagcacctcaattcaacccgatgccatacctcaagttgcattgtcagaatcggctgcatcggcttacctagtccgactcagacccagccgaccctaatcgcagccgatctggactccagccgattcctgctttgtttccgaactcgatctccacctccgacctttcctcaatctagtcttctttcccaatgccgatattaccaaatttagttgttaacagccgagccaagccgagccggccggccgtggcgagggccaggcgtgcgtgcgtgcgttgcgttgcgcatgtctctatccttttgcaacggatcagaatccaaccctgagattgcctccgtaatgggcaggcgattcaatacccattgatcgcgttgttactgcggcaacgggcggatctctctcctgcgccataaggaaagggggaatccgatcagatccgctcggttactttccaaacactggtgttcttccgagggcctccagaaccataccttcgcctgagatctgcactgggtaggcgggtgatcaggtttttggggagtgcttccgcacgactgctcctcgtcttctgttcgtcgtcgaccgtacatttgcatcaccatgtctgccgcacctgcacctggaggtggcgcaccgggagccggagctggcgcaccgggagctggtgcacagaacgacaacaccaacggaggcagttctgcctcacaatccagcggaggaactttcacagggtataatcctctactgttatttcagtttttgatatttctgttagtcgcactataattgcgttctatgtatgatgatgatgatgcttattctaccttaagcatgctcctgtttatgtttaattttatcactggatcacctcacattgttcatgtcatgattatgtcttaatattttggattaaaatatgccgatatttgactatatttccaacaacttgttcgtccttgtagatgcgattgtctatttcctgatttgaatagaaagttccaacttattgtatgaatttcccatagagttagcattggtttgaagttgttgtatagcacctgggttatgcatgattaaaaatattattaagtgaatgatcacgcaactaactgaaacattgtccatgtagtatcaatagttaatatagagcaggtagaagcaggagatgccaagtcaaatatatagaagctagtcttatccatatcttatttctcttcaccaaccacactcagtagctaccatgggtgatttttttgcgaggacacgatgagtgaaatttttagctagaagaattctttgataaaatgactattgactagttataccgagaccttgagccaatcatagaaactgagacgtaatatattttatccctacacaaaaagatgtactagaacacaatctatatactaacatttatgcatcacactgctaataatttcactgtcttctgtaataataataataatctatactaatagcagtggtgattgttctatcacaccacctccaccaacttgataaatgggcccctttaatcagccccacgctcccacaagttcttttccatttcactgttgactttccccaaaattcgaccaataatttattttttttgaaaaccagtacggtggacaagatctgaataatgcacaattcgagtcaggttattaagtaccatgaggaaaacatcgtaaagtactacttggactaactatgtttttaatcaagttaaataagctagaaactcatttttgttttgttgcaatgcacgggcttttggctaagaacaacaatgatgatgacgatgacgacaacgtagattttaagccatggagagtatatgtcgtggtttattcttgcatatggttcaaataggagtataaaaaaatagtaagaaaaaaatgataatggaactgaaatatagagataataattccaatagtttaccaatttgcaagaccaaattaaatgcaaaaaacacatcagattaatatcgttgaattaaaagagatagcaagtgtcacaaacctagctcagattttgcaaggcggacgtagagctcctggccaccgtcgacgaaccccgtgtccatcaagtcgccgaaccactgtatgcacccgctcccgccgccgcggatgtcggcgccggcgtacgccgtgcaggagcagttggacaggcacctccagcggcacccctcatgagtcaccgtggcatccacggcgcagccgtgcgtctccggcagcttcacgccgcgtaggaggtagaacccgtcctcgcctccacctccgctgctgccagtgcactgcagcggcgtcctctggccgcacccgccggacgtgttccgcatgtaccactccgccggcgagcgcggtgtgaagcccctgatgcagccgcagacggtggcgtcgacgacgttgcagacgccgaacgcgccgcacctgccgtagttgtcgcactggtccctcggccccgaccagaagttactccacgacatcgccgaccggtcccagaccatgcgttgcatgacgccggattcgttgaggagcacccatgacatcggcgagccgtcaaggttgcggaactggtaggagacctcgccgccggtggcgaccctgaactcgaactcgaacatgtcctcgaaggtcgtcatccacgggcccgtccggtacgtcttccggcctcggctccacacgtgcagctcaggtgagccgctcgtgtccgtactggaagtcactgggcgacgggtctttggcgccgcgccacgacgagagcgaccactcggcgccggtccggaggtccttcccgacgcgtatcccggggaggaacgtgtttgtctggtgctcgaagctctgccacagcacgttgccgtccttgtccgtgagcaccaggttgccggtgtcgaaaagtgtggagattatggataccccatatctacatggcggtcatattccagctgggtacgggataccgaataaagatagaataccttcatgaggactcggattagattctaaacttgtatgtcatgggaatacccgagatcctagtcggttacgattgtattttatctgtaattacatattccgttagggatatggactgtacttggtaaagcggactccgtcccctatataaggagggtccgtgtgcctctcggggcacggtttttgtttccagtttatacaatcaataacacactcggcggaatcatccccggacaggagtagggtattacttcttgaataagaaggcctgaacctgtataaaaattccttgtctcgaaacccatccgctttcctagcttgatagccacccccttttattattgccgaaatcttgtttcgacagttggcgcgccaggtaggggtagcgtcaagtttttgccgactaagtgcgatgggttctgtctccggcatcgacgacttcgccttccctcccgggcaggcgttccggttcggcagcctcaacttcatctccaacgacttcggcaaaatatctctccttgactcggattcgaaccagtcggggagagatcaggtcccagcgccgttcggtatcccgaactcggtcgaggcctactccaagatcatctctcccgagtcggcttcaaaccactcggacgagatccaatctactcctcctgcgcgaccagatcaagacgacggatcctatccctcaatcctgatgaaacttcctgatgatttggccgctgtcttcacagccgagacatctcaaactcgaagatctaggcgagctccggcttcggccccgatccaatctagatccagggaggttggcattatactccaacctcttgggacagtctcgacggaagagttggatagctacctccgctcccccggcgtcagttctcgaccaaccgagatcctcgactacgacgatttcggctaccactacgaccacggcgacctcgacaacttcgacgacagctatgaggataactatacgcccctcttcttcggtgtattcatggctgacaacgaaacggaggaacagcgccgagcccgagaagcggacctagatcgcgcacggcaagaagctgaacgtcgccgactggaggaagagcgacaggacaggagcgagaacgactacagcatgagcaacaagattgcgaacggattgcaaaggaggctgaagatcgacggcaacacgccttggaatctgggcggcgagcaagagagctcattgggcaacaagacatcaatggaacagcggtctttcgcaccccccagcagaacgcagttgcagcaatcactctccttgacaccctcctcaaggaagacgcactcaaccaaactgatcatgttgtcaacatcttgaaccagacgaagaccatgatcgctgcctcggttccagccaactccgcaagcacccgcaccccgactggtagccgagtccctcaccttcgatctcaggactatcaccagccaagcctaagcattgccggcgccggttctagtcgcaggagcaggggacatgatgaacggtctgttcgttcgcctcccgaacgatatagggagcgtcgagttgaacgaccgcactccccacatctaaggcgccccatcgatcttcgcgacaccatcaaccagcgccgcgtagcaagaggccatcattcaccggatcgctacgacgacgatatggacggagttgctaccttcacaagcgatctgcgtcgagtggattggccagccggctttaagccgactggaatcgagaaatatgacgggaccaccaacccttagtcttggctcaccgtctatggtctcacaatccgcgcagcaggaggagacagcaaagccatggcgaactatctgcccgtggccttggcagattctgcccggtcctggcttcacgggctaccccgcggcacaatcggatcatgggcagaactacgcgaccacttcatcgccaacttccaaggcacttttgaacggcctggtacatacttcgatctctataacatcgttcagaagtctggagaatcccttcgagattacatccgacgcttctccgagcaacgcaacaagatctccgacatcaccgacgatgtcatcatcgccgcctttactaaaggcattcgccacgaggacctagttggcaagttcgggcgcaaacctcccaagacggttaagcagatgtttgaaaaagccaacgagtatggcaaagccgaagatgctattactgcgtccaagcagtcggggaccacttggaagccaaagaaggatatgccggccgcaggagggagtggaagtaacaaccacaaggatcacaagcgtaagcccgaagagcttgtggcaacaacctctccatcttcccgacaacgttcccacgtcaacaccttcgacaagataatgaactcccaatgtccgcatcatcccaactccaaccacgtggccaaagattgcttcgtctacaaatagtttgcggagcaatacgtcaagaacgcgcgtaagccttcagacggagatcaaggcacatcaaagaagaaagatgatgaagacgatgccccgactggttttcaagatcatcgcaaagaactcaaccacatcttcggcggacccctggcttatgaatctaagagaaagcagaagctaactgaacgggagatcaatgcggttcagcccaacacaccccaataccttcggtggtcagagatagcaattaagttcgaccgctcggatcatcccgaccgagtggtccacccggggcggtaccccctgatactagacccagtggttcgcaatgtcaagctccgacggactctcatcgatggtggcagtgcactcaacatccttttcgctaagaccctggacgatatgcagattcctcgcacggaattaaagccgagtaatgcacccttccacggtgttatcccaggtttatcagctacaccagtcggccagatcactcttccggttacttttggcactcgggagaattttcgcacagaaaacgtttgtttcgaagttgctgatttcgaaacagcatatcatgctatactcggacgaccaaccctagccaaattcatggctgtcccccactacacctacatgatgatgaagatgcctggtcctcgaggagtcatatccctacggagcgacatcaagcaagccgtcacatgtgataaagaaagttgcgagatggcccagacccgcgagatcacactcgaccaagaagagatccgactagcggtgaccatggcaagcgaaggagaactgcccgcaaccaagatgcccaaaagcggagaaagcgatgccaagaccaaaaagattcctttagatccctctgatcctaacaagactgctgtaataggtgctgagttagattgtaaataggaaagcgcgctcatcacctttcttcagaataataaagatatttttgcgtggaaaccatccgacatgcctggtattcctagagaggtgattgagcactctttacacgttaaggaagacgccaaacccatcaagcaacgactccgccgttttgcacaggacaggaaggatgcgatcaaggaagaactaaccaagctgttagcagcaggcttcatcaaagaggtcctccatcccgactggctggctaacccagtcttggttcggaagaagaccggacagtggcgcatgtgtgttgattacaccgacctcaacaagtcttgtcccaaagatccttttgggttacctcgcattgaccaggtggttgactcaacagccggctgcgagttactcaatttcttggactgctacttgggatatcatcagatccgactaaaagaatccgactgcttgaagacctcgtttattatgccctttggggcctactgctacatcaccatgccctttggattgaaaagcgcaggagcaacctatcaacgcatgattcaaagatgtttttcaactcagatcggccgcaatgttgaagcttatgttgatgatgtagtcgtcaagatcaagcagaaggatgacctgatcacggacttagaagaaacttttgcaagcattcatgctttcaggatgaaactaaaccctgaaaagtgcatcttcggagtaccgtcagggaagttgctcggatttatggtatctcaaagaggcatacaggccaacccggagaaaatcaatgccatcctcaacatgaaaccgccaagctcccaaaaagacgtccaaaagctgactggttgcatggcagcacccagccggttcgtctcacgaaccggcgagtgggggatgccctttttcaagctgctgaagaagactgacaatttccagtggggacccgaagcacaaaaagcctttgaagacttgaagaaacttctcactactccaccagttttggcctcgccacatccacaagagccgctactgttatatgtgtcggcaacctcccaggttgtgagcacggtcctggttgtcgagcgtgaagaggaaggccatattcaaaaagttcaacctcccaggttgtgagcacggtcctggttgtgagcacggtcctggttgtcgagcgtgacggaccaatttatttcgttagcgaggttttggccgattccaagacaagatatcctcaggttcaaaagttattatatggtgtcttaattaccgtcaggaaattatctcactactttcaaagtcactcggtcacggtggtcacatcgtttccactcggggatatacttcataaccgcgaagcaaacggacggattgcgatgtgggccttagaattgatgtctttggacatatcgttcaagccacgaacttcgatcaagtcacaagctttagctgatttccttgccgagtggaccgagtgccaagaagacatgccagaggaaaagatggaatattggactatgcattttgatgggtcgaagaggcttacaggcactggagctggggtcgtattaatttccccgaccggagaaagattgagctacgtattgtggatacatttttctgcgtcccacaacgtggcggaatacgaggcgctactccatggattaaggattgcaatctctctaggcattcgccgactctcagttggttgttatcaagtcatgaaagagttgtcttgtctagatgataatatggctgcttatcgacaagaggtacgcaagttggaagataaattcgatggactcgagctcacccacgtcatccgacataataatgaggcagcggacagactggccaattttggttctaaacgggaagtagctccttcagatgtgttcgtcgaacatctttacgaaccaaccgtgcccagaaaagaaacaattgaagccatggatactcaaggcgtaagcatgatcgaagccgactagagagaacctttcataagatttttgaccaaacaagaactccctcaagacaaaaatgaagccgagcggatttccaggcgtagcagactttacattattcatgagactgagctgtacaagaaaagtccatcaggaatactgcagcgctgtgtgtctttggaagaagggagacaattgttgaaggatatacattctggtatttgtggtaatcatgctgctgtacagaccattgtcggcaaagcttaccggcaaggttttttctggcctacagctgtgtctgatgctgacaagattgtgcggacatgcgaaggttgtcaattttttgccagacaaattcaactgccagcccaagagttgcaaaccatcccgttgtcctggtcgtttgcggtctgggggcttgacatggtcggcccgtttaaaagggcagtcggtggttacacgcatctctttgtggctatcaacaaattctccaagtggattgaggctaaaccggtcatcacgatcacagcagataaagctagaaattttttcatcagcattgtgcatcggtttagggtacctaatcggatcatcactgataatggcactcaattcactagcggagcatttaaagacttttgtgaagactttggcattaaagtttgttatgcctccgtggcacaccccatgagtacgtggcacaccccatgagtaacggacaagttgagcgcgccaatggcatggtacttcaagggataaaagcacgagttttcgaccgactacgtccctatgctggcaagtgggtagatcagctgccgtctgtactttggtctttacacactactcccagtcgggctaccggccagtcgccgttctttttggtttatggtgcagaagcaatgttgccaagtgaagtggaatttgaatcactacgatttcggaacttcaacgaggagcgctacgaagagggccgagtagacgacatcaatcgactagaggaagcccgtgaagcagctttaattcagtcgactcggtatttgcaagggttgcgccgttatcataatcggaatgttcgatcgcgagcctttttagtcggcgacctggttctgaggaaaattcaaaccacacaggatcggcataaattatctcccttatgggaaggaccgttcataattgctgaagtcactcggccagggttcttatcgactcaagcgcgaagatggtactcttatcaacaattcttagaatattgaacaccttcgtcgattttatgcttaggcatttcgtttgtatctttcctctttgactgctaacttcaagtttttccttgaagttttcagtcggggggctactatgataataatggagtgtgatttttatcaattcaatttgcctacttgatttatcattgccctgtttggtctttcgacttagtcaatgaggactgaaggtttttaatagcttttgcgggttttaggctcaataaggcttgacaaaggcttttaagaaatcagaagctaagtatggaacaccaagcatagcataaattcatcagtattgtacaaattgagcctccatcatcattaatcatcaaaatcattgttatatcaatcagtatcagttttttcatcatcagaattatcagacccagtcagccgaaggtcgacatcttggaatctctcaaccacgtcagcagcaatcttgtcagcggctttttgcgcatcattgatgagatcaagagcagcttcttcgctcgtcccgtctgcaaagccatcaatggcatcaatgtcaactcttggataaagggatttggttatcgccaacgccagacttgctcccatacttccagcctctttgatgttcttgaagtaagtatccggagcgactctcagcttgtcgaagatttcggcagcatcaagtgtactcggatcggcgttattgaagaacatggcttggatgattggagtagcggcattagcgactttgtccctagccccttcaagcctattgatcttgtcaactaagacatcaaactgtgcctgggacttgatcttgcggtctgcattaacagattcacattaatgaatcagcatatagaagataatggcttttgaggtattgattattggtaccttcaacatcctttaaagctgagtccctctgtctttccagttctgccttgtcattttccagagtttgaatctgcttctccagttgagatatcttggcagcttgcactacattgactctggttaatcaagattacaaagataacaacataagttagttgggcagagtttgtgcgtaccttttgatgagccgctcagttcaaaattggattcctggagctcagcaatccgatccctcatatcatgttcattcttcctggcaagttcttttgtctcgtgcagttgattcctagtggcttcgagggtcccaagatgagggactaacctctctaaggttgccattttagcttcgttcctaagatgaatcctctgcaagacagtttaattagcgctcggactaaatggcaaacgagatggttgagatcaggcgccaaagagcttacatttacaatgcgggttgcctgaccaagcgcctttctcagtaggcataactcttcatcctctttttgcttatttattacgatcccttgaggctgcatgttgtcatcccaccacttgaccagaatgggagggcgcgaatcctcagctgctcgtatccggagaatttcttcttcaacaccaatcattggtcctaatgtatccactgacaaaggttagacaattgatcagattcatttggatcaacacgatttcaggcaaggtgtttacctgtgatgatttccggacggggacgagtcgactcttgcgccttaatgggagaccctggcatcgggacgttgctggcgtcttgtctaggagggctgtctgaccaagctccaacttctggaatctcttggcttggcctagagtccgactggttttcggtcgggggctcctgattaactccgtccacagcttcggccgactcattctcagtcaggggttgatcaccagatcctacattatcggttgctggctggctgtcactcggctgatcctcgttagttggctcgattccttttaagttcgtttccctgctagtcgggttagagtcttttccagaaggatctatatcagatggtttcctgcaagtttggtttgtcagtattttttctgcactgggtgcacgtcaatgcaagggagatcgttatatgatttgtacctggaagacttcctgatctttggcacaggacgactggtggttttcttccttggagtagcctgctttggcagtttcttggttgcctctcggtccccaggctttctagcagtatcgctttcgtcgtcactcgacaccaacttccttttgcgtgaatctggctggccggctggattggaagtatttggccgggcttcagaatggatcttgggacccccgctcccttggccggtttggcagtggggtgattggcattgaatgactgggggggtccgatttcatcaaagaaaattcctaggcatgatatccttcattgttaattgattcaacaaaaagacaagactatattttgtgaaaagttgaaatgtttgattacataccggtggaggaggattgaaagcattgaatggcacgactggcagcaagtgcgaatagctgacgacgatagcattcgagaagatcttgtacatcctttccttcataaccttaaagttaagagagtctggatcttcatgatttggatcatgtttgccgtcaaactcaaaagctgtgcgggacctctctttgattggagctaaccggatttttatgaagtgccgagtgatctgttctgcctgcaaaccttgctcttttagctttatcatcctctccatcagttccactgcttgcgcagcttcatctcccattggcagtgagttccaagtatcccgataaacgggaggaagacaggagtattcggggagagcaggctcaggattttggacatagaaccaatttgcgtgccaacctttgtttgaggtcttaaagggcatggagaagtatttttgacttagtgttccccgaagttggaaaccagcgcctccaacaacacatggtttgctcttgtttggctgaggcttaaggaagaagatgcggcggaacaaggcaaaatgaggcctaatgcccagaaaagcttcgcaggcatgaataaaattggcaatatgcactatggagtttgggttcagatgatgcaggctgattccatagaaattcacaattccccgaaaaaatcttgaggttggaagggagaaaccgccatagaagaaatgagcaaataccacgatttcatgagtatcgggggttgggaatgcttcaccgaatgctggtcgccacccgacgatctccttcgctggaagaacgccgtgcgccaccatctccttcagattatcttccgtcacatcggagggcgcccactgactctcgaagctttctctttcttccgccatgaatgtgagttggatggtttgatttggtccgagatacggctggaaagggatggggaatcggagcggtggatgtggggagaaattttgtgaagtttttgaggatggattggagcggattgatgaaccctagtttggccggcgcagttttgtactgtagcagagaatggggataatggcgagagtctcggcggggaagacgaagagacgttttatttcacttcggtgcttttagggtatcgggagtgctaacaggcctgggcctgcacagtacttcagcccaattttatttccagcatggcccgttgtgatccttagggacttaggcactttttgctttggcaatttgtcctatatttctattaaggcttatgtggaactcatggtaggaaataagaatgacatacttgtataaaaaattttgtaaaaccagggagtagatccaagaaggatactaatcaaaccaccatgatcaagtttatgcacatgtgtgtggaaaagaatacataggtggatgatgggaaaatggaagaatatgactcatttttggtatgatcctcctccttatactttatttggagaacatggctattttctatattatcttattcatcatgctcaagaatatttttttttgtttccttcttttttgaacattatgattttctaaaatcatttctttttttaactcatgtctcatttggcatggatagaggatggagaatcatagtcatgtgaagtctttatttggtggatggatgatagtggatgctgacttccggagtagaagtatagcatatgatggtggataaaaatgtttagctaaacattcagtgtacagggagagcaatatatggtggatgtgcacaagatcttgatgatgagaacatgaaagaaaaaaaaatctaataagggtctaaaccatttgacaaaacatagaatgatacaagcagcatatgtataaggtttatcatgaagatcaacatatggttttggtaggaataaaacattaatgatgagtaggcaaagttatactttttttaatataatttccaagaattaaatagaaaaaagcaagggtcatattgtcaggcaatcattcatttaccaattgcttagatgacatgtcttcctaatgatatatttcacaagcacaaggtatcatacgagaaataaggagaatccaagacatttgcatgcaagtcatatattctaaaaacattgaagcttattttaaaagttgaatttatttttcagattttcatgataagaattattaaactcaaactttagggagatgagaggataaacatgcaaaatttatcaacataatacctaaataaggttaaactagctagagcaaccgcgacaagtgggaaaatttaaaacttttccttgccattctaaaataaaataaaactataaggtgagagcttgcatttgcccatttgcatgactgttttgctgcgattgagtcttttatgtgtttttcgatcttaaacacatttcataataggattcatacgcatcgtattaacttgaaccaaaattattagaatagagaaccttatatataaatattgagaatcgcttcttaaaattttatacaactcacaaaatttcacatttcatcctaacctagtgttggtatttcttaacgacattactagaaatatttaatcctagcaatggcgtagaaatagttctggtataattatggttatagaagtaatctgcaagcgcacggatataccattgtagtatttcacccggaagtattccaaggtatcgtatttatttagtcgcaagtgaagattgtgaaagagagaccatgctaatatatacatatatatatatatatatatatatatatatatatatatatatatatatatattacttgcgttcgtggcagaaaatcacttcgtgattcacgcggcgaacttttctcaattagtgccaatattggaatatattggcacacattagtgcgatgtttttgaccggaatgaaaaagttcaaaaagcaccaaaacatgatttttggacatattggagtgtattgggtgtgttcgtggcaaaaaatcacttcgtgattcatgcggcgaacttttgtcaattaatgccaatattggaatatattgccacacatgggtgcaatgtttttgaccggaatgaaaaagttcaaaaagcaccaaagcatgatttttggatatattggagtgtattgggtgcgttcgtggcaaaaaatcactccgtgattcacgcggcgaactttcgtcatttaatgccaatattggcatatagtggaatagatgggtgcgatgtttttgaccggaatgaaaaagttcaaaaagcaccaaaacatgatttttagacatattggagtgtattgggtgcgttcgtggcaaaaaatcacttcgtgatttgcgcggcgaacttttgtcaattaatgccaatattggcacacatgggtacaatgtttttgaccggaatgaaaaagatcaaaaagcaccaaagcatgatttttagacatattggagtgtattggatgcgttcttggcaaaaaatcacttcgtgattcgcgcggctaacttttgtcaattaatgccaatattggcatatagtggcatacatgggtgcgatgtttttgaccagaatgaaaaagttcaaaaaacaccaaaacgtgatttttggacatattggagtgtattgggtgcgttcatggcaaaaaatgacttcgtgattagcgcgacgaacttttctcaagtaatgccaatattagaac

SEQ ID NO: 44980 - DNA, 22351 bp, Oryza sativa
  unsure (1)..(22351): unsure at all n locations
gaatgaaaaagtttgaaaaacaccaaaacataatttttggacatattgggagcgttcttggcaaaaaatcacttcatgatttgcgtggcgaacttttgttaattaatgtcaatagtggcacacgtagatgcgatgtttttgaccggaatgaaaatgttcaaaaagcaccaaaacaagatttttggacatattggagtgtattgggtgcgttcgtggcaaaaaatcacttcgtgattcgcgcggcgaacttttgtcaattaatgccaatattggaatatattgccacacatgggtgcaatatttttgaccggaatgaaaaagtttaaaaagcaccaaagcatgatttttggacatattggagtgtattgggtgcgttcgtggcaaaaaatcactccgtgattcgtgcagcgaactttcgtcatttaatgccaatattggcatatagtggcatagaagggtgcgatgtttttgaccggaatgaaaaagttcaaaaagcagcaaagcatgatttttggatatattggagtgtattggttgcgttcatggaaaaaaatcacttcgtgattcgtgcggcgaacttttgtcaattaatgccaatattggaacacacggtggcatcatgcatggcacggtgacatgccggtggattttgtcttgtgggtacagttgtgcacctctttctagagtaaaactatttgaatagtcgtgcctacgaatatgtgtgttcaaccagattcaccgtgattagtctcaccccttgtttcgcttaatggaactggttagttcaggtggtggattgtgtctgtttcaacgtggtgtagcgttaagcagtgattggttaatattgattaattactacaactgttttactgctttcaactacctttttaaatgcctgctatatgcaaatgaacccttagcctcctttttaaattcccgaatggaattccaagcagaatgtgcattaaaatccctgtcccggaccggccagggtacacaaacgataaagttgacatacagatccacgtcttacaaacattataaaagtcttacataaatgcagcagaaaataaaaggataactggagctaagccttgacttggattgcagcggggaacatcactccacaggcatccttgatggcacggacgaagcctactcctctggaaaaccaccatcggaagcatactcgaactctggggttgggagatagagcaagactgagtactacccactgtactcagcaagtcacaccggagcagagggtatgatgcagtatataaccaaagatggctaaaggagttcatttgcataaagctagcatctataaacagtagttgaaagcggtaaaacagttgtagtaattaaccaatattaaaccaatcactgctcaacgctacaccatgttgagacaggaccaaaccaccacttgcgctaatcagttccattaagctaagctagggtgagactaatcacggtgaatctggttgaccgccaataaccacgggcacagtctgattagaggtgtacaactgtacccacaagacacagtcccacgacacgttcctgtgcgccggcatgccaccacgatatactggaaagatgccgtgacaggacccttcgcataacccctctaaccaagcacaccacacctcaggttttacccccagtcctcaaaaggcagcgggcagtcccctctcgtgcctaggtgaatccggaagcgacaaaggccgtcgcagggcccatcccactccatcacgcccacccttgcctagatgcgttggctagaggaaagctacactacaagcctagctgttgcccacgctggcttgtggtaagtacgaggaattcttccagggtttcgcacgaaccggtccttaattgccatgggcacgaccatcaaaaccatgcacccacagcccaccatttaatgtattttaatcaaccaacaccatagcggtgggactaatctaatatcatactagagtccagagtctatgcattaatgtgactcccccattgtgtactagttgatctaagcatggctaagcaattcctaatcccacatctagtcatgttacaacccaagctagcaaaggaataagataaacaaatagtatggctgagacagtaggtaaacatcccatagtaacattataaaacaatgcaatatttaaagaaaacaatagagcatttgcaatatgggatcaatatattcaagtgacaagcatgacttgccttgctctgtggctggagggacctcggcgactatctcaaagtacaccggagcgtcgggagagccgaaatctaagcaaccaaagcaaacaggctataagactactgaaacagagaacaaaaccatttttaatggattctttgcatttttcttgatttactgagacttgaatgggcttaaatggagcacggatgaattttccatgaattttagaagattcactgtgtttttactataacagaaaaaatccttaattgatttatcgcgcaattaattaacctcgggttacgttagcaggggtggcggcgccgacaagcaggccacacatgccaatgaatcaaggcgtgccggtccacggtggaccaagtccacgggaccgggaggggaagcgccgcgcaggcggccacgtgggcagcgacagatggccctgatctaccgcacggtagatcggtctactgcgggcgcttgtggccgatggcgcacgggcacgtcctaggctagcccggccatggcgcacggcagctcggcagccaccggcgacgaccggcggcgagcagcggcgcgcagcgagggagggagaggggaaaaaggaggggagggcgtcttcacagcgaggtccggccggcgcgagaggaggcgacggcgatcgaccggaggtgatgacaagtggcggacgtgcttcgggagaacctaaacaaacactcgagaagagttagagagagagggaaaggtcacgacgcgtggaatcgccggccaaaggcggcagcaatggagaagctcaccagtgcacgacgaaagatggcttccggtggcggatttcgacgggggaggggtggacggcgtggccctcgggctcgcgaacccgacggtggcgacggcgaggcttggcggcggctctaacggcggtgagcggtgaccggaggtggctaaagcggcggcggcggttggtgcacggtgctagggcggaggagagctcgggagcgatcaacgagaatgtgaaaaaggaggaggaggatgcgggggtggtttatatagcccgcaagaaaaattccacatgccattttcgattattaattgcatttattaaattggggtttctgtcttgcctttacacaaataatttcttgagaccatttattaactcaatttaggcttgggagaagaacttcagggtgtgacaatacctcctcttccggtttgacttgctgaatacagtgggtagtactcagtcttgctctctcttccccacaccagagctgaagatcttcccagttggagctgtcccgttgaagttggtttcgtcgctgccatcaaggatgcctatggagtggagtcgcctcgctgcaggagtcaagctttcaagtctagctcatttatcctttccgctgcatttgtaatcttttatatttttgtaagacgtagatttgtatgtcaacaattgtcgtttgtgtaccctggctagtcctggacaggggttttaatgcacattgtgcttagaaattctagttcatgaatttctaggcgtgacaattctcctccattttgtgttcattctctgcaagaggttagtaatcctagtgatagtggaatatttttatttgaacacaaatatgcattgcaagcataactagtctcctttattttggtaatatcgatgggtgaaactgatcgctaacgaccgtcaacaaaaacccccaagcttgaacctttggtcatccctagtgaaggacgaaaggaaacaaagacttggttgttgatcaggagtcgctattatgctgtatatctcaaatgtacaggtgcagggtttgtgtactgtctcttaaatcaaataatctttggcacgatggcttaccgttacccctgattaccacgagacactgcctttccttatcttgagcggttgagaggcagaacagcaatttgagcaccaatcacccaatatttattcaacattcattccggaagtttttcaaatgattttgcgaaagaaatccaagttcctcaaatgattcactcgatctctcagggtgtatcaatttgaactcctcaccaatttgcctttttgattccaactctaaggttgatatgtggagctcagtagggatcaaacatggcatacttgcattaacatttattactaagtaaaaaactatgactaaaatagatgactaaacatactcaagatcaagatcgtgcaaagtgtgtgtgtgtgatatatatggtacaaatgaaatgtggaaactaaagaaaaagcttctcctatgtgcttacttccttctccaaaatccttctttcataaataagaagagggcatggctacacattattttcttttatattttctttctcaacatcatgctcatgattgagagagcataacattattattttcacaaccatgcctttccctccctctcttttttttcataaaggattttctttttaggagaagaaagcacacaaaagcatggagaatttattttgatggtggtatggaaatggaatggataattgctagctcccggtgtaggagtttagcgtgtgtgttgacggtcgttatcgaccagtttcgaccgtcagtattacccaatgtatgaagactagctatgcttgcaatgcataaattccaaataaaatatccacttccactatatactatgctactaacatgtatataggagaatcccctgctgtgttctcttcaaaaaaaaacatgtatacacgagaagcacacataaatggaggagaatcgacataaaattgataaaaaatcaatcagatgctgtcgaggatcagacttatggatagatgggctgagaacacagaaaagacatgatcaattaagcccaaaattccatgttttggattgaggagcaaatgaggagtcggcccgccaaaaattgggccgtttgggccagatcatggttcggtcgaaccccttgtttcggccgaacccctatcacagccgttcaggctggggtttggcgtggacgctccagatgaactcctgatggcggttgcggggcatttcggacaactcctatgctctacaaccgtcatacctacctatttaaggagccctcatcctcacttcacaacacacactcaagcaaggattgaagctccattttattaatataatatttcttctttatacaaggtcggtactttattccattcatagaatataggtaccattcttagtttattgataatcagtataatcttagtagttaaaccttctgggattttcattgatgctggtagaatgtctgataactgggtcataagtctgctctggctaggccgagagctatggcccggggactcagatgctctgcaccgattgcaaggctgtagagtaataagtagttacttaagcatagggttcaggttatcacttatcattatttgggggtatattcgccgggagagtagcaggctgctgatggtgacagctcagtatgggcgtcttcctcgcagtttatattcctacatacaatttcctggggttggatacacctctatatcctacttcggttggagggttatgacatgttgtcgtaagaaactcgacaacccttgctaactttgcgttgcatcgggagggcatagctgagttccggtttagctatgctgcattattaaaggggttatactacatagagtatactagttagaatagactaggatgttgtatactagaagtacaggagtgagatatttctattctatttccacttaatcatatttaggttaaggaggagttagcggaatccttagctgtgtgtcactttacccttaagcttaacttacccctgcatagaccttgatgtatacaagtaatatatatatactattagcatagtactctcttatcatatcttcccttgggataaaataattacgataccttggaatactcccgggtgaaatgctacaatggtatatccgtgcgcttgcggatcacgtctgtaaccgtaatatatcaaggttatttctagtgctattgctgggaactatatttccagttgtgtcgctaagaaataccaacagtgtgcataaatgtgggtgcatgatcttgatcatacagcatgagaagaatctacacgtgtctcaaggatttgacaaagttcaatggaattgcaaataaccaaactatatatggcttgatcaatatgaatatttttggctttggtaggaatttataatatcaaatgaggaacttcatgattttgtcattttgaaaaataaaacatccggaatttcaagtcaaactcagactaggattatagcaacttttattttctatctcatatctcacaacaacttagatcagattagcaaatgcaactcatttatctcaggttcccggatggctactcatattcaatttattagagagtacttgaccatgaacctataaatgagagatataaaacggagcagctattcatcatttcatcaaagagaactaagttgtcttacctagcataataaaatctatcctatctttttggtattttttattttgcaaatttttatgttgtttttagtttgtaagatgcaattggaaaaacaaacatgcatttgaaaaggaaaatatgcaatgatacaagttaccttagtagggggagagatttctccccccaagcttggctttcgctcagggtccttgataaggattgaatccctggaagcggaagtacgtttgaaggtcatcgtgctgttgctgcatcaggttgttgatgttggtgaactgagcatcagcattttgttgccattcttgcgtctgtgctatgtgttcctcgaggttgtattggatctcttccgtttgcatatcaagggtatccattctcctagtgatttcacctaagtcccaacgagaggaacttgagcgccattcaccgagagatggaggcataccgcttgatctgggggactgatagttcaagcctccccattgtatgtcatgaggcactgtcaacgaccaaatttggtaattcaagtatcggagatgaagataaaatcgaagcggaatccaagagatagatcgaccggaaacagaataagaatcggatgaagtccgaatcggctgcgatcagaatcagcagagttcgagtcggacaaggtagccgattgggccgattccgacaatgtgacccggtacacatcgttgggttgagttaatgtgcttcatatggattgccacgcacggattgggtcctgtaaaggcaattgtatctattaattaggatattttatataatttccttagagataagtttgggcaaaagtttgccgcaaagacttatggtatcttaaagtttgttagagataggagttgtgtccgacaaggacatattttgtatctcgggtataaatatgacccgaaccgatataatcaaacaacaatcgttcaatacaatctcggcgcatcgccacccttttggctttcgtttatttcgacgagttcttgctttcgggttgagctgcatcgatttcgatcttcaactagaggtaaagcttgttatggcggcttgcgttatcggggttaatgcttccatctttatgatactttaaccctgtctatgtaatccgtcgagttatcatatacatgttgcaatctatgctagtttcgctatatagcttgttatcggctggttcttattattagggaacaatcggtagagttatattttgttattaatctagattgtatcgtgtatttaccatctcttgtagattttcgtcatcttgtttagatatcatacttgtctttatgcttaatgctgcatcggttgagttcaatctattaagtgttatttataattataatatctggctcgttttatgattatgaatagagatagtatcggggtttcagccgatcttacctgatttagccttatgtcttacatgcttaattgatatgctaagtctgttctttatattaagatcttattgcaataaagtatattaggcttttgtttgatatattctatctgttttaacatcttagcatacagtagtatcggagtactagccgatacatgctagatctatctgatcggctatgctacaagcgtttataacctttaggggaaggggtccgtattacaaaatacagtccatatccctaacagaatatgcgattatagataaaatacaatcgtaaccgactaggatctcgggtatttccttgacatacaagttagaaactaacctgagtcctcataaagatattctgtcaatatttggtagcacatacccaactaaactataactgccgtgtagatatggggtatccataatctccacaggagccccaaagacctttgcagtcgacgaaattgctttctcagaacacaaagcaataatccgagtgtttcaattccttctgctccagcctgccgagtgcctaaatcaaagactgtgaagggcgaaaataaaatatggtgcatcgagtagatgcacctaattaggtgtagcctcccgactatatggttagttgaaaaactagacatgtagtcaagaaccgagtggttttacagccaaatagcaaattgtaaagttcgtatggtattcaataaaatacccagccgactgcctttcaacttgaatatatcaagaaaaaatatgaaaagggcccgagcgataaacactcaaaaggtccacaaaaagacacatttgataaaaatccgagtaagaaactcttaaaatgatccaccaaatatgataaagatcatggtaattaagaagtttaatatcctaggctataacccttaccataatcaaaataagcatataacatgccaaaagaatgactcttaataaaccagtcatctcaaatcaacccaaacagcttttgtagcctaataaagctgacaaaaatagtataacacctttctgtcgggcacctttttcatctgcatcgtggtaattccaaagaattatcaaactgcattaaaaaggattttaacagcgtcgggtcacatcattgtgagctcaaattgccaaagcaaaaagcgcctaagtccctagggatcacaacgggccacactgataacgatattgggctgaagtactgtacaggcccaggcccattagtactaccgataccctaacaaaacaccgaagtccaagcgtcacttcatcttccccgccgaaactctcgccatttccctacttcttgctacagtacaaaaccgcaccgacgaagctagggtttatcaatccaccccaatccactctcaaaaatccacaaaacttctccacgcgcccaccgcaccgatttcccattcctctccagctatttctcagaccgaatcagcctattcgactcacgtccatggcggaagagagagaaagtttcgagagtcagtgggcgccctccgatgtgacggaggagaatctgaaggaaatggtggcgcacggcattcttccggcgaaggaaatcatcgggtggcgaccagcgttcggggaagcattcccgacccccgacacacgcgaggtcgtggtattttctcacttcttttatggcagattttccctcccaacttcaagattcttccgagggattctgaacttttatggaattagcctgcatcatctgaatccaaactccatagtgcatattgcgaacttcattcatgcctgcgaagcctttctgggaattaggcctcattttgctttattccgccgcatctttttcctcaagccccagccgaacaagagcaaaccatgcgttgttgggggcgccggcttccaactcagaggaacactgagccagaaatatttctctatgcctttcaagacctcaaacaaagggtggcacgcaaattggttttacgttcaaaaccctgagccagctcttcccgagtactcttgtctccctccggtctaccaggacacatggaactcattgcctatgggagatgaggctgctgaaggagtggagctaatggagcgcatgataaagctgaaggaacaaggcttgcaaggagagcaaatcactcggcacttcataaaaagtcggttactccaatcaaagagagatcccgcacagcttttgagtttgacggcaaacatgatccgaatcgtgaagacccagattcccttgatttcaagctcatgaaggagagaatgtataaaattttctcgaatgcaattgtggtcagctattcgcacttgctgccagtggtgccgtacaacgccttcaaccctcctccaccggtaagtatcgatcatctcaacctttctataaagcgtgcttttaccttctgccaaattgacggaaaacttgaaatataggaattcgctttgatgaaatctgacccccccgattgctcagcaccgcagccagtcagacttccgcaagaggaaactagccttgagtgatgatgaaggcgacaacgctaagaaagctaatggctaggaaacagctggaaaacaaccaaggcaggctaatccaaagaagaaaacatctagtcgtcccatgccgaaaatccgaaagtcttccaggtacaaatcatttgacggtcttccttgtactggcgctcattcattaaaatcatactgataacatgattcaaacctgtaggaagccatctgacatagatccttctggaaaagactcaggccgactggcatggaaacaggttcttcaaaagagactgggccaactgcagggaatcacccgagtgatgaacagccggcgaccgacaatatagatcccagcagtgagcccccggctgggagccaatcagccgaagctggggttggtgcaagtcaggagctcccgactagaaaccagtcggatacggagcaaaacaaggacatccctgaagtagaagctcaagctgacagccctcctaaaaaagatgtcaacgtcgatccagggtccagctctcctgctaaagtacaagggcctacccatccccgaccggaaataatcacaggtaaatacgtcctccgaactcaatttggtccgacagatttttcttcaattgcttcatctttatttataaactcctaaggcccgatgatcggcgatgaagaagaaatcctgaggatccagtcagctgaggattcacacccacccactttaatcaagtggtgggacgatgataagcaacctcagggaatcataataaacaggcaaaaagaagatgaggaagtgtgcttgctgaaaaaggcactcaaccaagccactcgcattgtaaacgtaagcttccctatgctcagctccaactatcctgttttccattttacttaaacgccaataaattcgcattgcatagaatccatctcaggaacgaggcgaagaccgcaactcttgcaaagttagttcctcatcttggaagctcgaggccaccagaaaccagttgcacgaaattaaggaactcgccaggaaaactgagcatggtctgagagatcgagttgctgagctccaagagtccaacttcgaactaatcggttcatcaaaaggtaaacatgatccccgtctgacttgcttatgctaccatccttgtcatatcgattaatcaaaaaacaatacagtgcaagctgccaggatttctgaattagagaagcaggtccagaatctggagaagggcaaagccgaattggcaaagcagagagactcggctctaaaagacgttgaaggtactgatgactgatacctcctatcttcgtgaccacttgttgatgtgaatttatctgtgcagacggcaaagtcaagtcccaagcccaaattgacgtcctggttaacaaaatcaagaggcttgagggagcttgagatgaggttgccaacgctgttgcaccactcgtccaagccatgttttataataacaatggtccgagttcgttcgatgctgctgaaatctttgacaagctgagaattgctccagatatttattttaagaacatcaaagaggctggaagtatgggagcaagcctggcgttggcgatgaccaagtccttgtactcgaagattgatattgacgccgttgacggctttgcagacgggacaagtgaagaagctgctctcgacctcatcaatgacgcgcagaaagccgccgacaagatagctggtgacatagttgaaagattccaggacaacgacctccggccggctggatctaataattctgatgatgaaaaaactgacactgattgatgttatattgtaatagtgattctgattatgacgatgatgatggaggtacaatttgtacaatactgatgaatttatgctgtgcatgatatttcaaacttagctcctgatttcttaaaagttttcgtcaaaccttgttgagcctaaaacccgcaaaagttgttaaaaaactttcagtcctcattggctaagccagaaaatcaaacagagcaatgataaatcaagtaagcaaattgaattaataaaaatcatactccattattatagtagcccccaactgataactcaaagaaaggcttgatgttagcagttaaagaggaaaatacaaaagtaatgcctaagcataaaaacgacgaagatgttcaatattccaagagttgtcgatacgagtaccatcctcacgtttgagtcgataagaacctggtcgagtgacttcagatatgataaatggtcattcccacaagggagataacttgtgccgatcccgtgtagtctgaatatttctcagaaccaggtcgccgactaaaaaagctcgtgagcggacattgcgattgtgataacggtgcaatccttgcaaataccgagccgactgaattaaaactgcttcacgggcttcttccagtcggttgatatcatctactcggtcctcttcatagcgctcctcatggaagttccgaaatcgtagcgattcaaattccaattcactcggcaacattgcttctgctccataaactaggaaaaaaggcgactgtcccgtagcttgactaggggtggtgcgcaaggaccaaagtactgacggcagctgttctacccacttgccggtgtaaggacgcagccggtcgaagactcgcgcttttattccttgaagtaccatgccattggcgcgctcgacttgtccattactcatggggtgtgccacggaggcataacaaattttaatgccgaagtcttcacaaaagtctttaaatactccacatgtgaattgagtgccgttgtcagtaatgatacaatttggtaccccaaaccgatgtacaatattgatgaagaaatctctagctttgtctgcggtgattgtaatgacctgtttagcttcaatccacttggaaaatttatccacagctacaaagagatgagtataaccaccgaccgcctttttgaatgggctgaccatatcaagcccccaaaccgcgaacggccaagacagcgggatggtttgcaagtcctgagctggtaaatgagtttgtcgggcaaagaattgacaaccctcacatgttcgcacaattttgtcggcgtcggagacagctgtgggccaaaaaaaaccttgccgataagccttgccaacaatggttcgtgcagcagcgtgattaccacagatgcctgaatgaatatcttttagcagttgcctttcctcttccaaagatacacagcgttgcaagattcctgatgggcttttcttgtacaactcggtctcatgaatgacatagagtctgctgcgcctggagatctgctcggcttcatttttatcttgagggagttcttgtttggtcaaaaatcttatgaaaggttctctccagtcggcttcgatcatgcttacgccttgagtatccatggcttcaattgtttcttttctgggcacgattggttcgtgaagatgttcgacgaacacatcagaaggagctgcctcccgttttgagccaaaattggccagtctgtcggctgcctcattattgtgccgaagaacgtgggtgagctcaagtccatcgaatttgtcttctaacttgcgtacttcctgtcgataagcagtcatgttatcatcaaggcaggaccactctttcatgacttcgttaacaaccaactgagaatctccacggacgatcagacgccgaatgcccaaagagatcgcgatcctcaatccatggagcagcgcctcatattctgctacgttatgggacgcagaaaaatgtatccacaatacgtagctcaatctttctccagtcggggagattaaaacaaccccagctccagtgcctgaaagcctcttcgacccatcaaaatgcatggtccaatattccatcttttcctctggcatgtcttcttggcactcggtccactcggcgacaaagtcggctaaagcttggaacttgatcgaaattcgcggcttgaaggatatatccaaggacatcaattctaaggcccactttgcgatccgtccatttgcttcgcggttatgaagtatatccccgagtggaaacgatgtgaccaccgtgaccgagtgaccttaaaagtagtgagataatttcctgacggtaattaagactccatataataacttttgaacctgaggatatcttgtcttggagtcggccaaaacctcgctaacgaagtagattggtcgttggactttttgaacatggccgtcttcttcacgctcaacaaccaggaccgtgctcacaacttgagaagtcgccgacacgtataacaacagtggctcttgcggatgtggtgaagccagaactggaggagtagtgagaagtttcttaaagtcttcaaaggctttttgtgcttcgggtccccactggaaattgtcagttttcttcagcagcttgaaaaagggcatcccccgctcgccgagtcgtgaaacgaaccggctgagcgccgccatgcaaccagtcagcttttggacatctttctgggagctcggcggtttcatattgaggatggcgttgattttctccgggttggcctgtatgcctctatgagacaccataaatccaagtagcttccctgacggtactccgaagatgcacttttcagggtttagtttcatcctgaaagcgcggatgcttgcaaaggtttcttctaaatccgcaattagaacatccttctgcttggtcttgacgactacatcatcaacataagcttcaacatcgcggccgatctgagctgaaaaacatctctgaatcatgcgttgataggttgctcctgcgttcttcaatccaaagggcatggtgatgtagcagtaggccccaaaaaactgaggtcttcaagcagttggattcgtttagtcggatctgatgatatcccgagtagcaatccaaaaaactaagtagctcacagctggccgttaaatcaactacctggtcaatgcgaggtaaaccaaaaggatcttgagggcaagacttgttgaggtcggtgtaatcgacacacatgcgccattgcccggtcttcttccaaactagaattgggttagccagccagtcgggatggaggacttctttgatgaagcccgctgctaacagcttggttaattcctctttgatcgcgtccttcctatcctgtgcaaaacggcagagtcgttgtttgatgggtttggcatcttccttgacatgtaaagagtgctcaatcacctctctggcaataccaggcatatcagatggtttccacgcaaagatatctttattattctggagaaaggtgatgagcgcgctttcctatttacaatctaactgagcgcctattacagcagttttggtaggatcggagggatctagtggaatcttcttagtcttggcgtcactttcttgagtcttcgacatcttggtcgcaggcacttctccttcgtttgccacggtcgcagccagtcggatctcttctcgggcgaatgtgatctcgcgggtctgagccatctcgcaactttctttatcacatgtgacggcttgcttgatgttgctccgtagggatatgactcctcgaggaccaggcatcttcatcatcatgtaggtgtagtgtgggacagccatgaatttggctagggctggtcgtccgagtatagcatgatacgctgtctcgaagtcagcaactttgaaacaaacgttttctgtgcggaaattgtcccaagtaccgaaagtaaccggaagagtgatctggccgagtggtgtagcagataatcctgggatgacgccgtgaaagggtgcattacttggctttaattccgtacgagggatctgcatatcgtccagggtcttggcgaaaaggatgttgagtgcgctgccaccatcgatgagagttcttcagagcttgacgttgcgaaccactaggtctagtaccaaggggtactgccccgggtggaccactcggtcgggatgatccgagcgatcgaacttaattgctatctctgaccaccgaaggtattggggcgtgttgggctgaactgcgttgatctcccgttcggttagcttctgctttctcttagattcataggccaggggtccgctgaagatgtgattaagttccttgcgatggtcctgaaaaccagtcgggggatcgtcttcattatctttcttctttgatgtgccttgatctccgtccgaaggcttacgtgcgttcttggcgtattgctctgcaaattgtttgtagacgaagcagtctttggccgcatggttggagttgggatgatgcggacattgggagttcattatcttgtcgaaggtgttgacgcgggaacgttgtcgggaagatggagtagttgtcgccacaagttcttcgggcttacgcttgcgatccttgtgattgttacttccactccctcccgcagccggcgtgtctttcttcggcttccaagtggtgcccgactgtttggacgcagtaatagtatcttcggctttggcatactcattggctttttcaaacatctgcttaaccgtcttgggaggtttgcgtccgaacttgccgactaggtcctcgtggcgaatgcctttagtaaaggcggcgatgatgacgtcatcggtgatgtcggagatcttgttgcgttgcttggagaagcgtcggatgtaatctcgaagggactctcaggacttctaaatgatgttgtagagatcaaagtgtgtaccagggcgttcaaaagtgccttcgaagttggcgatgaagtggtcgcgtagttctgcccatgatccaattgtgccgcggggtagcccgtaaagccaggaccgggcagaatctgctaaggccacaggcagataatttgccatagctttgctgtctcctcctgctgcgcggattgcgagaccatagacagtgagccaagactcagggttggtggtgccgtcatacttctcgattccagtcggcttaaagctggctggccagtccactcgacgcagatcatttgtgaaggcagcaactccgtccatatcgtcgtcgtagcggtctagtgaataatggggagcatggcctcttgctgcgcggcgctggttgatggtgtcgcgaagatcgacggggcgccttcgatgtggggagtgtagtcgttcaactcgacgctccctatgtcgttcgggaggcgagcgaacagatcgctcgtcatgtcccctactcctgtgactggatccggcgccggcgatgctgaggcttggctggtgatagtcttgagatcgaagaggagggactcggcttccagtcggggtgcgggtacttgcagagttggctggaaccgaggcagcgatcatggtcttcgtctggttcaagatgttgacgacatgatcggcctaattgagcacgtcttccttgaggagggtgtcaaggagggtgattgctgcaaccgcgttctgttggggggtgcggaaaaccgctgttccatcaacgtcttgttgcccgatgagttctctcgctcgtcgcccagattccaaggcgcgctgccgtcgatcttcagcctcctttgcaatccgttcactatcttgttgctcacgttgtagtcgttctcactcttgtcgttgtcgttcttcttccagtcagcgacgttcaatttcttgtcgtgtgcgctcttcctccacttctcgggctcggcgctgttcctccgtttagttgtcagccatgaatacgccgaaaaagaggggcgtgtagttatcctcatagctatcgtcgaagtcgtcgatgttgccgtggtcgtagtggtagccgaagtcgtggtagtcgaggatctaggttggtcgtgaactgacgctaggggagctgaggtaaccatccaattcttccgtcgagactgtcccaagaggttggagtataacgccaacctccctggagctagattggatcggggccgaagccggatctcgcctagatcttcgggtgggagatgccttggtggtgaagacagcggccagatcatcaggaagtctcatcagaattgagggataggactcatcatcttgatctggtcgcgttggagtagattggatctcgtccgagtggtttgagaccaactcgggagagatgatcttggagtagacctcggcagagttcgggatactgaacggcgcggggacctggtctcttcccgactggttcgaatccgagtcaaggagagagatcttgccgaagtcgttggtgatgaagtcgaggctgccgaaccggaacgcctgcccggggggaaggcgaagtcgtcgatgccggagacggaacccatcgcactagtcggcaaaaacttgacgcttcccctacctggcgcgccaactgtcgaaacaagatttcggcaatactaaaagggggtggctatcaagctaggaaagtggatgggtttgaagacaaggaattttatacaggtttaggccttcttattcaagaagtaataccctactcctgtccggggatgattccgccgagtgtattattgattgtatattctgggaaaaagaagtcgtcccgaaaggaacctggacccctccttatataggggaaggggtccgtattacaaaatacagtccatatccctaacagaatatgcgattatagataaaatacaatcgtaaccgactaggatctcgggtatttccttgacatacaagttagaaactaacccgagtcctcataaagatattctatcaatatttggtaccacatacccaactaaactaaaactgccgtgtagatatgggttatccataatctccacaatatttctttcaataaatttatctttctgggtgacttagaagagctttttcacaccccacttcctgagcaaggtatagaccaatggcaaattctgtcaaatcacattcagtcaacatttcccaatgggaatcctgatcaatggaattatgtgtggaacccaaatgtctacaaatccaaaaagatgtatgatctcttcttttcgcatatccatccagacatacctctcacccttatttggaaaagcaaaggcacaatgaagataaaggtatttttatggcttctcctgatggacagattaaacaccaaagacatacttcagagaaagcatttcaacactcagggagggaccacttgtaacatctgcaacctgaccatcacaaaagactacatccatttattcttctcatgttcttttgcccaacaatgttggaactatattgggataaattgggatctgtcactagactttatgaatatgatcatgacggcaagaaggcttttccctcaacctttctttatggaagtattaagaattggatgctggcatatttggaacagaatgtgcctatcagattttcaacaatgtgcctatcaatttcagtaaatggaaagtggactttaaagaagattttactcggcatatgcacagagtaaaagtatcagataaacccagttggcaatcatggattaacatcatcagctaattgtcttgttttctcatttctcttctctttattttctttctcttttctttctcccttgtgtatattcttcctttgtacattatgttcctttttttatattaatatagcatagtaggagcctctcctgctgtttaaaccgtcaaaaaagataaaaccaatctgaattgtagatatgtcacgtcctaaaaatcgcttaaattaataatgcatattttaaatcaattttagaaattatttcaaaagcctacaagttaaactataataatctagggaaaatttcaacataaaattgagctagataaaatttcattaaatactttgcttgtttatctattttctagatttttctgggaattatttgagcaagggaagtatttttaataaatgaaatatcatttcacaaattattttaattaaaaaagttttaaaaaccctcccctaagccgttgggccgaattaggccgaacatcctctctccccgcgcgcggccgagcggcccacgccggcccatcctgagccgctgccccgccccccctctcacaagtcaccgacatgtggggcccacatgtcggattcacccccaacctccagccggccggccgagcaagccgagcccgagccgctgcctctctccgccaaattcgcccaaaccattcgcgttcgagtccgattggttgaggggtttttatccccttgttgtcctctatcttatcccccaaaaatcggagctaattgcttcgtgatttatccgaatcaaactcgttttcgagtttatctctccaaaactaaacctagattttcccagctcgatttctctcggttggagtccgatctctccaatccaaggctataaatagcaacccctagtcgtcctcttccgtttgcctcttgtcccacgcgaaacagtcgatcgtagcgccgccaccgcgccgccctagccgccgccgccgccggccgtcgttcagccgcctcgcaccgtcgccggtcgccggaacgccgtcgccgtcgccgacccgagccgcgccgccgttagagctcaccgccggccgctgttcattgtcgtccgtcgtgtttgctagtaccggtgtgttcgcgtcgtcgttctctacgcgtaagtgatgtagcaacgggggttcccgatctttcgatgagaggaggataaacttcgatttggggaaggatacgacgttggcggtccgactacaactaccacaggggtgctgcgccttagcaaccggtacaccgactccacgttgttgctgttcttgccgtgccaagaacaaccttgaacctgcaagcaatcgaagaacaagcaagaacaagttgacaaggaaacagctcacggcacttgtcaaatgatgaaatttaaacaaaccaaaatggggttctgaatacaagtatccgggtggtctagccgacacacgcgagtacaaggaagtagctgcagctaaacttacatcaaaacaaaacccaaagtgcaaaatggtggctgctaggagtttatataggtggaggaatgaccaggagaggaggtgggagcaaaccctaggttttgtggacccctaatgggctgtaatgatacaaggcccaagcccaagtttctgatgtaaagaactattttcgtcattctgagcagcctgggtcaaacttgatggtgaggccacacatagctgaaggtagacgacgagatctttccaacaagtactcatttgccccgtttgccctccggagtgaagagcattgacttcatcaaatcagcgctgctagtgctgcttgcgatttggttcctctcccatattcctaacaacaagtagatcacaacaaccatttagtagcacccaattctgagaagaacttgtatgattagctaggaatgactttacctgataattaagttcacgagctagagctctagtcattggtccttgctgtgcaataggcgtggttgtatcgttggaagggatgtcctcatcatcctccccttcttgcatttgagtcgtcctcgactctaactcatcttcttctcccaaatatggctttaaatctgcaatgttaaacgtggggctaaccccaaaatcggcaggtagctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngggctgcaggaatt

SEQ ID NO: 44981 - DNA, 956 bp, Oryza sativa
tggcgcctcgaaaaggaccatttctgggataagtttttccaggggtctatttacgaaataagtttttcaaaaggaccaaaatgtgaaaaatccaagatatggcgctgtggtgatagcttcacgacaggggtcggcatgacggtgggacaagctaccttcctccgcgtaggtccgtgcgacgtcggggtcgccaaggacagcgcaccgccgcagctcctcgggtcgtcgctggggtcagccacagcttcgccgtggccctcccaccgccaccccaacagcgcgaagcagctgctcctgcgcgcaccgataccgccgccgccgctgctctctccctccgctcgcgagccggcactgccgctacctccacccacgagctggcgccaccacagtcacctccatgcgccggcgacgctgcattgccgctacctccaaccacgaccgacgccaccgtagccccctcgccgccgccgtccccacgccgccgccgcccccacagagctcctccgtgccccctcagagcgccgccaccgcagccctccatctccacgagcgggtgccggtggggctccgcttcacaccgccgccgtcgccgcacgcgtagctcgccgccaccgcacgatttgcacgagagagagagtgtgttgcacaagacagtagataaggtttggagggtattttgggtattaggaatattataaacattttctttttttaaaaaaaaaccttaacggagtcgtggaatggaggtcagacgggagcttcatttttgaagagggtcaaataagcaaactttaaaaagtatggtcaaattaatagttacagcttaaaacggagtcagataagcaattgtccctaaatctcttaagtggatttgagtagaaaggagagagagtaagagcggcactcgagcttagacagggtaggtgcaatggtgtgtgaggggagggggggggtga

SEQ ID NO: 44982 - DNA, 860 bp, Oryza sativa
tttggctagtctcatttggatatgaaaataaaattgatgagaggtatgtattaaacttcatatattctaacttggtctctcttgtggatccaaaatatagtgtgagctccgtcattgatcttgattgattatgtgcatatgcgttcctttatatccatatgtatgcatatcttaagggggagtttattttatattttgtttattataagatctctagcttgatttaaaattatcgttcatctcatctttctatattgttatatccagttattatctatcactaaagagagaaaagattgaaagatctgggattaaacaatttgtgtaattgttactttggtgatagatgataaaccaatgtttatgggattaacctctcttttttataagttgtcaactaggttatttcccaatgatgagatgtggtagatatgcattctttggtgatggaccttaatcatgataaggatgaaatgcatggagataaagcgatatgtatcacttcttactcctaccttttgataggttcatatatatatgattttcatgttattgttatataagtgtgagactaatgtttacttgagtcttatcttatttagtctcctttacattgagaacatggagatcatgaaggtatgtgtttttgtttatcattatcattgctacatgccttctccatgtgtataggataaacctcattgcttcttctttacttatgcatacacttgcccctcttataaatttatttgtatgcatatatttggggggtgcaaatcctattcatttattgggtatgttctatatccatgttattctcctcttatttatatcggatctttgcacttgagcttgcgtac

SEQ ID NO: 44983 - DNA, 4603 bp, Oryza sativa
  unsure (1)..(4603): unsure at all n locations
nnnnnnnnnnnnnnnnnnnnnnnnnnnnnnnnnnnnnnnnnnnnnnnnnnnnnnnnnnnnnnnnnnnnnnngtgctgtgcagttgcgagcatgtttacagagaggcgaagcgccgaagccggcgatgtgaactgaacattttggctgttttgtttttgttttcttttttttttaggcagctcagataaactggagccgtgttggcgaaatgatgggtgggtggcagctgccggtgcggtggcgctgccaccgtgccatgtgtggggtggattgccgatttgctgggtgctctggggctttgacatccatgatgaattccatccaccatgtgggctgtggcgtcttgcctgcctgcccatctatttgactctcttgcaaattgcaatatgttgggttgattctggccaaatcgatgcaaagcttcccaatgtggtgaaagagcactcaatgatgtagtgtgtgtcctaggatacattatcaaacagcattgatgctcttcataatctacattgaaataccttaaattgtcttttagaaaacctgaaactgaaggttttcagtccttgtctatcccattgcgcagtttttatcataagcttcctactctgattcttcttggagggtcacagtgtgatatacctttgtgctcggtgtttttaactgtgttcagtgttcataaggaggcaaatgtttccatttgttcttgctagtttcactggagccttttgattatcactaattttcagaaagaaagggtgttctgtgtttggttagcatctaatactcaaacaaacgggagaggcagctgccgtgtcaccaaaagcaaaagggtatatatcacatgagaacatgggggaaggaatcatccaatgaaacatttgctccctccctcttcctaccgaagctgtttgtcatcttccggttgcacctagacttttcaaggccttttcagcaattggactctgccttttctacgcaggaaacaatcaaacatgccagccattgcaaccatcacaaacatcattctcatcagtacaatgcaaaaactgaaactgcatgcctacatttctcatcagcacaaatgcaagcgtgtgtcacgttttgttcctacgatatgtttctgcccaattctttccaagatcagaggactttgaccttacttacaccatatattccttgcggcaacgtgcaatcatcccattcagtcaaaccgaaaaatcaatcgacagaaaaattatctcatacgccaattcattcgacagaaaaatcatctcatacagtcaaaccgaagggacctgaaatgtgatctggaagaagcacgcgagccacacacaaatcgacggattgcgcggctgcagttcacaagtcgttcacaagtccaactccgataataacactcgggcctcacctcacctattcttcttcttttcattcggttgcttcctctcgccgccgacactggcttttattaaatgaagggcaaaggttggttgcgaggttggtagaagaatcagacgagtggaggggcacaacacagctgcaagcctgcaacaactcatttttctcatggaagcagtttaactgacctgtcgtcactctgccatcaggctgtaatatgcttgtagttcttgggacttccagttcagaggtaggtagatagctgcagagaaggaacaaagaccaatccaagagtactccagttctgcattggcaaaagacagggtttgtgctgtatatgtacgtaactgacaggcaagagaagctggcttttgttcagctttccaattattgatttatagttcagtttcaaagcataggaggtacagtatggtatagcctccaaacatatgccaattgtaacaatgacaacttacaactccattatgttcaattgttctctccagtcccaaaacaaatgccatctaagctaatggtacaagctgcaactctaacaatgtgctgtgtggtttggcttcatgcaagatcgaaaaccatggctgaatacctactatcatagaagaccatgggttctgcacactctgcttctcaagactgacagaagtcacatatgactcagaaaaatgaagttccacagcagttaaaagtgcatatgctgaggcatttcagctagaaattactgttgaagatttcctgacaaagtgaagggaataacagcacaaatctactctctcattctcttaagcagataccgaagagaaaagaacccgagcatgaatgtttgccaaaaccaacctgtagcattcctcgggtcatacttctttgccaagaaccaagcataaacagcttcaccaacgtgcaatgcagttgctatcacaaagactaaccgaatcaccaactttgatcggaaaacaaataaatggaggtcaagcacccatttcaatggaccgacgggtggaaggtaagcagcagaaaacaatgccagcatgccaattgttacaaacagccaaggaaatatggttgggccatctagttcttttctcttcctctcctgccagtaggaaatagttgcagccaatccttctcgcgggctcaccataggtacatagccgatttcctctctagctttcaaatatgaaaagtagtgtgtaacacccacctgtcacagcgaactatcaacattagcttcgactatgggtttgacatcatgtttattcccactcagctataaaaatagaattgcaattatgtaattctacatttctacttgcctagtcaagaaattactaaagatcaacagaaaatgattaatttatatataaaaaaggataaaatagctgtaagcaatactgcacatccatcattacatcttagcactatattacgcttaacaagattcaaactcctaccaaacaaattagatcttattacccctcactcatcatgattaacaacagagttgccgtcacatgagaagatagtaacagtgtaaaggcatatttccataatggactacattaggtaaagtcattggaacatgataaataagccgaccttgtatacttcagcaggaaggagaagaggctgaggaatccatttactatccaaccatggatagagtagtgtatacatgaacacaaaaaatcttgagatggcaagagcaactgaggtatccattctaactcgtggaactgtgtaatccaaactttgaaatagaggactgagaaattcaaaagtattgacaggcgatcctgcaaacaaccaatagtttcttgttaagaaaatgcaacatttctttcaaattacaaacaacaaacattaagagcaattctggtaaggaatataagtgtaattgctcaagttgctaaaggagtaatggttcagtattgaatgtaaatatattcaacagagcatccagtagactcattacgtatgatctgtaagcaataaaaatttcaactccctctaaaagaaaaaaggtttcaacctcagaataagcaaaacaaataaatagctaaaacgagctatgcagtaaatcattttgaatagatatcctcaacaaagacaccaatgcagaacacaagagtgtaaactactgtttttttatggtagcattcagcttagtagtctagtgttcaacagttcagatttatcaatatgacaagacaaaaataaaaatggctgcactcctattcaaaagatggaaataaaattcagaacatagtgccatggtatcagaaaaggttaaccagtaatatagttgccctacaggctaactgcacttaccatcacatatgaaatatgcttgaccagcagctacaggaattcccttcctgtcaggaatatcatctaaaagtcccatgcttgccaatatcagtgcaagaacaagattatccacatagacccaatctgacttcacatttggatccccaatcttgaagaatgctaatcccaacttcgcaagggatagtatccttggaagatgccgctcttcacctggaccatagatagcggcgggacgtattgagcatgtataaagacgactgcttttatcactcctgtataaaaacatcaaatcagtaagacagcctgtatattaccaatgttcaacttaagtcccaagccaaaatgaaataattggtggtggatcttgacacatggaaagtagaaaatacgctcatcataggtgaaaacaacacatttgaagatattatatgaagggtatcggccgacccggcaaaattatatgaagggtatgtaagtggcagatatacatggcaatgaggcagacataagaatcatggcaaaaatggctcaacttacttagtttgccggccattactcttcagcaccaactgttcagcaattgatttgctacgcgcataggcatcaacatggtcttcaacagggaaataaggcagcgcctcgttcccattgacaatcggctctcctccaaaaaccacattatacgtgcttacatacacgagccttctaacaccatgctcgtggcaagcgtccagcacattgcatgtaccatttatattgacctcgtcggctcgcccagcctgtaccatttccttccctgacatgccatacgaagcgagatggaaaacacagtccacaccgcgcaaagccttccccacat

SEQ ID NO: 44984 - DNA, 16277 bp, Oryza sativa
ccaggcaattatgcgcagtacatcatgggtattgttgggttactaacttactgtcactgtgttgagaaaacaaaattcaagattccctaactactccaagagccaaaacatatgtactagctaatagcacagaggcagtagtttactccaatttcacactagttagcaacaaatccggaggtagaactatagccaagcaaagcagcgcagcgctagcgctccagtgcgtcttacttctaagaaaaaactcagtgaccgcgtcagttacagtgaaggaaaagccaaaaccactgtagtgaggatgaactcgagatggcggaccttggaagaagcggacgccggcgccgagcagctggtcggaccagggggaggaggcgcggaggtcgagggagcggacctcccgggcgccgcggcggagcagctcgaggcacagtgcggagccgacgaagccctggccgcccgtcaccgcgaaccgcacgccctcgatcccctcgttctcgctcagatgcatctctgactctccccccaagccgccgacgccgagatgcgctcggtggcggagaaaacgagggcgagtggaacagtatggctgtatgggtcgccggcgacggcgaccgcgctttactacctgtccgggtggagatcgtcggatgggaactcgaaaggcctatctctcatgggctcatgggccatggcccacgcggaatgttttttctaaaaaaaaatataaacaaccaacctgtttgtagaactaggcaagaattattttaagagctattttttagataagaaaataaccctctaaaaaaatagccctaagttgtttggattcaagggttgcttttatgtatcttcctatggagagagatagagagaaaagacgttttttcagtgagccccacccgaaataggctcaattagcaccccttgggtagaataattttttttgagtgggttatttccaaatagctcacccttttggatctttttggctatttggactattttttagggagggctaaaaaatatcccttggatccaaacagggccattgccactgtcttttaacatacgacgttattaacttttatgacattcgtcttatttaaaatttttatgtaaatattaagatatttttgtcatgcttaaaaaatatttaataataaatcaagttttaaataagatgaatgtttaaactatcttaaaatattaacagtattatatgtttaaaaaaaggaggaagtaaattggaacgtatcatggctttcatatcagaaaatttcattgcaaatgattgcatgattgcgtcactgtagcagacgctggagaaaagtagtggtgtggataagattttttaaataaaaattataaacaagaactggatgtgatttttaaaaagcatgtctgggaaaatgaatagacgagaaatgtgaaaagtggctgacaattttttttgattgacctgaggaggagaaaagagggaaaataaaatgtgtaaaatataggctgacaatttttttattgacctgaggaggagaaaagagggaaaataaaatgtgaaaaatatacggaagagaatagacgagaaatgtctgctgagaagcaaaaaaaataaaagaatatatcaaggtcccaccgagatttgaactcgggttactggattcagagtccaatgtcctgaccactagaccatgggaccattttgcttaaaaacccaagctgtcattatataataaaccattgctgtgctgcttaagagctccactccgaagcatccaggaattgcacagcgttgcttaggccggttctttcttgtcagagacaaatggattacaagatcgcctacaaaactagctatgaaccccagccagtgacgtttttggttgggtaagaagcaatcttgtatatgtcacagactccctccggcttgccggtgcccctcctgatcctgaaatacccttgctctccccagttcttgccccacgagttcttcatgatgatgtagtcctggccgtagtacgagccgtagcccacggccgtcagtgcatgatccggttgaatgccacattccccatcaaagatcccctgcatccagtattcagatacacccattttgtcagtttaatgtttttgtgctgatctgtactgtatcatggtgaatgaagattgaagaacagctgataattttgtttacccctttgtagaactgaaagtctctgctcccagctgctatccccacactgacaggctgatgagccagtgccttcagtaggcttgtctcgctgttcgccgggacatcctcgtagccggttatggtgatgactttggaatgaggctaaccaccagtcatcagttcatcacagcagataaattcaactgttagagatcctgctagatcactacatgtgtttacagctgaattgcctctgaagaagaagtggttttcatgtttctacctgcttttctctgcagtagccttcttccatgaggtatgggtagtcttcctctgtgtagatcccctggttccccattatgtatgcgaaggcgaagtccatcagcccacctcgacagccatgattgaaggtgttgtcgcagtccatcagttcctgctctgatagtgataccaacttgccggtcacaatctggtttatcccctcaacagctgccaccgttgaaaaagcccagcaacttcctgcaagagaccgttttctcttacagcattttcatggaacaaattgcatcatatcatacactatttcagatagtgatttagtattaatatgctgaaacagactgtgtgcactctcagtttcaggcattgagtatcgatgcgatgaaatagattgtgcacattttcaggcattcagcattaatatgctgaaattgattgtgtgcagggattcagtatcaccgtgctgaaataaattgtgtgcattttcaggcattcggcctcaatatgctgaatagatcgtgtgcattttcagggattcagtatcactatgctaaatagatagtgtgcatttttcagacattgagcttaccacattctccttggttcttgaccggtgtcactgctcccttcttcctccagtccactgcccagggcaagttaacggcgttcgcgtacctgaatgttgttgaaccatgtggctgagcatcccttcttgctaaccctggcttcagtcccaggtaactggccttgaattcttcatgtgcaatgtcagcaaaatgatttaagccgagccaatagctgccatttctcctgttcgtctccacaatgtgcctcaggtttcgcttgaagatctcatacctcttgaccttctcctttgggcttgcatagatcttgctatgttttactgaccatgatgtgaagagaccaacaagcttatttggcaatgcaagatcctcctgcgagtatccgacaacggaaggatcatggtgactagcagtggcagaacatgccacaaagcctagcaacaagaagagcatggagagcttggagtccatggcaagaaggctattgtttcctgccatggcatgcctagaattcatgaacactctttataatgaccagccatgtttcttgcaagtaattcactacacctgaaatctgaatacctgacaagggcccttctggctcaagctgtgaaggagtggtactagtaccttgctttatgaagaagctgcagttgcaggtatacttttgctctatagtttattcagaaaattgcttgatgtattactttattgttctattgatgacctcttatcatgtttaaattttgatttatgttaaaatagaagtttcttatgcttgcagccttgcaaacctctgaattggagataacttgctcaaccatgcgaagcaggtgcacaggcagcagtggatttttggaaggatggacaagtatcctttgcttatctgctcaagtcatcaccaaacagaagtacaccaaactattctattaccagatcaaccaaccattagtattttcccagttcgagcttggtgtacgtgctcataggaatgcagaattggctgggatgagatatctaaaagaatatagagaaagagaaatgtcttgaaaaaaagaagcaccatgggaaagaaagaactaaaaaatagacgcggctttgcctatgaaatactccatccgtttcatattgatcatcatttaacacaaattgaattttttaaattgatcatcatgttatcatagccccttcgtttgacgtgtaatattattgcatttaagcatgaaaattgagtatgcatgcatgtatgtaggaattcgaggtagtaaagctatcgtttcttagagcaagtttaatagtatagtcaaccactgacttcaaatcatctatagtcaatttagtaggaaattcatatactcctataaacatcactacacaatttatacttggtcgcacctgtcatacatacatgtatcttggagtctgtgctacagctggctacaaatctatagcccactgctcttctctcttctgttttatctcatcgaaatgtgtttataattggacctgctcttatgtatggggcctaagaggagttaaagtgtgcatgtttcttgatttttccctaccacatactcacattaaatgaaaataggaaagttaatacttttttttgtcttggtgaaaaagttatatggtaatcaatatggaacggagggagtaaatgatatggtatgataagtacacttaatttctttatctatttaatgcctgaaattatggaaactatgcccttttattcatatattaatttaaagcagcgagacattgaattcatagacataagttggaagtcgaatatatgcgcacaaattccaaattccaacgaaaccaaagtaatgaaactacttactcccttcttctaaaagtctaaaacttattctattctttggtttttccaaaagtttaagtcctatttatagtcattatgttttaaattaaattattgatcggaacccaataaaccattttattacttattggttacatgcttattggttttgtcacattgtaaataaattaattactccttggtcttggtgccaaaagaaataattcctccatcccaaaataaacttaattcctgggtttttgtgtctaacgtttgatcatccgtcttatttgaaaaaaaatatgaaaaattttaaaaagataagtcatgcataaagtattattcatattttatcatctaacaataataaaaaatagtaatcataaaaaatatttcatataagacggacggtcaaatgttgggcacgaaaacccaagaattgagtccttttggaatggagggagtaggtcttagacttttggatggagggagtattttcattttatctcctggcggagctaaaaagattttttgagcccaagcaaactatacttctagtatttattatataaatttcatcatcaattcattcaataacatataaatttaatggagtttttgtcggtgagtttgcgcggccgcctgcgatagccaggtgtggcttcacccctgcctccacatgtctgtaaaaatcaagaaaatccttttttaaaaaataattttatcttcttattctttaaacataacgttctaaaagtgcataacattaaaaaattctatttgcacaataaagaagagtaaggaataaattatttgtttgaaaatttggaattgcgttgagctcaagctaaagcaaaagatactggtacctccttattctcttctactacttaattatatcctggatactccctaaaaaaattatatcctggataaatgattgcaaagaggctttatctgcccattgcaacttgtatgtgcagccgaactgtggtccgcatcgtttgcttatttcctaataagccaaaacggcttattagaaaataaaaataaatttgtaggtaaaacttttataaatgtattcttggtgacttaaaagccaatgttgaaaaagaaactacgttgaaaatatctcaaaattaagcttgaaaattcaaaatttagttttttctttagctgattaggccatccgatgggagcctgtaagtgtcaactgagagcacaatcaaatgatataataagatctttagtttttctcccccacactatctgaatgtaatactcactgttttttcatttagatggcaacgtcatgcaaaaaatcagagccgtccgtctgtacattgatctagccgttcgtacgatgtcttcagttgcaggcttgcagctaaataaagtcatatatatatatatatatttgtccttcccagtccccagcccccgttcctagtcgtcgacgactccgctgctctccagtctccattcctcaatctgctccttgctcctcagcgtctccatcttcgccacggtgccgctgcgacaacggacagtatatggcatcctttgcaggaagttcgatggcgcctgtgtctaaaagatcgaagtagcgccgtcaacatgagcgaggagaagtctgcgatgcgctccctgtcctccacctcctgcaatccctcctgctcctcgggccgtcgacgggtggttcgccgcagcgtcatagccgcgacgtgcaggtgacagaggatccggcgcgacgccaccacttacccgtgcacgccgcctcctctcatccgctagctagcgccccctcccttctcctgatccggcctccgggtcgacggccaccaccgctactcttctcttcattgggctcaatggatcttgccgaagtttgtatcgtcgacggctatcgcgtgcttgaggtgactcctgcaacatggcgacaaccccgcgtgtcaaggaagggcagcagcatggcggcggggagcgcaggggagggcaaggtggccgggtggtggtgaagaagacgagcccgcgccttgagggaggacatgagtgggtggtccgctgcggcacgcgggtggcggaggatccggtgggcggcgaggcgtgcatcgggaggagggatgggtggattaagggtcgagcgcttttgccagaaaaaatcaagcttcgttggtccatcgcagtgaactttcggagagcaaggagacacatggcagattttcggagatgagaagcttaatttataggacgccacatggcccaatctctaaccagggatagagccctgatatcggtattagagatgagcattatagaaacactcggaatgtcacctcatgtgactaccccatacttaggcattttttacgtttttaatccctgtgaatacgtcttaacctcaaccgaataaatagtattttaaagatatcactatgcgttgtttaaaaaacaacactatgctgatcaattaaggttttggttcaaatggatttttttgcgtattattgagggagattatatactatattaacaagataaattaatactccctccttctatttatatatatgatgttttttagttaaaaatgaactaaccaacttcatatataagtggaaggatggagtaatttgagaaataaaatttagaaataacctagagcaagaggtacgaacaaaacaataaaagatttgttttttgagaatttgtatttgtataagcatggagaatatattgatatttgtaaaagcatggagaaaataatcattggcaatttttttaaagaaaaagtgaaaagaacagggcctagactcaggtttttccatcgtcacggacaatagaaaatcttggcttattcctagcactaggttagttttaacccaatatattaattaattccaaactaaaagtgatacaatgttttatccttaaggcccacttaaattatcctctgaattattactacatattatctgcctgattatgtgaaaaataaacttaacaggtggtatgaaacaagtcgactaggcattacagtagaggaaagtattttgaaaaaaaaacatataccaagtaatatgtgtaataatttgatgaagtggcaaaaagaaagaagacattgtcagggttatggataccacatacctaatagtagttgactaaatctcagcagtatccaccacataccatgtcctatacggaaacaacctgcggatataggaggagtttcggataaggaaagacaaccagagttctatatggaaacgacaagaactactcggattgtatccatattggtttccctagttctacttggacaagaggacacctatgggtataaatacaagaccccctaggaggagaggggacgccacaaagccataagccaatacaagccaacatacaccaagataagacgccggatatcgacttcagggataagcacggctaggatactgtcaggagagacgaaagcgctatctctgatctcgccgggtacggattcgaggaggaagactaacctgttgtcgaccacgagttagaccttcagatcaccatgccaacaacagttagataggctaccccaaatattgtactggtgtgattatggtgaataagagcaataccggcttcggccaacaagatgtagggttattgcctgataattcaggggcccgaacctgtataaaaatccttgtctccgtctcttttacctcagtctcgcgtatatcctaataccaacgatcctcatactatgcaaataccggaatcgcgacatcaaacgtcgacagacatataaaagtggtactcaacaatatttacacattcaaaaaggagtgtaacttaggctgtgtttagttcgtgtgacaaaatttttaaagtatatggacatacatttgaagtattaaacataaactaataataaaacaaattacagattccgcctataaactacgagacgaatctattaaacctaattaattcgttattagtaaatgtttactgtaacaccacattgtcaaatcataacgcaattaagctcaaaagatacgtctcgcgatttacatacaaactgtgtaattgattttttccgtccacatttaatgtttcatgcatgtgtctaaacatttgatatgatgaaaaagttaaaaaatttaaagaaaaaagttcgaatctaaacgataatattataggctaaaagttagcctgcgcgccaacgggagcgctcattttctagtatactaatctcaagctggccgttgtgccagaatttgattggtccacgtggcttaatcaattgcgaatgaattggtgaattcgaggggtcgttccttgagaaagaaaacgaaaacctctagacaagcgtaaccaaattctccaacattacacaagcgtaaagagaaaaaaaaaaaaaaagctccgagcacttagttgggcctagctagcccagtcgctcacctggacctgcccactcggtgcccctcactatgttgatgtatgcaagtgacgcgttgccaattcatctcctcctctcctcccttcctccttcccttcttctcttcctaatatagtctacagtataccataaaaaattttaaaaaacaaaaaattagaaaaatttatgtatagaaatactatatataaaaaaattaaattcaaattcaaatttaaatcaggtatataaacttttaacttataaactttgggtctataaactttaggtgtataaactttagatgtacagaaatactatatatatagaaaacatttgaattcaaattcaaattttaattagatataattcaaatttaaattttaatcgggtatataaactttaggtctataaactttaggtctataaactttaggtgtataaactttagatgtatagaaatactatatatgaaaaatatttgaattcaaattcaaatttgaatcagatatataaacttttgacttataaacttttagtctctaaactttagatgtgtaaacttgaggtgtataaatttactaaaataggaaagtaatgcggtgtaaaaaaaagaaaccaagtagagagaggggggggagaatctcgcccagtagcatttctgcctcaacagttgcgtgcgtgaacaaggaaaaggaattatgaggaaaacgaaaaaggaggaaaaaaattaaatacaagaaagaaagaagtaaaaatattttatataaattatatactatggcttgaatcggaaattgaggcagctaccctaacttcttcttcttctttttttcagggaagctaccctaaccaaatcgatatatttctggaaattaaagacaacaaaaagaatgagaggaacaatgcgaacttatatcataatttgttgtcacgataaccatgttttaaaatatgcatttttcacaaatacactacacatttgataatctctactaatatagaaagtacgaattcattaaacacctctctttcctaaccctcagatttagggcattcaacccatagtgtccataagcagcaatgtctatggtgccatatcaataagacatcacaatagaaactatactctacaacccatggtttcttaaagtgggctattaataaatacatcatttctctcctctacccacggattgccatgcatttggcactgactttccccgccctttttcgtaacaactccaaataaagatggcaccaaaatgatagttaccgccatagacaaggattcatttgtgaatgataaataaaagttacccatatcaagaccaaataatggatcaatgaaaaattgatccaaggggcttgaaattattggtccgccgcttccagggataactcatatttattcttcatctattataaagtcactattcttttccaatacaaaacttgatagtgtctagtgcataggttctcatgttgaagctgtgtcttgcatgagatccagtttcttcctctcttcactctctcttaattaatatagtgccacataagataaaagtcctacatggcaatatagttaatgccatagacaccatcctaaatggagggttaggaccgcccttattcatccaacgaatttatggctgtgtttagaacttcagctcccaacccctctctcgcgcacgcttttaaactgttaaacggtgtattttttaaaaatatttctatatgaaaattgtttaaaaaatcaaattaatttattttttaaaataattactaatatttaattaatcaagtattaatgtatcgctccgttttcgttctgaggatttgggttcccaacccgggctgaacaaacacagaaattagcgatcccactccgtgtgaacggttatagaaattaattagcgatccatctccccctcccctgccccgccaccttctccaccggcgccgacgcctcctcgcgcctaccccgtcgcccgccgccggcagccgcgaaccccgccgccgacgcctcctcacgcctatcacgccttcatcgcctgccgccttctccaccgccgccgtctcctccaccgccgctccttgccgccactgcatcctctacgtctccccgcacgggtggacgctcgccatcgaccccaccgacctcgccgcgtcgctcctccacctcttcaccggagccgtccgcgccctcccgccgctcccggccttcttcgccgagacggacgacctggcctgggactggtcgccgcatggcgtcatggcgtcctgcggcgagggactcctctttacgcctccgacccgcccgccgccgcctgggcccctatcgccgccatggccgactgcaacgcgagcagcatcaactactccggtggcgagttctttgtcttcgaggacgacgtctgctactgctgcaccaccatcgtcgacgccctcaccctccccatcgccgccgtcatcccggtgcccgccgtcgagctccccgccgaggcgcgcatcgcggtggcaggcgacgagctcttccttctcatcaagtccaaaggatgtacctcttcggcgacgacatcgacttctccaaggcttccggacagctttgacttggcctgacaggagctcaccggcatcggcggccgcgccctgtttgtcgattcctgcacggatttgccatggagaccgcgggattcgagaacctcgagggcaacaccatctactcggtgaccaccaaggaggtgaacgatcggcattccaccacgatgaagtacagtcggtgttcagcctggagaaccggagcttcaagaagctcgcctgctgcctcaacaagctggagatggccctctgcggcgagacgccgtcctggatcataccaagctggaacgaaggatgaacggaatcagagattgccggattggtggttcttgaagcaatggtggtcgacaaatctctgtctcactctcagaggatggattctaatctctcttttcttgcattccacttaaataattatgaaaaaattttaaaaaaatttacaagatagattaatacgtaatatattacttcacaaacatgtaagttcaagttcgacttctataagttgtaacaaaaataacaaattaaactctaactagtatatgtatatttacagtcaaatttgttatttttgttacaatttgtagaagttgaatttgaacttgcatgcttgtgaagtgatacatactaacctatcatgtcaatttttttaaaattttttcataactatttagataacattgataaccgcagcatcactattgcataggacgccggccaccttatcctccaggaggaccggtgcgcctgacatgcctttcgccgtcggcaaattggtaggggagaattcatttagatcatcagaatctgttggaaagaccactgcttcgcccctgcacatgcatgttgtgaaacagacagcgtcaaacagcattagttacctactaggagcagtaggtttgcatcagcgtgtacagtaattaacaaagctattgcattgaacatacatatacatatgtagtttcataaagaaaaatgtgaaagaaaggctctcgttaattacagtatgtggccgcgcgatgttcccggatcaatacacatggaggtgccgtcaagtccgaagaatccaatcgcgacaacctccttcccagacaaatcagcctcatcggagaatcccagaggaatgcagttaggcgccccttggacacggatcagagcaagatcaacgtgttctgagacgtgcaccaatcgagcagaggcgatatgatccgcaccaaaccgaacggacagttccttaggctgtgttcctcctgacacggagaacaaagcacacgatttagtgagattaattaagtattagctaaaaaaaacttgaaaaatggattaatataattttttaaaacaactttcatatagaaaacttttaaaaaaatacatcgtttgacagtttgaaaaatgtgtacgtgaaaaacgagtgaagggagttgggaaagagggaaaaagaacatagcttactccgcttaggatcgattacgtgggcacaggttaataccaagcacgacgctccatcgttgtgaacaacaaagccagttcccacgccaagtttcctgccttctttggtaaccagcacgcacgtcacctggactaccgaaacgcggtgttcgtcgtacacgcgctgttccggcgtccgcgacggcggcgaatcaccttggtaagcaacacaagagcaaaaagaagcggtacgttaaccacaagcaaattttttatttttttttaaaaaaaccattttcttttcttgcaagaggatcaatgaaattaagaacaaagcgctagttgcaaaggataggagtgcaagatttgtaactaacttctcttgcaagagatcgaatgaatgaaagaacagttaagttgtagatgagtgcagattcaaaactagcagcgccacagtaggatcttttggccttaattcaacagtaaatgggagggaaaaaaaaaagaacagctggcctacctgttggcgctgatgaggacatcttgacttgttggacttgcggaagaatgggacggagtatcggcatgtagagcgctgtttgtccttatatcatcgcccgccggacagagctgtccaaaaggctcgagacgcaagctagttcggctcgtttcaagcttgtttggagctcggctcggcaagaaatcaaacgccgagcccgttatgctgtgcgctttaataacttacgcttttacccccttcatcagccaagccatccaccccacaggccacagggaggttaagatgttgggttattaccccctttagtgtgctcaacatggacactgtcgatggccgctattgtcaccatatatacgagcccccacgtcgcgcaggaaccacgcccgtctgttcggcgccggtgttccaggaggtgcacccgccgtctgaggctaccatgcagtggcggacgcaggatttcaacaatgggggtacgaagttacagactacggactgtgtacatagtaccaaggaaacagttcgacgatgaaaatatactcaaaccactaatgaacactcaatcgaagcgcaggcatgcatatataaacaaagtatatctcaatctttatacataacttgttgtgaatgatttgtagtgaacaatgaacgaaaaaaatagtacagaagacacaactaaccgttgcgattgtagcgattatatggctgcaccacccataaagattggatccaatctagaggaagaaaataccattgaatgatacccaattatctctattatctagaagaagaaaataccattggacggatggttgtattgcttttttcaaagcctacaaatattttggcctaatgatctgtatacatagtatatattatcttttttgttaccaaaaattttgggggtacagctgtacccccatgtcccagtgtaggtccgcccctgctaccatgcatcctgcagctgcttttttgcatgtccagtccttccattgtggcattgtccattctagagtttggaaattaacatgaccaattgtacataagttttttttctttacacgaattgtacataagtatgttccatgaaaccatggccaagttattttgcaactcaactacatcaattgtgtaaaattgtaagttgattgtagtatttgttttaataggagagaaatgcgcatcactacttcttagagttgtctatttaggccgtgtttagatttaattttttttcttcaaacttataacttttctgtcacattaaatgtttggagacatgcatagagcattaaatgtggacggaaaaaaaaccaattatatagtttgcatgtaaatcgcgagacgaatcttttgagcataattacgtcatgatttgacaatgtggtgctacagtaaacatttgctaatgacggattaattagacttaatagatttgtctcgtagtttaccgacggaatctgtaatttattttgttattagtttacgtttaatactttaaatatgtgtccgtatacttaaaaaaaatttggcacaagaactaagcacagcctaaaccagcagtgatgcctagctagcaccaccgatttaaaaccgatagtaaatgtcccggggcatcattgtcgtatgcctcccacaggttctaaattaaaaccaagagcaaatcctattacgaaccgatcgacaggtctgtactagtgttcagcatcgtccatgatgagtactgggctactggcgcagctaggagctcttggaacggcaacgaatgcagcagcaggctatggcgcttcaccatgctctatgggaaggaattgaagaagagattaagttttttacacaaaacgatatggtatcaacatatgattgattgagttttaattattacaaacttgaaaaatatattaatatgatattttagagcaactttcatatacaaagttttcgcacgaaacacaccgtttagcagtttgaaaagcgtgccacgaaaatcttaatcttcatccaactcgtcacaataattaatatttctatgagttttccgctaaacccacaaaataaacacagggtagctagctagtctaatagtataggcaccaccataacaagactccatgtcgagactgtttggttggttcccataacatatacttcctccatttcaaattgatctacatatagtttttttaggttatttctaaatgatctacatatttgtatgcatttattaaagtctatttgttatttgtgcattggagcaaatggagattgatgcatgcatccatactgtcggtgacatggggccgggggtatcgtgactagaggcttcggtagccgcggtcacccacgtggcctgaccccctcgggggggggggggtcgggcccaacggtgacctgggcacccctccctctgtctccccgagggggtc

SEQ ID NO: 44985 - DNA, 20139 bp, Oryza sativa
tcccggtcagatccattccaggcttcagcgcaagtatggcaaggaagtcgctggccattaaatgaaggttgaaatgggcgtccaccgaaaaaggggcgagcagagcaggaaacgtgcgctctgcttgtcagaggtcacttctggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagaggggacgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcatctggcgcgccaggtagggggcgcgcgtgtctttctaagccctcgtcctctttcgtgtgcgccaagcttcgcccgctcagcccaatggccgaacgggcagtggcgcacagcctctctccgaacgctagcggtgacgatggggagcagaacccgcgccgtcgggctcgcaccccaccgtccccctctcgccgaaatcttgggcggggggaggcgctcagggaggttggaggatccgcgacttcgccgcccgcgggcgacgggggaggacggcgaggcggggcgcgtcgctgcctcgtctactgcgatggcggcacgccccagggcgcgctccaggctgcgggcgcgctcctgcgtcacccgcccgtcgtccccgatccaaagactccagcccgacgttggctggatgacgtggccgaattggtcatgacggcgcagcagcgactaggcgccggcgggcggtcctccgccaccgaggcctctggcgctgccgccgccggctccaagtcgtcgaggcggagggcgcggcgagcggtggccgttgcccgccgttcgtccgccattccctcgtcaacgcctccaacccaagaagatgtgagtggggggccggatgcccgcctcgatatcgagcgccggcgcgacgctcgtcacgccgcccacgcaacggagggcgcttcctcgtccggagcgccacttcggtccgggcacgggggccagccccccgtgtccccggttggcggtgccggctgtcgaacctttgtggcgagccttcggaacgtccgttggcccccaaggttccggcccaccatcaccgaaaaatacgacggaagcgtcaaccccgccgagtttctccagatctacatgaccgggatcgaggccgccgggggtgacgacagggtcatggcgaatttcttccccatggccctgaagggtcggcgcgggattggctaatgaacttgccacccgcgtcggtccactcttgggaggatttgtgccagcagttcaccacgaacttccagggcatatatccgcgcccaggcgaagaagcggacttgcatgcggtacagcgaagggacgatgagtctcttcgctcgtacattcagcggttctgtcaagtccgcaacaccataccgtgcatccccgcacacgcggtgatctacgcgttcagggggggcatgcggcacaaccgcatgctcgagaagatcgcctccaaggagccccagaccaccgcgcagctttttgagctcgcggaccgtgtggctcgcaaggaggaggcctggacctggaactcctccgtttctggtgtggcagctccggccgcccccgggtccgccgctcggtcagggcggcgggacaggaggaggaagaaggggtcggcccgttccgacgacgagggtcacgtcctcgccgtcgagggcgattcgcgggccccccgaaaggggaggcctgcgagcgacaaaaagaaggaggccggcgctcccagcagggagcgcccgaccggcaagtggtgtaccgtgcacaacacctccctccacgacctcgcggactgccgcgcggtcaaaagtttggctgagcggacgaggaagtgggaggaggagaagaggcaggagcgccgtgagggcaagaccccggcggctcccgccggcaaccggcgaggtgaggccaagcagaaggccaccgccgaggacatcgacgatggcgacgatgacctagggttccaggagcctgaggccaccgtcgccaccgtcgatgggggagcgtgcgctcacgcttctcgccggagcctcaaggccatgaagcgagagcttctggccacggcccctacccatgaggcgacgcggcgggcgcggtggtcggaggttgccctcaccttcgaccagaccgaccacccgccgtgcgttgcccggggaggacagatcgcgatggtggtttcccccaccgtttgcaatgtgaagttggggcgtgtcctcatagacgggggtgcagccctcaacatcctttcccccgcagcctttgacgccatcaaggccccggggatggtgctccggccgtcccagccgatcatcggtgtgacgccggggcacacctggccgctgggtcatatcgacctcccggtcaccttcggtggttccgccaacttccgcacggagcgggtggacttcgatgtggcggacctcagtctgccctacaacgcggtcctgggcaagcccgcgttggtgaagttcacggcagcggtccactacgcctacctccagatgaagatgtcgggccccggtggccccctcaccgtccatggcgacctcaaagtcgcgcttgcttgtatggagcagcgcgcggaccaccttgccgcggcgtccaagcccgcgggtggcgacgagaggctcagcacctccgtctcggccgccccaaggcagcggatggtcacgtgcgatgaggtcccggtcaaggaggttgccctgggcgacggcccgtccaagaccacacgaatcagtggtcttctggacgacaaataggaagacgcgctcgtctccttcctgcgggcaaacgccgacgtcttcgcctggagaccggcggacatgcccggggtccccagggaggtgattgagcaccgtctcgccgtgcggccgggcgcaaggccggtccgacagaaagtgcggcggcaggccccggaacgtcaagccttcatccgcgaggaggtggcgcgacttctggaggccggattcatccgtgaggtcatccatccggagtggctggcgaacccggtcgtcgttcccaaggcgaacggcaagcttcggatgtgcatcgactacaccgaccttaacaaggcatgtcctaaggacccttaccccctgccacgcatagatcagattgtcgactccaccgcggggtgcgaccttttgtgttttctagatgcatactctggttatcatcagattcgcatggctagggaggatgaggaaaaaactgcattcattatccccataggaacttattgttatacgacaatgcctttcgggttaaagaatgcaggtcctacttttcaacgtactactcaaatttctttgggtagccagataggacgcaatgttgaggcctatgttgatgacttggttgtgaagacgcgcaaccaagagaccttactctcggatctagcggaaactttcgaaagtctccgctccgcccgcataaagctgaaccccgataagtgcgtgttcggcgtgcctgcgggcaagcttctcgggttcttggtctctacccgaggcatcgaggccaaccccgagaagatacgagctatagagcggatgcgcccccccagcaagcttagggatgtgcagtgcgtcaccggctgcatggccgccctaagtcggttaatatcgaggctgggagagaaggcgctacccctatttaagcttctcaaacgctccaggccgtttacctggacagaggaggctgagcgggccttcactcagttgaaagcgtacctcagttctcccccagtcctagtcgccccggagccagatgagccgttgctactctacctggcggcaaccccgcaggtggtcagcgcggcgttggtcgtggagcgcgacgaggacaaccctcgccccgcacatcccagtcctgtgtcgactcgaccgggagagagcagggaggagaggcccccgagccgaacggcggcccgaggcccccgacggccggagctggccctccgcctgcttgtccgacggtgccaggcgcccccgacccccaggatggccccggggccactgcgggaaggccgcgcctgtcgccctctgaccccgaggttgtcggcacagaagccgagtgcgccccgcgtggcctctcggacgaagagcgccctggagatgcggcccctggcgaagaggatcggccccgccgaaaggtgcagcggcccgtctacttcgttagcgaggccctccgggacgccaagacccgataccctcaggcccagaagatgctttacgctattctgatggcttcgaggaagttgcgccattacttccaggcgcatcgggtcacagtggttacgtcttaccccctcggccaaatcttgcataaccgagagggtactggacgggtggtgagatgggcaatcgaactctctgaattcgatttgcgctttgaaccacgccacgcgatcaagagccaggccctcgccgactttgtggcggagtggaccccagctcccgagcccgtctccgcccccgaggccagctcgggcccctcgcagctgcctcacaccgcctactgggtgatgcagttcgacggctccctgtctcttcagggcgccggtgcgggggtcacgttgacctcgccgagcggagacgtcctcagatacctggtccgcctcgactttcgggcgaccaacaatatggcggagtacgagggacttcttgcgggactcagagtggcagctggactggggatccgccgcctcctggtgttaggcgactcctcaacatcctcaagaagcacggcgactcgtggatcgaggagctgccagcggtgctctgggcgaaccgaaccatgccaagccgagcaaccggggaaacgcctttcttcctcatctacggcgcggaggcggtcctcccatctgagctcaccctgaggtcccctcgggtcaccatgtattgcgaggctgatcaagatcagcttcgccgagacaacctcgactatttagaagaacgaaggcggcgcgcggccctccgagccgcgcgctaccagcagagcctgcggcgctaccatcagcgccacgtccgggcccgatcactctgcgtcgacgacctcgtcctaccccgcgtccaaacgcgtgctggactgagcaagctctcaccaatgtgggagggtccgtatcgagtgatcggcgtcccccgggcgggctccgttcggctggccacgggcgacggcacagagctgcctaacccgtggaacatcgaacaccttcgtcgcttctacccctagtgggggtcgggcgtcatgtctcgggctcgggccaaccccgcaccccccctgggcgtgcaggattggccgggggctaccacatgcatatacttaccttttttctcttccgaatttcaataaaagcattttcgacttcttgaggactgtgtctgtgccatcgtttccttttgaagaatcttggcttgaattagcacgctcgtgctcgaccctgccctcggcggcccgggccggctaaaatcgccaaacggggcccagaaccgagccgtgccccggggcgtggtgacctccgggggggaatcggcaaaggcccacaatcgggtcatccataaccctcggtcaccgcgctcccggcctggccagtctcgacacgaggatctccccaggcactggctccgacccgcgccgtttgaggctgggacctgggcacgagcccttgttcaagccaagacaaagaaggaccgcggcaagaaccatcctcgtctcatacacacaacaaacagaactgacgtggaaatttcctctttacttgattacagattaaatcagtctatacaagaagggggcccgaaagcctcggaagaagaagcaaaagttattaagattggcgggggcctgggggctcactccgacgcgcccgggacgtcggcctcgtcgtcgctgtcgtccgcaccgtcgtcaccgccctcctcgtcggagtcgagcgcgaacgcgagccgaggggccgtaccctcgaagctgtggacgatatggtcggtggcgtcccggaccttcgcgcgcgcgccgtcctcggttcctggagggaactcttccagcgctgcccacggggaaaagtcagggtccctggcctggtggcttgccagtacgagctccaccgccccccgggcgaggtccctcgaggatgacatgatcgtctcctcgagctccttggggagccgctcgagggccccggtcatctctgagaggcgctgggcgaggcccccctggttggcggcgtacttcgcgtgccgcccgccccagaggcccgcctgccgcccggcgcggtctagacgggagacggcgtcccgaagcatgccgggccctacttcgctcgccaaacggagggcctcgacctccccggcggacgagtccagcgcgccctgcagctcggcgatggtgtgttcggcggctgcgaggcgggcggctaggtcgccgtggcccgcggccgccccgccgctgtgcgctctcacgtccagctccttcgcccgcgcctcgagctcagcggcccgctgatccagtgctgccctctcggcgcggacgccttccagattgcgacgcgcctgctcctcccgcactgcctcgcggaggaacaggctgtccgccagccgctgcgccacggcctcggcctcctcgagagctcgcccccactcggtgagcgcgtcctcgcggaagcggagtgcggactcctcttcggcgcaggcggcctcgtgcgccgccagtgttgcctcccgggtggcgacggcggcctcgcggtccgccaggtctctctccttcgcgtccagggcgcgggcgcgctcctccagcgccgtggcgcgagcctcaagggcctcttcgcgctgccgggacgccgcctcgttctccgccacccgccgttcccgggcagcggcggcgtcaaggactccccgggcggcgtcgagcttctcctctagctccgccgcccggctcccgtattggaggcggaggtcgtcccgcgcctcgtcgagcacggcggtggcgatgagggcagtctcccgctcctcctccacctccctggcgatctccgccagctccctacgacgggcctcgagctgtgaggtgtgccggcggtgcgccttgcggcccgcctccaccatggcctccaccgagcgccgcccctcctcgacgcgcgcccacgccgcgtcgagctccgcccgctccgcctgcagggcctccatctgggcacttaacccgtccagcaccgtgctgttcgcggcgaccaaggcctgcaggaagggctccgcactcagtggggcagcggaagacagaggggagagtcgcctcggtgtgggcgccgcgcggctcggcccgccgatcgacgtgccggactcgggggcgccccccgaagctggctcgtcccaagcgtcgcccgaggggtcaggcctgagcggcgcgcccacggcttcgtcgtgggtggcctcggaagtcgtcgtcgcctcgggtggagtcgggtcaggggtttggcaggccgcctggcgtgcgcgcgccgcctctgcctcccggacggactccccggcccggcggagtctggcctcctcccgagcggcctactcagcctggcgaacccggacggcctcctgggcagcctcctcggcttcccggaagcggtccacggcttctcgccggtcagcttcccgcctccggacctccgcggtcgccgtctcctcggcctcagaccggccggacttggaatggcggggggggggggggggcgacgggatctcgctgaggcagaagaaaaaccagaagacaaaaagaaacgggtgagtgaaaactcgccttgggagatgggaggatgaatacggccgcggtgggcatggggacgaacctgcggggaggtcggctaaatgaccacctcgggggcgagatgaggttcccccggcatggcacgatcccccccatcttgcggagccgtttcttctttcgctccccctcgggctgcggcgtcggcgcggcaccctccgagcgcctgctgctggcacgcaccgccccgcccccttggggaggagatgggggaggggtaccctcctgcttcctcttcccccgggcgtcggcagggtggctgccccccgggcccccgtcgcggggcccagaagcacgaccccctcccggggtagattgttcccccctgcggctcccacctgcgccatcgtggcctcggggggcccgctcccccgacgccccgacctcctgcatgatggtcaggatgttggcgcgctctggatcgcagcagagggggaggaccccttgggggatgagggatgcctccacggagctgagattcagcacccgttggaccaccatcctgaaatcctcagggtcccagtcccatttgcgcccctggtgggtcctcatgatgtcctcgggcccggtgtactcccaggcgccccgggcgcgccgctggagcggcgcgatccggcgacgaaggtagtcgccgaacaccatggcccccgtgagcccctgggatcgcagacccgccaggcggtcaagaacggcgtcgtagccgtctcccagatctaccgccgcccgccagctggaggcctgcgccggaggctggttcggaagtcggaggcgcgcttcgtcggcgaggggggtgtagaaccaatcgctcttccaatcgtcccactttttgcgaaggacgcagggaatgtagcggttcagcacctgcccccgcggctggaagtagcagccaccgactaccgtcggcggcgacaccggctgtacggtgaagaaccaccggaacagccggagagatgggcgcaccccgacaaacatctcgcacaggtgcgcgaagatggccaacgtcattatcgcgttgggggtgaggtgcgccatctggagatcataaaactccagaatatccatgaaaaaaatagagaatggcgggaccagccccgccattgcgaaagagaggaagaagacggaccgccccgggtagtgcggcgccgggcgtccctcgcccagcgtgaccacctcccggccggtggcagattccggcatgaatcggcgcggcagcccggcctgcctctcgctcacgatgcgggaaggcggcagcacgctaccctcgagcggtgcggagccccgtgccatgacgccggcggaggaggagcttgagagcgagcgagtatggcaagggtagggcgcaggaaacggagagtcagagcacaagtggcaaaggcaaggggaagagtggtgagaggaaggaaacaaatcccttccttggcgtctttgtacccttgccaacgctatgcccggctcctggcttcccgcgcccactacctcgccccctcgtttctcgcgcccacgcctccactaaccccacttgcccgtttgcggcgcacgcggcagatgtgcggccgtggcgtttgagatggggcagatcgtgcgcgcattaactgcgctcgccaaccgcgaaaaacgccatcatcgtgtccccaggcgaaacaaaccggctcgtcccgattcgcgcgctgctcgagtaatgtagcggtcttgaagaggccgctcattattgtcgatcggtttttcccttgccgatgcgcgcgatttgcgaccgttgggtttccgcccgcctgtggggaccggccccacctgtcaccgggcctaaggagtggcatcacgcccgagcgcctccctcgaggggggcggtcgccctggcgtaacgccgggggctactgtcggtgacatggggccgggggtatcgtgactagaggcttgggtagccgcggtcacccacgtggcctgaccccctcggggggggggtcgggcccgacggtgacgtggccacccctccctctgtctccccgaggggtcgggccgctcccgtttcggccccgagggctggggtgccccgaccccctgtggttttggcgccacgtgtgtgggttaggtgagcacagcgggctcacctaaccgcatttatagcaggttggacgagtgcgccacgccgcatttaatgcggcgcagcgcacgcttatccggtccgtgaccagtcgcggtgtgtgaccggtcacagaccggtcagatcgcgggttaggtggcaacaggcagcctgtcacacgcctcgccccgtcccgtcggaatgatgagagcttcgtggctctcgtccctagccggagccggcgtgctaactcctggagttggtatgtcagtcccggtcagatccattcctggcttcagcgcaagtatggcaaggaagtcgctggccattaaataaaggttgaaatgggcgtccaccgaaaaaggggcgagcagagcaggagacgtgcgctctgcttgtcagaggtcacttccggctgtagactagccctcattgtaaaagcatgtttcctttcttaggtggcgagaggcccttgtggtgacccctgaccagagaaaaaggaggcccaggcctagaaagaaaggagagagaaaaaaaagaggagaagagagggggcgaacggggctagagcctgaactctctctcgctctccggctctctgtattccttcactcacagatccaccagaacacaggagtagggtgttacgcttctcagcggcccgaacctgtctacgtcgcccgtgtctcgcgcatttcttctctcgctgacgttcctcagatcgagggcgaagaacctcacttagcgcccccggccgaaccggcaaaggggggcctgcgcggtctcccggtgaggagccccacgctccgtcacatgcacacaagtatttataacccacatgcaatatcttgatttgctattggctagaaaatattggggatgatgcatgcattgagtttgttgatagaataaatatagtatgagagagttattagtttgtcttggtcttgatatagctatgaaatatatagattaatttggaatggagggagcataaggttgccacatatcttgcgttagacaaatctaactaagttaggtggattagtcatacttaagacaagattctttcttcactatataggcttcgcatgccattgagataaaaagatgtggcaatagtggcttatgctaactaaagtgtatcttcaattttgttagccaaaccttaggtaagttggccaaaatattattccatccgtgtattttaatgtatgacgccgttgactttttaatcaacgtttgacaaatcgtcttattcaaaatttttatgcaaatataaaaatacttatgtcatgcttaaagaacatttgatgataaatcgaatgagcaataaaataaattataatacataaaatttttaaataagacgaaatgtcaaacgtttgtcaaaaaggtcaacggcgtcatacattaaaatacggaggaagacaagcttggtaataatttgaagtactgaactaattagcagtccagttatcttggtgtatgttcttgcgtgccttgttgattatgagaaggaaaatattgagacaatgtgttgtttcttttcctttggcgttgaaacatgtcgtctcggtgtactgttgattatgagaatgaaaatattgagacaacgttgtttgctctagataaacttaattgtctgttcatgttttaacgagctcagacgaatcgagctggagcctcgcagaggttgagcctgtgttaagctcgaaggtcagccttggctcgtgcgagctcggcttgttatagcagccggacccggttggtaaatgcatgggcatccggccgttgatctttttgaaagtgtttttgacccattctaccatttgaagctccatggcaagtatggtcaagctgagctgctaggcagatgtacaaaagcgtttttgactcatttctgttttaggcaatgattccattacgtctctcgctgcaacaagccagatgatgggccagtcgctcatttgggccggatgaaatgcatgtgacccgctagcagctaggcggaggcagtcactcattcgggaaggtagtagtagcgttgcttgtaagccatggaccatggtcacagcctcaggatgacaatgcatgtgaatatgtgatgtaaccgctagcagccttttccccgagacaatgccggaccgcggaccgcggaccgccgcacccctcaatcgacgcacttttgatgaggaatgcatgtgatggtagccatccatttttcctatggagggttcagatttgaagctgcattctcactcacccgataggcacagacatttgtgttcgtgcatagccgagttcttagcgggcatttgtagggaaaaaagaaaatctcaatttggtttcttttgaatggccaggtcactttgagattcctttatgctaaagcacctccgctttatccatcttccccctcttctctacgagccattgccgatatcgtacttcttggtgagccattctcctgctcttctgctcccgttttggccgaaactttttggcaacattgctcagactcacttcttttcttggggtttagtgtctgcttctttctctctcaggtagtagcgaagaagaataagaccctgtttagatgggattaaaaatatttttaagtctctatcacatcgaatgtttggacactaattataaatattacgtaggttattaataaaaacccattcataatcttggactaattcgtgagacgaatctattgagcctaattaatccatgattagcctatgtgatgctacatattaataaaactcatctataatcttggactaattcatgagacgaatccattgaacctaattaatccatgattagcctatgtgatgctacagtaaatattctctaattatggattaattaggcttaaaaaatttatctcgcgaattagctttcatttatgtaattagttttgtaagtagtctatatttaatactctaaattagtgtctaaatacagagactaaaattaagtctctggatccaaacaccacctaagtcattccttacgaagaagtgcttttcatagctctgaagatctgaataattttagcactgaaactttgtattagtttcaacaatgtgcagaaggaacatgacagtttgttaaacaaaagtacgaatttcaaaagtaaaaccccatactccagcaaaacagaagagaaatggaagccccaatctttttttttatatcgaagtagtagtaacaagttagcaacagatcaaataaaagtactgttagattgcgcaaatattacacagagaagagtttgtgaagtgcaactcaccagcaatattcaatagctctcagcatattgcacattaaggccttgtttatatcttaccctaaaattttacaccatattacattgaaagtttaaacacccacctcataaaactattaaatataggctaaaaaacaattaattgtacagattgcggctactttgcgagacgaatcttttaaacataattgctccatgatttgacaatgtggtgctactaataacatgtgctaatgcaagattaattaggcttaataaattcgtctcgcggtttactgacggatactgtaattagttttgttattagtgccggaacaccctttacgacatcatatataatacccgatgtgatatgccaaaactttaccccctagatttaaacactccctactgaaaacaacgtgtaacgcgctatggtgtgagaattctatttacaaattttgcatcacaaacgaatgaccaaacaaattctaggcctcacgaattcacgatcgaaacagccaatgaagcactgaaaaactacatatttcagatccaatagcaatttggaccatcaaatgacgtttctgatttgggggtttgttttgcagatttttcagaatttggagctgctgacgaacttggaggtggactagaaggacaagatcaaggagaaaccggagaagatcaaactcaagcagctgccttaccttgtctgcatcattgtcgaggcttgtgcttgcatcactttgcattaacgatgaaatttcatgttgaattagagggtaggtctaatcggcgatcgatcgcgattcggtcgccatgcacgaccacgtttccatgcagagcaaccgctttagccgatagcaatcatttcccattccgtatctctccaccgagccttgagtggttcatcctaatagtgtgatggtccagcccaaaaaatttatacatacactttatatgcaaaataattaatatataaaacttcatgtatagacatattatatgtgtacaaattttgtaagtacatgcgtacaaactttttatgtacaaattttgcacatataaatttgaaacaaattcaacggtgtgttaaattagtctcgagaaaaatatatatatagaattttattacatcagaaaaaactatacatagcaattttgtacgtatatattttacatatatgtgcatttaaactttgcacgtgtaaagtttatatctataaactttgtatatgtaaatttaaaacaaattttaaagtgatatatgtgggtttgaggcccatgtgcatgctggcagcccactctaaagaaaaagcccagctaaaaacaaggcccacacatcagtccagaaaggattaagtctattttgccttcctcatttcttgctcctgttaaaatcatattcctcaattgtacaaccagcgagtaatgtgactatgaaccgcgccaccgcaaggtctggcacctggaacgatggtgtatattgcatccaatcccataaaaaaacaacttatggggaagtgggacagagagtattttcgtagatctttcaaaaacacgtgtataaataaaaaagtttaaaaataatgtaacttttaaatttttattcgataagcaaccgcataagcaaaccgatgggggtgttatataatccaaacggaggatgtattaaatacatgttaacagaatgaaaaactaaacctgttttttttactagacttcccactaaaacacgtttcacaagaacagacaacactaagcgagtagggcacagggcaacgcaagcatcaaaaaataaacagttctgcgggtcaggcataaagaaaccaatagagtatccggaatctgaaatctgaggaagcataaagaaaccaatagggtatccggaatctgtaatctgaggaagcatatcaccacacagctgctacaatttgaaagcttgagaggttttaacagccctggattgcccctagaaaggaatcacaattttgtggcagccacctacaatccacaagctggcctccaaaagattttccatcagccaaatgaaaacgggtgaagaagcatcattgaggcatgacgagtcatagagcatgcgaatatccacgcacaaactgcaagtatataattaacaaaaaaaaactaaattgatgaaaacgaacaaaaagatcagaacaagatgtcctgacatattgtgatgcactagaaacttacgtaaccactgtctatctgttagcttgcgccttcatcttttatgtgcattgctaagggcttttctcttttttcgaagctctgatagactgacgctatcaacgtgtggttttactcttttttgaagctccggcactagtatcaactggtggcttccttttctctaataaaacattcttttggtccataaaaggctgcaaaatgtccttgattgcctacacaaaaaccaagagattgtaaataagagaaatttgtgatgttattgattgcaaaagatttcaaaatactgcaccttgctttttatctgtgtttgaatcttctgaacatgttgtataatagattgcaccttataggcccggacagcacctctattgtcgaagcagatcccaaccaaaagaccatcaacagtaaagacaggggacccaaatgaggcacaaggaagtagcacaatcatgagtaaaatccgcctttcttacaaacctaattaaacatttcataagagcctataaatataatttaatcatttaataggactaattaagcatttcataagaaccaacaaatctaatataatcatttaatactccctccgtttcacaatgtaagtcattctagcatttcccacattcatattgatgttaatgaaacagaggaagtaagacagatgaaattagataaaaataaggattttagctcaccggaccgatccaggagataaaaggtacttttggattctgatatcccaaggtgtaaacatcctcattaatcaacggtccagattcacagattttcacagcagctaatggattagtgcattttggtttgcttagcatgaaagagacaactatcagcaattgatacatcggtaaagttaatcgccacactctccatgttcaagccaggaaaaacagcagcatagagcccttcagaaccataacaaaatgtccccttgtctgttatgacgtagcatgatagcttcttcttcgcaataactattcctggagcaaataaagtcggttttcctgcactcatagctattatcctaacgaaacacatttgaaccttggcttggagattatcaaaagtatcctggtaatgaaacatcatattaaaaaaaagccattaggatcatttgatatctacctcctataaagaaacaagcatacaaccatatacaagaatttgaaaacttgagatcatgtacaatgggaggtatataaagaacttgaggttatgtgaatgattggtgcttataaatatggtgcctaaaagaaggatgtgtccatatcatcgagaactcatatataatttatattgtctactgcaaaattcttttctcaagtgtagattattatttttttgataagggcatgcccatttctattgaagtacagaaaacatggtaggaagaagggagaagtttaggagacaagacattacaaaagtcaatactcctacggtaagtagtttccacacacacacacacacacacagagccagcggaccagatccttccctcgacacactagaactactagaacagcagtactgagccttcactaactggagcgtagcctagggactgcatctacaggattgcagcatcgtgcagactcctacttgatacaaaagcaaagagaacccagccatactaacaatatagccatattaacaatactacaagtaaacaggacacgatcaatcactactggtaccacaagtgctcagacaactaccttttcctattattttatacataaacaactgccaagcatcacacacaaaaaatatgaacaacacaaatctgattctatttactatataagcactccatgtaagcacttgcgcaattaagcatttataacaacagaaccaagaaaccaccacgggctgctgcaggcaggggttcagccaacttatttcgagaaaccaaagagagagcaagttcagtacaacattagttttgcctagtgccttagaccatgcaaaacatcaattaatcgtaatgtatagaaaaagtgagtgaccgattcaagcacatacgaacagaaaagaaaaaagaaaagaggaggggaaaaaagcaagctcaccttaggcagcattttgcaaatgggggaaacaatacccaagtaaagggtgaatcggtgtagcaggtagccaggccaccgggtggaggtgcctaggaagagagatcgtcgcagtagcttatgaagtagtggcgtaacaagaaattttcgtccggtggtcctgcttcacaagttcacatcacataccaaaattttgtatcaccgcaaatcccatgagtacaaattcaggtaaaaggcgaacaaatataccaataatatcttataacatcagtaatcaactaatttaactagcaagttcaaaatgtgcacatattacaatacagatagttcaaaatgtgtactccccactcctcttcatgtctttaccaatcctacaaactaaaataagtccgcggcacatcacaaatttagcaatggcaaatgcttccttgatcaaacacagtgagaataatgaagatatgagctagaggtataacctgtaggagcaggagacggcagccgggagccgcggcgcggagggtagagaagccgcgaacggcggtcgacagcgacgggcaggggatgagggtcaggcgacagtgcgagagggagccagtcagacggggttcccgagctcccggagctggcgaccggtggcggtgcggcagatggacgccttcgctcggcggtggtctgtggctgtgccgatgcggcgccgcggcggggaccggtggtgtgcgcccccgtcctccggcctacgcggctcgggacaagcggacggcggcggcggcaccgagacccagtgctcagtggcgacgaggagaggcagagagaggctgcgaggagaggcgaggcaacggcggcggcgcggtcacgcgcgtgcgagggagcagcgcagcgccgccgcgaagcgcattgccttaccgagacctaagcgcagcgcccgcttctccttctgcttattgggcctgagtagctgggccaaaatcggggctagtcccgaaccaaccgggagcgtttgccatttggaaaaagtatatataagatccctcatcttgtcaccgaattacaacatcgtccctcaactgaaaaaccagatatatatgatccctcaacttacaaaaccggatcaccctgagtcataacttacaaaaacagattactctgggtcattaggtggttgacaccagttttgtcctacgtggctgccggtgggtgaactcctcaagcgggggagtgaggccccctttgttaattcgggcggggggtagcgggtgagaattgagggtttggatggatgtgtgctgtagagggggtcggggcccctcaagagcaatgagataaaaggagtttatacaagttcgggccaatgagaagcgtaacactctactcctgtgtatgatgatttttttgagctttgaaagtctctgaatctcggatgtacaaactagagttggtatgcaaaagctaatcttttgatccccccaccaaggacatgggcctccttttatagcctaaggaggcaccacaggagtttaccggattacttaggggagaaggcgaaaaggaatttatcggaggatgaactcctcgagcgggggaccgtgaggctcctcctttgttagttcggcctagggcagtggatgaaaattgaggagctggaagtatttgaagaaatgagggggtcgggccctcgagaggggtgagacaaaagagatttagataggttcgggccgctaaggagcataataccctactcatgtgtatgataatttttctaagattacaaagtctctgaatctctagcgaggaagctaagactcagcttcccttcagaatttttaggtttcaaccacctccttcgtaggcctggacctccttttgtaccttaaggggttaccacatatgccataagagctacctagagaggagggaaaatgttctctacattaaatgcatgtcttgtgccttagctcggaagccatatgcacattgccttggtggtgagcccattagaacaggccacctgacacggggggtgccctcgtcatctcccatttaagggatggagacttctgggctcctgttacaccgggaaacgggatcctttctttgaccagagcgggcggaccgactccagctggaatgagaggctgaaagcctctcgtcattatgatgagacggggcacttcaaggctgtaggctgcttgacagacggacagtgcgcaggtgcactacccctagtcccatcggttattcgatcggtcacggaccggtcagacgcgctgcatgccgccataaatgcgggtaggtgggctcttgggggcggccacctaacgcatcgcacgtggcgacccgcggagggggtcgaggaagcccgacccccggtcgcggagggggg

SEQ ID NO: 44986 - DNA, 16237 bp, Oryza sativa
cgcccccctaccccgggcccgaccccgctcgggagagggccacgtgggcactaggggcagcctccttcctctagttttgataccctcgggcaaggaggggcagctgtcactccaccccgggcccgaccctcctcggggaagtgctacgtgggtttaggggcggcctcctccctccaaacatgatacccccgggcctatatcatcgacataattgattatgctaaagagcacgttttattctattgacatgacgaccacatcctcgaccgccacaacatgggcccatcaaatcgagccgctagacacgagggagcattgtgtcattcgccaattaatggatgaagactcttaattgggctcctgtttacaccgggaaacaggaggtcggctttagaccagagcagatgaaccagctctgggcggatctaggggctagaaaaaaaaaccccaccatcacgatgtgatgaggcggggtaacttgccgccgcctgtcacctgttcattgactgggcggggcaaaccgtctgccgcatgtcactttgtcagtggctaggcatggcaagccacacgcacatcggctgccatatggggcccaccacatcaggccggctgacatgggggacgcctgcgtcattcatcatttaatggatggggacttagagtgcaggcttgcaccgggaatacaaactcgggcctggccacaccggatgggatgagtggctaagagcccctcatcattacgatggaacggggcataacccgctgcacgccgcctgacatgcggtcagggcatgagcgctctgcagtcgtcccatccatcattcggccggtcatggaccggtcactgaccagtcacaggccggtctggcgctcggcacggcgtggaacgcccgctgcaactgccttaaatgcggttaggtggacgctgtgaggcacccacctaaccatatacacgtggcggctcgacccctcgggcttggaggggatggccgccgcccatccttgggcccgaccccctgggaggagtgccacgtggacactgggggcagcctcttccctccaatctttgtacaccctggcccatatcaccgatagtggtggccatacctgggtgaccatgtcatcaccctctccctctctctcccctcttctctcctttcctcctcctccttcccctctctctctctctctctctctttctcttctaccctcgtctaggtgggccggccagccagcgggttcgaaggaggccggctgaaagggtcaattaggcctagaggggggtgaataggctaatttaaaactttatgcggaagctaaaactgaaataaggtcggaaagtctgatccacagtcagactatccaaaaatatcagatagtctgatgttggatcagactgtctgatccaccaatgaagcacaacaagtagatctatcacacagacaagagtaaagcacaaacagcaactagatctatagtggcacaattaagcaaagctaaaaggaggatgaagggagatcaccaatgatgaagttcacgaagttgttcccggagttcaaatccttgaggggattctactctccgttgaggagctcactaagagccgggtctttgctaaccctttcctcaagaggttgcactaagcactcctccttccactaaggggtatctctttccttgcggaggcgagatccggccttcacaaacttctcccggccaaccacacatagatcggtggctcgggagtgacacctagccgtctaggagtcctcaacctccaagagtaacaaacaccacacaactcttggtcaaaccctagtgctcaatatcgagtgaaacacacactaggccctcaaacaccaaatccacaaccaccaagatccaccacacaaagaacaaggagggatttgagagagggagaaagagctcaaagatccaaagcaccttagcaccaagttcaacccaaagtgaatgagaatgaaatgagttgggtaaccctagaaaagggttaggtggggggtatttatagacccccccccccaaaaaaaatgtggtcgttggagaggaatctttcagcccacgtcggatagtccgatacaagatcggatagtccgatattttaaacctccaaggcaacgagaaacagagaacgaagttccatgaaatttcggactttccgagacatcagactaactgatgttaaatcggagtatctgatattttagaagcaaaaacttcgtcctcaaacagagactcaagttctatgaaatttcggagtctctgtatcatcagactatctgatccgacatcggatactccgatacttagaaaaactcactcgataggattttttcaaatcaagacagagagtgaagttctgtgaaaaatcggatagtctgatttcaaatcggatagtctgatgttgatcaagtaaaactacaataactttttactccgaactccgatttcgaagatcttggactctatgaaaagctagtttcgtgggtcaaacccaacataaaacatggtccaaaaccttcaagagatgttgaaaaacttgcaaagaaacccggtgtaagtgttgtgacaagtgaaacaactcgggattgaaatttttacttaggtttttcaactcacacaaagatgaagcattttgagcactagtattctaccaataatatgcatgtggtatcgctcttaatagtacgacattcctacgacacaatgtaaggtaaaagatacaatataccatttgatcattgccgcattgcatcgtgatgtcgcattcatggggtatgcatctcattacaacatgtcgaggacataacaaccttcacatttgcttgaataaaagtgttagtcctctctaatcgcattgtaatcaatcatcaaaatcattaggggcctagatgcactttcaccggcaacgggtgatgcggtgggcggccttgttggtgcagtctaggagttgatgaccacacgtgccacctcctccgcctccacctccacagtgcacacctcccacaccatccttctcgccaggaatccccttgctgccgcccacctcctcgacgacgcccaccaccaatcctcacgccctcgtcgtcgccaccggctcgagacctacgacatcgtcgtcgaggccacgcgccgcctacaaccgtgtcatgttccagctccgctgatccaaggccatcctcaacttccccaacgaggtcacagccgactcaaattcctacatgaaattttctttgaatgcttgtctataacttttctaactttgtactagtgaaattcatttgtttataaccctcagtagctattaaaaaactaaacaattagctatctcaaacggagcctcaatattcaaatataaggaatattaggttctaccaatatctgttctgaacatactaacatatacttcctccgttccacaatataagatattttggcatcttcatacctcgtctaaattcaccaacatctatataaattaggacgcgtatatgaaatacatatatggatccatgcatctatttaaaacccaaaacgtcttatagtgtgaaataaaagatatcatataaattcaccaacattcatatgaatttggacatgtatataaagacacatacatggatacatgcataactatttaaaactcaaaacgtcttatggtgtgaaatagaggaagtataaatttaaaatataggtgtatatatttggcatatcctttttatttgtgctataatatattattagtctgtttgttaaaactctaattcctaaatttaacttcacttgctttagagtggagttgtgaagcggctcgaaccccactcagtttacctctctagtccattttatgatagctcttcagtatgttccgctccctttttaggtgaagctatagttctgccaacaagctctctatctagtactactggttctattatagttattggttaagtactctctccgtcctagaaaaaataaatctaggattggatgtgacacatcctaatacaacgaatctaaacagatatatgttcagattcatagtagtaggatgtgtcatatctaatactagatcggttttttcttggacggagggagtaatgccttccatgtgcatcctagccattcagttctctaggcaaataattagccctccgaaatcttgctatttagaagtatttaataaagtctatgtacagaactacttgttgaacccctgggctaattcgcaagacgaatctaaagaggtatattaattcataattagcggatgattactgtagtatcactgtagtaaatcatggattaattaggcttattagattcgtctcctaaattagcttacgggttatggaatgggttttgttagttatctacgtttaatacttctaaatagtaagattctggagggctaataattagccctccggatccaaagaggccctagttgattatgctcccttcaagagccagaccctcgctttcccctatagatggccatgaggcccgctcggcacggcccggcctaggcacgactaggcacggcccaccagccatcgggccggcacggcccgatcggccgcacctccggcctaggcacaacccaccagtagtcgggccgtgccgtgccagcccgaaggcacgggtggcccatcgtgcctttttttaaataagtctattctccctccctcctctttgggctgtgacatactccctccctcctctttgggctgacatatatatagctaaaataagtctattttatgtccctattctttggaccgtggcatataatatgtctatttttactccctttcattgtgtgttgggcctggctaccggcccaacgtgccggaggaggggcccaggcacggcccggcggtcgggccggaccggcacgggccctaccccgtcgggccgtgccgtgcttaggccaggccaaaatgtcgtgtcgtgggccggaccgtcgagcctcggaccttttcgccatctatactttccgctttcaagctacagctctatcgtcgcttgttcggccccttttcctcctttcctccgatgattcgtcgtcggcggagagagggagaggggtccggtccttccccctagtattaggttagtttagtcgggtttttcctgtttagtcggggttctcccgttgtgtagttggttttttgagtccggagcaagatgaacacagctggagctagctctggagtttgttctcagggtcttctagtcatcactcgggatccctccagatctgcgagttcacaggtagcgtcgaccaactttcatttcttcgacgaatttcttcctcggctggttctcctctgctacttctccagcgaaggatttttttttctccaaggcgtttgatatttccaagtctagccgagatggtctcaatctcctataaatcgggtatgcctctcagttttctttgcaaactgctacgttctctctctaatcctcgccagtggaatagttatagggttcatccttggaatttttgtctgcaagccaactttcgccagtggaagtggaatagttatagggttcatcctgccagtggaatagttatagggttcatccttggaatttttgtctgcaagccaactttcgccagtggaatagttatagggttcatcctgccagtggaatagttatagggttcatccttgaaatttttgtctgcaagccaactttctttcactgatccggatccggatccggcgaatttcttatatgttgttgctgatattattatgtgaattccaacatccaaacctcctttgcaaggccccgtttgggacagcatgttggttcaatctcctgcagcgcatcctccaccgtcagagtcaagtttctggatttcgtcgttggggttgaaggcaaaaaagggggaaaggactccattgctttttgctatttttaaagtccttttctgcactttattaagctcaagtgtaatttgcccagttctaaggggcttttctgcaaacctggttgtattccagtgtcctccactgtatgcaaacttgtactcgtgtactgtgttacttctcttacttaaataaagttacatgagttcaaaaaaagaaaagaaaagagccagaccaataatcggagaatgaaaaaatattaccaggctattctacttttacttgtcaggagcatgaattatctcgatagaacattatgcaacttttactaggagccagttagaaggaaagaatacgtatgctccacttttctatacatcagctatctatatgatgtcttcaaaagaagtgatccattccatcctatagcacacaatgcactgtcgtacaacacaacgcacaacgaattgaagaggtaattcatcttcccaaataacatacttccttcatttcacaatataagtcattctagcatttcccacattcatgttgatgttaatgaatctactaacatcaacatgaatgtggaaaattctagaatgacttacattgtgaaacagaggtagtaccaactaatcaaccagcatgtgttgctataagaactcaaaatgtagaataaaacatgagttttaataaacagtcatatcaatattaagacagaaataagcgcttttttcgggagcaagacaaaaaacgagcacttgtgcagatgtgctcagcctccagtagtatacatgtcaggaaataaagcagtgattgtgtgcgctttgctcaagaaggaacagatgagcatcaaatgccttattttaccatcacatattgagatgtttatgaagacgtcaggccaaagccataattaagataactcactccacattatttgtttttactggagctgaaagtgaactctaacatttaggaaaaatgggagtagcccattaccaaaaacaaagttcatatttgaagggcatccgcaatcgaaccagcaaggctcaacacctcaaatggaggttgttggttgatggctttcactgtttgagggcaggagtcagtgatccagaaatacgcaaacttgtcagctgacccagctgtgagtgggaaaaaaaagggtgagaactgaagttgagtggctgaaaggtagaaagagaagagaatcacgaattaccggaattagtgtgagtgaagcgctcatacgactgcttgggaaaaacagcatgagtcacgtaagcactaacttttgcagcaccatgagcagccaaaactttctgcaaaataattagacaaagaagcattaatgagaaatgcaacataaagcagcatatcccatcaacagtttatgaattagtacgtcctcaaaagtgttaaaacaattacatggagtaaaatgaacatcaagcctactaaaaaatgaaaatgcaaaaataagcatgtgactgactttgctaagatcaggttttacaagggcatgtaattaatctctgtttttcaggacctctgcctgttggcaattaatatgtgaaacgtatattataggaggcattactctttgtcagacaactaaaaacaaagatagcaaaaaaccatatccctcttggcctctcccactaaagtggaagtaagaaaatccaacattagtaaaaattaagtcactgaagcactactttgtagtatcatggcaaagccacagacagtatgttgatacctgacattctctaagagttcccccagattgcactaaatcatcaacaataaccacatgccggccttcaggattcccctccttaattcgaactatcctcttgtcaccttcccgaacctttgcgcagacaaccttataatcaaacagcccaaagtaaaaactcggagtctttcaaccagaaaaaaaaaagagcaattccacaatggcatgcataaccgaatttcgacatgttcattcattcacacaaaacaagaagctaaccattgggaagttgagcaatagcttgtggaaacgcttccacgccccatcatccgggaaggcaatggtgatctgcgcaacacacaaatcacacaagtcagcagtagcaacacgaattgggtacttgaaagaaattagtaggacaccggtggccttgctacgcacattgtcagcatcggggagctgccggaggcgctgcagcaggagcggaatcccggtctcgaagcaggggaggacgtcgtccccgaagtagaacctctcctggagcgcgtggatgtcgtagatgacgacgctggtcgggccgccccgggacttgggaatcatggagaggatgcgcgcgagggtgaacgcggtggcgacgtcgccctcctcctcgacgcgctcgaaggagcccgtggggaagaaaggcagcacgagcgtgaaggaggcgatgaacagcttgggcagcgcgaagatgacggagatctgctcgaagatgaccgacggcgagctgaacgacgccaggaacgccacgtgctgcccccggatgtcgtgcgcgttgttgatgaacaggttggggaacccgtcgtcgaagctcctgcgcggcggcggcggcggcggaagcgaatcagcgaatcaggtgactccacgaaaccggcgaggaggaggaggaggaggaggaggaggacggggagcgtacctccagttgatggactggagatggatggtgtcggagctagcggcgaccttgagcgcgagctcctcgcactcggagcagtagaagaggtttatctgcttcttcgccttcggctgcctcgccacgacgacctccatcctcgtcccgggctccccggcgggcggctgcggcggcggcggcgcgcgcgagcggaatctccgaaaagaacggcgcggggggacgcgagcagtgtggtcggctttatcgacaggggagaagcagcaaaggtctaggagcaaattattcgctcaacacttttctttttttttttcgcgagcgtaaaccctagcttagaccccagccgcgcggcgcgagccacgaatcggcccgtggtatgatcgatcgatcggccgacgcgagcaggctggatttgggctcgaggcgagactagcacctactagtagcggcgcaaattggggaagaagataatgcgagatttttatagagcgctacttgcaaaaactgacgaaaaaaaaacaaaaagggagaaagcatggaacgcgccgccgccgctgcaacgcgacggattactatcaccaatccgataccatatggtgtcatagagaggcatgaagtacacagccaacggctggctctcagggattaaacgtcggttctaaaatatactctccgtttcgaaatgtttgagaccgttaattttttagcacatatttaaccattcgtcttattcaaaacatttaagtaattattaattcttttcctatcatttgattcattataaaatatatttttatgcaggcatataattttacatattttacaaaagtttttgaataagacgaacggtcaaacatgtgctaaaaaatcaacggtgtcaaacatttcgaaacggagggaatactagtatactaagtacaaatttgaattgactgatatctaatactatctaaacggatattcgtacggtcagattcgctaaacaaactcttaccacactatctaatactattactactactaatctataaatagagagtcgctaaataataaactcttactatacaatctaataacctgtttggtacaactccaactcctaaatttagcttcaggagttaggtctgcagtgaagttgtggagctgtctaaacctagcttcacaactctagttcattttatgagagaactccacccaactccactcccagttttggtggaactgaaactgtttggctgagctccagctccaggaggggtggagctggagctgtacctgtaccaaacaggccctaatactactattagtagtatgtagtgttagactgtagtattatataatatctaattcattatttggttaatatattttagtacgaatgaagcaccgaagagcattgttggtgaaggtttttcccatgaaaacaaagtgtacagaagcaagggaatcgtaagaagcatatgagaacctgagcagaagacaagaaaatttctcgagttctaatgggagacatgggactagtttattccccacttgtctctagtggggtgctaatttacaccagcccgtcttgtgtgtatgattgattatccttagccaaaatcaacggtacaaaaatcgtaagttacagaaatgtggtcaatccaaaaaggtatacgaaatcaacacctgaaaagaatgccaaaacttttgcaatgatccaaccgctgttcaccaacagaatctgctccaggcctattcaagaattaagataaaactggcgtgtttttttcaggagcatacctcgcttctccggaacaaagctaagagctgccagagtatctgagtatatacaagtctagctaacgcacggatcagttgacgaatagcccttttccaaattgaatttcggctcgctgggatatacaaagacagttgcggctgaggctgaaggagtcagtgcagcagaatacctcactgaagttattgttatccttggcagctgctgggaaccagaaccaagcggcacaagcttatggctaacaatatgctcggttttcggcagaatggatgcagcatgattgtgagccccagagaagacgaagttctgggaatcaacaagagagtacttgatttcctgaagtaaggatgttgaattgtagatcttcacatgaaaagtgaaagggattccaaggatagcataaggagggcactccatggtcacaacaagtggcggctcctcgatatgaacttcaggtaacctttctttcattataacacggctatcttgactctctccaatgcttgaatctcttgaccagctcaggcaaatttcacctagaaaaaagcttggactaatagtatgtggattcactgaaaatattcctttgtattcttcactaggagcaataactgcgtattcattggaaatcccactgatctgttgcactgagcagagttgttttccatcatcattagacacaatagtcatcgtgtgtagccgcaaaggtacctctgtgcaatttctagcacttaaaataagcatatttgactcgttgaaagcaagagaactttttttatcatcatcacttgaggatctgatcctagataataacaggggttctcgcctaaatggtctcaaaaactgttgactgactatcatggggatcttaccttcaatttgcaagcttctgtgcacattaagtctgtgcagtgctgcttcttcagtcgagtccagggaatagccaagtgagacatagaacatcactgacattgcttgatgccattttatttccaatttgcatgaccaggaatcacctgcatataatgtgggaacagatacaaccccaaacgagtgctggatttttcttatgctatcaacttcttcctttgacccatttccgtggtcacatctgagacaccaagaagttcaacatgatgactttcagattcttctgcttccctaggactcatcaaaaggcctccacctttggcatcgacaaggttgattttcagttcaccagaatgaactgcgtgtccttttgacaatatggtcactgggactgtaaataattctccaaccaatgcaggaccaggacaatctaagacaaggtcaacttgagcatctggctcttcaacttggatcagtttctgcccagaaaaagcaagtacattgtccttcataggtaatgcctctacttggtcctcaaatttccacaatgaaaattctcccattgaaacaggactttccgcttggcagcaaactacaagacgtttacttattgttgccttcaccgccaaacattccagctttccactctgtcctgcagaaagtactcacattgttatttcatgataggactaacagaaggggaaaagttaacatcagcaaatgccgaataaagcttaaattttgattttcaatctatcagccacagccaaaatttggattttagaacttaattttatagttgattttgatgttttttcatcgtagttcattttccagcattggcatttaagtcgctaagaacgcatataaaagagttttacccgcaacttatgttttggttgctaataagtgtcatgacttaaaatcggttgtacgcaaaacgatgagactggtaatgtcctgttgtttctgtatgttcagattaagatactaatatgacaatatttacaggttacttttcaagaaataaaacatttacaagttacaatacgtgcagagagcgggtggatgaacatctaatgaaataaactatatataatatatataactgatacctggtttaacttcatgagtcaaccgcatccatttatcagtgaacagtgtcagaggagtctgaacagctccatcatgaacatgtgaatttgatgcagaacaatcttcctgtgcactaactataacaaagttacagtcggattggttaaactgaacctccaacttatcaatcataactggacaaggaagatgagactgtagagagacactgacaagcattggtgaatcaggttttacagattgatcgtgaaaagcaacagatgcgagaaacactatccttagtggacttatttgatcaatatcgaggtgagtagattcttccatcaaatgaagatcaaattcatcatcagtgttctccgatgcatgctttccttccaagatattaataacttcctgctgtataagctctctactggaaatggtaggagatcctgctggtccatttttcttttattttctgaatttccctgtccactgccagagaataaaggtaatgcagccatctcaagtgaataactgataaagtccttcagagacttaagtttccttgcacattctctcaagtaacctaggttttcccaaagtaaagtggcccaaccttcttgacggtataggccagcaacaccatcaaaaagttgttttgcattactaaaatcccctgctgcataatactcaatggccattccaccactacaggcagaagccattcttgtggcacctaggctccgaaatgattcataagcttttctgaacaatgcaattatctcataggaatcttgaaacctttcagcttctgacaaagcatagctggtatactcagtatcagaaaggctgcaagcacagtgtcagatataagtagtcatataaaaattacgttaacatctaaaagtaactaagggtcaaagaacttacggaagcaccgcaactgtatctccttgctcaaacaagcgtacatactgaccaacatatacggaaggcattactgactcaggtaatccattgactcctttggtaaggcttacacttgatgaagagaactctaaggcatacctcttctctctcaagtaatttgccgccaactgccagaagggaaggcatcataaaaagatcactagtgtggtcaagtaaaaggaatgaaatatcctctgttgtagtgctgtgtagggagaggttgaacctgatagtagtaagctggttgaaattcccactcggtcagtgcgttgtcagcagtgccaaaacgaggagatagtgtatccggaacagttgtagatgttgtttctatgagctcaccaaagacaaggaactgcctgctaaaccattcccagtgaagaaaagcaacttctggtgatccaacaacacgctcatagcttctgatatgcttacggaaccatgtgattgctcccacaaccttccccccatgaagtaatattgttgatatcttaaagtgaaattgctcagcaactgcttttacctcaacaaggcgttgtgttggaggcagtcttgttgaagttcctatcatctaaataagagcaattgtcaatgcagggtgtaaagccaatagaaactgcttaagcaatagtgtcggaaaaataaaacagtaaggaatcttgaaggctttcaatatgtaatgtaagatgcaaacacacatggagaggatagggcaggatagagtggtagcttggataaattatctttaatgctagacaggtatgagatcctcatgaagtgttttctatatttaatattttaaaagtagcacgtgcacaagagtatattcagcattacaaatatatacgacatttggatggatagcaaccatagctgtctttctttatttactcatgagttcagtgtcacaataatctggcttctaaaagagtatgtcaggtgtggattcacttaattatcagtcttttaaggtctatggcaaacatggaacagggatccaattcacacctcacgcagaacacgaatgccctcctcatagaactttaatgcttcaggccaatcccgcctaaactccgcataaacagcgacctggtgttagaatcagaaatatcagaggaatgcagcccaaaaaaaataaaaattagagtagtgagaagtcattagcactactgactttaccaagcatgtgaagaaaaatttttgtcccaataccacgggcattaagaatgactaacagtgctaaattgaaccagagagagattcctcttcctaccttgaaacagtagcgaatgctcagctcaacagatgagaaattccttttctcgatgcgagctttgacccttcgtccttcatccttatagtatgtcgtacataactccgcaaaaacagttgtcaacctttcaatacagaacataatgcaggttagtaggtataactccaaggaacacatgaaaaagaaaagagcaaaagatagtttcaaaaaaaaaagaaatataacagtagaagattaaggggaagtttcagagcatacttgttgagagatttggtccattccatttcatctctctcaaccaaaacaaccaggtgctttgaatcaatttctgcacgtttcctcagagcaaccgtaacatcctcgctcagttcatctgcaaaatgttattggctatctggttaggtttgacgacacaaatatcaagcgagtataagggtctgttatcataatgcccatgcccaagcccaaccctcgattaccatgacgcagagagaaggcattgacatgcgtaaaataacagatctaatgctgctgcagatatggccagttgcagattgtttagctaaacttcttatgctaaagtgctaattgcttgttcagcgagaaaatgtattactattacgtatactcgagaggatgcttaccaccagcttgactctgtacaaggatcaccactaatttagtgtttcttccctgaatcacagacctgcaaaaaaaaaatgaacattacttggtatttgcgaattcagtctgtgctacactagctgcttatacactgctgatacttcagaaaagtccttaatccaaaagaggtcgatagtttccaatttcattgcaggggtgatatttatgagttctgattatgcgcacatctatttgggatcaacgatgcaagagatgtagaggaggtacttgaggttctcgagatcggagcaggcctggagccactgggcggggtccccggagacctgatcggcccggaacatcgcggcgacggcggcgggcactcgggtgcggtgcttgaggagccagtccttcttcaggatcccggcgggggcctgcggcggcgcgagcgggtcgcgggccttggcggtgcgagcgaggatggaggccttggagaagtccgggagggcgagcaagttcatgggcggctgcctggagctcagcgccgccgagatcgcggggtgcagctccgggcaccccacgatggacaccagcgacagcggcggcgtccgcagctcctccgggtagtcctccatggccgccccacccgcggcgccgcggcgaggcgaggcgaacggtcgggaggcgctaggtccggtcgccgccggggtggtggccggggaggacggggagctcggatctgtggtgactgtttggttcgtttggaagaactgggtgggggcgaggacgacgacgcgcaaggagtggaaacacgtatcgctatgtgagatgtaataatgaatatagtcagggtgttttctatgaagtctgaaggaccttgttataaaatttcagaattctgacagtcatcaggttaaatgaacaaatcaataaactacgtagtagcttgtactccctccatactcataaagaaagtcgtttaatacaatatttaagtcaaacattaggaatataaatcataaataactctcaagtg

SEQ ID NO: 44987 - DNA, 7586 bp, Oryza sativa
taaaggaagttgttttggacagtgacacggtctccaaacacataactttgacttcttgtttctataaaattatttattgaaaagtgatatgtgtatagttttgtgaaagtatttttcaagacaaatctattcatataatttttacattttcaaactcaacaacttgagagttatttatgatttatattcccaaggtttgacttaaatattgtcttaaacgacttcctttacatgtacggatgggagtagatgataactcatggatttttgcaacgtggtccggcttgccgcatctagatatgcaagtgggtcgatctataaactcatttataggtcaaattaatagataacccgcaagtcaaatccatgggttacccactaattttgcctataaacgggttcgcggacaagcctgcttgcacccctagtgaaatattttttaatggcaaaagaacatgatctgtttggatcccatgaagacgaatattaagtatggacatgtaaaactagaaagccaataacacatggttaatttagttttaattattttaaacttagaaatggatttatcttatatcttaaaacaatttcacatagaaagttttagcacaaaatacatcgttttagcagtttgaaaaacgtgctaacgaaaatcgaggtaaaatatgtatcttataagacaacggaagtcattcgaatttttttagtgaatatcaacaactaattcctaactacactaattcgaaagtagaaatcacagattcagaggtcgggtggaccgacacgggaacagaggaggcccgtggtggtggggcgacgccatgctccctagcctcgccactcttctcgccaagttcacgcttcccctcattgtgtcgccaaaggtgatgacacctagcctctctctctcctttcccatatcttcccattatgttctctcctatcttcacgacgccgaggcctgaggccctcacgacagcaaaaatgacaacctaagcatcaacctgagcttccccgtcttcgtcaccgatagagctcggtgatgccgccgccaccgtctagctcctctctgccgactaccgcccttctccctacacaggcacgtgccatggaggcctgaatagagatgaggaagagagagaggggaggaagaagatgttgtttcaatatttaggaccatcatgatttttttttattttctatttttgcttttggttccaggtcagcttaacacagcctacaaagctgccttgggactacattcgtttgttttgaaagataaagaacgtgtgttatacttatatctggtactgcggtccaaagacacgattcgaactcaacgtgaattatgagggacctaaagtgaacttattctatcacgcggttggagttcaatagtctatcaggcccatccgggcagagagaacaaagcggcccatccaggcagagagaacaaagcggcccaccactggcgggagtaggcgtaggaacaatctgtccctcgctcgcaagccgtggagatccatcctttttttcccattgcgtgccagttgccacctctcaaccccccgcccctggctcaccctccgggcctccctcccccctcctctcctctcccctctctcgcggtcgcctcggtgcagcccgcgaaaatagcagccgcccgttccctccctctccctctcccctgccctgccgaagccgcggcgatgaacggcgccacggccggctccggctccggctccgaccacgacgacgcgcgcgccgccgaggaggccagaggggaggaggcggcaggccgtgccgtggaggttgaggaggaggaggaggaggaggaggcggtgcccgtggcggaggagagggccgcgtggggcggcggcggcactcccccgacccccgagccgaagagcgacgcggacgcggagggcgcgggctcgctggatcgggtggagctcaatgcaggggcgggcggcggccgtgagcgcgaggacgacgagggggaggacgaggccgtgggggcgaggggggtggagatgaacggggaggacgccatgagccacgacggccacgacggcgatgaggatggcgatgacgaggaggacggcgacgacggcgaggaggaggaggaggaggatgatgatgaggaggatgacgatgacgactccacccccgatgcgtcgccgagggcggaggcgaaggcggagggcgagagctccaccgtgatggcgggctgcgccaaccagcccgctgagcccgaccccttcctcgacggtgacgactctggaacggaggaggagcaggcggcgttcatggtggagctggagcgcttccacagggagcacggcctcgagttcaagcctcccaagttctatggcaaaggtctcaactgcctcaagtgcgtgtctttctacacctctcgtttctgttagctcctcaacccgagtacacccatctcttctcgtctaagcttgctctgttccttttccaatccaggttatggaggcaggttgcccacctgggaggccatgagcaggtatggtcctcgactccttgtcactagcttgctcgctgctgctactgtagagtaaaatattttcggtgacatatgtccgggtggatcacgatcaaataagttcaacagtgattagtgagctgcaaggacctgagttatatttattctagttaaatattttgcttgttcaggtaacaatttgtaaactatggcgtcaagttggagagactttcaggccgccaaagtaagcctctaattttcacagaacatgttattcgcagaaaaaaaaagacttccatatgtgagtaatttgttgctgccgtaatcctttgcaggacgtgcactactgtatcgtggtcgttccgaattttctatgagaaggtgatgcatttgctgcatgattttcttttgcctctgtacttgtcacaagagaacttcccccttttcagttctttctgtcacaagtaaatggtcaccaacaatcattttttttcctgcaatcagtatcatatcgcatcaactttattgtaagttttagttgcaaaactgttagacttattagtatagttcttagtttcaaacataagaattgatctaaaatgatgggtctgcctttattagtgtaaaaattttaggggttcccgtgtcagttaatgttgcttccttttttggcagggaatatttaatgttcttacttcttacttttagtttaacgagcaattatcttacttgatgcgtcccttcatcattttattgaaactgttgcgctttcttcagatgctattactcttaattctttagatcattaattttcttagttatttatatgctaactgatgcatgttttggatggaatatagtacagaagcattattgtaagcttagattccatcccatatttatgcattgttttctgcttgatttgttaatttttgtttctcattaacttaggcacttctcgagtatgaaaaatacaaagtccgaactggccagcttcaagtaccattgtctgctttaccacagcctggtggtactggccgtgaggtaattgttctaatagtgcagtttttaataagagctctaatttattaattcagtttatattttagttcaatactgtacaatttaacgggattcaccctatttgtgtaaatctttaataattagatgaacacatgctgtccttttaggacctgtctaattcgcgcctgcgccaaaagtcatgatcagttacggacaggatgcagccacgcaggacttttttttaaaaaaaaaatcatcactggaagaatagtaagacgagagcacccagaaggcctcaatccagttcttgtgtccccaactcgtgcagcttgcatctcatttcttgaactccccagtcacagtcacgcatgggcatggcacatttgtttatagcttttcgtgcatagtctcccctaatcctttccctggaatttgtagcccttcttgttctgcatcccgaaaagggaaactttcaacttctcattgcaaaaaaaaaaaaagatgctactaaaaacctttgattggacaactttcatctggaactgaaaactttcacctggaactttcatctggttactgaaaactttcttttggagactaagctttctactagagattgaaaagcttcctattggagactaaagagcttttgatcggaaaactttcacatggagactttcatctcgagctaaagctttggagcacacaactttcatatagaaaaccaaaagaataaaacggaaaagagaagggaaagcataatcaatgtgcttgtcaggggcctcctgagtgaatgccaagcctaaacaaaattgcataccccttcgtgtcgatcaggcccgtatgctagcattcctcacaatgtgcgtgaggggatttacttttttttttatatccatttgtttatggaatggtgttacgcctttgttagcatgcacctcattagtcatgtataaatgaaagctgtgatatttacaccaacctagctgaattaaggacacagtctggttatatccggaaagaccaagggattttagtcactgaattccttctgaaaattgagtgttggttatggatccaattttattgacatagacgcactaataactgatttaagatgcctgccatttgttaaggtttccatcaagatgtgtggtgttgcgttgttgccaaaagtgttttcttgtcgatgcgtgtaaactactagttttagctagcttgacaagtttgtttactgccttgcagattggtatgaatcaatcatcttctgccagagttagaagggattctgcagcgcgtgctatgcagggttggcatgctcaccgtctccttaccaatggcatatatggagatcaaatgttgaaggttaaaaagatcttgctctttgtttacatgtaccttttcaagtcaccaactatttaatcagaaaagattcaaacttgtacaggaaaaagattcagtcccttcttcaagtcgtggtaagaacctaaagtatttggtatgtttgataagttttctttcagcagtgcatctgttgttttttctcatttatttgttttgacacatttaggagtactcaagaggaagaaagcatctagtccagagtgtgctatcaaggtgtctcgtacaaaaataaacaaatcacagttaagacttcctttcctttctgttggttatatagcattggctgataatgacttggatttagctacggaatatgtcattacaaaattttataggaaaatcctaaaaattacagttacattttgttcaattaagcttctcagcagaatttaaatccatatatttggatacttagcctatgaagcctgaacttgtatttatgtaacgggattctcaatttcagggatgactcaatggtcactgatgttggagaacctgccgagtgggtgaagattaatgtacgacagactgtaagtctcatatggtgcattgatattacagacaagtttttcagtgctcttctgaaatcctaatagcatatgagctggtttttctgttgagttgccatttttattcgggagaaatctcttcatttggctgtttctttcctgcagaaagattgtttcgaaatctatgctctggttcctggacttctacgcgaagaggtgaaaaaatatctttaatgttgaacgcatcacttcaaactgttccattttcctaaaataaatacctgacttaatttgtgcgtaacaaacaaaaagcttccacttcttgaactgaggcactacctgcgagaagaaatgaattgttgaattttgttctaaatggtgcaggtgcatgttcagtcagatcctgctgggcgtctggttataactggggacccagagcagcctgataatccttgggggatcactccattcaagaaggtgatagcagcaatttgaatactaatttgagcacgtttgcattctcttcagataacatgaagtgattactctttctcaggtggtcaatctgccattgaggatcgatcctcatcaaacatccgccgttgtcacgcttcatggccaactatttgttcgtgcaccatttgggcatgctgatatgtagatagtttcctttgagtgcagataccactggcccggtggtatttctggaattctttataggtttgtgattcaccgttgcatctatcccttgcttcaaattaagctcgtcatgctttgatatcaggtattctgtttttcatgcaggctttagacaattttgttgcagaagcaagtttttgtgtgagcagacgctcaatgccgagctgacaacggaattttgctgtaatcagtagcaagacttggggatctgctataatagtattgtttatagtagttgacataagtaggctggtttattttggtttgacctaccggagatttttgttttgttgtttatttttagtcggaagcagagtatatcaaaatagagagatgaaaataggttaaatgaaagcttaacttctttattttttggaaaacaaaggattagtttcttaacattattatttactattttcatagtaatgtttataagtgcctctgggcaatgcttgtccttaagcaaattttttatgcttgcatttgattcctcgtcccaatggactattgaattctaaattttgttgctggctatcatcgaatattaaggtccatgttcttttcagctatttcactagatattgtttgtggattatttgtttcatgtgtccaaaaatattgaagctgttgctaacttttctctaaaatttacatgagccatctctaatgaatttcgttggatttggtgaaaaaaattccacatatacaatcttatctacatcgaatttataccgtattagattacctgatagaggcattattttccaatgctattgggtgggttgatttgatagacttcttttgcttttgataaataatagcgataaaaataccaaactaaaaccccttgaaatcaagggcagccccatcgtttggcatacttgaggaaaaaacggaacggcatatttgcaaataaaaaataattgtgaataaaacttttatatacatgttttcaacaatccaaaagcaaaggctggaaaataaactatgatgaaaaattcccaaaatcaacttcaaatttaaggttgaaaaatttaaattttggttgataagtataatcgaaaagatgagaatgcgaggttgcgttcgttggaatgagttgggaactaatcccttgcacacaaatggaacgaattgtagcgtatgattaattaagtattagcttatttattttttatgagaaattaattaatatgattttttaaagtaaatttcatatataaactttttacaaaaggcaatacgttcgagatgtgaaaaaacgaggaatgtgagttgagaaagccggcaaaagaacacatccctaatagctccagtaactgagcccacttgtaactgcgatcctacggcccaactcccagggcccatcaattagtagtgaaacaaatccggtggtgggcccgattcgcaattcgccaaacggcagggacccgacgcga

SEQ ID NO: 44988 - DNA, 36810 bp, Oryza sativa
tcactcgttttcggggaaccagattggatctgaatcgtgctggacctcgcctgcgaggtgcagggctctgtctagcaatgtactagtagatccaaccggcgtgcctggcttgcgggaggctgcgtgcgcgggggaatttttttttttgaaagctcgttttgccgtgttggtattgtcgtgttgctgttttatttatgagtttagtagtggagcgtagcaacttggaataaacagtagatggattgattcgtctacagcaaccatggacttttctttttggactagctttcacggtcctgtgttgtgttgtttacttttgtggtgacccatgaatcgctatcaaatcgtaagactttctcctgtttagttatgctgtttgactggtggctggatcggatgaattcatgataattttgcgaatgattttctcgcgtgcgtgtgattggtggtggatgaatgattttgtgaattcacgctctgaatttcttcactccatgtaaatcagggcaccactgtgagagtggagtatggtgacgctgcaattgctgctgatcctgcaggcgctcatgtgatcagccacgcgttcccccacacatacgggcagcccctggcccattttctccggaagacggctaatgtccccgatgctactgtcatatcagagcatcctgttgtcaggtatatatgtattttttacttgtgatattcaatttttttacttgatatgccatctgctgcaagacaagaaactgttttgaaaaaaagaaaccaaatactagtagtaaagtatttgtcaaattataagagaatgctggagagaaattacatcaaattatttgtcttcgcctctcactgcctgcacatataagacatctgattgttttgttttggatgcagggttggtgttgttttctgcggaaggcagtccccgggaggccataatgtcatctggggactccatgaggcaattaaggctcacaacccaaacagcaaacttattggttttcttggtgagtcctttgatatgcaactatgaatgtattaatagttcgttccctttgttctcatgtctgcttgttgcgtccaatcagactttcagcgtttgcttaaatagcttcacaagctacttagcacactatgtgttgtcgacttcccctagcagccaccagtgttttaatttgaattaactcagcatttttgttatattttatttgttttcattaccttagcaggtgatcacaactgtatagcatcaatacatcatttagtatttttgtcacataagtagtgacatctaaagctcttcaaccgaactttgctaggtccacttaatgaaattaacaacacagtgacatacctatactaaaaaaaaaaaaacaatcagtgatgctttgctacaagatcttggacagagtacctatctttcttaagtgtctaatccaaatcaaatgtgttaattttgtgattggcatcctgtgcatgaatccccccaaggcgggcttctgtctctcatgcctgcttttctgaacatgtctaacacttggagctaatgcttacagattttctttaactgtttcttatgtttgtgtttatttcgttcttttgttgaaacaggtggaagtgatggtcttctcgcacagaaaactttggagatcaccgacgaagttctttcttcatataaaaaccaaggtggttatgatatgcttggccggacaaaggatcaaattataacaacagagcaggtcaatggtgccatggctagttgtcaggctttgaagttggatgctttagtaatcattggaggtaggctttgtggcattagtctactaaatagctacattgtgtatattttttttaatcctaacatctgtttaatttctggtttctgaaggtgttacatccaatacggatgctgctcaacttgctgagacttttgctgaggctaagtgtgcaacgaaggtatatcataattcccttttcttgttgcagtccgtgccttggttcctgattccctatttccattgcaagtgtatgttttacttgcctgtaaatggcatgacacaatttattattgaacaggttgtaggtgttcctgtaactttgaatggggaccttaagaatcagtttgttgagacaaccgttggttttgataccatatgcaaggtagctttacattactatgctggggctccatttacctttactgtccttccattacctctatatgatgcataactgacctgttaggcatgtttggttttgtcaattgaggttgtttatgtatgcgaaagtgtgttttttgtgctatggataactttccaagttgcccattcaaaaatactacgcatttaatttaccactttgcaatttttatttattgttgaacttatttattattataacaggtgaactcacaacttataagcaatgtatgcaccgatgctctttcggctgagaaggtaatatctaatatggttgatccgcttcttctttagttggatgtactttcgtgtctgtgatactatttagctatggtcaattcctttatttttttctcagaattaaataatcaaattgaattgagacagtaaaaaaaactctgaattgatactgttaagtcccagtacagaaagagctaaacaaatatagaacacgggctataatttgcggttcactccttaattcggcctatgtgggaggttcacacttcacacacaggtgtacacaatctttgtataggcaataaaggatgccaatactgattgataacaatgcaaattcgcctaggtccattagacaactgaattatcctttttcttggggttccatggtccatttgttcttcagtatttctctcagcgtggttattcagtagacatacttttccagcaaggcctgctgagccttcctgtttacaaattcacattacaaaagtaacaattttatatgccttgtggttgtattctttctggcagtattactactttattcgcatgatggggcggaaggcttctcatgtggcattggagtgtgctcttcaatcacatccgaatatggtttggacttttcaacttttcgcttatgcttcctgagttgctgcaaattcttcttgcatttgtttgaacctgtatcatatgttcaggttatcctaggtgaggaggttgctgcatcaaaacttaccatctttgatatcacgaagcagatatgtgatgcagttcaggcaagggctgagaagggtaggggccttctattgtgatatgctcatgtaaccttgctttcaccaatgaaatgccattttgtgaaaatttatgaatttacttaaccttatatttgttgcacagataagtatcacggagttgtacttattccggagggactcgtggagagtattcctgaattatatgctttgcttcaggtaagtttgtacatgccatatggctattcatttacaacatttctaagtggcatctatgtaattgtaggaaattcatgggcttcacggcaaaggtgtttccatggagaatatctcctcacagctttcaccttgggcatctgcactatttgagtttttgcccccatttattaggaagcaggtgtgtattgtctgatactcatctatcaactcttggacattcataactctcatcaggtctctgatattgcattgttgttttctgatgcagctgcttctccatcctgaatctgatgactcagctcaactttctcaggtatattatagtatatgcagcaatactttcagtcatttgcgtatgctttttttgtttcatttcattatgtctgattacaacctccacatggttaccggtgcagattgaaaccgaaaaacttttggcccaattagttgaggatgaaatgaacaggcgtatggtatgctttctgcagcctttcttgtactgtctcttggttctgaggcattactgatgtctcagtctacatgtggagtgagtaatatttatattggctcatgatgttcttggtatctctgcagaaggaaggcacttacaaagggaaagaaattcaatgcgatctgtcacttttttggctaccaagctaggggttcactgccttcaaagtttgactgcgattacgcctatgcaagtttcagctcacctttctacttggacaaagcaattttattttgctgttgattaattatatgtatgttgtttggcttcaggttcttgggcacgtgtgctaccacatcttagctgctggtttgaatggttacatggctactgtgacaaatcttaagagtcctgcgaacaaatggcgatgtggtgcggctccgatttcggtgagattactactgtgcacccccttttggcaaaattagatgagtatgatatgaatgaagggaacacctaacccacaattcttttccctttagtctatgatgaccgtgaagagatggtcacgtggtcctgcggctactcaaatagggaaacctgctgtccatatggctactgtcgacttgaaaggcaaagcattcgagtaagtgtgtacacaatctattaatcccatcttatattcgatcgctgtacagttgctgtcattggtctaaagaagatgcataatctcattgacaataacaaacttgtgtttacaggctattgaggaacaattctaccagcttcttaatcgacgacatctacagaaacccaggaccactccaattcgaaggagcaggtgctgattcaaagcctatttcactgtgcgtggaagatcaagactatatgggcaggatcaagaaactccaggaatacttggagaaggtactttccataatcccaataattgatcgatcttcgtatcgaacaatctgaattcctgtggacaaatggcacatgttggtgtctattctaactgttgttgctgcgcaggtgaaaagcatcgtgaagcctgggtgctcgcaggatgttctcaaggcagcgctgagcgctatgtcatctgtgaccgagacattggcgatcatgacatcgtcttccactggccagggaaccccactctgagtcaaatggattactaaatccacattcgcttgtgtcatctgacatgtggggttagaaacagtgatgttgcaaccccacggctttctttttcgtgttttttctttggagagttttgccatttttgagccggtagcgtgagtctgctattgatgtgtttggttggactggaataataattgttcagacagcgatgttcttaaataaaccaaattttggtaggcaaaaaattacagtttgtgtttttcttccctccttcgagagggttgcactggaggagtaatggctgatggtacataactcgtgaggccaactgcgtggatcggaagagcgctggtgtggaggatcaggaggcaaagctccggccgcaaggtttggccgggaccccattcgctgcgtaagccgaaaggccaaaaaggaaatttctagagtccctgatcgctgataaccgatagtattgggtctgttcggcagccctatacagcggctgtgcagctgctaccattgatcttctataaatttcactgtagcagctggctgccaattagagctaccgaacaggccaattcttttttgttggagaaacgttattttctttcccgatggcgaatccctactgttctcgagatacgttggcaaatgaccatttgataatccttggaatggtaaaacatagagcaggttaaaaatgcaaatattaaaaaattacctaatatcattttttcctatcaaataaataaaatgagtaagtcctcaaacccacgctggttagcccatcaaattgttgagggaaaggagaggacctgtcactcagttttgaacctttgaaccgaattaacgaaatattaatttttgttccaagatgaggttcttgttggtaaagctgcgccgttttggtttgatatcaaaatattgccataccaatgttttggtagtttaaatagtaaatgtgatgatttggtttaaagccaaatatttggtaatgcctatactcaatttagcacaattctagaatgttcttcaccacaatttaaaatttggctctcaattggcatcaatccaaagacactcatttaacttgcctagagtttggcactaacaatatattggtagggtactaaaccaaacaagcccgctctgtttttacccatttttcttcctcttggttgaatcttcaagaattcccttccatcagccagctgaacatagtattattgtgtccaggtccaggcagtccagctgaacataatagtattactgtgtcacactcttgctaccttctgaactccacaagtccttttcctcatttgtgtgacgagcattcaggaagtttagtactttagttcgcagcgtgcagccggaaggactgcccatatttccataatactcctatttattaaagtaccgtcatagctctagtacagacatcctacgtgcaagtgtacaacaatcattggcgttaatacccatagaaggattaggtataggtcattttcgatgggtggaattcttgaagttcttcaaaccggggggagtttaacacggtttaacagcttgttggttgtgacagttttttttccccacctaaccctggctatgatcatatataacctgcaattctaaaggcttaaatttacccaatcgaacagcattgcgcgctggacgcctagatttagtacaagtggtactacaaatctaccatctgtttgcccatgatccatttttacgagacagttgtgtggacctttgtgcgagaaaatctgcattcctcccctagccggccatccatgcatgtgccggccacagccatctgatctagccgagcaatcaatgcgacagcattgcacggtatcgattgctacagtagccgctacatggcatattggcataggttgtgtttagtttcacgttaaaatttaaagtttgaaaaaaaagttagaagtttatgtgtgtaggaaagttttgatgtgataaaaaaattagaaattttttaaaaaagttagaaactaaactcggccataaatcacagggcgtcccgcagtcacagtgacgtcaccgttggctgcgtactcggtaaccgcaaagttcagaccttcatatgtgagttgtgacgccgccgaatgctgcaaaaccagccggtctgagtacgggcgtgggacgcccctttttttctgctacgagtagtggatgaaaatttttatcattgtgacatattttttaaactaccaaacaatatatttcttacgaaagttattctaaaatattagataaatattttttaattatacattaataccatcttatttaacgtaaaatatttaattttcatttttattttcatttccaacaatattttcatttccaacacaaaagaacaccgcgggtcgctttcctgatccgatcccgtttcttttaaaaaaacacgatcccgtctagtcatgtccgcatcttgcgagtcagctgctgagctaatcaatagcggcaacagcaacagcgagataaatcacggtaatcacagcaacagcaacagcaacagccggtcccggtttgcactgagaaatcactcggttagccagccgttcgaatccaaaataaaaaataaaattaatcaaaacgcaatcattttggtactaaaatttatcggcaaacttattccgaaaaccctgcgtccagcttacctcgccgattcgcgctgatccgcacgaacgggttcgtcgtcgggcgcacgcacagcacaaccatcccatctactccatctcatctcccttattccaagggatggcccacctgtcagccgcgccggctataagttggcagcgtggggcactgacaggtcaagcccgcgagccacagcggagacgacgcgacgacgcatcgaaatcgcccgcgacgcgagagagaggcggacaatactagaagcatccctcgacgcgagacgcgacgtctctctcgtcgccagcggcggcggcggatgggggcggggaatggtgaagtgcggtacggcggcggcggtgccggcgccggcgaggcggcggtgatggcggacgacgggaccacggtgttccgggggacggcgcagccgccggtgcgcaccacggttgcgctggcgctgtggctgggggccatccacttcaacgccttcctcctcctcgcctcgctcttcctcttcccccgccgcgtcgccgccatgtaacctcttacccaaatctctcctccagcttcttttccctacctcgcgctctgctcgccgttgacgggttgggtacttgggtctcactctcgcctctccgcgctgtattatccagggtgctcgccacgcagctcttcttcatgttcgcgccggtcaatgatatgagcaggttggggcgcaagatcgccaggttcgtctcctcgatttcctcggctgccaacgtttttttacctgaccgcattgttggatcttacattttggaggacgacgcatcctcaggttcatcagcaagtgcgtgattgggtacttccccgtcacattacatgtcgaggactacaaggcttttgatcccaatagagcttacggtgagcttcctctttatctcattccatctctggaatcttgattaattcttgaatcacattgatgattgataccgaggcttttcagttgattcctaaagctaaacagaaacaactactaaagatgatattgtgatacttgaatctttttaatctttaaagtatcaaacccttttggcctatttctaaaagctaagtaaaggagtagtaatatatagaaaagtatggagtcttttatatagagggcactgtccactgggttggtgattatattgtgctgtgcttgcagtgtttggttatgagccgcattctgttttgcccattgcccttggggtccttttggagcttgttggattcatgccattaccaaagataaaggttcttgcaagcagtgcggtgaggttcccacttcccagatttccttcctaggagtacattcttaagagtttgatctttcgacactctattactacatatgctatttattgtggctgcgaacatccatctggatatagaggccaggttttaatccattttctaaataaagatatgctctttactggtgaattggtcggtgttaggtgttctataccccattcttgaggcaaatatggacatggttggggttggttcctgcatccaggaagaatttctactcctaccttaaagctggttatagctgcgtcatagtgccaggaggggtgcaggagatgcttcacatggatcatgattcagaggtaactgcggatttcttcttttattatcaataaagacattgccttctttcttgtgcaaaaccaagtgaaatacttacatcttttaccggaatagtgatggttaatttttgcaaatgacaggttgcttttcttaaatcaagaaaaggtttcgttaagatagctatggaaacaggttcccctttagtccctgttttcgctttcggacaggtaatctactcttgcacccaataagttcataaatgcaaaattccttatccatatagtaaatttattcatggtattcagtttgctgatttttttttggcactactttgactagagctatgtttataagtggtggagaccaggtggcaaattaattgtcaaaattgctagagcaattaaatttactccaattatgttctggggaaaatttgggtaactttctgcagtttatatatattttttcaatattttttatttggtcaagagttcatatgtccttgcacattgtgatgcaggactcccattccgtttgcgacacccatgcacgtggttgttggaagaccaattgaggttaagaaaaatgctcagcctacctttgatgaggtgaaatatcatcttgacattatgccaagtacaccttttgatcagtctgcacactaaaaaactgaaattaaatgatgttctaagataaatattaccatggaaagtaggatcttttttgttttaattgtttttgaatggtaaaaaaataaaaatgtatatattcttacaattaaaattgggtaattccctgatgtggcagataaatgaagtccatgaacaatttgttgtcgcactacaagaactgttcgagaagtacaagactaaagctggatatcccaacctccatttaagagttctatgatggcttctgtaagttccagcagtaagctctaatgatctggatttacggaataaaatggttatgctgttaggccatcaattcaatccctcgtagcactgaagctggagtgtgttcagttcaagagccagaatcagaattcagtagcttcagacatgattcgccacattcccaacagcagttcagtaaggcaacgtattgactgacgaattatcctctggtggtttggctttggcagaatagaatgcattgtatgtaaagtaaatgtgtacatttgtttattactcacgattctctcacatcattatcagcaccagtgattgaatcgtgcacagaaggggaaatctcagggttcatattcacagacctggtgtacttccaaagctccaagttagtgcattggcagcagcagctaactcgagctgagagcattgtgtcgtcatacagaaaacactcaattttctgtaacaatatttcacaaaataaagacagcgaaaccgcagataaatcagttcaaatagtaaagtttttaacaacctagacttgaacaatatcgctgactcgggcagagagcattgtcgacttgtcgtcatacagaaaacacaatttctgaaacaatatttcacataatacacaagactgccaaaccgcagaacaatttgtacaagttttaacgatcaagactgataccgctaactcgagcagagagcattgtcgtcacacagaaaacacccaatttctgaaacaatttcacataatacacatcactgcaaaacagcaaaacaatttgtacaaatagtacaagttttaacaatccaggcttacacaacaccgataagaccccaaagcatgggtttctcatccgaactgatttattttggtcggacaacaaagtgccgttctcggaagtcgaggaactgctgagcacatagcaatgaaaaattaaacacataacaacagttctgataccgataccagtaacacaatagacggtagttctgataccgataccagtaacaccatagaagatagtcctcgtgacctcgctaccagttggtaacgagtaacgaccctgagcagttccggtagacacttgggttacagatacaggaggaaggaccatcttggtccaacattttggacatgatgagtgaagcggacgcaataactatttatacctccaaaggccgatcaagcatagatcacgacgatgaccatagacagacacaagactgacgggacgggctacatttgttggacttgtgccagacttcaacactgggatataatcaaccacatagtagcttgatgattcttcaggagtttaggtgaacaatcatatgagtgcatcatgactaatccaaggggattagtcatcttacagagtgctggactccattccagcatccagtatatctccatgggctaatgagctgtcagatacaggatcaataatgctgtatctagagcttcaagctgcagcaatggtcgcagtcccattgagacataggatgtaaccaagcaaaactgacaagagcaaccgttgctcttggatcattgtcccatccatcggggcaacatcatgattccaggtacatctgatgaccatgataagggcaacctgcagaaatttcatagcgaagattatcataataatcaaaattacagaaatagaactcaggtcaataaaatgaaaacttgtatatgataaaaaacaagatgcatgatcacattagtatacacgtgcgggcacatgatccaattggcttacaataacttcagacaaacacgtataaaccatttcccaatgttttgaaacaagaaacaaagaaagcctgaagcaaacagaaagaatttctctgggaaatttttgctatttagtgtcgaccatatcatatcacaagcaaacagattgattaagattcagttggctgtttagtctgtatgttcagagtaatgatgaacgccatgatgccatcaatgtacttatcttctgttagatgcaaaactaatctaacatcaacgttaagaatgaatttcctggtttggtttcaagttaattatgggaaagcatcacccagtatcgaatgcaatactattggagcataataggagatcctaaaaaacataacgagattaaggagtacaacaatgagaataagagacaaaacacaagcatattaacatcaaagtttgtcccttttgagttctgacaagttagaaccaataggtaactccatcattttgttctgaaactaaatgcatctgaacttctgaagggcagaatattgatggactaatttcccataagagtaagattggcattctatgaatgtaagcatggcttctcagtacagcataattggtaccttatgaatgcaagggggattacttgccaggtaagaaccagtactacaaatacagcagcactgctcttttgtcctgctgcaatctaagggtacctattagggacagaaaaagaacagttactaccagataatcacaagaaaagataacagcagtccagacagaacaaacctcaaggtacaaatgtttggcagcatagttcagcttgctctttggtctgaaccactagcctgtgtaaactgaggtgagtgagctgggaggaccaagtgcgggtgagtaggaaccggtgctgctacaaaggccaagtaatatgaagttattcacaaaaggagaacacttaagcagacactataaaaagatgcagggtgacgaatgaacgatagcatccatgttagcctggtaaatttggtgtgagaacatatagcataacacagtattgtgttttctggaaagacaagaggaatcactaaatactaaaaaaaataggcaaagaagaccacattaccaactaaaaagggggcctgaatggtgggccgaggtgtaggcgatgcactgctaaagtttgatccagttaactgtacaaatggatttcctggcacattgtaaccatgaatagccacataaccattacccccaccagaaatggacgggctgaactggctaaatggttggctagcagtatttgctgcggatgaaactccataaattggaacatattgctgaccaacatatgggtttaatgtaccctacaaagagatctctcatcagaatcagtcgatgctttgtaaaacccttatgttgcgcaaggaaaattaaacgtaatatttttcacacttcaacctgtggatagatgtattctgtcccatatgtagtgtagctgcaaaaggaggaaaatgaatgaccgaacacactttattgacttccaaaacagcgatattatgttccacgaagaaaatgaacatatttatttggcaattttcgaagaggagcagaaaaaaaataggatgcaggctatgcacaatctacacaaagtaattgccacaagattatatgccaaatgtggacgcctaagtaagaactacttgaagattgtcacaaatgggccatctaagagcaggaagctgcattggaaaagttaacacatcatacctgtattgcggaaccgggaatccttggtaatacccaagaggaagtgtccggtgctgaccataaccccctacataaacaccccttggaactggaacgccaaagtaggacccagctgatcttggcctccctgaaaacgttgtgcatgtattcagaacaaatgcttacagaaatagaactattatcaccgcatgagcacttccaagaactgtttaaggtaccaaaatggtatattagtagtcatcgtatcaccattaggggtggcatactgtaatttgtagttttttgtttgcaaaacaaaacaagcacatgccaaacaccaacatcatcagtacttctgttcaaatgaatgctcagtatcattttagctcacctgtggtgttattttaagtcccaaacccacttgagaaggtatatagttgactgtacctatgttcacttgattatcaatttttcttctttccatagttgtcttattctaggaggacgagtgcgggtaactaaattctagagcaaacacaatgtagaaccgatcaaataagtttgcagaaggcaacacaatcataccacagataccactgcagtaacttgctagcaagcaaatcctcacggtggtatcaaaatgtgctcataatctactcgaataagttagtgcaaatcagtgtcaaggcagggagatcaataccgagaggaactgcaggctgagcgcggccaagcgacgccaggttacaattggcacgcctgccgtcgatcaccggcgtcgggtcctcgcatgccttcctcgccgactcaggatcgcggaacgtcacctgcacaaggtcaacatgacacttgtataagccaaccactgtttacagccagcaattccacgaacaaacaaacaaacacccggaaaaagcaggatcaacagcggcgaaaaatcgaagggcactgacgaagccgtagcccttggagcggccggagtggcggtcggtgatgacgacggcctcgaggatctccccgaagcggtcgtagaagcggcggagcctctcgctggtggtctcccacgcgagcccgcccacgaacaccttggtgtaggtggtgtccccgaacggcgacgccagcaggtgcagccccgagctggagctcgacgccgacgccgaccccgaccccgacccctgctgctgctgctgctgcgccatccggcgagctacgcagcgatcggctggaatcccttcgaggatcggtggtgcgggtgggctagcttcgctgtccccctctccgaccttgggattggagagggttcgcgagtgggagcgaatcggcggtgggattttggaagggggaaaaggtgggcgagtcggcggaggaggggaaaggggggattgtgactggggccgacggttgggttggcgcgccttcttctgctacgggaacccaagtcacgttcgtttgccagcgaagaagccagtgtgtgtgacagtgtaagagggagagagctgtttgggtttttcaaatggatcacgcggttgacagcgaaattgcgggcgcttcgaaatattagaaacgaatttggaatcgaagtgttcgtggatgatgagcaaatttgctacttgtcgtaagttttggtcgatataaggtaagttggattcggacatgtttgagtagattggcattgcgttgcatcacggtatgataatataattttaaaagttcgttgcatgtttttcgcgtttttatactgttcatatgatctcagttagcatgtaagcaattgattttatataaaacaagttgaagagctacatgcctcttctatttggattcaatggatgtgatgtgtcatttttctttaatttttggttcaaggatattctgatgaggttgtatttataattctaacaaaattaattacaaacatgtatattagagtatatataacatgtaacttactagctatttctttgacttaccaagtcatgagaaaggtgtttttaaggattaattaactatctctatgcgaaggagaaaacatctccatactaaagtggaattgagatgttgaagtggtgttatgctaagataaattactaccacattttccataaatatagggatttctaactatacacttagatgaatttttataatcgtggatagatatagtacattcaatatatctttatacatgatagtgtggttgctgcagtaaacatagcttttcctatagataaattatcttatccgtagaatgacatgaaaaaaagttagggctaaaaattactcattttatcttatccgtagcatatatagagtacgttccatacatccatcttgatacatgatagtatggctgctacagtaaatatggtagcttttcctataaatgaatcattttgtccgaagaatgacatgaaaaaacttagggctaaaagttactcatttgatcttatccgtagcatatcctattttactcactaagttgtcgcaccctttttacgaaaaaagagctaaaagtagaagttatatagaagacctaaagtatgcacttaacacttctaaaaacatctaatgtagtataatagtaacacacaacaattgtcgtgaaacatgtacttcttaattctttatctttattcataagagaaattcaaaattactttagaaagttttatgaccaccattatattgtgtgatcagtaaaagtcctgtgaacgtatgaaataatctcatacgaatttgatcaaaaaaattttagggaatagatcatatactgtactccacctgtctcaaaatatatgattcgtagatatataacttctcatactaaattaatttattttggacgaagtgaatatttgttttaactatgtgccttatgataaagattctgtgttcggcactcactgctgggaacatatatgttgcgcacgaaaaatagagcggtccattagcgcgtgattagttaagtattagttttttccttcaaaaatgaatcaatatgattttttaagcagcttttgtatagaaactttttgaaaaaaaataccatttaacagtttgaaaagcatatgcgcggaatatgagagagaggtgttgggaaccaaatgtaccgaactgggggtttggatggaaccatgtcacatcagatgttggacactaattagatgtattaaacgtagattattgacaaaatccattccataactctaaactaattagcgagacgaatctattaagcctaattaatccatgattagtctatgtgatgttacagtaaacatgtgataattatgaattaattaggctaaaaaatttgtcacgcgaattagctctcatttatataattagttttgtaagtagtatatgtttaataatctaaattagtgtcaaacatcggatccgatgtgacaggtactaagatttagtctctgaacccaaacataactgcctagtcaggatgtaaaatatttccaaggtgagcagtgactgagaccaaaatctcgcacaccattcccatgctcgagcgagttcatcacatcaaccacacatttcatcatagattaccgagtagagagtgcttctcgttcacacttttccaaacgatcgactgcataaaagagagaagaagaaaaaaaaacacatttctcgctgagctccatcgatgacggatgactcacactgctgacaaaagagcagatttgcaatttgcaaacagcatcggacgtggaaaacgcccgagcctctcctgtctcctcccggtcttctgcttggaagaaaagaaagaacccgccgcccatccgcgcgcgggccccgtgccgttccccctcccccgcccacgcctctgcttgcggcttgccgcttagatccccctgtcctgtcctgtcacgccgaacatctgaacgcccgaggcgagcgagagagacaatcccgcggtcacctcccctctctctcgctgcgccttccgtgtacaccaccatcacaccctcccgtccgtccgatccccccctccgatcgcgtaccgagcaaacacgcacacgcccaaccgggaggggggaggcgaggtccgcgtcgttcgcgatcgccttgggttgggttgtgtctctctctctgtctccagtgatcctgggccaaggaggcggatggacgtgccccggggcgggggcggagggcgcatcgtcgggcggcgccggagggcgctcacctggggggcgctgcccctcccgatgcggatcaccaacggcctggccatggtctccctcgtgctctcctcctgcgacctgctccgcctctgcagcgacagggagcggcccctcggcggccgggagttcgccaccgtcgtctacctcgtcagcctcttcgcccaccctgacgcccccgccaccaccaccggcgacgacgacgacggccaggggggctcccgccgcgcgcgccccgccgccgcggagcccgcgccaatgcatgggcatggtggcgggatgatggaggccgacgacgaggagatcgtcgccgcggtggcgtccggcgcgctgccgtcgcaccgcctggagtcgcggctcggggactgccgccgcgcggcgaggctgaggcgggaggcgctgcggcgggtgacggggcggggagtggagggcctccccttcgatgggatggactaccaggccatcctggggcaatgctgcgagatgcccgtcgggtacgtgcagctccccgtgggggtcgccggcccgctgctcctggacggccgcgagtaccatgtccccatggctaccaccgagggatgcctcgtcgccagcgtcaaccgcgggtgcagggccatctccgcttccggcggcgccttcagcgttctgctccgggacgccatgtcccgcgctcctgctgtcaagctgccttccgcaatgcgggcagcggagctcaaggcgtttgctgaggcgcctgcgaattttgagttgctggctgctgtcttcaataggtacactccacatcatccactaatctagtttgttgatttgtgtgcttgctcaaagtgttataagactttgcgcgacaataggcaggcacagtgttaattaatgggggaaaaatgtgatctttcagtgtatcttaaggttgtcgtcttatgtttgagtaatggactgatgttgatagctagcactgaatggtattttaagaccaggtgatttcccacaacggaaagcccttctatcatgtgattgctgacagggtagagcccacagtgtgtaagctagcacatgcactggaggtactggacaatgcattatcaatactatgtttacttgttctaagagctaccagctaaatgcagataatgccagctcatagataatacctttctgaagtgttcaccttgaattgcctttttatgttcgcttaaataataccgaatgtgaatgaatcattggtttgtgctctccaaacttgagaatatgtggatttaagatctcaacctctagtgtgtatctttgcaccttcagatgttcagggactcagggtacacacatctactgacagtttacggtgttagaattttcagattaatgtcatttgtcttttggagtttttctgtgttactgactagtaactgtcgctctgtagtcagtatccttagaggatctattgtctctctctttttttttaaatgtacgatatgttgttttgttttattttgttgtctggaacctttacgtaattgtaggctcatgttcaaaagctttggttactgtcattaagtacactttagataacagtaggcttgtgttccaataagttattgttggttttcatgtttctaattaatgtatcttttcttacattgttttctgtcatttgagagtactgagaaaatatggaggtttttattgaatctctttaaaaaattgtggccgtgtgtttcaaagttccaaataggtccaacagttagttcctaggtatgctgcatttagtatactttcctaatatcctcacttgtgctattttaccacacaagccacttctgtgatttccacaactttgttgtgcagatttttcatattcatatttttctttgatttttcgtatccagttattcagacactgtacatatcggcatattattctaccagtcaaagtcaaaggtgtctatacatcttatttgatttctgatcttttaaactgtacaatgttttatagttgttcttggcagctagaaccatctacccaataccgacgcaactctatgggttgcatatatgggcaagtgtcatggttccatggatacctttttgcatagtgtattctccagggacttttccggagctaagtgtgagtttgccattgacattgttctttcaacctctgcatttcggattgcatatgtttcagtcttagtttttgatgtggcaaatgtcacacaatatggttgctatacagtgttgatttggtactattgtttgaagatccattatactgtgagaatcaatctgtttgtacaacttatctgattgttatcctcctctgtgccctatataagttctaatttagtaaatttcatgcatactttattgttggctgtgtacactcttgtggagtgtagaggccggaatgatatccattatctaaaaaatgtatactttattgtggaaattttcatttgagacaatcacgcagcttgcttatctaaggccccatttaatctccacatttggagataaattttggttgcacgtaaaacgagaaagctcattagcacataattaattaagtattaactattataaatttgaaaaatggatttattttcttttttaaaacaacttctatatagaaactttttttaaaaaaatgtatcatttaacaatttgaaaagcgtgctaacggaaaacaaggaagttgaagaatagaacagggcctaagtcgttcttacatcatcctttttttttcttttttgctctattgtttcgcttccttagtagaaccaataactccatatagaggtcatcttctattagaattgacataaaaactgttttaatcggtgtaggtccagcagatttggtaggcttcaagacattcgttgtgcactcgctgggaggaacctatatatgagatttagctgtatcactggagatgctatgggaatgaacatggtgtcaaaaggtgttgagaatgtcttgggctatctgcagaatgtcttccctgacatggatgtcatcagcgtatctggttttaactcttccccttgaactttgcatgcttcagttagttttgctttcctctctaagtcaatgcctccttttagcagaaaacgaataaaaaatcacattctttaacttctgtttggaaatgttgcgaaggaaatgatgaaaaacatatttcatcagcacccaaaatatttcctctcctattgctttgtaacttaaagaaacatgtccctaattagatttttccgatctagagaggaaacccttggcttcatttacagaaagcagatatcggttcttagaagattcagcaggttataagatggatttttttcatccctaagaagtatttttggatgcctttttatttattttctgctcattgtgcactagcctagttcaattgtaaaatatattctgattaccgaataacagtgaatgtactacttttcatcagactcgcatcaaacatggtctaatattctctgataatatatttgcgtgtatcaattaggcatttgtgccgggggtgctttttttgaaacaatgggtgttcacactatctgttttcatcaattcaccatgtattttcttgtctttgcatgcacattgatgaattaatctgtgtgcatcaggtaactattgctcagacaagaagccgacagctgtaaactggatagaaggccgggggaaatctgttgtttgtgaggctattattaaaggagatgttgtgcagaaagttcttaagacgactgtagaaaaacttgttgagcttaacattatcaaaaatcttgctggatcagctgtagctggggctcttgggggttttaatgcccatgcgagtaatattgttactgcattattcattgctacaggacaggatcctgcacaaaatgttgaaagctcacaatgcatcaccatgttggaagaagtaaatgatggagatgatcttcatatctctgtcaccatgccgtccattgaggtgattatttattcgttttactttccgttcctacctgcattatgtagattatagcataacctgctagccttaaatggagctgcaaaatctatagcatagagatcttcttgtattaactgaagtaatattttgttttagcatgcagtttgatcgtgagagcaatatccgcatcgatttttatttatttaatttcttcatgttagtaaaatggttcattttttctctcaggtaggtacaatcggaggtggtacatgtctggcctcacaggcggcttgtttgaacctgcttggtgtcaagggttcaaatcatggctcacctggtgcaaatgctaaacgtttggctaccatagtagctggcagcgtgctcgctggcgagctctcgctccttgccgctcttgcctctggtcaccttgtcaagagccacatgatgtacaatcgatcaagtaaggatgtcgccaaggctgcttcttgagcagcccttcgcatcattcaaatgctggacatatttagacagggattgccctgagcttgtggagaagcgaatgagcaatgggcttgtacatactgctgataagagagcgattctttagttccaaactcaacctgtattatactagcataatgtgtgaggaggcattaacctatagtgcagcttctgactgtaattttacccttcagttttttttttcattcttctgtaaccaatcaaacttatttttccattttttctggatagcagcaggtcaggttaacttatgcttttgtgcagtatagcagctcagtaatttttgtttacagcatagagaacctgactgtgtatgttcattttactgttcgttctgccttttgttccctccatgtccctcagttctgaattttgtagcctgtattgcatcttgcctgactgcctgttgcctgtgaccgagtgttgatagtgtggatcaaatcagaacgccttctctttttattttttcgcaatggtgtgcctgttgctgtcaggtacttgctttgatttataaggtaagtcgaatatactggtccggttcgttccataagcacacagatttcaaaagccaaatgtgctgtgattccttgagctcacagatttcggtgcgaaaattctcgtgttcaatcacgcctgctttctattgttgttgctgaagaatatcctcgccgcgctatgctggttcctacgccgcactagaaccacttgaaatcttgaatgattctccttatctttaaccaaaatcctactcctagtagctaaataaatcctacctcgaatctacaagtgcacatataataacttctgttcttgtgtagtcgctttcaatacacaagtagaaaaggcagattggatcaaaatcccggaaatttccacgctgttgaagagaaaacgaacagtcttcgggccagatttgtagcccaaaacagcccataaagcaccccaacaattctcccgtcttctctccggcccaagagaccgaaatgaacagactttgggccagatttgtagcccaaaacagcccataaagcacccagtcaattctccttcacctcctcctcctccagtcctccaccgtccagcactatctcctgcaactgctagtgcaagatcaaccagccctcgcacggcacaaaaatacacaatccttgcgaaaagtttgctccaccaccagtacaccacacccccaatgcgcgatcacgtccgcgtgaggcacggacgccgccacaatcccgcacgcgacgacatcggagcgttccgcgccaaggcgatcgagaccgcgatcagcagctgacgcgacggcacgggtgggtggacggatgatggtggcctccggcctcgggctcgcgcgcgcgcggccacagtggccaacgccgctccgggacgcggcatccgccggcatcgtcacgtggccgcgcggcccacggccacggccggcccgtatcaaaaattcgatgtgacatatctcggccccccgtcccctccacccaattcgcctcgccaccgcgcggggccgtcgcccacgtgtggcgcgtgacccattccccgcggcgttacgtgcgctctctctctctctcttcctcctgcagtagcctgtgcggtgcagccaacagtagacgaatccccctgaaaaagaaaaaaactgtaggcgaatcccagggtcgacacctgtcccatatccttggcgtgacacttcacgcatggctttttctgatgccatttcatcattagttagggttcccaaggtttacttatgaataaagattagtaagtactagtactactcctgaacaaacaattatttatgtagtagaattgaatcatcgagccagctttatatatagagagaattaatactgtaagctttgggagccaggcaaattatacgaaatgacaggagacacaaaagaggcacaaatgagtacgtgcttacaaattaatgtgacaattgagaggttgcctgtctctaacccagattaggtcaccgcagattacgacctccccgcgggtggcaactgggcgcatatctcatatcatttcaagtctcttcccgaccgataaagtaatcaactggctgcttaataaggtcattaacaatcaagtgctaaagtcagacggcttcaacgaaaagattagcattatcatcatcaggttaaccatggcgccatgcacggacaagcgagctaccgatcgatcgagagacgcttggcgccgcaacgcgacaggcgagggagctagcacatgcccggcgatgagacagcgcgccgctcggattatcttaatcctgcccccctaatctaatctaatcactcctccccacttgcatccacgcagctttaatcagcctttcgcccaggcactaattcttaattagccggccggccatcggatgctgcctagctagcttagcttatctcttggccatgattggttaaggtgcagaaaatatttaatcatatcatggttctcttgctcccctgtccagtcgcgagctaattagcttaattagcttgactgcagctagctactaagctgatgtacattttttgctgtgctcaaattcgatcggattctgtggttaattaatcaaaactaaagcctagaaatttgcgtggctgggagttaattagtgttaacttattctgatgcactgtccttttcaacgcagtgagttattcccgaaatagatcgtgtgtgttcttttccggcggtagtgtatttttgcatatatatggatcgtacgatctgcagtttcagcatgcatgcacgcgctgatctgcgcgtacggaagggaatcggacgtggaagaaaaagatgaaacaaagctatgagtttcgccttttcacagatttgtatattgcttaagtacttttctggctaataagcgacatcatgacaggctttttgattctgtacgtacagattgattaattaacttggtgcctgcggctagctaggcatatagctgtagttgcttaattggctgctgcctgctttaaccattgtgcgccaaaacaggctgtaaagaatggttttctctaagattaattctggtcgtatagcaatactcctaagcaatgactttagttcatatcttcgtatatcgtacttcctccgtttcatattataagactttctagcattatctatatctagattcattaacatatatatgaacgtgggcaatgctagaaagtcttataatataaaatggatggagtagattcaaattcagttgtactatgctctagtagggtgtgcagactttgactatttagaggcaggcatagtgttatctggtactggagtaagatggctaaattagctatagttatttgagttcaatgaacacataggaaaaactgcacgctctccgaaataagaaaatagctaaataacaagtcatggtataaaagttaatataataattgaataaataaatcagtactccctccgtttcaggttataagatgttttgacttttaacaaagtcaaactgcttcaaatttgaccaagtttgtaaaaaataataataatattttcaattcaacacaaatttattatgaaaatatattcaattattgaattaatgaaactaattaggtattataaatattattatatttatgtataaacttaactaaatttgaagtagtttgactttataaccatgtcttataaccatggaagtggagggagtagtacaaaagttgatatatgaattaaatagtataaaaattaatagatatggaataaaatacggtctcgatatcacaaagctaccttatattctgcgacaaggcaaaagtaagattcatgcatgtattgcctctgaggatcttattgattaattagttattatttcttgtgcttttaaattagtagtaatatactccctcagtgctcagaatataagggcattcccaacccaatgactaggatggtgtctatagcattaaataaactgtcacctatgatgaaaaatgatgtgacaagtgaataaatgaggaaagagaaggaaaccatgtcttgcatgagacatagtttctacacaacatccaagacatcatgtgagataagtagcattaaatttaagtatagaatagtggtgtttgcattggaagagtagtgtctagtactccctccattccaaaatataaggcacaaccacccttaacccaaagaccaagaagtaattattatcatcttgtagtttggatcatcctcgtaaatataatgcatgcattcaataggattagataatatgagagtggaggatttaaaaaagttataatttaatgaagaagatgccatagttaattgcatatttgcatgcatgccttatattatggaacatgtaagaaaagtggttgtgccttatattatggaatggagggagtactagtttcttgatgatgtggagtttatggaaaccatatctagtgtcttaggttgggaatggcctaaaggaagtcgttttggacagcgatacggtctccaaaacacaactttgacttcttgtttctataaaaatattttattgaaaagtgatatacgtataccttcataaagtatttttcaagacaaatctattcatataatttttatatttttaaactcaacaacttaaaagttattcatgatttatattcttagggtttgatttaaacattgttctaaacgactttttttacgagtacgaatggagtaatttacagcaatcgaaacattgaatatagtcctatcttgcctgctggcggtgatattgcgtgtgcgctccatcatatggtaaattacattattattcgatacattgatctttgcgaattttagaggcacgtacgccgtacaaattaacatcagtactggatctctgagctatatatccctctatgtccaacttgcggctgtatgggtgtgtttggttgcaagccacactttgccacagtttgccacgcctaagagcatcaccaacagccacccaaaattcaatcccctaaatcattttttttagatctctaaaaaggatttaaggtatgagaataccttttatctccaagagattcccaaaatttaatcctcaaaacaaaaaaagtaggccacatcgacaactaccaacagaatcgtcattcctctcctccactcacgctcgcacacgctgcaatgctgcatcctcctcacggctcctttcaggacattcagtgatcaatctctttgacatcataactgacagtttaagcattgaacaatgtttccattggcttcaggtacgatctgagtatttgccccaaaatgatatttcacttgattattaccacgatctcctgtattttacatggaaaaatattggttctgcaatcatcaacaatggggttttcagcccagaaaaaaaatttcagcttttttagtgtgaacggtgttaacaacttgaagttttcagcagcaagcagcaagatatttcagcagctgcaatagtacttttcagtactagcaagcagcagtttttagcagcaaagaacaacagttttcatcagccagcaaacaacaaatttccagtaccaccaccaagcagttctcagcaatagcaagctccagattgagcagcagcaacaatcagaaatcgactccgaccgaggtgcacgatgattcgatgaaggccagagactgggcacctccggttgtcgccggctgctggtcgcatcgcatggggcctttgtcgcctgcacattaccggggggagcgcagcgccagtctgacgcgagagacaggctgtgctgcaggatgcggtagggtcgagggacgattggagatgaataggggcgacggccgattcgagtcggtggtggtgctgggggagcgccgacgaaggtccgcccaattgggttggagatgggtctggcgctgccgctgagaaaaaaatgtcgacgctggggaagcttgggggagccatggctgctttcccagacagctgcggggaagatgaggctgctggcgtgatggattgactcacaggtagacgaacgcacaaagaagaacctggtaggaaaattttcacacagcgcgcgcgaagtgcatgcggttgaaggattgggcgccgagtctcttccctacaagtggagaacgaaatatgcgggtttggaaacgccaagcttttaggggtgatttaggtctactgttggagcgattttttccaacaaaactcctcaaaactgatattgggaagagtatcgggaaactgttggccatgctctaaggttaggcaaatttgacaggtgtttggttgtagccacagttgtggcaagattcccctccaacaaattgggtcccacgtgtcaatggctcaaaaaagtgtggcaagattcccttaggcttagtaagttgtggctaacaatttgatcacctcaccttagacaaagtgtggcaacttttgttggcaagtaatggtaaagtgtggctgggaaccaaacagcccctatatctataccggccggctgggcacttgggcagtagtactgctggactactggcattagtgcattaattagagccgtcagacaaattaacttagatctacgcgcacatcaacttactttctttgttaaaaaataaatacatcctgactacgaatctgaacctagcctatatccaaattcgtaatcagaagttgatgattttttcttggacggatggctatgtgcataaattaatgttgaactcgacttaattttccaccaaattattggtgaactagttaattactactcccccgtcccataatataagagattttgagtttttgtttgtattgtttgaatttgtgtaaatataaaaaataaaaagttgtgcttaaagtactttggataataaagtaagtaaaaaaataaataataattttaaaaatttttaaataagacgagtggtcaaacagtgcaattaaaaactttaaatcctttatattatgggacggagggagtaagtaccagcaagctactcgcgggccatgatagtaataatagttttgttggatcttaattatcattgagtttgctgtagatgtttaactattggcagttgaatacctgaacctaattagctgcaggactattcgcctgtacaagctggatatccggaggcaaatgcgtcaaactaaacaaagcagcggagctagtcgcagcgcaccaatcgtcaactctgaaagtctgaagtcgtcatgagttttattatccataacatgcaggcatggatcgattaccttagcactgtcttatatatgcatgcctggtagagtatagtattactacttgatttttcaaacctaccagaagaacatgcaacatgtatctataactgaatttgtttctcgctctctttctgcattcaaaacacaattttctttgcaaccagaaagcagaaaaccttacacgcatataatccgtactacaggtgagcacagattcccttttctttagttgagttgccgctcattgtttatgtccctgtacgtacttgacttaataaacgacgaaataattaaaggcagagctagcatgctcttgcatgcacagccaccaacagtgagaagaattaggtcatggcagtgggcatggcatggcatgtaaggcagtttttgtcgccatccacgcaaggcgtcacatcaaaatatagcttccaagtgtagctaagccgagttggcccggccatctagctcgcctgcccaattttataacccccctagataacttaatcataagctcgaacacataaacaatggtgtttagttgaggaagccaacaccagcactctttggataatgaactcttaatcaagtgcacaactgctcaattattttacaggccagtggagagatcgttccaacgcttttgtccaccctatgtacaattctatatctgcaaaaatacaagcgagagccaataaacccctgccatgtactgtatcgtttgttctggtgtctttgatatgctataaaacttaacgtaccttggaattggattggaagcatgattctcgtagcttcgattcaatactagcactagctagtaaataaatatgccaccaggaagagcaaactacccccccccccctcccctatatgtatgcgcatgaggtcactcatgggtgcattcatggacgatgtttgtcgctttaatttagaggcagagctatagctatatagacaacaaatcaacaatcactattcgctactgcaggataatgttttgatttgatcttgtcacccacccaaattaatactgcacagtaactaaactatggaggagagtaccagcctagctaatcaattaaacgatatccaacaacacaatgcttcaatcgcatgcatgttgccgatctatcagagaggcgctcgatcggcggcctcgcatgcgtaagtgcagtgtggcagcagcagcacgtactgcttgcgaatggatcacactgtgcgtgcgtgcagagtatgctgcaggcagagatcaataaaagagcgtgctagctagctagcgcgcatgcacgggaaagaccgagaaatcaaaggcgctggccgggcggtgatgataattgataatgatattgatacggatgcgagcgcactgtgtgtgtctcgttgcaacagggggccagcggccatgcttgcagcgatcgatcgatcgatgggatgagacatggaggcatgggacgagagagaggggttgggtaggcaccggcgcaccgcgcgagatacgtttacacaggcacaaccgctgatcagggaaagcagatggatatatcacttgcatcgcgtgtttgcaatgcaaatgcatatgcagtgatcacggagagagagagagagagtccaagtagtgaaggctgcagctagcacgggatactatacgggctatatatctagcttgatacagggggcgtcacagctaggtatacagagctcacatttgcgttatcttgctgcagacttgcaggaggaatgggagaggaagatgcagtgataaatagcagttacaatagcaggctattagccagttgtaaacatattttaatgagataaaagatgagagagaagagcagcgggctacagatctatagccagctacagcacgtacttcaagatacaatgtgtgtatgacatgtgggaccatatattaatagtatagtaagcaactattgtataaattgactattagattggctatatataaattgaagctaatagtgggctatactattaaacttgctctaaaacggccgtttgattcaggcgaggccggccgatgccagtgccaccgatgaatttggggatcgcgagagattgatgaggagggcgagatgggcttaactgtggcccgcgtgggcgtggccgcgagggcgatcatatcatatcatcgcggtggctgatcgatctctcgctagctagctgctcgtgctagtagatggtgaccgagacgcgcctgcccgccaccaccacgtgtctgacagctgtacggacggtgtagccgcccatcacccccacattgcgttctcgtttattttgaccggacgagagggtccccctagcttatccttgaccgcacgtgacggtgatctagctagctcttgcagctacgaggctcgatatcggtccaacggagtcctgccagatcggtgcagtagtactttttcttcgcgtgcgtactacggagaaaatcaaatgtacatatataatcatttcatcctaaaataaacaaatctaaaatacaatgcgatgtagtagtactatttgaagtataaatctgtttgtttcggctgatttgggatgaatcggaatggcgatgcatggctttaattttaccacaataccaccgtgtatatagatggatggattcatcttcatatatactagtactgtggagtatcatatgaccgagttaatttatgtgctccgatccagtaaccaattggttatttaatttaggatctaattgatgctagaagtgctgacatgcacgcgtgacatggcactgtgcacagcgctttctttaatttcatggtgccaggtctgcaccaattaactacatgcagctatatactatctccgtcccaaaataaatgcagccgtagaaatccgtgtccaacgtttaaccgtccgttttatttgaaaagtttataaaaaaattttaaaaaatagttacacataaagtactattcatgttttattatctaataacaataaaaatattaatcataaaaatatttcaaataagatgaacagtcaaatgttgaacatgaatagtgtaaaactgcatttaatttagacggagagagtaactcattcttaaaaaaaactgtgaaaaagaataatacaactgctagaggtatccatttgttgacatgatatgttatggtaccgatcactttcaagaagatggttaattaattacgtctgcaccgatggctgttttaatttagggcaaagtggcaaaactgatctataattgatgctacagctattgtaactagcagccgagaagttctgacatgcatgcacgcgtgacatggcactgtgcaccgtgcagaaatgctttttaaaaataaaaaataaatcatgatgcatgctaggccaggtatatgtaccaggtgcatataagagcaagtttaatagtataaccaactactagctctaaatcatctatagccaatataatagccaatttatacaatagttgtttactatagtattaatacctggttctatctatcatacacacattacgtcttgaagtccgtgctgcatctggctacagatttgtagcccgctacttttctctctcttcatttatctctttaaaatatgtttatagctagcttataacctgctattgtacctgctctaatgcaatcaatagttagctggtcaacagttaaacgatctcaagatatcatgatctcttgtcttttaagaattactccgaacaaaagagattcaacttaagagtgtccagcgcgtgtttgtggtacctgcgtttagagtcaaaatttagaaattactagtaacatgcttactccagtatgttactatacggccgctgtcaaaaaaagatggttaattaattggtgtatcaaagtcaacatgtgtactggcccatgcacgtaaaaaacggggaaaaaactggccgaccgaaagacgtactcgcctttggatttcaacctgttttgttgcgtgctagctcctcccttttttatatgctcgtgtagctttcattgacatatacaccattcatgtctccactctgctaatctgtggcgacgatcattaagtcactgttcgtgattgcgcggcactaaactaataccgctgcgtctcgagatccagccaatcaggccgtggtcattcaaatttgtttgctctctctcatgcgtcacatgacaatgacccgtaatccgctattaaaaattaattgaacacttgagagcatacgcaaagcgacaaggttatcttggcttctccacgccgagaaaagcctggtcacaaattgcaaaactcaagttttcgcccagctcgtttgattaatttccagttcctgaatgggacctctcaccaaaccggacctatccatgcatgccacatgccagtatttgggcgcagccgataatacctcgagtcgtccttgattagttgagaaaccacttcatttctaaagttatccaatcttggaattgtgaacagctgcttgtacccatgttgaaatatttccaaacgtaagccgatttcttatcctaaacaggctctagtacatgcagtttggtttaacggaacatatcaaggctagctctagaagcttgcgatacacagcgcatgtatataatcgttggacaattacgtacgtacagtgctccaaatgggggccaaaacggctgcgttctttccacaagtttcccaacccctttccatcgttttccgcgtgcacgcttttcaaactgttaaatggtgtgtttttttgcaaaaagtttctatacgaaagttactttaaaaaaacaaattaatccatttttaaaaaaaattaactaatacttaattaatcacacgctaatggaccgctccgttttccgtgcggtggagttgggttcccaaccccaagtatcaaacacagcctatactagtactaaacgaacccaatactcttggatatgatcgaatgaaaaagccttcatgcgaaacctagctactcctattttatacgcgtcctagctgcaaccccatactatatagtataattaaactacatatatataaaccgggcagattttttttaatataaaaaagcttcacaaatcaggaccggttcgtaggttttcaagtagtagcaggaaggaagcgtacgttgcatacatacttcctccgtcataaaaaaaaaaaagacaaactctagtttacgtgtccatcgtttgatcgtccgtcttatttaaaaaaattataaaaaaaattagaaagacaagtcacgtataaaatattaattatgttttatcatctaacaacaataaaaatacgaattataaaaaaaattatataagacggccagttaaagttggacacggagaccaggttttgtctttttttattttttttttgacggagggagtatgcaggtcccgtgtagtattatcttatgcggattgcttgtacttgcccgggtgtatataaaaatcaccggtacagtaaaaagcgacgacccaattgtttaacacgccttgtaggtccaattatttgcttgcttgtctgcctactgtccagtgactgaccgagccctgcacaccctacgtgacagcaccactaccctcgacttggcaccgatcgatcggtgcatgcacatgcaccgcgctgccgctaccgcgcacgcatttgggcggccgcctgcgcgcgagagcaacggcgcgcccgcgaatttcacgacgacccgcgtcgaccacgacgtcgtgggcgaacgcgtcgcgtgcagctgcagtgcgggcgcgtcccgtgggcgcgcgcgggggagggagacgtactccacgttttttatgttcaacgaacgcgacaaacgagtccacggcgcggcgggcgcctcgttcgctcgctttggcgtacgtggcctctgctacttcgggttgcccccacacgcgcgcgcgcgcggtggcctggcctgggcggggcaggccggcctttccgttccccgagcgagcgagctgctagtaaaaaccggggagttggtgtgggtgggattggcattgtatcgtgagagagattgatagagagagaggcggacctccctgaccttatcggcagcgccatcccatcccttgccgtccccccaagagctcacccctccgcctcgcttcttcatctcctctcctttaattcggccccgcgccgcccgcttcacccccatcctacaccgcgtgcctccttaccttctctttgttggaataacgatcgtttcgcttgctgctccggggaggtttttcttgggcgatcgatcggctgggcaggttcgtcggagggaggtttctgccgcgcgccgccggggtgtcgacgtgtcgagcggtgcgtggaggaggagaagcgtgcggcggaggtaaggaaaacatgctagctacagcgatcgatcgttttgagagcttcatcattgctgggtagcttagctatgctagctagagctagctgctagatgtgtggacaagtcaaaggccaaagctttgctgttgatgaaaagatctcccatttcgctttggttgctttgctttgcttcgctgtttgggtttgggctgcactactgtgccatgcaaattacttcgagattctttacaaggggcttaatctcgctttgtcttggcaggttgtggtggtgatggtgaggagcgagttgtagaggaggaggggcaccgatcaaccgggaagctggcggccgggaagtggtgggagcggccagatgacacggccatggccgggatggaccctggcgggggcggcgccggcgccggcagctcacggtacttccaccatctgctccgaccgcagcagccgtcgccgctgtcaccgctgtcgccgacatcccatgtcaagatggagcactccaagatgtcacccgacaagagccccgtgggcgagggagatcacgcgggagggagtggaagcggcggcgtcggcggtgaccaccagccgtcgtcgtcggccatggtgcccgtcgagggtggcagcggcagcgccggcggtagtggctcgggtgggccgacgcggcgcccgcgcgggcgcccgcccgggtccaagaacaagccgaagccgcccatcatcgtgacgcgcgacagcccgaacgcgctgcactcgcacgtgctcgaggtcgccggcggcgccgacgtcgtcgactgcgtggccgagtacgcccgccgccgagggcgcggcgtgtgcgtgctg

SEQ ID NO: 44989 - DNA, 4290 bp, Oryza sativa
tgtacgagcggctgccgctgaagggcgaggaagaggaggtctccgcgcccgccgccggaggcgaagcacaagatcaagtggcacaatcagctggaccccccagggcagcaaccggcggcgtcacagtcctccggcgtgacaggaggcgacggcaccggcggcgccggtggcatgtcgctctacaacctcgccgggaatgtgggaggctatcagctccccggagacaacttcggaggttggagcggcgccggcgccggcggagtcaggccaccgttctgacccatgtcttagcatccagttcaaaaattctccaaattaagaattgcgcagtgcagaagccatagcaatccaatgcagatatgcaagctaagctaatggtacaaaattgcgacatgcatgttggattgttgattggacgatcgacaggcctttgtactgggtgcaacatacgtatgcatctatcatgcatgcgttgcaaattaagatttcaattcatattcatgaggaggtttatcatatacacatattttaacatctgtgggggcaagaagctagaggagagttgcaagagcaagctcggaataaaccaaaggtcagtgagattatccaatgttttgtgtttaattctaccaagtgtttttttttcatttttttctcttttgcattctgtaatatggtactatcctattctagtttgtatcttttgatcggtagaaccatgtttctgaaaaactcttgttcccttttttcaacctctgaaacatgtgcaacaccagaactgtcttatggtcactttcactggtctgaattcaagctcacgatttggtggcgttgaatattattttttatttttattttttgttttggaaccagatggtgatattgaatggttctcgacctggtcaaaatttcgaaccctagctaagctaggtcgatctgaagcatgcattttgaacaccattttttttgcaagaaagtaggagtagtagtatactcctagcttaaagtttgctctcaacaaattcaggatagtatacgatcaagtactgtactatcctgtgcttaattttggcgttcttgtactgctactcctactatactgtactgtacttagttttggcattcagtatataggtccagaaggaaccagccaccaggaggcaggagccttctgccctccctctttttgtttcacctgcagcttttataatggcctctgaatctctgacatcttcagtcatgtttttggcgtttcattgcttggaattatatgtgtgattgaatactgtagtatatatagcaatacttaagactgtgtctaggtgaggttccgtttaaccaacaggcaaagctgtagcaaggcagtggcagtgaggttccgtttaaccagcagggcagagctgcaaaatctggaaagctgctggccatgagatgccaagcccaaaattgacactagctgcaagattctcaccatctgctatggtacttgtactatcatgcatcttgcattctcgaagtacaaatctggaaatagggtctcggtcccttaatgggaaataaagaggagagggacgtttcacactttcgcataatttgtggggggagagagaaggcccagagctttggaacttgctcatagctttgcaacctttgtcctctcggagtcctggagatcagatgccagagcatccccacaccaatatctggtggtcaagcctctccaaatccgggatactaagctagtgccatactgtcatagtatctctcccccctttatttggagcatcatcatgtccatttgttcagtacactttagttttcagatgtcgatgtgttcagccacctttccaaagcaactgtttagattatgaagtatattttctgaattaaattagctggagtaatccaaaccagcacaagtgttaattaagtttttgcacccatgcatgcatagcactagcttgttggcattatatatctttcaatgttactagctagctagtactatatgcgagttatagtagacatgatttggtctctaattggatatattattaatgaaatgcaagttgcgaaaggaaaacttaagacgaggtctaaccgtctaatagtactagctaagtgctaataacagtgcatatatattagggtaaattgtattagcatgcaccttgtctctagttgggtgctgccatctacaagactacaactaaatcttgtggaattccattgagtggcattggatgttgtgtcatctacaactaaatcttgcagcaagcgagcaaactgtatttgctattgtctagaggcctagtattcagattaaacataaaatatcgatgcagaacatgcaaaaacaggattaaaatatgcagtcggcaatagttcaacctacattcatcttatgaatgataactgtaccttgcaactttgccttaaacagaatatttttgtgatgaatgaaatacttaacttggtggttaaaaaaccactatatattattgtttgttcaccataatgccggccgtttatttgcttggtaatgggtggtagtgataatcatgtggattaatttttaattttcatggctttaatcagcttatgttttaaagagatgatcatactaaataatgtactgtttcacctgatttgatcccgttaatttatatagagttttgttaacatttctatgttatttgttcccggtacattgacaataatgtaagactaagatcttgctcgattttctacctgatgatgcacctcttatgacttctttcgtcaagaaggcctttgtcaaatcacattggagtcaagcatcagattgccaagttttcctaatttggtcctatatatacatgttgttctctatattatggtacattaaatttgaaagaaactaaaggaacttagtagcaagggcagatccagaataagactataggggggacttatcttctaagaactagcttgggatttcatggttgctgaagctagtctcttttcttttactagaaaaaatgcccatgcgttgcaatgggtaaaaatattttttatcgcctatacattatactccttatttggttttggaccgaaagcccattattttcttccttttcagccctatcgtcttcaacctccggaagtgcatgtacgataccggagccgatcctcccatcaaattcggtcgaatctttcacgatgggttagttgagggtttttatccactcgatctcctcttttcctttttaaaaaatggagcaatccacaaaactcagaataaaaatagtgattgagattaaatccggtgaattaaagacgaattttaaggagaaatcaaggggaaaatgatgagggagttgtggggaatcaatttttgcaatcaattagaggaggaaacgcatagagggatagatcaacgtggcggctgagctagggttcagcccgacgacagaagaaaacctagttgataaaaaaacgaatccttaccgcatgcgaaaaaacgtaatgtaaaaaaattgggatgaaaaaaaagcgtgccaaaaagaccgcgatgtaaaaaaaagtggatgaaaaaaaccctgaaaaaatggcaaaaaaacatgtgaagagaaaactgcgatgaaaaaagtagatgaaaaaaaagcggggggatcggcgaaataatacggatggaaaaataccgagaagccttatgtatctttttattagccttatgtatattttattatgtatttttttattaggtatatagagatatatatttgttagcatcatgcggttctaatacatgcacagataaaccaatacaatttttctttatctttatatgcgatgacaagatgagtggagttggatggataaatttgttatggaggaggcataataggaataggggaggaaataaattgaaggtgaagtagatcttagcgtgacactcggtgcaacctagcttccagctaagttagctagctcccaactgtaacatggacattgttttttttaaaaaaaatcatttcctagaaaactaacaaaacaagaaattttgtgcactcactgggtaatggataatgtgagccagatgactctggtagagaaaccatctttgctcgatcggtcaaattccacaatagttctggttctaataaaacctgggattaaaaagtatctttagttccagtttaaaagttgaggggtactttttgatctttagtagatcatttttagtctcggtttaagaagttgttgagttcaagacagaccccgattatttttactcccggttggtat

SEQ ID NO: 44990 - DNA, 4191 bp, Oryza sativa
  unsure (1)..(4191): unsure at all n locations
cccctctattttgtgatgtgatgtatttgtgatctctgatgtatttcttttcaatctgtgatgcatttctttccagatctgtgatgctatgatttgtggatgatttggggatatatagggagcagatcaatttgagcaaagaaacaaaaaaaaaaagaaaaaaactagggatcaaccggactgcttccaccattaccaactgggattaaagatacccggatttatagttccggttgtatagggggttcccaactaggattaaagcccctttttccactagggtgaggtacgtttcgtagggtctaaaatttcagcaacgctatatcaacgcacgtacgtacaggtagcctagctacccggccattacccagtgagcacacaaaatttatcatgcccagatgatcaggcgtacgatgggaagaagaggaagactggaagaggaaagtaggaacttaccgcgtgtactgctgcccgcccagatgatcaggcgtacgctgcgggcgcaggtacggaaactccctcccccagaacgtacgccgggccttccgccgtgcagcttgccgctaccgcgacgagatgcgtcgcacactcgcacgcgcccgccgcgccgggatgcctggtatagttgtacggtgggcggccgccggccggcgctgcgcaatcacgcagaaatccggtcggttagattttgtagggggcaccggccggtgtccggtggccaagggctaaagccagtagaggccgcgatatgatctgggctgagcgtacccagcctgcgagccctgtaacataggctggctgggccgcacaggtagttgggccgtgaaggtgaagagaagatgtccatgcagaggcctctgatagccccgcaagcaggtgtacactgttacatacatgtctagactctagagatggcaacagggtgctatgacccgacacctgactggtttttactctattagaagctaattatctattatatgctaattatgttttaactcttatacccatgagtttaccgacgggcgaaaattcttacctattaggtacatgggtatgggtctattctttatctactcgtacctaccaacccgagggtgaaaaaacctgtagattaagcctaaatccatgagtaacataaaacttctttcttatcttaagttctattctagttatatgaaattattatttgatttcttgattatgtaatatggttgtagattttttttactcgactttgagcgctaatgttaatagcattgttgccagaagaattattgatgggttacggttcaaaaatagctaattatagaacaaaactataaatggtatgagtcaattatatgggtatgggtacccgttacctgcacgggagtgggtacagggatgatatcgaaagcaatactgttttgagatccaatgtgatccgattttgtataattaagaatgtgttatatcttgtattccggctcaggaatggttttgaaacttgacaataaaatgaaggagctcaaatgaacattttcctaggctggctaggctgcataggtcgtttggttcgtgaaatgtccacagggtttctcaggcgcaaacatgtcctggtgttttctctcaaaaaaaagcgcgcgtgcatgcacagggggagagagacagagccatccattaagattgtactaaatctactaactaataacaacgtagtaaagcatctgtaaactaggcaaggcactactagatggaactaccaattttgtttagattttggagtcggaactcctatccgatcgagtacgtgtatgtttcggcaaaatttttttttacctaatccctttcctgttcggtcagcccggatgtaaaagatacagtacagtgcctgcttttctctgcagcagttttgcacagagggtccaattttgagtggcatcttatattcttatacgtgcggcctgcctccggttcgtcgggtctagatatggtaacggggaattccccatcggaggttactccaccatacccgcctccgcggtggagaattttccccatcaccatcaccgtgaaatgcaacggggcaacatctttccccatcaccgcctccgtgcgggtaatttatccccgtggagcctccatccccgctatcaacttactcaacagtcaacatgtatgcatttctcatatcaaacaataatttagatacaaaagattaacactcaaaataacaattctagccatcaatttcagcacatcaacaacaactacaagaacacaagttcacaaattcgcaaatgcacatcatcagttcacaaatgcacatcatcaattcatcacttacaacaacagtgcagcaacaagcagtgcaacaaaagtgtgcccaagaatacaatatccatcatattcccagattaagcaacaacacaataatacatgatcattcatcattcatcagtcatcactcattagttatcaccacattgcagcagcaacacatgttgtccaggcatacacaaaaccatagtcggagtaggtcttttgtgccaaatatccaaaagcattgccatggtttacaagtttatcatgacacataacaggggttacaaacatccaaaatcattgcgagaacagtgcatgtccatacattcatggcttcaaacaagagcaagtccctaaattaaagaagtagcaaaagatattcaattagtcaagtactagaaaaaaaatgcccgtgcgttgcaacgggtaaaaatattttaaaattgatatacattatccagcttgctcggtttttttagttgaatactccttggttttaggctgaaagtcccattcatttcttttcaaccctcagccttgttcgctagctccatccgctcggcttgcctctttggcacggccagtgttggacacaggatgttgcggatgaaaaaatttaggtaaggacggacgaatccttacatacttttttattattaggtacatattaacaccataaaaagtgaccgtgggtcctttgcatgtgcagcaaccttttgtttctttcatggaaagaaagggcattaattttgtatacttgaatatgtattacatcctatatatcggtaagcatatatttatatatatttttgtgtatataatatgattatctttacttttcgaattaaaaaatggttcattataagatttcagaatcaataatttcgaattaaaaaatggttcattataagatttcagaagcaatctgttgaagaaagaggtgcaatactttttatttttcagcaatgggatgtgcatggtaatatgatttgacacgagggaaggaaagtagacttattctaggatgggcccatagacatagtgccagcaataataggtgaaaaaatgcgggagatttgacacgagggagggaaagtagacttattctaggaggggcccattagcccataggcatagtgctagcaataataggtgaaaaaatgcgggagaggaaggtgggaatcgaaccctggtcgccgggatgaaaactttcgatgttaaccatgtaggcagattactatatgtgctacgagattacatggaacttacatatagtatataaacctcggttttggagtagattgaaaactgtccgatccgtctattaatcagattaaaacggatttagctacacgtgtgggacagacgaaaaaaacgcccagaatccttacatattttttaattaggtatatagattttataaggatataacaaataatggcggtaggagtttgattgctaattttaagttgttgaaagaatagctcaatccgatcttggatatcttgaaggcaactccaaaagcttgctgcttcttcgttatcagctacaagataacaattataagaattattttgcatccattgcattgtaaaatctatgctaagcatgatgtatgaataaaacagcatatgtacctcgatacttgttttgcagccaatcttgtgagcacattaaggcctccaagagttctgaagtaagccggctacgatgctcactaagaacccttccacttgtgctaaatgcagattcagatgcaacagtgctaacaggaatagcaaatatatctcgtgctaccttcctcaatgtaggannnnnnnnnnnnnnnnnnnnnnnnnnnnnnnnnnnnnnnnnnnnnnnnnnnnnnnnnnnnnnnnnnnnnnn

SEQ ID NO: 44991 - DNA, 787 bp, Oryza sativa
ctcctcaacactttaaaattttatcaaatccacccatcctcatccttatcctttctatcctctctctgactctctcacctctctatcctctctcactctctcacctctctcacactaccaggcgcagacggcacgggcgcggcaggcggcaccgcgcggctcggaggcgggctcaaggcatgcgcacggggtgggcgactgggagcagtaggctcgcagcggcggacgactaccccccgctcggatccagcggagacggctgccccccgcccggatctggcggcggcggccggtgggagggctcggacggtgaggaggagccggatccgactaccgtgacggcgacggcgaccgtaaggagggcggcggcagcagctttagggctatggttttctttttttggattttctttttttcagtttataaattttgcgtgcgggcaacataaccaccccgcatgcgtaaatcagatgtttcgcgtgcaagtgcgccatccacacgcaaaaatagcgatttttacagatacttcgtttcagacggttggaagatccgcacgcgaaaatcacttttgaccgcacggaaaaatcgtttctctactagtgtgttcccctcattgagtaaagtatggtggaatgttaagagtgtggttgcggataagatataatgaaatttaaaatggacgtaattgaaggaatatatagtatttaaaattcttaggaccaaataaatccctcatatttactgatgcagggagtatatagcaggtacgagtactactaatgtgttg

SEQ ID NO: 44992 - DNA, 27644 bp, Oryza sativa
  unsure (1)..(27644): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgaggggaagttcccaaccaggatcaacaactccctctggacaagcattttgatatgaaaaatgtgaaaagggtaattcggttattcttgaagcttctgttacttgactcatcaattgtatggttataatcaatagatattccttttgccttttttcttttgtgccagattgttcttgaggctgatggttaccaaccatacctgatatcacctgaaaaaggtttaagatctcttataaaaggtcttctagaattagcaaagggaaccatcgatactccttgtggatgaggtaacatagttgaggatctgtttccttattctgaactagatagctttcctgttgtagtatattgcagtattatttcttattactcttcaaactctcttctacatgaacctttgaaagacccttgacttacagtctattagtactcttgtctggcactctgatcttgaaacaaatttgagttgcatgcttcatatctatatattccactgatatccgagtgcacttgcataatgcatatttagttcacatcattacatcaaaacctgcaaccaacatttgtgttattctcaattcatatttgttctgtgccttcttctacaagcatgtttgcaaattaacacaccatatgctagttccaagattgtactctcgaaacaacccccccccccccaactctcaacttacaactgtcatcactactcatgtactttctgtttgaattataattgccaggttcaccgtgtattgctagatatagtatcagccacagcaaatgccaccccaggacttggcagatatcctctatttaagcgtgaggtatcttcttaggattcataaagagggaagctttcatgattcaccattagtaacattttttatctccatttccgcaaggtaattgcaattggatctgctgctttagatggctttaaagatgaggctaaaaagatggtaattgcactagtggatatggaacgagcattcgtgcctccccagcattttatccgcttgttgcagagaaggttagtcttattactacgtagtaaccttggttaaaatttcaatgtaacttaatgaaacactgatgatacttgacaaaacatttgtggaacactgatggtactaggtaatactcagtgtctcagagagattcctaatgcctcccaccatctctcttttttcatcatctataggctcaatgcctgcattatctttccctcttaagcttactaatctctatttagatgtgtttttcaatctttatgtgttcacagaataagtactcgaaacttggtcttatattgcaacaaactgcataacctatataatttgaaattctaaaattacaattacttaacaaatattttgtgtttccttatttatcctcagagtcgtacccagcatgaaaaatactcagatgattaacacataggagacaatgccttaattagagttgtaaacaatctgctgatcttgtcaacagcttggtctattgaaaaaaacgagaacaccaagaagggaacatgcgcaaccacaattatagatggccatatggcccgtggcctggcccaaggcaccccattttggcccggcccaagcacggcatggcctgattggggtcgttctcgtgccggcccggcccgacagctgggccgtgcttgggctacgacctcggcatggtgggccggcctggcacggcacgatcgaacaaaaatattatagggatgcaaaatatacttaaatagccatataatgcaaggcccaaagagaagaggaatacaaaatagacttattttccagtcatatgaacacagcccacagagttgatggatgaaaaatacacttattctgtggagaagcacgatgggctgtcgtgccttcgggctggcccagcatggcccgagttgtattgggccattcctgggccgtgtatgcagcccgtgggcatggcacgactaacctcgggcctgggccgtgctgtgccgggcggcccatttggccaactataaccacaaacactttgtctattcttaggcttatgccccggtctaaagtggcaggttaatgtgctactaccatccaatgcactattcagacagctaccaactcaactaaagtggcaagttaatgtgctgctacctactccctccgtttcaggttataaaacgttttgactttggtcaaagtcaaattactctaagtttgactaactctgtaaaaaaagtagttatatttacaacaccagcatagttttattaatctataattgaataaatttttataatatatttgtcttgggttaaaaatattactactttttttacagagttagtcaaacttagagtagtttgactttgaccaaagtcaaaacgtcttataacctaaaacggagggagtactattcaaactgctaccaattcagctcagcccagccaagtctgcagtttagaactgaacattagttggcatactacaaggttgggttactaagagaaagctgtctgcatgtctaacactcgttttttttcaacttttaacatttttcccctaaccaacataagccacatttctctaaccatcagagtagtggacagtctctaacaatgcagaattaccatgtctgggggtatgtgtgtgacatgaaagttccttggacatgcgcatgataagtgcctgctgttcataataataaaataatatattactcccttagttttttaagtagatgattcgttgaccttacgtttgacactttattttattcaatttttctgtgtaaatatgaaaaaaatgtaactcatcaaaccaagtcacaacaaaataaatgatggttacataatttttttaataagacgaatggtcaaatacatatccaaaagtcagcagcgttatctgttaaaaccggagagagtatgtagtcatacttaggcagcatgggcaaccacaattaaatgcatttttttttgccaaatgtacattttcagccagtttggatgttttgctcaaccatctgtgctaaatttatgctgtacggatggatataaaccatatctgtgttgaaatttttaagaaattttgtttgattgttgtatatgttggtgcatggtctttcctgtttctttcaatctacaaagttttgcatatgttgtcttgcaccgtctagttttgcttcctattgctttgaaggctttgtttctatcttgatgtatacgtgttaggttttacatgcagaatggaaaggcaacgtcacgaagatgagctgaaaagtcgctcaacaaagaaggtttcagatgcagaacctagcaaagtacgcttctgtatattgtatattgtgtctacctttacattgaacttttttttcgtacagatattttttccttggccatatgttttaatcattacttctgtgtgtgtaatattctacatcatgctatttccccagttaacgtgtggctttcgttatatgttgtcaggccacaagtccacaaacccaaacaaaagaaggatcaaatttacaagtcttaggacctgcaggagaaattactgctggtatagtcttaggacatatggcagtttgtttaaagcttatttattggacgtagaaatagtcaaaagtatatgcctattagcataatttactctaatttaaatctatgttttttaaagtttccaacaggtttattttcttatttaatagttttttttcctatatcaaaggtttccttttcaaaaaacgtgcaaaagcaaatgactggagtaaccgctggtttgttctaaatgagagaagtggaaaggttggctttctgtttaagcatcttacatcccgtaacgtcatttcaaattttcactgggtttttactactttgatcatgggacaatgaattttatccagcttggttacaccaagaaacaagaggagaggcattttcgaggcgtcatcaatttggaggtacatatcttcagtgctctttgcttgtgattcttctcatcgctcgagtaactttctcgagatgaatgtgatgatgtcatgcacgtagatggattctcggttgtgccagtaaatctataaaggcagaagaaacctaccattttgcatttctccaaagcaccagtttatttctatttttggatctaagcattagttgaaaacattttgattggtgaagtaaaagaaaaataattagctctaactcaattccatagcactagagcaaactgaccgtcagtagattatttttcctttggtgtgaatcccatgataagtcatcgctacattagatttgtactggcttttgcttgttaaagtttttaatgttttcaaattacaggagtgcaatcttgaggaagttttagatgaggaagatcctacgagaagccttaaagatcctaaaaagccaaatgtgccagatattggaactcctggtctcattttcaagattacccataaggttgcttataaaaatgttttaaaaggtacatttaaatcagttctcatttataccaggttgtttcatttcttagtcttcacctgttcattaattaccgtggcagctcacaaggctattatactgaaggctgaaagtatggcggaaaaaactgaatgggttactaagattaggagcattgttgaccaaaaaggagcttctgcaacgagtggtttaccaatgaagcaaagccattcggatggttctctaatgtccacttctaaaaaggatggttctctagtaagtcagaatccttcttttattcttcaaaaagttcatcgtgaaaagattttgaaaatcatcttctagagtagaaaggattaattagtatatcgtttttgtaatcctttcctattttcaggacacgatgcttagaaagccagtagatcctgaggaagagcttaaatggatatctcaagaagtccgtgggtatgtggaagctgttctcagcagtcttgcggcaaatgtccccaagttaagcatgtctggtgtcttgcttaagctttcctggtctcctttctagcttcttgcattaatatcattgatcctgttgagcaggctgtggttctttgccaagttgagaaggcaaaggaaggcatgcttaatcagctctatacttcgataaggttggagctaattgatacacagattgaactcagtataacactttgtttttagtggcccaattcatagttcttgctccttttgtaaccattatgtggcattattgatctgacagcaaaaatgcacctatcttactctgcccttgtttagttcccaactttttcttcaaacttccaacttttccatcacatcaaaactttcctacacacataaacttttaacttttttcttcaaactttcaattttagcgtggaactaaacacaccctctgtttcattaacaatgtgttaactatgtctagttcacaattgtcatttgtggttagcatgcgaagcgtagaaaggattgaagagctaatccaggaggaccacagtgtgaagcacaggcgtgaaaaaatcaaaaagcaatcatcacttctttccaaggttactcgtctgctccgtatccatgataatcgctcagctacttctaattggtcgaatgattctgctggatcaggtaaccatatccttgttcctcattagttgacatagactagggaaccacttgcaagatgcatgaaaactgccccaaggaatagccctggacatttcttacgaaatagtaatcaatacgaatcttacagttagtatattcgactgtaatgttctgtgactcattattctcttctatctttatttcttctcagcgtaaaatcagatcacatgattggctttcgttaccaactcactgaatttccaacttacctctttcagatagtaatccagggagcagtggccagtctggagacgaatggaaatctgcatttgatccatcacaagatgttgatccatctgctgctggaacaaacacggggagccgccgcattccgagccgaatgccgccgccacctccacagggtggttgatcagttcgtagttttctggtcctggggcttctgttttctcagctgcagggagtacattccattatactattgctctaggtgctcttgatcaatggctaatttgggtttcaagaagaaaacagttaacgggaattgaccggtgaagcgttcataggcctttgaataacttgttagttgaagatagaatgtcagtaggacctcgaatattgttaggcacataaccgcagtacgtttatctctgtgtttttttttctcatggaactctggcaaaatcttgtatttcatgataattatgttgtttttgagtattctaccgatttgctatccatctacctatttgttgtattgtttgggcattggttaatgttgagtataatatgaaaaactccaacaggcatgcttctaaaaaggaatataaaggtttaaaatagcatttacattgtgtttcatgcaatactccctccattcgtgtatgatcattgtatatatcttttcagtgataccaaggagagcttaaaccttcataatgcatttaatttctgtactaatcttatcttagggaaacataacatcgtctgattttcacgcaagcatggctaagggcacgtacaacggtttttattagtagactttctctattgtcatgcaaataaatttggtgatgtgaaagaaagaaagaggagaaaagagaaatacggtgaaaagcggtaagacttgccgaatatattaaaaggaataaacaaacgtgcaaaaacagcatagggagagacagaaattagggtacaactcgagaaagagcatattacataatctcgagaaaaggattggcaactagggataaccacattcctttaaagggtctgggaagctagattgatctgccctatattttcctttacagcgaaagcaacttgttcttcgtttcgatggatttgctggaagatccggcgattacgttctagccaaacattccaccaggttatgagatctccaattattttcttcctcttggctatcggggaaaggttacagagtgtctcccaccagttcgacaaattgtttgtcgaggaaatctgtgatgctaaatcgtgtccttgccattgacaaactttgtcccaaactgttgctgtaagtgagtcgtatttttgaaagcatttctacaaaggctacagatccaatcacagggccagtgtctctttagcagaattttagcagtgaggattctttgatggagtaaaaaaataagaagagtaaaaaaaatattttggtacattaataattagagaccatattgtttcagctgttgtaagacgttagttcttagatgctctagagtttatacatgtcctaacgattgaattaaggctgtgtgcacacgaaacaaagggacaaaatgcaacgatcaatcagaaagtgacttgtatactgtggaatcgataaaaacgaataggggaagtactatctgttctaataaggattatattttttgcacggtctttaataactagtattttattatattctatgttcctaacaaatatgaaattagcatcacataaaagtacttcaaaatacgaatccagtgatataacatgtataatgcttagtataatgcttagtataatgcttagtatagatataattagtatgattattagtcaaaagctaccaaatttattttttttaaaaaaaaatgagacgtcctataatttaggacggaggtagtactaactatggcatgttcagggtttgattttagactgcgcaaaacgagatgagttattaatgtatgattagttaaatattaaagcactataaagacttaaaaataaatttatttaattttagaaaacatttatatggaaattatttacattgaaacgcaccgacgaaaaacatgctcattgatcttccattggacacaacttttaattcacatatttgaattttaacactaaaatccgtgctctattttaacctttcaaactaaagacttggagtttggtcattgccatttcaactcgagaactcgattcagtaacaccatttcaactcttgctgaaaagctggatactcaatctctctatctattataaactaaaagtctattaaactttctacaaacgctcccaagccaccacgtggtgctcctacaaacgttcctaggccgccacttggcagagtctaatcttaccgtcgattttcatttaaattgatgggcccgttattctgtaccgttagattagatctatacctgccatcagcggtggagccaaacaaaaaaggatgtggggtcatcactgtgaaccaatattaccgataaataaaaccataaaaactgcttggttttcatacgtcaatccagtagtttgagaacgttttttttattacggagttgtgacaaaaaaaacatcgatatttttttttcttctacactgttgcttgaaaatcatccaatgagcttgcaaaccagccggctaatcacaaagattttaattagtagctgtgctcatacaagatgaccaggtggactggggttaaatcaataattttactgggagcacattcaactacaacataggtaacaagaaacccttttacatgccggtttttctaaaagacacccagataatgacacgtatgacttcagtcatcggtgttagattataaaatcggcacctataatatgtataggtgccggttttgtaccaataatcggcacctataccgacttataggtgccaattatggaccatcatgccacgtggctgcccttatatgtgtcgattatttacaacaaccgccactcaataaatcagataaatcgaagaaattataagaaaaaaagaaatacatctagccatcgattttcagttaatacggtggacccaatattttatatcgtcagatctatcttttaaaaaaaatcccaaaacccataaaaaatcatctccaccgccctttcctcctggacctcctccccctcacggtgactacgtacatacatccctcccactttccttccttctttctctaatttaactattcaactttaattgatgaatccatttacatataaatagctcaggcttctaatataaatgttttaagagcagatttttaagcaccatattacacaaatattaaatttagattctataaacgctcctaaatcaccacgtggcaattcgacaaacgctcctaaaccaccatatggtactctaataaattatgaaaaaaaaacacagaaattataagaaaaaaaaagaaaaacatctaaccattgatttttttctttaaattggtagggccaatattttcaatcactagatctaatcttaatcttaacctatttaaaaaattcaagatgacaccgtgctctgtcacttgatgacgctatccatgagtcaaccacacatactccgcgcgtgtgttccgttaatgagggagagagaaagagatcattcttatgataaaatcttccagcctaatcgtaatgcagtgttgcagtccatcgaaatcaatttttgtatatgttcactgcatataaattaagatatgaaacatcaatgaataagcacaaacaaagtttgacgtgaccaatgaacagaacaaggaaatttgatcgtatcatgcatggaggaagtatggcttaacatagcatgagatgataatcaagaaaaataagtcacaactaacctaattagataaaaccctgtataaggcaacgttaccgcataaatgatgtatgataatgacagaaacatagtacaaaataaatttatttcgtagctaaataacgtaatcttatatgttactttgtacagtttgcatctttagttaatcatccacaaaagctataaacacagttaagattatgtgctttgaaaatttagatcaaatatagattcaacatcataagacaaaactaaggtggtatggctttgtgaaagaagaaacaagagagagagctttcgaccagactaatcatcgaggtgctagaaattgagagatgagaaaaataacattaactatacttagtgagggttaagtgtataattatatatatgattgtagcagacataataaattggcacgaacataaaaaatgcctaactatgtaacacaaatttagaagtggaaagatgataagcactaatttatgcccactacaagctagctaaaattattaaaaaaaaggtcagtttggagcaaataaattataactctaatataattttatagaaaaatattcaatctatgatatcaacaaaaattttacattttaaaagcaatgacacgtgagcagttatgtttagacatcaaatcatatttccatcgaactacgtggagcctcgcacaatctttatgaaatggcatatgggttgtattccacatcgcacaattaaattggacctcacgaaactttttattttagcaatggaaaaaatgcaatactttgagaaaagaaatagaaagttagcagcatcagagcaggacacaatgaatgagttataatatctagcatgcattgctaatgttatttcacatacggactatcacatattagcacaaataattttaagtctcttatccaacttttttaatcgtttgaacaattatattcatcacaatgcttttactcatactattatatagatcagttacaccgagcttaaatcagtgtactcccttaactatacaaaatatctcattttatgtcctaacaatatttttttatttaattttttatatatgttttaaatgagtcatatttaccttcacatatataaagagacaagagccaatgataattatgtgatatcctaaattccaatgtgtcatgggtttttactcttgcgtgtatataagccactaatagcattgcataattgatggcctttcatatttaaaagttatatttttcatattaaatttacattttattactcctgttgaataggtatttttagaaaaatatcatatgggtgccacgtatcatagatagattgatgttgtgcaagaattaatatacttacatgcatatggactagaggtaaggatagcttgatacacataaaatatattcattaattaataaattcttaatatttcataagaaaagagcaagacggtgaacattcaattaaaaagaatgaaaaaaacatatcaatttaacttgtcaagcatgtttttaacgaactaacgcgcgggctacattcctagttaatataaaatgaaacatgctctgtttccaaacccacatgcagatactaatttttcaggaaattaatgaaatcccactgaaaaataaaacaaatatctactgcctaaaatatcctccgatggccgcaacgaatggctcagatttagccgccgtcggaaaatatcaaccaatctccttcgctgccggcgctcagcattttggctgccgcgactgcgcggggagggagcatcgttacgcgactgcccgccatggcgtctcctcgctgcgccgccgtcgccctcctccatcccgccggagtcgccgccggcggcggagctcgccggcgtgtcctcctcctcgaccaagagcggccgttgtgggggactgaggtgcgccggcgccggcgccggcgtttctcgagcctcgagacgccgccgcggtgcagcaagatgtacgtacccggtaattatttgtctgccctcctcttaattacgccactactccctccatttcatactgttagcttcaactttttttaacttatttaaatttagttaagtttataaaaaatatagtaatatttttaagttaagtttataagaaatatagtaatattcctatcccaaaacaaacataatatctaaaaatatctaatgttatatatataatcaaactaatttaatgttatagatgttactaatttcttctattaacttaagacaaatctaaagaaatttagctaagaaaaaaagtccaaacgacttataatattgaatgaagagaagttaaaatgatttataatatgaaacggagagagagtattaacaatttaatttttttagtcgcaatgtttgaaacagaatcatataatttacttgctttgcgtcagttttgcataaccatttcgaaccaccagccagttttggcaatttgacatgaaacagttttattgagttttcttgtcaaaactaaaggaacagtttgcctcaaatatgctaatcacattagtcatctgtcatcctgaaaaaaaataatttcaaatttaatccacacaataagaaaaaaaacaaattactacaccctaagtagtactagtactattcatagtcatagccagatttgttatttttcttcaacttgttacgtatttacatgttggtgtagtgatacaccacacaattatctgtattattattattattgtaatttttcataaccatttaaaacacatgtgaagaataactgtacatccacttaggtgacaaaaatgagttttcctgtttataaaaaggagagacacgtttaacctcgaaaatgaagatgagagagacgtaagctgggccagcgtttgatgttttgggcctcttgggtttggatttgtgccattgtgtgggcttacttacatgtggtgtgggtttgggtttgtcggtccaggcttcggagagggatcgccggagaagaaggcagcaagaaacctgcagcacttcttcaactacattgctgtcagggttgtgctcacacagcttgaggtacctactcttcattccatctattttatcttctcattgcttccttccaaagtttcatcctaaaattcaaccggcataaaaaggaataacaaatgttgttaagttgtatctaatgttactccctccgttctaaaataaacaaactagcacagaatatgacacaactacggttctgagcatcttattatactatatttgtttgttttgggatggagagaatagctctaaactttgtacataatgctttgtgacactctgatacacaagttatcttcgttccttttttttctttagagagagatattatgtcttgctggagatctgattagatagctctttgtttatcgtgtttgtatcatcaataaagagttacaaccgggaagcatatggtgagctgatggatttcgtgaaccgaaactccctcaacgacgctgatactttctgcaagaagttgatccgcgagtctccaaggcacaagcagctaggtaatgatgataaaacacttatttgaactcctgaaatagttttgaacttaatttgcatcctgccatgtttcgttcctgagtttttctaatcttatcaattcccaccttacgtgaatgatcaactctgccataaagattactgacgtcttaatatcttgttttcaccctggggacagcaatgaggatcttggaggtgggcactgtcaccaactaccaatgtcatcttctgaacttaaaccttttgattacctttctcccgccggattaactaatacaattgcaggtccgatctgcttatgtcaagcatgatttcgagtgggataatctgaaaaggttatctttcaaggtcagattaatattccattttagttatctgtattttgcagacagaaaaaaaactaccatatatttcttccctttctggttaacttaactaatatcctatttgattgatttatttttttgaacgaattagcgagccaccaattttatttaatagaggagtaaactgtacagtataaatggaaaaacaggaccaaaggtcctaacaaactatgttataagccaatttcccagatgttatgctcctgctaagatccattctctggcctcctctttgattttcgtcagcaagccattcgacgagagttccttttgctgaaaggttctacggtttctttcattccaaatctcccagatgaccaaaagtgtcaacgaacggagggccttcttgggggcttctttggtgcttgtgattatttcccaccattctaggattgacgaagcttgctgcctcgggttagggtgcaagttactacatgccacccagttcgccatagcctcccaaattcaccttgtgtagcggcaattcaccaagaggtggagggccgtttcctgggcctagcgacacagaggacagacggagccattcgaccaccccctagtagttagtctttctgaagtccaaactatgttctgaatgaccagccagacgaaggttttacattttcgtggggcccaaggtttccaaattagggtgttgaagttggtggccgttgtgccgagaagttgcgcattgtatgccgacgctgtcgtgtattcatcgtgattgttgagtttccatgttattttgtcctcctcatgctcggacaactcaactgtctaggtagtgctccatatcactacaagttggtcgatcagttccgttgtctatcctgtatccgttggaagggtcacgtcgagtagccactgatttgaccgcagtgcttgttggagcgataggttctttttctttgaggctgagtagactagcggcgccacgtctttcaacctcccttcccaccaggccaactcccataagctagtagttgccccgtctccaatttttatggtggttgttgcagcaaagaggagcttgtcgatgtcgtcatatggtgtactagatcccacccatgctttatcagacaacttccaatcatgccatggccatatgaggcgcaaggcacttatgaatattattaagtggattattgtgtggattatctacttgattataaggaataaattagatatttaagaaaataaatttaataaatagcttaaaattgtggtctaatcaatataagtagaagaaagtttttttttgagaaaacatatttcaaagcgtgaagcaaataatctgtttcaataactcggtgaatgagctgaaaagaacaggacctcgtgaagtctcctaagtaggaagttgagaacagtcctgcctaatgcacctagctgctagtgtttattccattgtttacctaatttttgttcttccattgtctgcagatggttgatgaggccaacacaaagctcatgagggactatgtcttggagaccagccacatcgaagacgataactgatgaattttgcagagtcccatcaggagatctatccattcatgacactaaatcaatgcccttccacggatacacagctacacgcgcgcatatctgacaatgttctgtcaatcttacatagtttgcatacaaggtgtatataaataacacaagctcaagccgaagctgaggaatctacaaagctctgtactgaaagtctgaagcatgatcccttagaacaccacaaagtgcagacagctgctacagatctgaaagatggcatgtacatggaacatggtatatgtagatagtcaaacataacttcaataaaaaccctggagataattctgcgtgcatgtgcagatggttgaaaacttgaacagtccataatagtgctgatcattagccttcagtaataatttgcatcatgttatcttctcccaatcatacatggacccttcatacaaacataccacatgtgaggaaccactgcaccattaggcagctgacgatttgctgaaacttcatgagcatttctcagtggcatcttgatcagtttcagaaagacttgctatgatctgtcatgtcttttactttgaccttagaattagtaggttcaatgtttcagaagtagcgcttgtggccttggaaatgcactgtagaatatcctgttgagttaaagccttgactgcaaagtactcccttcgtttctaaatatttgacgccgttgactatttagcacatatttgaccgttcgtcttattcaaaaatttttgtgaaatatgtaaaactatatgtatacatataagtatatttaacaatgaatcaaatgataggaaaatagttaataattacttaaattttttaaataagacgaacggtcaaacagatttaaaaaggtcaacggcgtcaaatatttagaaatggagggagtaagtagttcagaatttgaagaaaaattgcagggtgctcagtttcagaaaagaaaaatggccaatggctgtcattcacttgaggagacgggccaaaaccacagttattaagaccggtccggtccagtcaaaagatcggccatgcattcaaaccggaggaaatccggttgaaccgccggttttaggtatgatacggagaaaaaccggacattagacgggagaataaaccggtaacatgcagctggaacgtgggatgggagagaggagaaaattaagggaaaaagagacgcgcggtgtactcgaactaccgacctgtgctttcagcaatcttcaaccactgagctatgcactcgttgacgattttaataaatatgtgaatctatttgacccgtgttgagccggtggtccaaccggtcggaccatgcaaaccgtgaaccgacggcttcaccggtttaacgtccggtccggtcctgaaaaccgtccggttcacccggtccaaaacggttcaaatgcacgtccagatccggttttgttttgttttagtcgatctgggtttttatccaactatgcatgcagatgcaggctgcagcatgttaggactcaaatccggagagacagagatttttttttcttttctttcatgaacatgttttgtggtctatgtttaaataggcagcagatttccagattgatacatcggaattttgtgagtatgtatgtctctgctttcggaattcagataccatatgcatggtcagttatgacgagcaattggaagattctaaaatttttctcttccataacggaactgccatttttatatgttttgagttttgaagcatacaaatcccttgaaaacccctttttcttttgtaacaaaaacttcatctatttcaacatgcaattacatacacactactactaaatgcaaaaaatagctacacatgcaaacttacagtgccggcctattcagccatgcaacaatgccacaaacctacacatccctaatcaaaattctaacactccaaattaaaccttaacccaaaaaccaaccaaaacccctcctaataatcaactaaaattcttggtgttcaatccactcgtttaatcatcgatcgatcggcattattattagcagtcctcgccgccatcttctgggcgtgcaggtgcgcgaagacgccgaccatgggcgcggtgttgtacgtgcacgcctccgtctgcatgtagttgtcgcggctgtccctgaacctgtcgcggtcgtccggcccgccgacgatggctccggcgaccacgttcgggttcgcgccgccgcgccggaaccagcggtcgtacccctgcacgcaccccacgaaccgcccgtccgcgcggtgcgacaccatggacgccccgcggtggtgcacccgccgcgggaaccgccgcccgtacccgaccatgtagctcacccccgccgggttgtcgcccagcacgtagtccgcctgcgccctcgccatcgccgccaactcgtcgccggttgccatagccccaccggagcaccggatggtgtcgccgccggagtcgcggaggtagcgggagtagacggtgaggaggaaggcggcgttggtgacgtactgcatgttgttccagcggcggacgaacagcatgccgccggcggtgcggttgacgttgtcgccggcggcggcgttcttgccgaggcaggcgcagaggtagtgctccgccttggacctgtactgctccagcgttgccgcgtgcgccgccgggtggtcgccgccgtccatgagcaccttggcggcgaggatctggaggccggcgtacttgacgtcccagctgaactcggtgacggcccagccgacgccgccgagctcgtcggccatggcgacggcgtagtcgaggtagccgcggcggccggtggcgcggtgcagccacagcgccgcccacagcagctcgtcgccgtagccgctcaccgacgcgtagtacgccctcacctcgccgatgctgctgtcgtacttgcccctgtacctgtcgccgaagtcgaacagctgctcggcgtggcggaggaggaggcgggagtagcggggcttggagcggcggaacacgatggacgcggcggcgagcgcggcggcggtctcgccggcgacgtcggagccggggttgtgcgcggtccaccttgtaggcttgcctcgacgtcgtcatgtcctccggccgctgccagcagtagtggtcggtgtcgccgtcgccgacctcggcccacagctcgtcggcggcggtgtgcgccttcacgaggtagtcggtgccccacttgatggcctccagcacgtgccgccgctcgccggcggcggcgatctcgtcccagaactccgccgcggcccacgacagcatcgtcatcgtgaacgccatgggcaggccgaacttcacgttgtcgccggcgtcgtagtagccgccgacgaggtccaccccttgctgcagcccgtcggcgagccccgagtggccgcgccaccgcacccgctggttgtacggcaggtgccccgaccgctgcgcctcgaagtagagcagcccgctgtgcagcgccttcttgtagtcgaagccaccgccatcgccatcgccatcgccggcggcggccgccattgtcgacgtcagaacgaggagcaccgccaccgcggcgcacattgtcatcgccgccaccatggctagctagcgatctcgcgagctccttcttcctctttcttcttggctgtttgaattgcttcgtctcctcgtcgtcatctcgcgggtgctgccctttttatggtgttgcaaagcgccatggctgacctctcgtcgttgaccacacgttaacctggtcggaccacaacttagttaattacactgtcttagttaattacaggtgctaatcatttgattatagggtgtccaacagaaggatctaatgcagagcatgtaatggtggggccaaggtgtcagtgggtcatgaggctgcctcagcttgggggcagtttctgtcggtagtgatctagctggattaaatggagaatagcttaattaattaatttaatttgctagagtagaggaagaagactattatatggagattaagtagcttagcttgcaaattcaacagtttagcagctgtgtaatactggggttgacttgcatcaccaaccatgtggtttcattgcacatttatttatttagtaccccagatataatatgttgtagtcaaaccttcctatggaacaggggagcctatatgcagccggagaatattggaaatcaaatgtatccattgatcaacacgttgctatgtaatgagtattactttgccaaaaaatattcccaaattagtgttttaaaaaaataaaaggttgagcaggtctttatcaacttagaattgaattcaactgccaaatgaattccacttcataattaccactcattagttgtatcaattaattaactggatctgttccaaaaccaaattaatgttctaagtggaacaagagattttgtgtggtttcaatgatatacaacaggtaatgatcatgtttgagttaacaaagcatgtgcaaaagaaaactcaatttaaaatacaacttaagttaaaaaagttgatatacagcttaagttaaaaaagttgaaatttgaagatgcagatgttggttatatcaactatttatggtattactacctctacttttaaatgtgtaacactgataactttaatatatacatggtgattcatcattcaattcgtctcctctacccaaaatataagttttgggacgtaaatagtaccatctattttttttcctttttccatatttgcactaatcttgttttgagtacttatcttgggctatctttatttgctgaagtttcacaatggattagaagtaaaccaatcttttcatttaacatcacatatatttaccatctttaatttatactttggaccggggttagacagcttgagctgccatgttggctttggcccaagaacgacatgggttatgctgtaatttttgcattttgcttcttaagttatgagaatggattcgagggctggtgtccaccacaaccgaagtccttaccaccaaatacccaaaaaaaagttctttttttaacttactttgtatgaaataccaaagaaactttttttctcgcgtgatgaggatactcaattgctgccataccaatcctttatctcgcatgatgcaccatcagttgcggcttcatggcttggctaaaattaagtccctcaaaatgcaacaatggcaattatatatgtattatgtggaaggttaggcttgtcctagttcattgtgaaactttggttaataaaaataactttactcagctgtttttgggtctgtttgggggagttttagattctgagaagcagctgtttggtagccagcttctgagaatctaaaaaagctctgaaacctagcttcttcagcttcttgctttttagttcatttttcagaatctgtaactatggattctcagaagctgtggattgtttggggcggcttctagcagaagcagtttttgggaaaagctacagctgggacaagctcccctaaacaggccctttgtcaagtacccagagttctattccccttcgttttgtcctaaacatctgatgggatagcacctctactccaacgaatgatcgatcaacacctgcagttttgatatatttaacaacaatcaacttggtatctgctgatctatctgctgggggatctagagctgtacaagtgctgaattgaatccgacagtgcagggggttggatccaatgtaattaagcagtaattaaattaaactaagcaggggataagacagctaccgttagattcctttcccctactactagggtgaggaacaaaaaccgtttagttggttgctgatgcgtctttgtcgcatcgcattcagtcagtctacgcatgtcgcagcctacaggaacaatcgacgactaagctaggggctatagggattagggaagtggatgaccacaacacattacccatatagtagtatatgtaaactaaattaagcatagttgaccaagctatatacaaaagttaactgctactactaattaacttcgtttccccagcagtaatgagaatcttagctggattatatgttctgcagctgcaggggttgcagcatgcaatgcagcctgacaaaatatactagagatgaaaaattcatgtttattcgatccctagctagaccgtcagtattcgtcatatatagtatttgtaagcaaacaaatttaacgtaatatcccaatgcagtattaatatggagccactctatcaatcaggattttgagcacaagtgtcagccattttgtatcctaattttaattcgatgaaaagaacttctaaagaaatttaactatgaagcgtgcatgtgaattgaagtaggagtacttaatttggttttgttttgcatttgcagtcttggatctctctgtcaagcttcatgttatcgatcaaagctgacaagagttctgctatatgctagtaaacatttggttgtaataatgttattgtcagtccgccccttaaaaaacgataattgccagtatatgatctgtttaatttccttaacttgaattcttagttgcatagtgcaataattgtttcagtaattaaattaataaatagctagttgacaatagcacatctcgatcggtttcacaaagaaaaaaagcatttcttacctacatgtttctaaactaatatatattgtctgcaaaggccagttggcgcaatgcgatgcaccggccgtgtgggttcaattaagagaaaaacttttgattactgtctgtaaacatattttaatattctgaacttatgtatatcacatggaattctggacaagtcacctgatgaatggtcgatgtgcagagtgttgcagaccgtgtgtgcaacagaaaattaagctgtatgcaatcatatatcgtaccaagcctgttaattaattattttgatgcagagcagccggattaggagaaggtattttgcaggctaaaacgtccagcgtgatccctgatttaagttaaacatcatgtgacatggaatctaagcatgttgctcctgaaattctcagtaggttttttcagtatatttgatcgtgcgggttcattaaaaataatctccgggatcgagccatgatcaaattaatctctgatcagcatgatgacaagtacttttgttatttctctaatttacttttgtgcagagttgacaatgaactgtatgatgttttctttcttctttttgttttaattcataaattaaaattatcattgcttatgatatacgttatttcatgtttttggtgtactcgtaaacattaaaaatatgtgttcactgggagagtatgccttcctattcgttcatagtggaatacgcgtgtacttttggagacttagttatatatataactaattaatggttttatcagttccatttgtcggcgagagaagtcaaactcgagagttgagtttcttctacatgatcaggactggtttgatgtagttcatatatatatatgtcaacttccattgtacagaatttgcaaataacaaattccgacacttatggtgatcgatcgatcgatcgtcgtctgaacactgacgcagctatgctataagtactacttcctccgtttcataatgtaagtcattctagcattttccacattaataataatgttaatgaatctaaatagatatatatgtctagattcattaatatcaatatgaatgtggaaaatgctagaatgacttatattgtgaaacggagggagtactagtatacacaaatgtatttatttgacatgcataaaaatctaattaattgacatataggagtatgttgttatacacatatccgatcacagttagatacaactgacaacagtattggacaccaaggtatatttaggttgtgttcggtactctcttttcccaactctcctctcccgttttcgcgtgcacgcttttcaaactactaaacggtgtattttttgcaaaaaaaattttatatgaaagttgctaaaaaaatcatattgatcctttttgaaaaaaaaatagctaatacttaattaatcacgtcctaatagaccgttccgttttccatgcatgggagatgtgttcctaacacccacctccgaacacagccttaattggtatacacgagatatattgagagaacatatattccgaggccgtgtttttcttcctgaatagtagaatagttgagtaactaaatgattttgtgttcactattcgagggtataaatgaatgacctaactattataaagttgaaaaaagtatttgaaacaatttttaagaagttaatatatagaaattaagtatttttttaatgaaaaatacaccatttaaaagcccgagaaatgtgtcgcattaatccattcttccattccttcaaaaagaagatgcccatatggtatttaataaatttcagagacatcaaagataaaataaattattttttacttacctaaaattacacattgatgtctacacattgatgtctacaattatatatagtgctatgcaatatgcaattttttcattatatggttttagtatatttttaactatgttaatttgaacattgttacatgtcattttttttcttttttgtatgaactgtcaatttattttatgtttaggttattagaacaatttattgttcaaccatttatatctaggaaaagaggatctttgtttaaataagtaatagtaatataagtgatgaaccaccattgaatttctatccaataggtgaaaagtgactaatttagacattcccctattatattcataaagcaatagaaaaagaaagcccctacattcattttaaaggactacaaattaattaatacttgtggagaaaaatgtgggagagctgattgtaatgtcggttgaacaaaacatattagagttgttacaaagtttataggaatacacttgtattatccacaaagcaagcacacgagttgtattttaaatatgtcaaatgcatacgtgtattaagaataagaaaatttaaaacaacacactgttcatattaaactgcagtttccttacctaactttgataatatttatattccaaattaaatatgctcattggtgttccaaaagtaccctcctgtgcaccaaaccagaaaccatgtatttgggctcgaaaactcaagctcagccatgggctatgactcccactccttttttttaaaaaaaaaagaagaagaaaagagtgccttatttaataattaaagatagtttactatgcaaattcatggatataggtaaataatttcatcctccataatacgagtacacacaacatctctcgtccatttagctaaatctgcatttcgttatacctacaagcctaacttgatctctgtgcctactgcatgtagtacaaggctacaaatggaaaatgctaaaaaaaatcattagccttattcggataaggctagctaatgattttttttctcctaaactatttgactgatctgtgataataaatgtttacagtaaaagtttttatgagtatatttgatgagaggaatatgtatttttaattattaaaatttgatttttcatgtgtaagagtgaaatgtttcaaatagcgttttactatgtttgatattttctttcaaatactttaatgactaaaccttttgttttacaacgtataacttgatgcttcacctatgttcaactgaaatattttaaccgtttaatttttaagtgagcgatcagacttccgatccctaactttgtctttaaggaagcgtatatacttctttcgtcatcttttcgaagatcttcaaaaaaaaatttaatcacagatttcatatttttcttgttagcttaaatttcatgccatttttctgatttgaattcgcaattggtactggccggtttgcggttttctttcctgaaaaaatgagaatgcgcatgggagcaaaatgggagagaccgctgttttcttatttctttttgaaacagggagagcaccgttggttcatatgacgtgcagcgcgttgcggccggcccatgcatgagattcaccggagcagaatgggcctttacaagtttactctagctggggcgagcgctggacaggagacggcccagtgggccaggccagcacaactcgtgggcttccctcctccattttttttctttttcttataggccctcctccatacttgatccaacaaactgtggcatgcataaaatttggcatggcaactttgggagccaaccaaacagcccctaattcctcccccgtctatgaagaaaaagaagacaaaaaaataaatgctactgagaatattctcccttctaaaaaatgagaaaaagggagaaaattaatctacggttgagagattatcgtacagatcgataagtttatttccaagcacattcagattttagtactaaaatatagctatctttgagtaaattttgttttacatgctccctccaggctagaatataaggatttttatggttgaacatatgtattaattaagaaagtcaataaaatcaaatgagagaaggttatgattggttgagaagtgaatgtgggtgagaaaattgaatggtggagacttgtgattggtggagaaaagaatgttggtgaagaagttgttatattttgggacaaagcttaagggctactccctccggttctatagtaattgacgttttgaacaaggttgaggtcaaactttcataactttggctatcaataactttaaaatatttagtttaaaggaactataacaacatatatagatttctctttcaaagcactataatagaagtaaacatacatttatttattgaatatattataataaaaaaataaggtcaaagatatattttgtagaccgtgtcattgtccaaaacgtcatgaaaccggagggagtagaagttgttatattttaggatggagggagtagctaactatagaagtaaaagatgattttaccctcattacttctcatgctatctctggtgggtcccatcactcactaactcttggaacatgtacctcatccatactacctaggggtggcaatttccccgttggggccggggacctagcaggtacccgcccctacgggactagggacgggttgaaattctcacccgcgggtgagcggggacgggggtggggattcaaaactatctcgtggggccccagagtataagatactgctgtaaaagcagcccatttcaaaaatataggcccaactagcccacatataaattctaaccctaatctctccactctctcctcacccaacatactccctctagcctccaccccagccaccgccctatccctcccgtctcccgtgccatcagccgcctcatttctgcgcatgctcgccatctgccacgttgccgccgcgccccttctcgctgtcccccgcctcatccgcgccccccctctccatccgtctcatctcctagctagtcggtcattgccgagccactctctatccactcctcattagcgcacccctcctcgtcggtcgtcgccgagccactcgtcgtccgctgcctcgtctgcgtgcctctcctcgttggtcatcgccgcccccctcgccgtccaccgcctaatccgtcctccttgccatttgcctcatcctcgtgcccctcatcgcctcatcagttgtcaccgaggcactcgtcgttcaccgtgtgcctcgtcatccacctcatcctcgtgtccctcgtcgccgcaccaacgccgtctgcctcgtccccacgcccctctcttgtcgttggcctcctcatcgtcggggttacggggggccgttcgaggtgcgggtccccggaggggccgggggcggggagattttgccccgttcatcactccggggccaagggcggggatgttatagcccgccctgcccccgccccaccccgttgcaacccctaatactatcccttgctctccacaccaaaaaccaaaaaaaagtaagtagagccactcatctccacaatacactgtgtatttcagccctacctctgacgagacacccccaaaacaccagccacaaccatgacctaccagtattgccgtgccgatgaactcgttgtgccaccgccgctgctgcctatgatcccaccggccggttgtgccatcactgttgtcgcatccggtcaggggaagctagatttggctgcactggatgccaccatcaactagccttgaagctttccactgccacagctggtcgcgccgcctcgttgctcctgagagaagaacgaccacaccggccactaccatccttgaagctcgatcgctcggttttcggctagctgctctggcggtggcggagcagggaaatggagaggaatatggggctactgggg

SEQ ID NO: 44993 - DNA, 37520 bp, Oryza sativa
tgtatatatgtattaaaataatatatgcaactttatatctaatttatatagagataacaatgtagttatagtgtagttacactatagttacaatgtaattatagtgtaactacaatataactagcatgtaactagaatgtaacttgaacaaatctacaataaacatgtgatgatgggactagcttgtgaaaatagggtttagatccgatagcaaaatatctcagcacaaatcttaacacggaatcaatggtaaaaaaatttgacagttttcattaaaaaaaactgtcgacggttagctacatggggtttggttttggcagtgctaggttttttttctttttcagtgaatcagtgtcagtgctaagctttgctcttgcctcagaatagtcaaagactcacgtgttcaactggtgcggtgagtaaatatggctctggcggttatgtgggaatgtgaagtatggtcagggcctcttgctcctgagagatctgaaggcctggcccaaaattgtaagggcccattgacttcgtataccaaactgaaagctcttgtgggcctcaaaaaggtccgtcaaggcccacaaaaatcagcatctgctcctgcacgcgggcgagcagcttaaaattatcccgaactgattcagaacagtataaaaaactgttgtgatcgcaagggatttcccggagcgcaggtgaggcgactgctcaccgcgcgcgtctgtcatgtcaaaatccgtgtctccccgaccgccccacggcgcacataccgcaccacacgcgtttttgtccgtcaagtgaatggaatcctcatcgatctatcatcggtgtcaatgttgcacgtacgatgatgattgatcatcgcagggcagggcaggcaggccacgtaacatccttcctccaaaaacgcaatcttcactgcacctgcgtctcaacaagagtgaaagagacgacgccatgagagggatgcagctggtggcacaaattatactcaccatatacaaatgctgccactctacgacaacacacacctcgcatctgcatctgattccctgcactgcactgcactcctgctcccacttattgggtgggagggagataaaaatgatcacggaaatttgtgaccgagtatcgttttaatgtttctaactatttttattttagttatatataaaatttgattttttttttctaaatttcttttgacgtcgtattgtattgatatcgactctaaattgttaaattaataaaatatgattaattctagagagagaagagatatgttaccggttccaatcgatttcgcgagactcactctccttttacgtacggctaggtccaggcgaaatggaatgatctggaagctacaacagaagcaggtgagtgattaatgagagatggacccgatagatcgtgcactccatcgtgccgcccggtcaggtcccccaagctttttatgaaacgtcgtccctctttgtcgcatgcatccatccccatgctggtttggtttggaaccaatttttgctccattgaaattttaatactttaaaaccctggcaagcttttatgctaccaaatttgataatataaaatttaaattaactagctagctagcgtggataaaaattgatagcaaaccaagtatcgccgatctcggaggtccttcagtccatccgctcatagagccatctttggtcgttagctggcattgctaattttggggttttattgggagagtagtgggctctgccccttccagttggttggagtcgtactttccgagtctttttcctttggtcttttgttttcctcctcttttggcataagtcggtctggcttaatgcgttgtgtaacgaatattcttatcttctaatatattgacgtgcaatccttttgcgtgttcgagaaaaaagatagatccctttaacactgttaaacttatcaacactttagtaggacaaatatcaatcttggcttcaaaccaaacaaatccatacaccgtacatccaaagtatgaaccatatttcttttatcactaagattaagtaggaattaactcacccaccatatgatataaataaaaagctatatacatgaatataaccaatcaatactaaaatgacatcttaatatcttgtcagtaatttaatttagcacatagaaactataaatatgtttctctaatttgaaaattatgtaaaaaaaatagatatattatagcctcttggatgtagggaatgccagattttgcatgcagatctatgcagcatagactagtgcccggccctgatccatgcacagccgcacacgtgttacccagccaagtctccctcgtacgacctgggctccacgtcatcataatgcatatgcacccgatgtgccacgtgtgcatccacttctccaattgttgtacagtactgatcactaaggccagtcacaatgggggtttcactggtgtgtcatgcacatttaataggggtaagactgaataaaaaatgattatttgcatgaaatggggatgagagagaaggaaagagtttcatcctggtgaaactcgtcagcgtcgtttccaagtcctcggtaacagagtgaaacccccgttgaggccgattcgtttcattcaccggatctcttgcgtccgcctccgccgtgcgacctccgcattctcccgcgccgcgccggattttgggtacaaatgatcccagcaacttgtatcaattaaatgctttgcttagtcttggaaacgtcaaagtgaaacccctccactgtggggattgtttcataaaagatttcatttgagagaagatggtataatattttgggtagccgtgcaatgacactagccattgtgactggcctaagagctgaatagagtctgtttggtacagacccaactcctaaatttaattctagaagttgggtctggagtaaagttgtagagctgtctaaacccagcttcacaattctagtttattttgtgatagagttttacccagctctactcccagttttggtggagctgaaattatttggctgagctccagttctaggaggggtggaactggagctgtagctatctcaaacaggccttatattgctgatgaatgtagatttgccaactgagagtcgtcacacgtgtcagccgtcctccactctctgtctctggtcgccactgcgcatacacgagatttccaattcttggccagcaattgcttttgcttggggccggggtccaataatccaactgaaagccatccatagaccaaccatgatggacgatgcgatgcatatatacatatatagctagtggcaccactttggtgctgtcatagatggagaggtgacacgtggctaatactcaatcatgttccaccgaggttttatggagtagtaggtcatctccggtttcatcccaaagtgtgcctaagatgaaggtatgcggaaaacaagtaatttagtatatgattagttaaattttgattattataaacttttaaaataaatttatctgatattttaaaataacatctatataaaaagcttttttaaaaaaatattccatttaacagtttgaaaaacgtactaataaaaaccgaggctaatggccaaaatattgaccgaacataatttggttagttggatcttaatcaaatttctctatctcggtcttttttttctattggttttagtcttttttttccttcacccctattggcacgatggtaatgctctactgaccgattttgcaaaacaacacgtgagtatccacctagtaagaatggatcaagctgagtgtttattagattattttttggactgtgtactactgtattttactttctccgtcccaaaataaatacagttttacattattcatatccaacgattaaccgttcgtcttatttgaagtcttatttaaaaattttttatgattagtatttttattattattctactactaataatcgaaaaataagagacgtttctgtcgtccggtggaaaaaaaaggcgagaaaataaaagaaaaacaacttctatccaaaaaaaagtccgactacttaaaaaatccgactcctcggtggaaaaaaaagagaagaaaaaaaaacttctatcgtaaaaagaaaccgtccgactaaaaaaaaagtctgactcccggtggagaaaaaaaggcgagaaaaaaataaggaaaaaacttctactgtaaaaaaaaggaaaaaaaagactgctgactacttttttaaaaatatatatataaaaaatgaaaatgtttttgccggtagttttggtacatcattcgtatatgggtcggtttttaaattcgttcgcttttgaaaatacaaattcgtatttgagtcgggttttaaattcgtccgcttttggaaatacaaaaggaatcgtataaaaaatctctttaaaaaactcgcatgctaatttgagacgatcggactcctaattgcagctcatgattttctaacaaaaatatatatccaagcgaatttaacacggtaaatttcatcttaactaaaccatataacaataataagattaaaatagccttcacccgtggcaacgcacgggtgttttttctagtagatgataaaacatgaatagtatttaatatgtgactaatttttttaaaattgttttttataaattttttaaataagataaacggtaaaacattcgacacggatacacagtataatctaagtgagaatctaaacttttaagagctacaaattttgaaggcactctcactgcatgcaggacagtcatctacgtcacctacaactgtatactggcccaaattattctaatacatatattaataattatatacgtaaataaatactccataaatcatcctcacactaaatctcaaatatcatgtaactactaggtctcaataaaaccctataattcctttcttaatttcttcattaaatgcattacaatgttaaatactgcgtagcaccttattaatttaattatataaaaaaatatacaacatgaaacactaaaattattatggctatgtttagttcagcgcaaaacttgaattttggttgaaattagagatgatgtgactgaaaagttgtgtatgacaggttgatgtgatgaaaaaggattgaagtttggatccaaactttagatcaaaacacagcctatatgagaattgagaagtcacagcggtcggaagcatctcagatactatcatggtcacgaacttatacagtagctctggaaatacatgtcggatgaaagttgatacagaacttatgtgtaaggactgagcttgtacgcttgaaatttacgtggttgtatacaccccattaatgtagaagttaggttttataaattctaattatctaaaaattagtgctggatgcctgtgttatcagttgacacacaaaaatatgcttatttaatttgtgtgccctactagaacaaaaatagctaaccccacttaaaatatctttcacagattgatagcccctgtatatcaataatatattttttcaaggttgctgatggttatttatttacattctcaaacatagtgatgtgccattaggcggatgatactgaaaccgcgctgttaattaattagcctgccatagctactacttatcccatcaattatctctcatataattcttttttctaattatcttggcacatacttcctccattttacgacataagactttctaacattgcccacatacatataaatgcatgtgtttagattcattaccatctaaatgaatgtggacaatgatagaaagtcttacattgtgaaacggatggagtatataactatcagggttatggataccacatacctaatagtagttgactaaatatcggcaagatccaccacataccatgtcttatacggaaactgacctcgagggagttccggataagaaaagacaaccagagttctacatagaaacgacaagaactactcggattgtatccatattggtttccctaattctacttgaacaaggggacacctatatgtataaatacaagcctccctaggaggacagggggacacccaccacgagacaatcaactccgaacacaatcaacatagaagccaacatacgtcaagacaagccgccggatatcgacatcagagatacgcctggatcgaccctatccggtaccttcagaggccggccgtagggatctagcactgtctctgattccgtcgggcgcgagctcgaggaggaaggctaccctgttgtcgactacgagtcagaccttcagaccgccatgtcgacaacagttagataggctaccccacatattgtattagtgtgattatggtgaataaaaaacaacatcggctccggccaacaggatgtagggctattacttgatagctcaggggcccgaacctgtataaaaatcctcgtccccatctcttttacctcagtctcgcatatatcctagcaccgacgatccccatactatgcaaatactagaattgcgacatcaaacgtcgacagtggcgcgccaggtagggggactttggtgcttcaggatctcgatgagatgggttcaagagatggattctccaacaacaagctactcgacgacttcggctgtgaggagatctaacccgactgaagtacatcttccgactagatcgaaaccatcatcgtcatcgacaacttggtctatcgagatcatccaagcctcaagatatgcggcgtaccaaaagatgtcagatcatatgatgtcgaacgagtacgcaataaggtaattggtagattggtttttcaaattaatctactaatttcgtagatacatccggcatgtatctacaaagatacgcaatattttctatgcaatttatcgtaccttttcagatcatacagcattatcagatctataatttattatgtttacctagagcatgttttttatacaatatctattgcgcggatgtttccgacattaaaccaactacggtctaacgctgggggctcgctctgttatcttctgtataaatcatgcttgtttacggtttacataatgtctgatatttacatctgctcgtcatatcctgataatactagaagatccatgcagtttttgagtacatactcgatattatctgctatatatcttgccttctagaaaatatttttcaagaacaattgagcactcgagtaggttatggtcgagtacactccattatcgagaacattctcgacaaatgtggagttatcgcacccaacctatcaacgaagaccgacgacctttctcataacgctggccatcgttggactactcgagaaaaggttgttaacagataattcctcgcaaacgtcgtcggtttgatcacccgacatgattgcgagcggacatctggatatgctataagttgggtacgtgagtcatgctggccacatgatatgcacatgtaatgaaccaactctagcgcccctataggtgattaagagactcctactcctggttctcgaaccagtaaaacgtagtgatctctctcgcctcactttaagtggtcgagttacgactactgcctggtcctcgaccagcgatgtagcgtctctcccactacttccactttaagtggtcgagttacgactactgtctggttcttgaccagcgatgtagcgtctctcccactacttccacttcaagtggtcgagttacgactactgcttgatcctcgaccagcgatgtagcgtttctcccactattttcacttcaagtggtcgagttacgactactgcctggtcctcgaccagcgatgtatcgtttctcccactatttccacttcaagtggtcgagttacgactactccctggtcctcgaccagcagtgtagcgattctcccactatttccacttcaagtggtcgagttacgactactacctggtcctcaaccagcggtgtagcgatttctcctactacctctacttcaacaaagttgatagcaggtacacaatatcgccaagtgttttacccagagatcccttaccacgacgacacctagcgttgaaacctatcctactgtccctttacgccgtcttgacaaggcctctgaggaacctaagggatcttcggctggggacgcccagagccggtaaggccttgccggatcctgtagagacgaaagaccatgtaagatctggtcgtgtaagagttcttgccgtgcatattaaccaagctgtgtaatcggaaattaactttccaacttcatggctgggggctaggatcagtgcttgttcaaccaaggcaggtcaagggtctaagagccttttcctccaagaacgattctccgatgacaaggctgggggctagggagagtgtatgactctacaaactgattgatcgaagtcggtaagagagaagacgctcatacacaaaacattagtcggtaaaattaattcatttttagttttccatacatattataacatgtcaccctttgagcgttcgctcgggggctatttctatttgatattcttttctgagtattgatttcaggaaaattctattcgacattgatgaagactccatgtctctatggttctacaccaagatcgactaaggcgagtacgactaatgttgacaaggctccgtcgcagactctacgcctcctcgatcgctcgagaacggttgctggatctcgacaaggaatacggaatgaagaaatggtgtacccgccgagataaaatttcttgacttcaatccaaattctcgattacagccagacgggagacttagtcgtacgctctgtactttctcggtcgacatcagagattgacttagataaaccctttcggtgcccgcacgaagctaataaaggaagtctaacgttatctctagactcaccgagaacggtcacgtgagctcgataacagttcctccgaagtctgcggttgagaatatgaactcgttcatttgcattgaagtcgggggctatcgtcagggttatggataccacatacctaatagtagttgactaaatattggcatgatccaccacataccatgtcttatgcggaaactgacctcgagggagttccggataaggaaagacaaccagagttctacatggaaacgacaaggactactcggattgtatccatattggtttccctagttctacttggacaaggggacacctatatgtataaatacaagcccccctaggaggacagggggacacccaccacgagacaatcaactcccaacacaatcaacatagaagccaacatacgtcaagacaagccgtcggatatcgacatcagagatacgcctggatcgaccctatccagtaccttcagaggccggccgtagggatctagcactgtctctgatttcgtcgggcgcgagctcgaggaggaaggctaccctgttgtcgactacgagtcagaccttcagacctccatgtcgacaacagttagataggctaccccacatattgtattagtgtgattatggtgaataaaaagcaacatcggctccggccaacaggatgtagggctattacctgatagctcagggtccgaacctgtataaaaatcctcgtccccatctcttttatctcagtctcgcgtatatcctagcaccgacgatccccatactatacaaataccagaattgcgacatcaaacgtcgacaataaccatagacacatcacacatagactagctaacgtctattgtcaatgactagttaaacgtcgccttcaatatatgcatttaccggttttgtgtacacgtttctatcttgtgttttgcaccacgaattagatttgcacaatctgatatttttctagccagttataagacgtgaatgcacgtacgtacacactacacactcgcgagtacatcttccagcgccctctcaaaaaagacagattatctcggtaattaacttagtagtaattagttaattatttcctccgtttcaggttataagacgttttgactttgattaaagttgaactactcaaagtttaactaattccgtagaaaaaaaataatatttacaacatcagcatagttttattaaatttataattgattacattttcataatatatttgttttcataacatcagcataatatttacaaaaaatagttctataaagctagttaagcttagagtaaaaagtcagagcgtctcccaaccaagtaggagtaacaaaaaaaaaatgtacggcactctttcacactttgagatatcacagaagcgggacatgtccaaagctagctatgccggcggcggagtgctcgacgccgacgccgcctccggcgagctcgcagacggcgtcgaacaacgccctcaccggccggtggtcggagatccggtagccgccgcagcgctcgtagctcgcctgcctcatccccttccctcgccacagtatcctgtcacacctgcaacatcgatcgaacactactcgtcagcttcaattcatgcatggcgtcgattggtcggagaaaatatacggacgacggactgaccatgccggcgcgcgctgctgctgtttgtcgccgccgccggcggcggcgtcgatggaccagtagaacatgtcggagttgaggtggtacttgtaggtcggggagaaggtgacgaggccctcgcgccagccgtcgaagctcccgccctcggcgagctcgaggaggagctcgtcgttctccagcagcatgctccacttccccgcccgcaccagcagccgcgcctccgcgtcgtccatggcgatccggtagttgaggtcgccgagcaacaccacccggctgcaaaaattgacaacgacgatggcgacgtgagctgcggcggcggcggcggcgcgcgtaataatggcgtcgacgggaagggcagtggcagtgccacctactcgtggtcgaggatcttcctcggcaacggcaactcctccggcgccggcgacgcggcggcggtggtgcggcggcggaaggtggtcctggagaggatgtccgccgcgtcggcgttgcggagctgcgcgtcgccgtccttgccgccggaggcgaggtggcagcagacgaagcagaagcttgtgccgtgcagcaagaaccggaccgacaccgcaccctgcaacgccgccattccacggtcaagccgagctgccctcgccgccgcgcgccattgctggctaagctaagctctacgtaccttgttgccgaggcggccgaggacgccggcgccgacgcaggaggcggcggcgtggcggacgtggcggcggagcccactcctcgcccacacggagacgaagatgcccaccatctgctcgctcaccacgcacctgaacggctgctgctgctgaccatgccgctgcgccccctcgtcgtcgtcgtcgtctcgtcttcttcttccggtagtgaacctgttcagcgcgtcgccgatgagcgagttccatttcatggcggccgagctcctcgtcgggccaagcacgttcctcgtgttcagcggcacgatctcctgcaacctgagaaagcaagcaatcgatctcacgccaagaactcgacatcgccattgccgatgtgattgcgatcaagaaaccgtcaggtttacccaagaacgtagatgtcgtaggagtcggccttggcgtccagccagtcaccgaggtccaggtcgtccggcggcgccacgccggcgacgttccacgtgccggcgaacaccctgcgtcacatcagcatcagcttcatatcaatccgccattttttctctctctcaaactcagctcaatgcaaattctgcaagaaacacacacgaacctgtacttgaccgtgtcgctctcgtgcaacgcgtcctcccgccctacgtcggcgaactcggagacgagccgccgccgccggtgcagcagctttcctggccggagaatctgaaccagaggtaggagaatttcaattcgaagctcatgtcactgatgaacaactgaacaattacagacatgaaaggcagcaaatcgatcgatgctgacctctgaaagcttcgagctaggatgcttctcgtcccccataatgcagcacctgcaagataattctcactgaacttttgaactctgaatttttcttcttcttttacagctctgaattttcgtctgaatttagtgagaaggtaaggagcaaatatgaacagcctggtgcgagatatatagcgagaggaggcagattgaagcgacaaagagaaaggcactggctgcgatgttgacaagaacacgagatactactactactacatgtcaagcatccaaccacacattcggtgagggagttgtcgagtcgcctgcatctgcaggtttataatttcactaagtgtgtgtgaccttggacctcacaaaaaaaaaaaaaccagccgcttctctttcatgaaacatgaccaaacaaagccatcgaaccagcttatggtttactcgatctccctgtcattttctcacatcattacggatttacattgtaaacggcaaagacttgaggagaagcattgtttgtgtggtggtgaagacatacgacaggagtataaatccacctacccggatttaagttctggtacacataaatatgactgcacgcatcgttagttagtgcagagatcggaagttatattttctttgtcagaaaaacaacaaaggttgtgtttagataggggtaaaaagttttggcgtgtcatattggatatactgacacacatttgaagtattaaacgtagactaataacaaaacaaattacatattccgcctataaattgcgacatgaatttattaagcctaattaatatgtgacggagctcgtggctcctcaccgggagaccgcgcaggcccccctttgccagttcggccgggggcttagggtgaaatctcaagctctcgctctccctctgtatctggaaagatcgtctgcccacaagacacacgagacacggcgatgtatacaggttcgggccgctgcgaagcgtaataccctactcctgtgtttttgtggatttgtgtatgaatgagctacaaagtgtgagccaacttcttccccgttctaagctctaaatctggaaaagaatctccctctaaatgggcaaggtcctccttttatatctcaaggggataccacatgcacctttctctttccaaactggactgttctttttctctttaatgggcggagatcggtacggtttccatccgggagcccttctgatgggacagcccacacctacccccacctcccccgaagacagagatgacgcgggaccgtggctgtctgtcgatgacgcgaccagtgccagaccggtcattcttgtccaccacgcgtcagcttaacaacgtgcatgtttgcccttcttcgtgtaacaccttgcctgtaatggttaggatgaagcctggtataaatctgaccagggctaacgtgccatctctaagagataacacgctagctccggcttgagacgagtgcctagaggctttcgtcttgacgggatggggcaaggcgtgcgtcagaccgccagtcgccacctaacccgtgatctgaccggtctgtgactggtcacagaccggataaaggaacgcgctgtactgcgttgcatgcagcgtgacacgcttgaccagactgcaataaatgctgttaggtgagcacagctgtgctcacttatcccatatatgtggcgcagacttccttaaggggtcggggtgcctcggccctcggggccggggcaagcgcaacccgaccccccccctcgggggaaatcaggaggagggcggacacctcaccctcgggcccgacgtccccgaaggtgccaggccacgtgggcgattgcgtctgcctcaagcctctggtcatgatactcccggtcccatatcaccgacaatatgtcattagtaaatgtttactgtagcaccaaattaggcttaaaagattcgcctcgtaatttacacgtaatctgtataattagtttttttctatatttaatattctatgtatgtgtccaaacattcgatgtgacaggatgaaaaattttgccaggggatttaaacaggcctaaagactttagtataggcatcatcggtgtgatagtgaagatgttgatgtatgactccaccagttgggttcaaattctgatgttcagaaatatgattgtgcgtattcttagctggtgtaggtatcgaaagttatactttctttgtcaaaaaaacaacgaagactccaaaaacatacaactgttgattggccattggtgtaatcttcagcgttagataggttcagagtttgagcaggtaagctagtaaagtgggtccaagagcaatgaattccagatagttctgatagggaatgtcatactgtcatgtgcaacatgttttcgtgatttgtttggggaagtagtaaacataggccatctttaaagatctttctgagtgatggctgggtaaggatgggcaaaagattgtcagtttgtgcaacttgggcacttggctgcataatgtgtatagtttttgttatctgtttggtgtgctacctctggttgtggcaatgctaccaacaaaccatgcaactgtgcctgaattttgcctcttgtgactgtttccatatgtgcctactatttcatatcttagctagagatatctgaaggctttagcagcttctttgctggagatgacagttctgtagacatgtagatagatagattttcagatgctcaaattcttatcaatcattcaaccatctgcaactttggcactaccatgttatgcttttttttttggtcttttgagaatgctcgaaatctttgcgcaccatctcattaaagagatagatatatggaaaattgctgtacttcctcttccagataaaagcagaaccattatgcagggaatgtgcagtcaaagtggtaattggtcacattattgcttcatttcagaagcatgagaaaatcattctgattcggcgttggaagagacttttgcatcgattctgaaccacaagtagggaataacgttaggcaagcttctctgaataattcagctgtacgtcagttgcaaattttgactgccttccggcggcactacgtcaatgctttactttttgtgatgaaacttcggctgtgtttagttcgtgtgccaaattttttttaaagtatacatacacacatttaaagtattaaacgtagattagtaacaaaacaaaattacagattccgcctgtaaactacaagacgaatctattaagcctaattaatccgtcattagcaaatgtttactgtagcatcacattgtcaaatcatggcgtaattaggttcagaagattcgtctcgtgatttacatgcaaactgttcaattggttttttttatccgtatttaatgctctatgcatgtgtccaaaatatttgatgtgacggaaaagttggaagcttgaagaaaaatttttgaatctagacaaggacttcctatgattgaaatgaatcccccaattcattttgacttgacatttttttaattatgtagtttattccattcactttagtgtacttgtctccaatacatatttgatccatatcaccatatagtctacacatgtttgataattattttttctctttaaaaatacaactaaccgggagcattcttgtaacaaatttattgatggcctagagtttcttccattatctaaaaaagtctctctcccatcttgactgtagtgaactccaaatatgttaataaaattttggacagaccttcatatcactcatacaaatatcttgtatatttttttagtttctcacaactgctttaaagtgtcgggtatagcaccacaaaccatgaagagtctttccaaaagttaatgtgtttcaaaattattgtttagcaatcctctcaacaaaggagaaaaatccccaaaaggaaaatcccacttgaatctgcaaatggaacacaaaatctccaactattgtgggatatacagggacttcacatcaaaattattgaaacattttcatgattaaaaagctgtgaataaagagataagattagatatattttctatcatttccccccactaacagcacacacaagcacaaaacaacaagagctttaactgcaattattcatcagatcagcatgaatgctatgatctgtgacagcaactgtagtggcaggttaattaacttacctaaaaccagtaagagacaagcacaaggcagcaacttgttttgggagacagatagcagatggccaatagtatcatgaaaccagccaatcagaccatggattcagaattaatagcttatcacctcttaattcccttatctattctacattatctttgtgcctcaggaatggccatgttgttgatttaaaactagacactgcgcagaatgagccgcaatagattgagctgatgttttcctgcttccttgtcttatctccaagactccaagtgtgaagtgccgaaaagaaaattagattaagagaaaactgaggctagccagtagtcttagagacacgaaaaagagtattggattcaggagagaagcacgcaagattggatttcgagaataacgttactacctccgatttcataattcttaatattttatacaataacacggtctccaaaacatattttttattataaatatctattaatattcttttataaaacgagcaagaatttaaatttattaaagtatttttagactaatctatatatacatcgtattttagtgtcttcaaactaaatattttaaaagttttaattatttgaccttaaaatatcacgaattatgggtctgttcactttgatttaattttcaatcttaccaaattttggtaaagttgaaaaaaaaaatagatatatttagtttgttgacaaattttggtaactatataagaaaccctgctaaaattttagtaagtttttttaacatcaaagtgaacaggccctatgaaaaaaaaaagaggaacatgcatggtagcatgcattaattaagtggtagcttgcgcaaactggcaggtaactcttcaaaaggagtagctcgatattagtcacagatctatacgtgtattaattgggtttgacagatgatatatatccctctttaattattttattgtatgcatgcttgtgtctggctaaccgtgaagtagagaaaaagaaaattaaggaccccctactaataacttggttgtggtataaaaggagtcacgatttatgcagacagatgtgacgtcgacacctgtataatgtgttttttttcagccttttcagaaaatgcgtatcaaggatatggtgaaaaatccacagtacctaatcaatccgcaagataatgggtagaagtctgacctatatatatccacaaaatggatatgcacaatcaatctaccgactacctaactgatttgatgatagttgaattaaaagccctattttttttaggtaaacaaaatattattgtatttattctgttcattcatagacttttaaaggcaaaatgaaatatttaggttaccgtgatacttcctccgttttagatcattggttgttttggatttggtcaaaatcaaactatttcaagtttgattaagtttataaccaaatatagtaatatttacaatactaaattagtttcattaaatcaataatgaaatatatttttataatatatttgtcttgagttgaaaatattatattttttttctataaacactggtcaaacttaaagtaatttaactttaaccaaaagtcaaaacgacttaaaatctgaaatggagggagtatgtccgtgcatcccgatgatgtttttcctatggatgaaaaggggaaacacgaggagtagctaaactgttaatcatcgaaactgacttttttttaaaagaaaaaagaaaaagacattgcagaaaccgcagactatgttgaacaccgaaaaggaaggaattttttctgtactttccccttaaaaaaagaaaaagaaaagaagaaaaggaagcaaagtgaacctaactaaggacatgcatgattccagggtgaataaagaaatcagttcgaaatttcgaatgtatatcgagtacaacatgctgatgaatttgacaccggcccctgccaaggccagctgcaaaacaaaccaacaaattcattcaaaccagagcgatttgttgctcacgaagacttcaagcagaataaacgatcttgcgtgcttgcagcagcagcacgcaggctttgcgtggataacgatggcccattattaattcattgtacgattgggccggaacggtttcgacggttgtgcggcccatcttcgatacggagaggcgaatctgtgggccggacggctcctcctcctggtttggcaccggcggctggaataagttcatcttaggtcccttacttgtcaacgaatccgattttcatccatcaacaaaaaaaaaaaaagatacaatgggtccctcaactgttaaaccagtgtaaaataagtcttaagacggtttggatgacggttttagctgatgtggcgcctacgtggctaatttgactcggtcttcatctgacgtggcacatcaagcaaaatttaacaatttaaaaaataaaacaaaatacgttggtccacatgtcagtaaaataataataataataagattaaaaaataggaggacccatatattagtggaccccacttgctccacctcatccaccctcttttctgtatcctatcctctcttactctcatgcgaagcggcgggacggcggcgggccacaacaggcggagcggcggcaatccgccgccggcaccgatctccataacagaggtgtgcgtcctcctcctcttcgaacccgtcgccatcttcgtggtcttcggcgaccgcgatggtggggaagcgggtggggaaatgggagctctcccgccactgctcatggtgacgacgccatcgaggtcggaggatggcgggaacgggggcgggggccacaatggtgaggtgcgcgtcatcctcctcctcgaacctgtcgccatcgttgtcgtcgtcatctttggcggtgacaggagaggaagcaaagggagaagttggtcggctgccgcaacacctcttgccgtcgaccttgcgggggcgggagaggagacgcgagtggcggccggtgggagaggagctacgggcagcagccagcgggagagaagcggcgcacagtggccggtggccggtggccggcgggagaagagcgacgcgcgggctccggccgacgggaggggaggagccgtgggaggcagccacttatccctctcctttccctcccagatcccacgagttctattttttttctggatcgaattgccatgtaaccaccatgttactgccacgtcagatgaagactgagtcaaattagtcacgtacgtgcaacgtcatctaaaccgtcttatgacttattttgcaccattttttctattgaaggacgaaaatcagattccttcacaagttaaggggccatagatgaacttattcccggcggctgcagccgcgtgtggcgcccgctccaaggaggagatgccgggagacgtcacgtgatgtcacgcgcggtccacgagcgaatcacccatgatggcgcccacacccgataaggaggaatccgaatccatacttgcccgccctgcccttttttcttctccctcgcgccgcgcgacaaacaccgccgtatttatgtgcgcgccgcgccgcgcgggaagcagcacagcacagcacacatctcgtccagtccatccatggcgagcctgagcgtgccgccggtgccgacggacccgcggcgcgacgcgatcgacctccacagggcgttcaaggggttcggctgcgacgccacggcggtgaccgccatcctcgcccaccgcgacgcctcccagcgcgccctaatccggcgccactacgcggcggtctaccaccaggacctcctccaccgcctcgccgccgagctctcgggccaccacaagcgcgccgtcctgctctgggtgctcgacccggcgtcccgcgacgccgccgtcctccaccaggcgctcaacggcgacgtcaccgacatgagggcggccaccgaggtggtgtgctccaggacgccgtcgcagctgctcgtggtgaggcaggcctacctcgccaggttcggcggcggcggcggcggcggcctcgagcacgacgtcgccgtcagggcgtccggcgaccaccagaggctgcttctggcgtacctgcgctcgccgcggtacgaggggcccgaggtggtcgacatggcggcggcggcgcgcgacgccagggagctgtacagggccggcgagaggcggctcggcaccgacgagaggacgttcatccgcgtcttctccgagcgcagcgccgcccacatggcggccgtcgccgccgcgtaccaccacatgtacgaccgctccctcgagaaggtgatctaccgatcatgcacagcagcatatgctttggctttggttttctctctctctgaatttaatggaggacgcgtacgtgcgcacatacaccactacacacggattcatttgacgcatggcgcttcatacaagacacgtatgtgcacgcacaccactacacaaggattgagaaacgcagaggggtcttccggccagctccacaagatggtgggttggctggattcaaaacctcactcctatttatttgatattaggtcattccttaatattcgcgtttttttactacacaagaactcatatgatgcacgtcgcattacatacacagtattgatctatgagtacgtccctttaacgtaaggccagatagatatagtttagaggcaaaattctaacctcgttaaaatactattgaaaatgcacgcgcatatataatatttatggaaaccaagatttggtttgtgttttaatttctttttggaacaaaatttttgtgtgcgtttaattgtcaggctgtgaagagtgaaacttcagggaactttgggtttggcctgctgacaatcctcaggtgcgccgagagcccggccaagtacttcgccaaggtatatatataacaacccggagccccgttttctgaattatgtttaaattaaactcatcagtacacgtttctgtaaaatcaaaggaactgttaaaattcatgtgaaatgaatctcgatcatcccgaattcatttgttaggtgctccacgaggcgatgaaggggctgggcaccaacgacacgacgctgatcagggtggtgacgacgagggcggaggtggacatgcagtacatcaaggcggagtaccaccggagctacaagcgctcgctcgccgacgccgtccactccgagacctccggcaactaccgcaccttcctcctctccctcatcggccgcgaccgctaacgtcgattggtttcggtctctttgagcgtgtgttaagggacgcatttgttccatagcgcacaaacatggcaattatttatgtgcgtgtgtagtggtgtgttcgaacgttcgtttttcgtgtaataaaaaaaattgagtttgctgtcttgtgatgctgctgctgttcttgcattgcctctgctctgcattccatttcagaaacattcatgtatatacgtgtgtattatttggtcatatgtgtgtctaagtaatttgatgatgataaactgataatcggcatcttgcgtgtgatgagatttccctgtaatatatggtgcatcgatgcttgtattatttgcccctagatgctagtattgttgatggctattcaatccatgtttgcaaaaactttcaagcagtcatggagaacgaacaagtgctttgcagcacagcttattccatataccaactacggtgccaaatcatacaaactagagaggtttcagagagtgcctcacactaaaaagtaccaatatacagagagatcatccatagctgtactctgctacaatgcatgttctatacactcccaaaaactagacaagccgtaattcacatagaggcatagacaacagcacataactcgtagacgatatggcagccacatagctcacaaccgaatcacagatcgcctcagtcgataggcttctgctttgcatggcgagaagcagagtatgactggatagccgaatttgtcacgccgatcgagtgcttcgtgaggtccatgctcttccttgcagcaaaccaaatcatccaaaagaatccaagccaacctgcagcagccaggacattagtacaggtgatgcagacagcttgttaattaagaggtaataatctattgccatgtcctggcaaagaatagatccgaaaagagcagcctcatgcagagaagctgctttgtcaaaaacaatagcccccttttagggaaggaatccaatatgtgttcacatttctagatctgcagcatcacaatcttcatagattttgaagcattcaaccattcaccatcaatagctagttttgctaaagtagtattgctaaagtagtacctaattgttatgtcactttattcccgcttatcgcaatccacccgtgttcgtgtctatgtttctcttattctccagaagcaaaaaggtgcaagatagtgccgtggtgattgatgtctaccattccaaaagttaagaaggagttggcaacatattctacaccaccggtcaaaaatacattgcttttggtaaagtgttgtatgggagttgattcttaaaaccaaacatgtaaatcattgctaagtggatgtaatttgatctcatgctacatattcactctaaaatatacgattcaacgttccatggttgtgggcataactttctagtacgtcacgtgtgctaatgcgcctgagatttactaaagcagaaattattacacagccccttcactagaactagttaacagacttttcacccatggaattcactctgtacacattataaggggatctaacatgaaacataatagaggttaagatgcctccagatggcactcctagctaattagagaacactatcaagtgcattaatgacccaccaaaattacgtagcattactataaacagttcacttattggcttgagtaagttaacgtgaaaaaaaaacttcaagttgaaaaacttgcttcacaattataatttactctaacaaattaagagaaccagtggatgtaaataacatgtggttcctcttaattgctgagcaatttattacaaataatttcgttggatgccaagggaagcccataggcaaaccagtggccactatcaaactcacacatgctaaattactgtgttgacattgtgttagtacaagattgtgcccagtcagacgtgtcttcctagtaccagttcccttctttcagcaaaaaatgcctctattgttacttatcatgctctacgtcaggagcacctaatgtttatttggaaaagaataggcaaacttggactgtctagtcactcttctctcccctaaagcagcagccactggctagctgttatcttggcggtgcttacccaataacatgttagtacattacaaaatgactaagtgaactgaagacagaatgttttaaatactttttctcactggacttattgggacaggatagttaataatgacatatttatatttatagtattaataaacatgaccaaccagatatgttaaagtggtatgggcaacaaaggataactgtgttaatgttgcaaaacatgatatattggtggctattaatgtgctaacagaagatgtatgattacagattagattaactaacacacctaaaaactagtttgtaaatatggacacctctaagggattttatggttttcatgacagaaagagagagtaagtttgtaccagtagcaatcatgacgccgacaattgctgagatgactgtggcggaaatgacaaaaacagcaactgatactactccaatatacactgcaaccaagcaagcaaagaacatagccaggaatcctccagcagctgccagcgacatcaggacggaaacaacaacagcattggtggttgcaaccagcaggaagaacatgaagattagaaggccagtcaatgcaataagtgtgatcgttccaacctgccacaccaggaacagatgaaatgagggtagcttaacttaaaatacatttcacatattcttaaactaaatggcaaaagtaaaagatgatccaatcaaataaggaaatggcaaattcagcaaatgagttcatgcccacatcccacagcaatacacttctgcagttactgaacacaaaaagaaagcatgatcatcaaattatcaaccattcaatgaacacactcaagtagagccatttgaaattacattgtttatccatacaagataaatcagattgattacgctgatgcatgctagccatgtgatccaatgaatttaactgtaaatagagatcacacatccttctctggatagtgaaaacataccctatcatacctgctaaccgaccagcggcagtaatctatgacgtgttttctgtaaaatatggtacaattcatcccatccttccttattacactacagattacagaattctgtaacacattgaaacttaaatgaagaaatgtaagaacattgtggccattagagcttgataatcgaatggtcacatgctcacacggcaacaaatcaagtccctaatgacagcatgtatcagttaaaactgtatttacttaataacaaaggagacaagccacaaattaaagacatggaaatcacttcgcgcgcatctctatggggattagtcaaaggaaatgcaaaagaaggatccagaaggcgtccaagccgagaggggaaagggaagtgggggcggcgcgcggccggtgaggtggggctcgctcaccgagatgacgaggatggcgcggaggccgctgccccttctggtccactcgagcaggtcccgcgccgagttcctcgacgcctcgcgcagccgcggggcggtctcgcaggacgccgccctgatcctccgcagcagcggctcccctccgccgccgccgccgccctgcgagcagacgccgtcgacgaagctgcggagcacgccggggagcgtgtcctccacctccaccggtcggccgccgccaccggaggcctcgccgttgggggccttggcgcttgcggccgccgcgtcggattcctccatacctgggctgcagccggcggcggggactcgtcggcggcgagggaaacggatgggggataggggcgaggaggtgctggcgactactactactactcctagatttaagaggggttcggtgacacgtgtcccttctgaccgggaccactgacacgtggcttcatgtgaatctggtggacccacctgtcagtggctatgcgtcggccgaaaaccgaaagccgacgtggacggatcaggatcacacgcctcaagttatgaatgttttttttcttttttttctttgaaagaatgattcgtttgacaaattttgatggaaacacgatagctgatttggtgtgtccacgttggagacagtgtgtttgtggatgaggaatttgtcgcagttccgtgctagaatttcgattatgtttatacttatctgcacggtatctacacgatagttagtgatttgaaataaaatattttagagcaactgttgtaaaattcattatgatgaaaaaacataaaattaactttaaaattaaattttaatatttaaatggtagcttataagcataagtgaaatgatgggttgtaaatatctagattatgacattttaccacacaaaatcgtggtggcaacttccgattgtttcaaactctagcgtctctatcacgtgatactgtgatataaagcgatgagcaaacgtgtttttgcaacgtagacatgatgcttgatcgaactaccacgtactagtctacaacgtagccacgtaaaactgcatgttgtgattttcctccctttttttttgcaaaatatagcgaattatatgtgcaaattagttggaagcacaaataatattgttgtgcatgttgcatgacaattctttgttgcgcatgttgcttccctaacattcgcgtctcctttttagtagtgcgagctaaacgaaaactaaaagacagatcatatgtgggcaattaagagcattgagtgtctttaagactacctcatattagtgttgccttaggctcagttcgtttgtctaggttcccaacctctctttctcgattttcgcgtgcacgtttttcaaactactatttcggtgtgttttttacaaaatttttctatacgaaagttgttttaaaaaaaacatattgttcctttttgaaaaaaaaattagctaatacttaattaattatgtactaatggatcgctctgttttccgtgtaagaggcaagcgttccaaacctgccctctagaatgcaacctaagatgtcttcctgtgtaaattgttatatttttcgcatgtggtcgttttaattagtaatttggaatcatgccattataattttgtaaagtttaagatatgccatcgatatctcaatgacatgtaggacctacatgagtcaatgatgtgggtcaggatggcatatctcaaattttgcaaaattataatggcatggttccaattttcccttttaattaagacatttcttatgctaatttgtttacacacgcaaccatcgacccctctctctctagcaaaattaatgtagatggttttctttcagcatcacatgtcactattagaaaaaatgatttcctacaatataacacataatttttttaggcagaccttattttcgactatgattgtttgcttgtatagttgtgtgaagagaggtctattggctggccgcctgggaacataagtcccaggcttccaactccctctcctctcctctttctctctcacatctcctcagttcggcgatgagggcggtggtggtggggaggggagcaatggcggcgttccatagccgtggcacaaagtttggtggcagcagtggcgggatccgaagatagcaacgcatgggggcggcggatccgtggaaggcgacgtgtcggaacggcggatccggcgacggcaagagtgggggcggcgccggatccggcgagggtgacacgcgggggtggataatccagtgatggcgaggtgagggcgcaccctcctcgcgctgctcgtggtcgtttttctcgtcgtcatggcggagaaagctgacttccggatcggctcctcgatggcgacggtggcatcctccctgcgatgatgaccaccaccacgacatccaactgatgtttcttttttttttttgggggggggacttccaactttctgtgaaaaatatggatgtggatttgaatgtgaacttccacttctttgtagaacttccaccacggatgtgtgtttcaatgtgaatttgcatgctatgaataacaaattgcttcttttttttgcaccgaattcttttgcggacagtcctcttaatgggtccatttgtgaaaattgacttttgcaggcatacctatgatcgccttgtgaaaatgaattttggcagttgcataaattgtttttatggtggtgtgtagattacaatttacatattaatgtttgaccaacgtctgacaattcgtcttatttaaaaaaaattatgtaattatcatttagtttattgtgacttgatttatcatcaaatattttttaagcatgacataaatatttttaatatttgcataaaaattttgaataagacaaatgatcaaacgttggtcaaaagtcaatggcgtcatacgttaaaatacggatggagtatatcataacctgcagctgtgagtaggaatacaaatcagcgtgtcattgaactaagcatttttttttacttgtgtacactacaagtacattcaagcaaagtgatgagaaaaaaagaacaaacatacaatgagcatcagttgcttcggcaacagataattatctcattataatgagaaacctagacctatttcttcatctttcaaaagcttggcatgatccacacgggcgccggccagttgaaccaccgttgaggagagactatctcatcggagctatcactgcccaaactatcccgacgagcacctttagagtcgtacatattagaaactattaagtgtggcggaaggggcggccgctgagctacgccacgtcggatagctacagtgcacaggatggatttttttcgaaaaagccctccggtttatttgtaattcggtgtaggtctctcggaacagtaccgctgagacgatattttacgttgtgactcttcgaaaagcaagatattccatgcaaaggagagaaaaaccgagaatcaggactgcgctctaaaatgttgaatccgaggggttttttcgaaaaaaatacgcccactaacccacccaccaccaaaaccctagccgccgccgcccaatccctctccctctgcccgctctctccctctccctctcccacgccgtcaccgggcgccgccgcctccgcctcccccttgcgccgtccccattgccgaccgccgcgcctccgcctccccctggcgccgccgcctcggcccccgccgccgtcgccgcctccccatcgccggccatctctgcctcccgccatccccatcgtcggccgcctcccccctcgcgccatcaccgtcaccgagtgcacccgtctcttcctccgccaccgctgtcgtcgtcgccgagcgccgtcggtgccacctccgcctcgctccgccgctgctgccgtcgccgagcactgccgcagcatcgtcgtccactgccgccgccatcgccgagcgtcgccgctgcgtccttcgccgccatcaccaacggccgctgctccgccctccgttgccgctgccatagaagaaacggcagtggtgacagaaccgacatcttcggcttctccagtttccttccacctcttcccctcacctcctcgccgccttcggaagccctagcgaagcgactgacgcgagcgctgaggcggcggcagaggaggaggaggagcgagcaccatggcggaggacgactacaacgacatggatatggggttcgcctctcccccaccctccctcgctcgcttccgccgttacaatttcgcaccaacctagggtttgctggtgtcaccgatcgcgttcgggggcgtgggcggagagggggggttagaagggagcccggtatcttcgtgggtgggttgcgggaacgttgattggtaggggcgattcgtggggggagctctcctttctcaagggagggctctgcctctacctgctgggttggtggcagtacggagtttttctttaggcgaatatttcgtctattgtgagatggatgggtctttgagcttgattgacacatcgttcttctctctctttctcaaatcatgtcccattctgatgtttggctgctgatcgggtgacttcattgattcttcggtaaatcccatgcttgattgcttgtgtgcttgttaaaaggtggattttttcttagtctttaatgggattgctaaatggtgcagctgttgccaggtttgtcagcaatcaggtttcatacagaatgtaagaaactatgccgatttctgggtgaccaggtgtccaggtgtccatgaattatgtggggtttgagcattcctagccattagatggactcttgagtttagctcacccagcatccttctggaatgagaatgcacattatgatatatgtttgttgggataagatgatgatgtttcttggcttaagtataatccacatcttttgtatcaattaaggattggtcccagctattttaattaatggctcaaaaaaaatggagttgttttcaaggtgctggttgctttttagagttagctttttcaacgtatatgatgaccaatatagaactgaggaagtatagttttaagttcatgtctagcttgatgaggcattgtagatatgttgcatgaaaaatgcctatctttgcttattgttatgttctttttttttggttatgcttagcataatttattatatatagctgcagaatcattttagtattttatggatttatttatgaactaaagatgcctttccttttcttataggtacgaggatgagcccccagaacctgagattgaggtacagagctgctgctttgttatttatttctggactttactttatcaggaagagctatgtggcttatttaccttttctgaactggaaggagctgaggaagagcctgagaataacaatgaggatgctgtggatgacgtggttggggctgaagatgacagggagcaagaaaagacggctcgcccatggaaaacatcaaagtatatgacaaaatacgagcgtgcacgcatccttagtacacgtgccttgcagataaggtatgcttttataaaatgtaatctgtatatcatcaattaagttaattaatcatatcaattaagtaaaattcgagcttatctattgttatgcagcatgaatgctcctgttatggtcgagcttgaaggggggacttatccacttgaggtaaactcctgatttcagttttcatagcagtgatggaggcggctttgataaggtttccgggatggactcctgtaaatatgtgcactacacgcctgagcaggtggaggcgcttgagcgggtgtataccgattgccccaagccaacctccgcgcgcaggcaacaactgctgtgtgagtgcccgatacttgctaacattgagccgaagcagatcaaggtctggttccagaatagagggaatgataatagaattgaatctttctccgtttgttctctgtgacaaaaacttgctatggcagttttccctgttctctgtgacaaaaacacttgttatggcagttttaggtacccaggtaaccctcaaggtactcctgcactgtcacgtctgtctccccccgacactctgcctgatcccccaactgtgagaaggtcagtcaacgttcacgccgctgagtctgcatctacatcattttgtggcatgtatagaaagcgtcagatgcgtctcaggaggtagattctcaggaaaatcatgaaactgtgatgagagcaaggttatcattctttctatatagtatctgttagattgccatatttacctttgtctgatgaactcatcatcctcacctttaatatcttataaattgagttgagttggtgttagcatgttgacacgtctaatagggtgcagctatgtgttcatgaaattactatgctttgggagataactaccatccttccaatggtttcaatgcatttttatcatagaatgattcacataagaggataaatcaatgttctacagagtttagtaacaatggtttatcgaaaagtacatgatttatgtcataattgtgcagagccttaagtttcttggtggcacttaaagcctcaaatttgttagcttcattttaggttttgggctagatgatctgaacccttaactgccttcttatcagagataccatatgcatacatacatacatacatcaagaacggatagtccccatgtatcgtagcgactggatgtttcatcaatgctatttataatttttttaccacaatttaccaggaacggttagtcataaagaacataaaaatgatcatcactgtggtaacgtatgctactatgctatactaatcctcagttcctcacttatgaatcgtaggaacttactgcacaactaggtagctcactgacataaagagatatttatattattttgttttttatgatgaatacaggtagctgcacatcataatggacatggcacgagccatgagaatcacacacaagaaagtgagtcatctgttgagcaggtataatttagcttcattattataaagtactaagaattctactgctacatatcaccttaagtatatatataggtagctgcacatcataattgggtttgtatgtcagcatgatcctgaaagccaagacgacatcagcataaaagccacacctgctgatgaatcaccaccggaggagacatctgcagcacctactaaagagcaggtgacttaatagctgcttgcatctgagtcatttttgggccctttcgatagatgttttccctgttctttagaggcaatagtagagataaacttgattatattaataataggcatatttcttccagggattggacctgttccaaaaaagtattgtgcatttctctctattataactcaaatactgatatcctgcataccctctttaaatatataactttgtactgtttggtaaccttccttgtaaacattcctccaatagtccaatctaacagccctcaaatccaattggctgttgtgagttgagctacatgatggaatatgagccactcatctgcatattaatgaaggggcaatttcgttcttgcccctacttcgatgtccaatattgattttgccccagttttttaggttttcgtttttgtccctacttttttttaaactaaacagtcgtttgcccctattctgttaattcttgttaacggtgttaaatgtgggggtaaaaaggacaagtataaccttatatattttccggtacttttgtacaccacattcaaatttgacccaaattttggcaaactttcacaaatttttgacaaattaaattactgctatagtatggcatcaatagatttgtattttgattatgtcaaaagtacgggaaaatatctaagggtatacttctctttttaccctccacatttaacaccgttagcaagaattaatggaacatgggcaaacagatgattcatttcaaaaaagtaggggtaaaaacgaaaatcctaaaaaacagtggcaaaatcaatattagcaccaaagtaagggcaagaacgaaattgtcccattaatatgatagttaccgaaatctaattttgtaatgtttttacctattctttggtatgtgactgttttggtgtcccatgaaccggtactaccgtagcaaatttgccatgttacagtgtttgaaacattcaagcaaaccgtgtgtgtagtatgttgcgcgctgaaaattaagtaagtataaaaaatattagtttcatactcgtcctcaatggcatcaataaacaaaaatgacaacgaattgttagagtttgtgtcgaatatgtatacatagtcggttacagtttaggacttggagttgtaataggtattaggagtagagtaagagtcggactctatcttaggatctctcataaatagagggacgtgcctgttgtaaccgcatgacgacaatggtgacttagcatagcgagagggagcggctgccggcggcgaccggttgtgagtcgttgtaactctgatacgctgtaatatgctggatcggggaggagcgcccataatcagtgccccggagatgtaggcctcggctgaactcttttatcaaatatcgtgcctcggtgtcgtcgtcgtgtttggatctcctatggcgtttcttccgtgtttggtttccgatgtgatttcggggctggttttctaacaagtggtatcagagcctgcgggagattcatggtagaggtgcgagggaggtgctccacgccgcgacgaccgcacagggtgtctagggacggacatggacgcaaggtggagcacggcggcgatcaacggaatttgatcgatggaatcggacacttcaggcggcggtttgaaccgttcgatggctgcaatcaacagggagatgaccagacgtggtgctcggtttgatggcggtagaaacgattggcgatctaatcggtgggtcggacacttcgggcgggtggctcgaactttccggtgagctactctcaacagggagacgtgtggccacacgctcggggttgattgaagctggaggagatcggcgttctcgatcagtggaatcgaacattctgggcggggtggcctgggcctttcgatgagctgcgttcgacagggagatggctagacgtagcactcgggtcgttcggtggctgagaagacggcatgtgatttgtcggcttcggctcgcggctagattgacgggttgttaatcggaagtcggagcgggtggatccgtggtgctgatggagttgtgttgatgacgaggtggtgcatgatgctacaatggtttgtacaagcgactggactattcacagttatagggatggttagaaatcggcggtgttagtcatcgacggagttggccggaatatcttgtgggcagtgcgggagatcgtagtgtgtacgtgaggctggtggtcaggagagaccattgcgggcctggatgtagcgggagcatgcaagagattgactgtgtgtgcgggcagagatggacagcgactcggaccattgagtccttccggaactcggtctagcaccgaagctaagtcagggaccaagtctgacacaaggaggtggtggatatggattcggtttgcagtcaaaatcggatacaatgccatagtgatacgtcagcaaggaggatatccacgggattgcaagattgcaaccgtgcaaattatcaaagcaaaaagagatcggaattggatttcttggtggcgatgatttgcggcgtcaggcaggcggcaggaacacgtggctttggtgcggtcggcgtggaggtgctagcggaacttgacgcaggctgtctccggcgagaggggatggcgagcttacggctgctacatggtggttcggtcagatggcttgcacgtgaagaagctgagtagggctgcatgcaacattattttcgagatgcattgatttggccaagacaagactcatgcatacgtggagatgttggatggctgttgatcgtagctatgcttgtatacgcattcagctgatcgtgctgatcttgtggagccgcggtaatatgcaaaggggatggatgcatgtagtatattacgggagcagaaacgtgttaaagtttaaagtgacttggcggagcagccatagctaaccagaaaatcccgggcaacagcgggtgaaaatcgttgagggcgtcaacgggctgtttgacagtacaagatatatccaggatctgcggggtgtgcatgatagggatatagggaatctgcgtaaggagaagagtaaacgctatggtggtaatttcttcgggtgatttatggcaacaatgtattttctcaaattatcgcatattcagtctacggatgtgggaaagcgaggatattggatttattagctcggttcataagacgataaggaagaaaaggttcagttcttcaagtctggtgagtttgatttatctatttggtgataacatcggttatctggccatggattagatcaagtcaaacttaagatggtagatgaagttgaacatggtcttcggggagtctatgatgggatagctaggaagaaattcaatttcgcttggcaagacgactgtggtgatatgagagaaggtggagcactgttgcaggtggagtcaagagggagaagttgcagggatagcgaagtctcttgtttatggtgagcctggtggaggcttatcggggcagctcggcgtgagcggcgaaatgatcaactcaagtccgggtgcatggagattcgcgcatggtacaaattcaggttggcgtgtcatattcgccaaggtggagtttgttagagtttgtgtcgaatatgtattcgtagtcggttacagtttaggacttggagttgtaataggtattaggagtagagtaagagtcggactctatcctaggatctctcgtaaatagagggacgtgcctgttgtaaccgcatgacgacaatggcgacttagcatagcgagagggagcggctgccggcggtgaccggctgtgagtcgttgtaactctgatacgctgtaatatgctggatcggggaggagcgcccgtaatcagtgccccggagatgtaggcctcggctgaactccgttatcaaatatcgtgcctcggtgtcgtcgtcgtgtttggatctcctatggcgtttcttccgcgtttggtttccgatgtgatttcggggccggttttctaacacgaatcaatctggcattggatcttaatacaatggaatttgaaattgaaattttgcaggtttagataattttatgtgcactgcattcctgtttgtttttggaaaaagaccaaatgaaatctcctttatgatacatgcaaattaattatatgtagcaactgtagagcaaatgattttaaatctaaccagaggtgtccagattaatttggtatgtcgttatatgccccttggacatgaaagatcgtattgatcaagtctgataattttcaaatccccaccatcttctgttagtaattctcacaaaaacaataactaagtgtacaggtttatctaaatcatataggtacaagaaagtgaatatttcaatttaggtggcatggattgattaagctaaaagcagtaaagcatgcaactaattcaaacttaacattattattagggacccttattattattccactcacagtaatgtatctaagagagcaatatatttagctggattcaacgatatgttatgaacatcagcaacagaaagcgattcaacgaaatgatagataaacatattactcactgaggcatgcatgcgttcattacttgtgtaaaagctcggtcatctccagctactcaatgctaagccgttgttgctgattcatcagctatgtgtactctctcaaccgctcaaggcagtagcaaaaggagcaagcgtggaagaccagcgattgccagattggcctcactatggaccagatccggtttcttctaagaggaactttctctgcgactgtagacaggtatttttggcctttatatacatgccacaaaattatgtttactttaatcatgaactcagtgccatgtatgattagttatattgttcaaattatgctttctagaagttaagcaaggtgctttgagaatatcttccgtcgaggaaattaaacttaggtgtacatattaaatgattgaactgttaatctataagtttccgttcctatagtttgttagttgctaccatttttcttggtttcttctattcctcaaattgtctatttcctataaatttcaattctcagcagtcaccatgtgactgcataccatttctatagtaacatagccaactatttaatttcaaatcagcatctagcaaccattcttgatacctagaatttatttgcgatcattctatctgttcactatatggtgggttacttcagtatcatttcttccatttcctttcctttttcgattcttttgagaacaataaacttgattagcggcctttttttattaaagatgggcatatatctatataccgttttgtgatttatcataagaaaactaatatggcaacatctcactatcaatctgatttttccttcatacatattataggatgaaaacttcacaggaagatctcgactgttttgctattatacctagaaaaaaattacatattatagtagtagcttgacttattgattgctttgaagaaaaaaacatgaaatttttcagcagggcatcgccgcattgccaatcatctatcctgattgttaggctaatgg

SEQ ID NO: 44994 - DNA, 9957 bp, Oryza sativa
tgccatataaatcgcagcttactgactcttactactgtcatcagggagctaaggtctgattttcttaagaaggaaaaaaaaaactctgggtctattatctcttatctgcactaatcttgaaagtagttgctgggttacctcattgcactcatgggttagtctcatttctaatgttatcagacaatagatcattggatcagatggattacatccttctctacaattttaatgctcttagctggtagatcattgaatggttagtatggtcaattatgggttgtatgctgatatggtgtatatttgtctgcaggattttttttctttcctttccctattatcattctctatggtgaggtatagctttttatttgtattttactcatttaggccttttgcgatagctatcttgatggaattattgtagtttccataattatattcagctatttgtcttttaaaactgaagctatgagcttagaatagcatagtatttgttgtcgaaaatagagatgatttcctatagcccactatggagtgatggcaggataggtgtggctctctgtttctaaccccagtcgtcatttatactattatgcggtctgtgtgccagcactgtagttagaaaggaccactcttgcaaggatatttctccactcttgcaaggaccactcttgaacgccaacggattaaattaaattttcatttactcgattttaatcgaacggtgatttacgggtttgctttggattggctagattgggaagaatgctctcgcaaactgtattatcaaattttctgggttacctacaggaaagcgaagtgtgggttgttcgtcacccatagggtcatgccaattgccaagattgatgttgggcgttcggtttaggctcatgttgttagtgtaaatgtgccacactgatagagatgcagaaagggttattttgtataaatgggagtatgggttggtcctgttggacagggttagtaccatcagaaaggattctggcagtatgtcaatgtaggtatcattaagttattttgcttttgaaagaggaaccacctgtcagggaaaaaagactggtgcatgacaaggggaaaaaagtagtcgcaaagaaaattcgcaaacgaagttaggtttagatgtaaaaccacaattatggtctctggttgactttactaaaaaagatgagtggttttgttgtaagaatgttaactgagatttttctatgtaatgcttgaagcaagcacatacacacgtgttggccgcttactgatatttgaagatgataattctggcattcgcgtggtggagttgtggtgaaattagagaaaatgttgattgctggaattgtgcagagaacagcttgtataaaccttcgggatatgcaagtgcattttcattttacaaacttatgtagccaatgtaacactggtgcaatgggtttattattattctttttcgcaaatctaaatacatagttatttaaggaaaaaaaactattggggcatgagtttcttttagtgtaaaaaagaaactctggttaaaaaacaacttttgaggttgagtaaatgtgatttaaataaaaattagcttggctgcattttcttgttagattgaagtgtttaatactgaagaaactgagcagccacaaggaggctccaatggtatgatgtttgtgttatgcacttatttttatccttcaatttgcatgtgttattttagagctgaactatttttcctgtcgtacaggtcaaataaatcatggcaaatactcaacaaggagtctctcatctaaagagtactcgcagctaactggatttaactaataatgataccactgttgttggcattgtatgtatatgttggctttgtatgtacatgtttttcaacaagacaagtacaaattagtgaatgatccttcatctctagccttgtataaatgtgtaatatatgaaatctgcatgtttctcgttactgtagcacaattgtgtacaggcggcgcgccaatggcgcgccccatcatctagtactcatcatcgtcggtaaaatagacgtgatttggcagcagggcagggtaatccttggtggaaagacaaagggtgccattatgcccaatgaacaatgcctcatcttccaaggaatcgataggcacgacatcttggctgtcgaagtcaaccttgtatacatggaatccaaccgtacgcagttcttcctcctcgtcttctggcaaatgcgtcaacctccagacctgcaatgaccaatattttaaatagcgacctaagtcatttaacagttagcttctcaaacagctatagcgggctaaatggagctataacggctaaattgcggattgggatttggtgacattgcgccggtgacattccccgtgacattgagtcactgacgtgtgggacccacatgggtccaggcatatgtgagtcctacatgtcagtgactcaatgtcaccgattatagcgagagatttaaaaccctgcctgcaacacgtcccccgacgacggcgtccaggccatgtacgcgtggtgcagcgtgtaccccagcgtgtcggtgagaaccaccgtgcgcgtggcgcgggaatggtggatgtcgtagcggtggatcccgcctaggaggttcatggcgtagaaggcgccgtcgcggtaggcgatgtcggagtagggagaccagtagtaggaggaggtggtgatccagtgccactgcttgtcgtccccgaccctcgcgaacgacggctgctggtagacatggtagatgagcagcacgatgcagccgccgcatccatcttctcctccttcgccgccgccgccgccgcggcggcgtgacgacgacgacgacgggtcgcacgacaggatggccttgatgttgagcaggtcgcagagctcgtcgggccggtagatgccgggagctcggtactccctcatgtcgccgtcgtagaaggagacttcgtacccgcggaggtcgccgccgtcgccggcggcttcgaggatgggcctcacctgctccagcgtggcgatgggcggcagctcgatctgctcgcgggtggccgggttcaggaggtgcagctccgagcgggcgtcggcggtgaccagccacccgtgcgacgaccccacgatgctgcgctccgcgatcggcgggtccgggagggtcaccgtgtagggcctctcgtcggcgaggcagtagagctcggcggagcgcgtgctgctgccgccattggcggcggcggcggcggggatgtacaggaggcagggggttcgagggaacgagtagacgccacggcggcggaggtcgagggcgggggcgcgccagcacgtgcagacggcggcggtgcggatgaaatcggggagctcgagcttgcagaggacggtgtctaccatgtcggccagcaggtcggaccagtcgcggccggctgccggcggcggcggcggcggcggcggtaactccattattacggaatttggattgtggccggcggcgatgtagcagatcgcgcggccgatccactgatctgtagtgatttctccagcaatggaattggaattggaattggtatatgaacaggagtacgagtcgacctactcggctgtttcgccggcgacgaaggcgtgcgcgagaaattcgtgggctttgttcggtacacgggtcaaaaggatccagggcctatacggcccagcaatgaacaggattcgtgggctttggggaattgaattgggccgaattgaagaggccggttgggcccaatatgccttgtagtatttattcattctgggccggtagtttcgtgctgttaattaatttcggaataagttaatttgaggtcccttaacttgtcaatgaatctgattttcatccctcaaccgaaaaaccagacacaacaggtccctcaactatcaaaaccggtgcagattaggtccctcagcggttttggctgacgtggcgcatgcgtggctaatttgactcggtcttcatctgatgtggcattgacgtggaacttacgtggcaattcgatctaagaaaaacaataaacaccatgggacccacatgtcagtttcacacgcattaataaaaatggtgggggccgcgtggaccccacatgtcactctatcactcttcttctcctctctgggactccaggcaacccggcagacgggtcacgccacgcacgatggcgtcgagcccgggggcggaccagggcgaaaggacaagctcaacctcggcgacggccacgcggtcgaccgtggctgggaagaaccccgtcacggcatcaccgagtgccacggcgtctagctccatcccgtgtgccgacgaacggcggggcgaaggcgtccctgacgcggtcggtgtcgccgaggcctaggttggtgctgatgcagccggccagcaactcggcgagggagaccgcctgcgtgatgtacgcgtccagggactccctcgccgcgggtgggatgtctgggaagtcggcggcattgttcttgtggcggtgctggacgaagtaggtggcctcccagtcccaatcgacctggtcggctagggcgttgtcgctgccgtcgacgaggacgtcgtcgtcgtcgtccttgtccagctggaggttgttggcgaggtcggaggcgtagaacttgttctcgagatgctcgtcgtagtggcgagccccttgagatcaatcaccggagtctccatcgctcccaaggctatctagctacttctagaagatttctactgatattttcatcctgaaatatactccctccgtttcccaccggccagaggtgaggaggccggcagtgaaggcacgcgaaagagggaggaggcggggaggccgacgcgagcacacggggagagggaggaggtggcgcgggagcaggccgaggcaccgagcctaccgagtccacctccgcgccgccgagcccgccgagtccaccgctgccatgtagcctcttctcccatgtcgccgcgctgccgcgtcgccccttctcacgcgtcgccgtgtcgcctatcgacggccgccggccaccggactgcattctctcccctctcctctctctccgacgcgacagagagggagcggtgtgtggcggcgctggtgggagaggatgccgtcgaggtcggagggccgcccgaaggacggtggaaacgggggcagggaccgcgatggtgaggtcacgctggcctcgggttaccacgcctctgccggcgcggcgctgccgacgtcgccgtcgcaccctggcacggcgttgtcggcctggtactgccgtcgcaccaacatcaaccctcgctgctgctcgtgcaagctccgccggcgggagatgaagcgagggaagatggggagaggagaggggagagagatgaagagagggagatgggggtgtgaatgacatgtggggccccggccccaccattttttattaatgcgtgtgaaactgacatgtgggtcccatggggtttattatttttcttagatcgaattgccacataagcgccacatcaataccacgtcagatgaagatcgagtcaaatcagccacgtaggcgccacatcagccaaaaccgccctcaaaaccgtcaagggacctaatctgcaccagttttaatagttgagggacccgttgtgtctggtttttcgattgagggacaaaaattggattcgttgacaagttaagggacctctgatgaacttattccattaatttcaatcgctcctgtcttcatgtcactgtgtgttattgtctgaatactgaagaatcatcaaatacgtaagcattcaaggggcctcaacgatgtggctttacaatatttttaaggcatactccctctaatatatgttgtaactattttttttcgacggattataatataaaatcggcgtattcatacatgcaattaattttcctgttccaaattattttgtttaaatataactcttaaccattaagattttaaattttattgggtacatgcattatacttattgggtttggtccaaacataatatgaaatgtgacaaaatcgtactataaatttggataggacttccatctggattcgtacgtagtactgaagatatgttacatcttatgctataatgatttattttaggatcaagaaagaatatatacactgtggtccatctatatataatccgatggaacctctcactcaattcaattcgccatttccatcaccatcaacacggagtaagggtcctctgcagtactcctggtgcatcattttgttattagtttatgtttaatactttaaatgtgcgtccgtatacatcaaaaaaaaattagaggaggaactaaacacgaccattcatgctaacgcggtctaacatatttaatgatttattgttccatttttagaaggtttcgatcttcctcctttattattgatttggttagaataggattcttgtgttcaaatgtgttcgatatgataatcacggccacttcatagaactacgcggcttatgatgatgatgatgttgtgaaagtgtattccaggtattaagggttttattatttttttagtaaattgcatcaatagtacaagaacttggcagatgggtacgatttagtacaataagttgaaaaatatgcagaccgatacataaacctggcaatcaagtgcattttggtcaaaactctgttacatacaaatgattcaacctattttgtttgatctattataagcataactactagattattagtcatgagtacaattgaatatgtttgactaataaaatcgcttggaaattatgttacaataatttttatgcacttagttttaacaatcattatatttttcggtttcaaatcgacattttattttttattgtaagcaagcaaatacaatacatgtagaccattattatttgacaatcattatgcttattagattattggcaacggcgactgctttttttactacgtggtttaaaaggtgtggtgtctaatattgatttttaaaccaaaatgcacgtactagccaagttgttgcatctaaatgatcatttttcaagttgttacactagatcgcacctacctaccaagtttatgtactgtggacgtaatttactctattttttctacttaagaaaaaacctacatgtgcatgtaacatgcatgcaaaggtggatctaggctttaggccacccgggccacatatcccaaggcctgcgaatgaaattattagttttttcaacatgttgtttggaatgtgtcctatttcatggtgggccgggctcaggtgtatgacccaaacatagatctgctcatgcaaatacgcatagttgaaatttatctcaaaacaaaactatttcttctcacctatttccttaattcgcgtgaaaaacatcaaaaatccttacagtatgaggaggaatatgaagcctatcctaatgttcacatacaatgaggtttgactaagatttcacactgcaacttggtgcaaatttgctcaaatttatttttctataccctagctagtgtcatataaaagtagtatgcgctaaatttggtgcagatgagactaatttatgttaatgatgataaatcatccatccatagtactacctctgtttccaaatgaatgacattgaataatgcaattttgaactaaccggcgtcaaacaaaaagaaacagagagatacttattagcgctaactctaaaatatttctagacataatatatgacatcataacgtgcataaaaaatatttctagacaagctctaaaaatgcatttttcatgaggctcacatgtcacaccaaacatcacaattcctgaagagagttcccccgtacacacacacacagtagtatataaaaaaattaatgatgaaaagcacagctagaaaaatattaaaccacatcttttgtcggctgatctgaccgtacatccgatgataaggataactcatatcaaaatcacgtgtatgtaagcataaaagaaaagtatgtttccatgatcgatcgatccaggaggagagctagcactgaacaaagataggaagagagagagagagagagagagagaaagagaccaagaggtggttgcatgcacagtgaactggtccctgggtcccaacccctctgtactgtgccctctgtcctttgtaaaagagaaatgagagttgtgcccatgcagcagtgcccatatcatgaggccatcatcatggccgatcttttgcgtcagtggcataggcacacatgcaaaaaaatgaatggtgacagtagagagagagagagagctaaaggggggcagggaggggtataagatgtagtcagcgggtatggaccgacatcactcgtcgtgtatcatgtatcctggtgaccagactagctaattttgtagagacccttcctcctaaaataaaattatttttatcctctttcgtttatttagagtttgtgtaggtagatgatgataaacacattggaaatagataaggtatgagacagttgtattaaggtttgataaagtgaggatatcgtaatctttttgtttctgtattagtatgtactggataggagaaaaattaatttattttggaatggaggaaatgaaaggttatacatatatatgttaaccgtaaggcactaatgcatgttatttacagtgtgttgtgggcttgtagccattgatgaccatcaaactatgattttaacagtctttaaacatgtgtatcctttgaactaatttgttgtagtttcttggaggcaaaggctaaaatgaattctattatataaaagaatcgattagcctaggcgattgctctttggttgggttttgggtccactcataatgttgtatcctgtcctgcatatattcctctgtgttgggattggacatgtgaatacccatttgctttcgtattgcattggaagttttgggagtaatcataaggatgtagggctacgttgtaagatggtgaataaactgcactccataatacatgtttacttgctcatgaaggcaatatgtcaacttattttttcacctcttcctcatgttgccaatatttaagcacatataagttaaaccacaatcattttctatacatgtcacatttttcactaaggtggaatcaaaatcagatatagaaactactgaacaagtatgcctccattattttttaacaaaagctacaacaattattacatagctcttggcttgaaataagatacaacaatatctaaccatggatgaaagaaaacacattaaagagctgccaacaataagaaagagatacaaattattcagagagcaaatttaatctacctctattaaagggcatctcgagtggaggccacacctatagcaatgctctcacgtgggccatatggactaagattattcataagacacccatctttcaatggagggcactctctaagacaacaagataaagagggcacggtctacgcccaacgcatggccagcaagccgtggcttggcgaaaagcggccaagaacactaaagccgcacatacgtaccttgcctgggcgtcacgtttctttgcaggggcacagttccaacttggaaaatggtagctaaacaccatgagcagagctctgatctgaaggtacgcattgaagatggcctaatttgctccatgcaactttgatcgttcaaactatatagatccaccccaatttgtatccctatatgtgtgggagcggtgacaaggggcctaggggacagcagtgaagtgaggaggggaaaagctcatcaatcataaagcaatggattacagaatcatttcatgtcctttgctggtcctttcatccctatgttaacatctgagatcttgccctttactcctgcctcaaggcagcaggcaagcagcagtctgtggcctctgtgtatctatctgtgacaagtccacaggagtccacacacatatgcatctgcatcaatgcattcatgattcactatcacaat

SEQ ID NO: 44995 - DNA, 31140 bp, Oryza sativa
  unsure (1)..(31140): unsure at all n locations
cggcatggggcatggtcgcatggacggcggaggatcctgcatggtgacagagacggcgccggcgacgagcttcggcgtggggcgtgcacggcggaggatcctgcgtggtgatggcggcggcaccggcgacgagctccggcgtggaggatgcagccaccgactgaggcgtggacgatggacgtgaccgcaagtgacgaggtcccggcggaggacgcggtcgctggcaacgagctccgatgtggaccatgggcgggggaggatgcggctgccggcgatgaggttcgggttcagtgtggagcgtggacgggggaggacgcggccgtcggcgacgatacctcgacgcctcgacgcccagctcctgtatttagttagtatcatatgataccttccaagtattaccctgatacttgtagaaatcgcgcgatacctgataggtatcacatgatacctcgcgagtatcgtctgatacgtgataggaatcgtctgatacctgatacgtggtagaatcacatgatacctggtaggtatcactcgataccagctaggtatcaggacctgatacctcgcaagtatcacgctctacgtggtaagaatcgcatgatacatgataggtatcatctgatatctcgcaagtaatcacctgatacgtggtaagaatcatatgatacctgatagatatcatctgatacctcacaagtatcacctgatacgtggtaggaatcgcctgatacttgatggttatacctgatgcatgttaggatacttgcgaggtatcaggtatctataaggtattaggcgattcctatcacgtatacatgtgatacttgtaaagtatcaggtgatacctgtaaggtatcatacgattcttaccacatagaaggtgatacttacgaggtatcaagtgatacctatgaggcatcatgtgatacttgagtaggatcatgttaaacctaggaggcatcgtgatcccccttagtatcatgttcggtttcaccaggtttcataagtgatactttgggaggatcatgtgatacctggaaggtatcatgatcctcatctgtatcatgtctgctatcatcaggtttcacagatgataccctaggaggatctgcatgaccctacttaggtatcatgtctggtaacataatcctataaatttcacagatgatactttagtaggatcgtatgatacctgtgaagtatcacatgatcctacccaggtatcatgatacatgatcctcaaaagtatatatcattatgtgtgatacttgtgaagtatcacatgatcctatctagtatcatgtctagtacagtggtttcatgcgggtttcacaaatgatacttgagtaggattatgtgaaacctgggaggtataaggaggtaggatcaattggagtataaggagtacatcatcctcctgaggccgcggccggatgccgccaccgtcggcatggacgacgacggcgcgcagcgagctagtacttacccttcctccccggcaacaccaccgccggcggcaagctgcggctggtctgctcgtacaatcacgccattgacggcttcaccgccgtcgccgtgtccaaggagctggcccagctccgacgctgcttccaggacggcatcgcttgcttgtattactggtttaagcaggaaggaggatggcaaccttgccggatccggccatggcgacgatgcgctgcgcgtggcggcgagagcacccgaggcggagttgctgcggatgcaccggggcagcggcgacggcgacgcgccgcctgcgcggtggaggtcaatgaggtgggaggacgcgagggacgacggcgccgccattctctctccaagccaatcccttcgtctcgtgctgcagcggtggatgacgcggtggacgaaaggggatcctgtcccgtcccgacgggatcctgttatttagcatttccctttacttttctatatgtaccaagtaaatttgtgtcaactttttaaactaaattaatggatgtactcttctgtttgtgaagtacgtacgaactaatggtactatacgtgtaaaggaggcagagatataattttttggtgtttttggtacatcttattagtacaaatctacaaacatctttactgggataatgaagtagttgcggtgtcagttaatttgtcaccctaactactttgattgtaaattttataaatttctttatactttttaataaaaaaataaaatctagctaagtggatagcaaatccgctgctggtcaagtttttaaaaatataaattaaattaacatgaatatttcctatggtaaaaacataacacatttcttgcaaaatatattgtttatgacgtgtatatatattcttctatttgtaacaaatgaaacaccgctggagaaaggggtatcactcccagttggtaacacccctatagtcccagttttgtaaccgagaccacgaatccgggactaaaaatgctcacctctagtctcggttaaaataaccgggagcaaagacagatctttattctcggttggtgttaccaacctggagtaaagagggaaatctttattcccggttggagttaccaaccagaacaaaagagggtagtgctaggctctctaatgcctattcttctctttttctttttcattgttctttgcctattgatttcacaccaaaatcacatagatcaacatcacaaaattgaacattgacatcacaaatttacatataactgacatcacaaatctacacatacatcacaaatccacatattattggcacaacaatttcacaaaaaaaaatcaaacaaattctcaaaaaatattcacactgctggggagggcatcaccgccttccgccgccgcctgtcgtcgcccctcccaccggatccgatggaggggagggcgaccttcgctgcccgccgcctcccacttcgcgcgctgccaccgcctgctgcctgccgccgccacctcctgcccgccaccgccgccgctgcccgccaccaccgcctcctacccgtcaccgccgccgtcacatcgagaggggaagggcggaggggaggaggagtttaggagttagaggaggagtggaggagttagagctgcgagaggagatcgaggctagataaggacgagcgatatgatcgaggtgtgtgtggctctggtatttagtcccggtgggtataaacaaccggggtctaaagataggtattttttcccggttgtttatactaaccgagactaaaggtaatgggcctgacatctttttcaaccgggactaaaaatgatctttagattcttattgaaatcgggactattgtggttttcgcccaacccatcaaagatgcattctccattagtgagagcacgtacgggtattcaatgagaagcttaaaaattcaaaaagaagtgtacataagtagaattataactgatttccataaacacaaagtccctaccggtcccttccttaattgatgccgggtaatattacaatttggtacattcaatactactagttactctacctcttagtctcggtacctctaggaccctagaggtactctttgttttaattctactagttaatttaatttcatgccccagcaaattctatcgatcatgcatcaaccacaaaaaatgaaccaagaaaataagcagtaagtcgatcatgcatggttcgcttgaatttgaatttttatatatacatggcgcggtggatacactcatattgtcaatctgttgattaattaactattttaagagtgtgttaagcatatcatgcatgacatggtactacgatacttcctccgtttcataatataagactttctaacattgctcatattcatataaaagttaatgtgtctagctaaaaagttttacaatatgaaacagaggtagtactccttagccctaaagcataataaatatcaggatttctggagttttacatggagaataaaaaagcatacaaaattaaaggaacggttgtgattgattaaaaaggataaatgatagaaaaattaaattagatattattacgattggatgatattgaagcgtataggttttagggtttagtacatgaaaaagttgctatatatttggtgacaaattactattacacaaatatttttttaagcacccttttttttccaacgactaaaagaacataagtatgtaaaattgtttggattgtgctaaggccccgtttagttcacaccaaacttcccccaaactcccaactttccatcacatcacatcacatccaaaacttttctacacacataaactcccaactttttttcaaactaccaacttttcccaaacttctccctaatttcaggaattaaacatagcctaagtaaggaactttatgcgaaaatccattttcatagacagaccacttaagtagtatagttttcgaagtcaggcctgctatgaggcacgtctacaaaaccttctaattttgacgtgaactaattaaacacaccctaaatttactaaggcattgtttagttccaaactttttcttcaaacttctaacttttccaacacatcaaaactttcctatacacatgaacttccaacttttccatcacatcgttccaatttcaaccaaacttccaattttgacgtgaactaattaaacacaccctaagtcttctctcatccagcctctcccatagatctacgcctctacctcattcttcacctcccttccctctcaccccctcagctccacagcggagtcgcactccgtggacgtgggtcggcagcggtgcagtgagatccaacgacaacttcggcagcggtgcctgcccttgctcacgcagcgttgtgacgcaattcgatggtggcctcagctgtagctccctgcgttgcttgcatggcggtgcggtgcgatctgacgatgacgatggcggtctcaaaggcggtggatttggcaccgctatcctggaaggggcggtccgccgtaggactttccctttcctttgcgcatggatccatcggtggcggcggcgggaggggagaaacaggtggcctctcccccttttgtgcgcagatccgccgacaatctctccctctcccatgctcagagacctgcctgcagcgatgataggaggggctgagctagcgaccgctccccctatgatgatacggctaaataggtggatccagctccggggaggccggtgatggatggattcctatcttgggttttgatttttctttttgaaattttaaattttttgaccgaaaattatttttgcagtcaggtggccggcatagcgctccgtgcgaaaatcatgattttaggtgcggttaaactgcccgcttagaaaaatcactatttctgcatacaggcaggggcaagcggatgctacacccatctgcgaaatgtattttagccgttaacaaaaattatgtctgtagcagtgaattttaaacgactaccgatcgagtaccggtggcacccaagctcactaacagtgtagcagtagcgacagacatgcattcatccacgtacatacgtacatgtacttgtcaaccacacacagtatatatatattgtccataaaggcaacagtttatctgaatgagtgaatcaatcaaaagaaggcacagagagctagctagctactccatctgtcccacataaaaaaccaacctaggccttccaaactttttcttcaaacttttaactttttcatcacatcaaaactttcgtacacacataaactttcaacttttccgtcacatcgttccaatttcaaccaaactttcaattttgacgtgaactaaacacacccctagtatcgaatgtaacacatcctattaattactagtacgaatttaaacatacatctgtctagatttgtagtactaaaatatgtcacatccggtattagatttgatttttatgggacatgagtacatgtataggccggccatgagagaacgctcgttccatatatgcacagttgcacactttatctctatacatccaaaccctcatgttcatatgcaatgaatggtatagtagtagcagcagcgtgcctctcagctctgcttccctttttcagctctgctggtagctacttcacccgtctcttaaaatatactccctctgtttcatattgtaagattttatagcattggacaatactagaaagacttatattatgaaacggaggaagtagatacttatccgcctgcttgtttaaaccactcacaaccatcttaaacaatcatgataaaaactatcatcatctattttgacatctctccgtctttaatctccgtataaaaaaaattagctccagcaataattatattttagaacaaagaaaacaaatatacctcgctctccttaacctccattaaaaatctcttgaaactactttctccgtttcaaaatatttgataccgttgactttttagtatatatttgaccgttcgtcttatttaaaaaaaattgtgaaatatgtaaaactatgtgtacatgaaagtatatttaacaatgaatcaaatgatatgaaaagaataaataattacttaaattttttgaataagatgaatggtcaaatatgtactaaaaaatcaacggtgtcaaatattttgaaacggagggagtattatatttgggacagtgaagccagctgatctgcaagagcctgcacgtacaggcaactgccgagcagagcctataaggttaccttgactccctgactagcttatcaccgcgatgcatgcatgggcacatctgatctgcatggatcgatggccagggcggaagagcaaagtgaatggagctaagagcaggtacaataggagctgtaaacatattttaaaaaaataaataagaagaaaaaagagcagcgggctacagatttatagccagctgtagcacggacttcaaaacgcagtgtgtgtatgacagtatgacaggtgagactaggtattgatagtgtagtatataactattgtatagatgagatattagattgactatatatgaattagagttaatagttggttatactattaaacttgctctaacagtacactctctggatgcaaatgccgtgccattattattccatgatggcatcaataatttgcacccatcgtcatgtatgtgccgcagttaaggtttgtgactgccacccacagcctgccgcatttatgctacacactgcatgtggatccttttctgcttcccccctccgccacctctgaaggtttcctagctttcaagtttcatccaactaacccaagttataaataaaccatatagagtaaaaccaactaacctgagtttaattctttttcctcgaatacgactaacccgatttataaataaaccatatagagtaaatttcacaaaactacagactatcgtaaaactacaaatataagattatgttttatataaaactacaaatttaggtctaaatttatcacaaaactataaacttaaagtagagtatcgtaaaatacaaatttagtacttactccgttttacaatgtaagtcattctagcatatcccacattcatattgatgctaatgaatctagacatatatctatctagatttattagcatcaatatgaatgtgggaaatgttagaatgacttacattgtgaaacggaggaagtaacaaaataaccacaaagctacaaatttagtgtcaatttaatcagaaaatttgagcgtttataactcaaccatgacattagtgccaaagatttaaactctgaagtttatagttttgtgataaatttatttttaaatctatagttttgtgataatttggttaaagtatatatagttttgtgaaatttactcaatcatatatatgttccaaaatttacttatatttacgtttcttctctattctacttgcaggcctccgatcccatcctcttacctcttctctctactacatttctttcttctctcctctctaaaagtttttggggaacttttcatgttcagtttagtaagataatagcaattttgtatcaaaactctgatttgatattctttggctagttaaaaactaatgaaaaggttaattaaaatcttattgctctcgtgaataagctccaaaagtgtccctacgtacaggccctcaaacagcttccataatttctatacctattggtttgtaattgtttttttttgctttttcgtattttcaaactcctagtttattgtgttatatgtggctttgcttggcatggctccaactcatctcaaattcttgcagaaatagagtttacaaattaaactagagttatgcgcttaatcctacaattttagtctaaaatatgaataaattgtcttacccaaatgacttaatctatcaagagctccaacaccaagataaatttctgaacctagaaagaaaacctgctgctaaaaaaatactccctgcgtcccataatataagggattttggttctatatataatttgtcctacaatatacaatattttttatcccatttatcaactcttgtattagtttgttttcccatttatcaactcttgtattagtttgttcttccacctatcaactcttgttctaatttattcttcatctatcaaatattgtactattttattctcccatttatcacaatttgtactacatgttcttttgctacttccttaattcatgttaaaaatgacataatataatctcttatactgtgggacggagagagtagagttggagctatgttgataaatagtacagtatatatatgttcatgatttgaacttcgcactttcacttctcttcggctaaattaattatacccaacactcacagccattcatgataaaccccttatttatgcatagggcccactgcgccgccaactagggagcaccgccgcgcgtcgccttgccggcctcgccgggcgcctgcccagccacccgccgctctgcggccctcccggccgccgccgccaggcccccgccctcccagcctctgttgacggtcattatcgatcagtttcgaccgtcaatattaccaaaaaagaggagaactagtgattcttgcaatgcataaatatgttagaataataatatttaactagtattcggtatactaaccttttgcagagaataacaataaagtgaaggaggatcgacatcaactcaaacaataaatcaatcggacgatgtcgagaatcagacttatgcatgaatgggccaagaacttagaattgacacgatgaattgggccaaaattcacaagtctacaaagtgaagcaatagaggaggtcgccagctgaagatgggctggtttgggccagcccatggttcggccgaacccccatctccaccgttgaggccagggttcggcatggacgtccaagattgcaccccaatgacagttggagagtacttcggacaattccttccaaccgtcaaacacctctatataaaggcttcactctcttacttcaacacacacctcaagcaagagctctctcatttctctcaagtttagtttagtagtatctagctggtggaataggaatagagtagaaatcaggagtccggaagccttcagaagagttcgggtatggctctagtagcttttctttcctcttttgtaagctttgtacttttattagaatactcttctatgtacatttatggtattgaaatatgttctgagtatatgagtacctactttacattatgttcatgttatactgaatatacagctaacttatctgggagatgctttggtgcgggtataatgtttgcttatgcaattactctatgtcatgacgatgatattagagtagtatctagtagtttaagcgtggtgtctagattacgggatattattatttggggttatatgctgcggatgagaggtgggccgctgatggtgacagctcaatacgggtattcctccgcgcctgtatataatcctaagttaattccctggggagggtattcctccgtatttagcccgattttatggtcatgacgggttgtcgtaaggaacttggcagtcaggggtggtgtcgacgtttgatgttacgactacggtatttgcatagtatggggatcgttggtactaggatatatgtgagattgaggtaaaagagatggggacgaggatttttatacaggttcgggcccctgaattgtcaggtaataaccctactcctgttggctgaagcctgtcgttgctcttattcatcataatcacaccaatacaatatttggggtggcctatctatctgttgtcgacttggcggccataaaaccatcccgtagtcgacaacagagtagtcttcctcctagaatccgtgtccggcgagatcagagacagcgctagatccctcctgacggtagtcgtaggaaccgtatggggactaactaggcttatctccgatgtcgatatccagcggcttgtcttggcgtatgttggcttgtatgttgatcttgtgtcttaatctattgttccgtccccctctcctcctagggggtcttgtatttatacccataggtgttccattttccaagtagaactagggaaaccaatacggatacaatcagagtaatccttgtcgtttccatgtagaactctatttatctttccttatccggaactccttctatacccgaaggttgtttccgtataaaacatggtatgtggtaggtcctgccgagtttagtcaactactactaggtatgtggtatccataaccctgacaggtggcttctcgaagtaccatgagggcatcggatagagggtattagctagtatatcggttaactagaatgcatgtatactatgtatattagaagtatatgaatagattttctttctcttttctttccacctatcttagataatatattatgagaatgagtagctaatgcttgtgtgtcactctacccttggattatcttaacccctgcttagaatataattatcacaagtaatatataaactattagttaagttctctctacatgatcttcccacgggataaaataaatacgatacccttggaatactctcgggtgaaatgctacaatggtatatccatgcgcttgtggatgaactctgtaaccataatataccagaattatttttgcgccattgctgagaattgtatttctattaatgacgttaagaaatatcaacagcctcacgtggtaggaggtggaggaagagaggagaagagggaggaacgggagagaagggataagaggctatttaatgagaggggaggagagaggaagggggagggaccaagatgagaacttgagaagtactggcgcgtggcttgggtgatttttttttattttggtcccggttggtataaacagccgggactaaaaatagatctttagtcccggttgtttataccaactgggactaaaaataattggggtctaactcgatcggacaacttcttgaaccagaactaaaaatgatataaagcttaaaaagtttttaaccaggacttaaaaataaattttagtcctggttcctattcgaaccaggaatattgtggtttttgagcaaaccagcaaacatgcattctccagtagtgagaattagagattttaaggctggaggattttaaaagtaataatttaatagagaaaatgtcctagttatctgcatacatacatgcatgccttatattatgaaatatctaaagaagtagttgtgtcttatattatggaatagagagagtacttttatattatggaatggagagagtactttgaacgttttgttataaagaatttgttaatatatgctatttcttatgtataatatatatatttaaaaatagttaattatgatcgaagttatagcttatattgacagtacgtacggattgtaaaacaatattcttttgtgattgaagtcgatcaataatatcgccaaaagctttttgttagaggcggtcggtcgaaccatctttgcgaatgtatttagtcgtcttcaaattaaattattttctgtagccgcagtgaatgtatttcgtatgtcactacagtacatggtagtactgtattaaactaggcggtcagagcacagtacgtgacacttattttttctcagataaaactttaaacggatttgaatcgaaaaatcactgcacggaactataaagtctgggaatatatatatcttccgaacagtagcgatgttgtcagtacatatggtggccctcatccgctagaattcaataatatagtgttaatgtccacggttacgtacaaaatgtaacattttcagcgctaattaacttggtaattagggttcatcacggatatatcaacggcatccacttattaagcttgcgtgttaaattaaaatgcatcgatcgtgtgagtgtataattatgtgtatatgtgtgatatcttccaacgatgtattatggacctttcatcccaaatcccaatccttaatcctcaaaactctattttataattactcatatttttggacgacaaaaagtatatattacaattctctctatctttaaacacaagtggttgttgactttaagacatgacagcaatttacacaaaaaggtaattaatatagagagatttctggctgctcgatcatcatcacagatcccaaaattaatatagagagatttttccataaggtacatatattgtacatactccctccgatccgtgatgcttttaacttttcttaaagtcatatatataagtaatataataatatctacaacaccaatttcatttcattgaatctaacctttaatatattttctagatatatgttttattacatcactgctacgaaaactatttttcgtggcggtcattttgggttttcgctggcggtatttgaggccgccacaaagcaaaggccaatgaagatcaagcatcttcgctggcggtgaaaaaccgctagagaagttcagttttcactggcggatccacataaggcagccgccantgaaaataatgttcaccagtggctgccttatggaccgctagcgaaaatatattttcactggcggtggacagcgggcagccgccagcaaaaagccggtttctctggcggcaagtaagaagacctgccagcgaaaataatttcggagaaaaaaaaaataaaaatcacattccccaattcacatcccaaatccacaattcacatcccaaatcacatttcaaacttcatgttctcatttctaaatctactccacaattcatactcctgcaaaaaaaacccaaaaatccccagtcccaaatccatggaggactcgacgtagtgtcaacttcggcaccctcctccaatcgctgcatctgcaccacctcctcggccaccactcgccacaccttgtggcagtacaccggcgtgccggcgagcaagaagggtcgccaggaagctgtagtcgtcgtcgtcgttacgggagccgtagccgtcgtcatcgttcgccgccggatccacctccttcactgccgtgaaggaccgcccgagcaccgacgccggcgaatccgagcccaccctccccgtcagcctcccccgtcgtcgcggcggcggatccggcctccaccatcatcacggcggcggatccggcctccaccgtcggcgtcggcggcggatccggcctccccggtcgtcgtggcggtagatccgaccactcttgtcggcgtcggtggcagatcctacctccccagtcgttgtggcagcggatccggcgcgcggcgtgccgccaccgcgagtccccgtcgcgccgccgccgcgcgccacccatgattgtgggagaggagagacggccggtggatctgggagaggtgagaggagtggttggagggagaagtgggatggaagggagaggagtggttggagggagaagtgcagaagtgcgtgaacgtgtcacgattaatttatgcctatcccatgattttttatggcggtggctattacaccccgctactgaaaatctatttttactagcgggtcctagaagcaccgcttgtaaaaatagaggtgtttttgcaagcggtactcttaagtaaccgctagcgaaaactgattttcgctggcggttctaaatttaccgccagcgaaaatattttcgctggcggttctaaaccctctatccctcgttagaatttcacaagcggatttctcatataaccgccagcaaaaaaaaataggataccgtcatgaaaaatcatttttctagtagtgcatgttggaaatactacgttttactttgtcaaacttatttatttgttttttttaaaaaaagacaaaacctcaaacaaaaggaaacttggaaagtcattagcttaattaaataattataagcaacatttttcaccggttgggtaatactagtagcacacgtacgtacatagtactacatggttacgtgtttggccgtgagctagctagctatacgtgttcggcttgagctcgtgacatggacgcaatgccagaattctataaaactatagctgattgctgatgcatacccctccgtaattaaaaaaaaaaatctgggcgcacgtactccctccgtatcagagaaaaagcattcatagcattacaagttaaaattaatgtgaaataaaaacgatcaaaatatcccacattattaaagaaagtgatgatggtgatagatcggtaaatggtatttaagggataaaattagcttctcattttacgtgttgagggtaggtacgatggtataagttttgtttttcatattttaaaccaaaagttaagtttttttaattgacggaggaatatctgataggattagttttttgacggagttgtacgtgagtgcgcacaagaccttggtgtcacggctcagcagtcagcacacatgttcatcgacatcatccactagcttaatcaactcttctacttaattacgtacctagttatagttaatctcttgtacccaaggcaagcgattggtcagtgcatgtgtgtacgtactaagccagtactataagtacctaattatttatcctaagatatcccgtagacttattttggtgatatgcgaaagagagaagtgaggagagagtgcattggaggtattaagatttgagtgttaaagcctaaaaattgtacatattacctcttaatttacgatatataagataaataaaattagagagagaggatgtttggtttctagctatactttatcacaccacacttttaaatatcacagtttgtcataattgcggcttgcgacgatttttaatagcatatgtcccgtatatcatagactaaggttttttctcaacttgccacactttcgtggaagcgacgagaaaaaaacttgaagttagtattagaatcatttttttattgtttatttttatctcagttatgagattttgcactgcattcactggtgtaatcgttggttgtgtatgtccacttatgaatatatagaagaagttagatttctattcaatatttttttgaaaaaagatattttataaggttcattcaagcctccagctcgctttttaaacagtcatgcatgtgttagatgattcccccacctagtttatatggtttaagttatgattctacatttatgccacacacacacacacacacacacacacagatatatatatatatatatatatatatatatatatatatatatatatatatatatatatatatatatatatatatatatatgtccttcaccaaaaaatatgtaaaatccatggattatttatacttaaatgataattgcccctgtatatgtgagcatatatatgtgtgtgtgttgaagaggcgttctcgtgctgtgcctggagagtggagagttatatgtttggctggtgggaaaaagtcgaaatttctagttagaaatatatgtgatttatgactattttgataaaactaggcacaattattgtcacccatttgtaaaatttcaagctaattaaagtaaaattaactaaatttcaagttaatgtaaatttagattaaagtttgaagaacctagttacattttccttggaatttactcccacatatatcaagtaatacttctaagtaaaaaatataaatcactagcctggctggcttttttgcgatagattaaaaaaaatcaagaataaatgtctcaactatttggtataagtagttaagtacttgtgacattttatatcgatgttttccacagtcagacgtacataaatgtacatgaaacagatcaattacaaacgagcaaaaagggacatgcatgcacttgcgtattggcattcataggcagcaatacagattgccaattggctcaaactgaatacgatcaggcaataactggcctagtacccacaaactaatcatcttcagctgctctgccaataatactggtggtccagtctcagagtcagtcttacataaaggccctttgatttgattgttttttctatgtgcacacatacgtgtatttttttcaataatggattttattaaaaattaaagcagatagcgctgtgcgaactcatcactagaaatgcgcacgcacacaccctatcaattatccatatgaatatatttgaaagattggaccagtatatcttgggattgactaaatcatcacgagcttatcactattataattgaaagaatgttaaatctataacttgaatccgaatggactagttccaccaagagtgatctaactagttaaaccacgtatgctcacttcgcttttaataatggatttagattaaacctggtcaccacattcaatttgatatacatagccaacacgtatatgaacatagtttaatatgtgattttaacttttacgatatttgagaaagtagtgtattaaaaattttggaatctgttaatatctgcacacgaaaactagagatcagatgctagagggctccacaaattggcgctaagaacaagagaaaacaatatgatatctattcaacgaccctaaaatcacttgtgagtagcatgaattaacaccctaatcaccagggtgtaccatggattttcagctatcgtcatcagcactaaagtgtttaagcctcctttagaatttagtaattaaattgatccaacggaaaatgcgagaaaaaaattctacgtcccaaaaagaaattaagcgcaggaattatgtaacttgacaaaaatgatacacataatttgttgggttaatttgatttatgccattgcaaattacatgatttgaaaatatactactattatgcacctattcgtatcaatgccattacaatacatctaaaattaaattcatggtatttttttccaaattacagaataggtgaatcctattatgtactccctcctaaacgactttctttacgagtacggagggagtaaaaatgatggcataatttgttgggttaatttaaattttggtcatgggtcaccggattgaagaagttcataaaccaccaaaactccaaaacatgagtttttgtcatattgaagtggattgggtgcgttcgtttcgaaaaatctctacgtgattagcgcggtgaacttttgttaatcaatacccataatgacttgtattagcacacgcgggtgctatgtcactggaacaaataaattcaaaaagcaccaaaacatgagttttggccctattggagtggattgggtgcattcgtttcaaaaaaatctctccgtgactcgagcgacaaacttttttcaattaatgcccatattattctatattggcacacgtagatgcgatgtttttcaccggaacaaaaaaaatcaaaaagcacaaaaacatgtgtttttctcatattatagtggattgggtgtgttcgtttcggaaaaatttctctgtgaatcacactgcgaacttttgtcaattatctccagcgtcgacgtgctcgcctcgccatgccacacaactatcgcagttcgtacacacgcggctaagaaattagaacacatctatatatatcacacacatgtgaaacaaaaacattaagctagcaatggattccaccctgcgaatcatacccaccgaggcattgttcggtttggaggggattaaagaggattggaggggattaaaggggaataattccacactacaataggtgtggaataaatcccaccaattcctccctcatggggattaaccgaacaaggcccgagggtggagatgatgtccatggactcctcccgtggctcgacgatggtgaaggcaccgctggctgagaaggtgcgaggcacggaggcattgccgctagagtggccggtgcagtcggggacgtgaagctcagctggggacttcatattcctgtggccttcgcttcaccgctttgacccagatgtgatgtgaccattgttactatagatacaaccgtcgctcacatcaagatcaaatgttgtggaatccaattcggtcacctgctatactgttgacttcaattggccgtcaaagttgcatacgagctccgttttttggtccatgagtacttgatggaaagctcttggaatcctctttccaatagatacagcctcattactaaattccatcccagtcatccacaatcacaaaaacaaggtgttgcgttacttatattgggccaatgggtttgtaaattcatttggaaccccggcccaagtgggacccatgtggggtgcaccccaaacaggtggagcactaccctagggacccctaggtcgtcctcccacttccataaatagctaggtaccccttcagagtttctcggattttgtttagataaagtttagcttcgctactttgctgagtaatctcgtgatcgattagaacgccggtttgcttgttatggaaccccaacttatcattggtattcaattcctattcgcaattcagattgcttttatcttgttcttgcttgtttcttcgatttgcatgcacgaataaggttggactgcatcggtaagatcaacaacccacggagatgtcccagcaaaaaaaaaaacaacccatgaagaggtgtatcgatcgctaaggtgcaacacaacaatgtctcgtacggttgtagtgtggtcgtcaacgtttatcccaaatcgtagttatcatcaactcatcgaaagatcaggccaatcaaagccatgagtgtctcgagtggaattcaggctttatcaagacggcggctaccggcgcttccagtcaccttgtcctctattggacgctactgccgcccccaccgctcggtgtgcccctgtgaagcatctaggccctcgttgttaattttggtaattaatgacaagcactaattatggactaaccattgtctttaagctatatattttaagttaggaccaagtcatatgtgggcatggatgattatcgatggattaaaattgacggcgcaaagcaaagagaaagaagacggtaaaactagtgcttttatttagaattgatcgaggtgtagggcgatcaaatttgctagtttatttgttagtttcgcggtactatcaaggagggtaatgacctagcaaagagttgattttaattgccacattaggtcattatgcatttagacttgtgctcacactatcacaacacacacttgctatatatattggtctctgtttcactgggttcggcctgactaggggcggccagaccggccacactggcggtctgaccggcgtgccctggccggtctgaccggcgccacaatggcagtctgaccggcgcataaggccggtctaacaggcggcacatgcgcggtcagaccggccccctggaggccgggatggtgctgctcggggtggccgatacagagccgacggagccgtattcgttcagaccgagccgacggcggtctgaccgagccgaggccggtctgaccgcccactcaacgccggtctgaccggccaggccgatggggccctctgacagcactacaacggctagttttctagccgttgcagagtagcacggtctaaccggccacatacctccggtcagaccggcagagtacaaagttgggggattttgccctcaacggctagttttggttggtgggagtataaatactccccctttagcagcaagggggctctcttggcacccaatttaattgcatacaccccttgcacctctctcacacccacttgagctttgtgttcatccatctagtgtattagagggttgattagccaagagtcaagtgcattgcttccatttgtagagctagtgtggcacttgattgatcatctccacgccaggtcattgcttgttactcttggaggttgccacctcttagacggcttgtggaggagttgcccggtgaccactccgagaagattgtggaggaggcccggcgccggtttgtgagtggtttggagttcaccaccttcggagtgaaggaagaactaccctagtgatcgaggcttgggtagtcctctccatgggccggctcccaccttgcccaccccttgacgaaggaggtgtgcggtggcttcgtggttgagtggtggagttgggctcgcctcaacggggagtaggaaaccggcgagtttccgaacctcggtgaaaaatctcttgtctccttgtctcatttgattgtcgaatttacatttgtgaaatttacatttctagagacgtacttgagatcatatcaccctaggattgctaaactttgacataggagtgtgatttactttcctagagatataattgagccactatcaccctaggtttgcaaaacataacttagttgcttagttagagttgaccctcaccaagcctagcaacttaggttagttttgattaggtgtcatttagttttaaatcgcctattcaccccccctctagtcgacatctcgatcctacaagtggtatcagagcttggtctctcttgattgggcttcaccgcctagagagaagatgtcggacgaggtgaaccatgtagagaaggctcccatgtttaatggcacaaaccactccacttggaaaattaaaatgtctactcacctcaaagctgtgagcttccatatttggagtattgtggatgtaggctttgctatcaccagcacgcccttgacgtagattgatcaccgtaatctccaactcaatgcccatgctatgaatgctttgttcaactctttgagccaagaggagttcgatagagtgagcaaccttgagaccgcatatgagatttggaacaagttggcggagatccatgagggcacaagcgagtacaaggatgtcaagcttcatttcctcaagatccaatatgagacattctccatgttgcctcatgagagtgtgaatgacatgtatgggaggctcaatgtcattgtgaatgatctcaaggggcttggggcaaactacaccaatcttgaggttgcccaaaagatgcttagggctctaccggagaagtatgagacccttgttaccatgctcatcaactccgacatgtcaagaatgacacccgcaagcctcttgggaaagatcaacaccaatgacatgtataagttgaagaagaaggagatggaggaagcctcaccttccaagaagtgcattgctctccaagtcgaagttgaagacaagggcaagggcaaggtgaatgaagccaatgaggacttagaggaagagattgcccttcttgctagaaggttcaatgatctcttggaaaggagaaaggagagaggtagggactccaactccaataggagaagaaatagaagacccaacaagactctctctaacttgaggtgctttgagtgtggtgagaagggacactttgcttccaaatgaccttccaaggatgatgatggagacaagtcatccaagaaaaagagtggaggctacaagctcatgaagaagctcaagaaggaaggcaagaagattgaggcattcatcagggaatgggattcaaatgaggagagctccgcctcatccgggtccgaggaagaaggtggtgatgatgcaagctccaagaagaagaagatggccgttgttgccatcaaggaggctccatcactcttcgctccactttgtctgatggcaaaggctcctctaaggtaacatctcttagtgatagtgagagtgatgatgagtgtgatgatgtttcctatgatgagcttgtgagtatgtttgaggagctccatgcttatagtgaaaaggagattgaggagctccatgcttctttggaggtcttgtatgaggagctaaagacctctcatgagagactcaccatttctcatgagaagcttaaggaagctcatgacaacctcctttccactactcaacatggagctctcattgatgttggcatatcttgtgatttgcttgatgatagtgctacttgtcatattgctcatgttgcatcatttagcatttctacctcttgtgatgatcttgtggatgtgcctagctctagctctagctcttgtgtttctatttgtgatgcctcacttgttgttgagaacaatgagcttaaggagcaagtggccaagctcaacaagagtttggagaggtgcttcaagggtaagaacactcttgacaagattttgagtgagcaacggtgcatccttaacaaggagggacttggattcattccaaagaagggtaagaaaccttctcaccgtgccactcattttgtcaagagtaatggtaagtattgctccaagtgccgtgaggttgagcatttggtgaatgattgccccagtggtaagccttctaagacatgcatgtttgattctcattatatgcttaggaaggctcatgatggtagcattgttgctagatatgtgggttcccctatactcggtggtaaaaagaatgtcatttgggtgcccaaagctttggtctctaacctccaaggacccaaacaagtttgggtacctaaaagagcttgatcttcttttgtaggtgaactaccgtaccggtggaagccattgggtgcttgatagtggatgcactcaacacatgaccggtgatagggcaatgttcaccacatttgaaggagggaatgaacaagacaaagtgacttttggagacaatagcaaacaaaaggtaattgggttaggtaaaactgctatctccaatgatttgtcaattgataatgtctctcttgttaaatctctaaatttcaatttgctttcggttgctcaaatttgtgatcttggcttgtcatgtgctttcttcccgcaagaggttattgtttctagccttcttgacaagtcttgtgtgttcaagggttttagatatggaaatctttatttggttgatttcaattctagtgaagcaaatttgaaaacttgtttagttgcaaaaacttcattgggttggctttggcataggaggctagcctatgttggcatgaatcaattgagtaaactttcaaaacgtgatttagttgtgggcttgaaagatgtaaagtttgagaaagataagctttgtagtgcttgtcaagccggcaagcaagttgcatcttctcatcctactaagagtatcatgtccacatctagaccattggagctcttgcatatggatttgtttggcccaacaacctataagagtattggtggtaatagtcattgtcttgtgattgttgatgattattctcgctatacttgggtgttctttttgcatgacaagtctattgttgccgagcttttcaaaaagtttgcaaaaagggcccaaaatgaatttaattgcacccttgtgaaaattagaagtgccaatggttccaagtttaagaatacaaatatcgaggactattgtgatgatcttggtattaaacatgaactttccgctacctactcacctcaacaaaatggtgtagtggagaggaaaaatcgtacattaattgagatggcaaggactatgcttgatgaatatggtgtttccgattccttttgggcggaagccataaacaccgcttgccatgcaaccaataggctttatttgcatcatctcttgaaaaagacttcctatgagctaattgttgggatgaagcctaatgttgtctattttcgagtttttggttgcaagtgttatatttactgaaagggtgttagactaaccaaatttgaaagtcagtgtgatgaagggtttcttctaggttatgcctcaaatagcaaggcataccgggtctacaataagaacaaaggtattgtggaagaaaccgccgatgttcaatttgatgaaactaatggctcccaagaggggcacaagaatttggatgatgtaggtgatgaaggcttgatgagagctatgaagaacatgtctattggagatgtcaagcctattgaagtggaagacaagccatccacctccactcaagatgagccatctacttccgctacgccaagtcaagctcaagttgaagtggaggaggagaagagacaagatccacctatgccaccaaggatacacattgctctttccaaggatcacccaattgaccaagtgttgggtgacattagtaagggtgttcaaactcgatctcgtgtcgcttcgatttgtaaacattactcgtttgtttcttgtcttgagccaaaacatgtagatgaagctttttgtgatccggattggatgaatgctatgcatgaagagctcaacaactttgcaagaaacaaggtgtggactttggttgaaagacctagagaccacaatgtcatagggacaaagtgggtctttaggaacaaacaagatgagaacgggttggtagtgagaaacaaggcaaggttggtgacacaaggtttcacacaagttgaaggtttggactttgggaaacttttgcccccgcggcaagacttgaggctattcgcatccttcttgcatttgcatcatgctttgatataaaactatttcaaatagatgtgaaaagtgcttttctaaatggtgaaattgccgaacttgtcttttattgaacaacctcccggttttgaagatcctaaaaatcctaaccatgattttctattgtcaaaggattttaaaaattggaaaagttgacaccactcttttcacaaaaatcattggtgatgatttctttgtgtgtcaaatttatgttgatgacatcatattcggtctactaatgaggtattttgcaaggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggcttggaggatgcaaagcccatcaagacacctatggcaaccaacgggcatttcgaccttgatgagggaggtaaactggtagatttaaagctttatcgtactatgattggtagcttgctttaccttaccgcatctaggccggatatcatgtttagtgtttgcatgtgtgcacggtttcaagccgctcctaaggagtgtcacttagtggccgtgaaaaggattctaagatatttaaagcattcctcaactattggcttgtggtacccaaaaggtgctaaatttaagcttgttggctattccaactcggattatgccgttgcaaagtggatagaaagagcacatccggtagttgccaaatgcttggtagatcccttgtgtcatggttatccaagaaacaaaactccgtagctctctctaccgccgagacggaatatgtttcggcgggtagttgttgtgcccaattgctttggatgaaacaaacattgttggactatggcatatccttcaccaaaaccccactcctatgtgacaatgatagtgccataaagatagccaataacccggtccaacattctagaaccaagcatattgacatacgccatcacttcctaagagaccatgttgccgagtgtgacatagtcattagccacataagaaccgaggatcaactagccaacatctttaccaagcctcttgatgaaacccgcttttacaaattgagaaatgagttaaatgtcatagatttctctaatgtggcttgagatggtgcaccatggttgtttcttttgtattatgtatttttgctctcatttgctcttatgctttggatttgttgccatttggttcttcattgtgaaaatggagcatgtcacattaagggggtgttttgcactcttgcatgtgctctacttccctttatatgtgagcaaatcaactagttatgctagtagtattttcaaaatgcccaagttaacataagtcaaaacttttgcaaaatcaatgtaatttgaaaactatatcttggaaaatgtttcaaaaggttccctttatgttttccaagcctcacattgcaagaaaaatgatttttgaatgaaaatggcattttggccctcttttgaagaatctagattcttagttttggccaaaatgagatttatctccaaaataagattaagaaggaattagagaaaagtttcaaaataaagttggtagagaagaagatttgaaatgtttttggtattcaaacctatttcaaaaaccaaatcattcaaaagttatttgaaaatcaaattcgccccaaaacccctatagaccataaaaggtcacctcctagcactcaagtgagttttgttgcaaattttcataattttcaaatgttatgaatggttagcaatatttcaactcacacatttcaaaattgctccaaaaatcaaatttttttgttgatttttattgagtaggggtagccgaactgtgcaagggctgtgcacagtcggctgggggcctagcggtctgaccggccaggtgcggcggtctgacaggccacatagggccggtctgaccgactggtaggtgggcctaggacttttgtcctttttcttctcccttcttcccctacccaacccaatctcctcccattcagccatcttcttccccaactcgaaaaaactcctcctctctcctctcccaaaccctagccacctccctccatcaaatccattcggtttgaccgcggatttctctccggttacaccgtaagtgactctcctctgcttcctctctctattccatggattagtttgtgtttttgttgagtttttgatccatggcatagaaccctaggtgaagcacgaggtgttcttcgatttgcaccaatagagggtagtttcttggtgtgattcaactcctccaaccggtaaatcactctccctcttgtgcattctctcaaatcgatctatttcaccctagggctatgggtagttgttccaatcttgatgaaataggttcaaccctttgatgttcatgttccaatcttgtgccatattgttctagcaaattttagactcaaatgtgtagatgtgaaaatttttggatgcttgaacttgtgggaggaggtctgcccggagccacaggcggtctgaccgtgggtcaaccgccggtttgaccggcgtgtgcgcccggtctgaccggccggcagccgtcggtctgaccggcctgatgccgtcggtctgaccgccctactggctgtggtctaaccacccctccacaggatataggcaaattttcacctctccaaattgtttctataattattgctaatatctatcatcctttgctctttgacagtgatgcctccccgcactcgccatggtcgtcgtgtacccactccggatcccgtgagtgagcctaaggaatcgagcggagatgagtacgctcaaagtgatgaagaggttgaggcccatgttgaaggggctagtgagaaggcaagtggagatgatgttagtggaagtggagaggatgaggacgaaggaagtgatgatatgcacattgatccctccatccagtttgttgtgaacatgaggaatccatcgtagtataccatcttgaggcaccatgttcagtttttgaggcctcgggacaccccggatccccgttttcacaccactttccagaagagtgtgtatgagcaggtttatgtagggaaagcttttacagagcataagtggatttcttagagagatatcaatgagacttcagagtttgagggcttacaggatctcttcaagactgttggcattgaccggattgtgactctcaaacaagactacaatgaagatttgatccggcagttctatgctacagagtgggtggctagagactatagtgagatgaagtggatgtccgacacccttcagtgttctatctccaggaggcaattccggcggctcctcaatattcgcttggactttggagatgacttgcatgaggagcacacccataatccgctctccatagactatctctctcagttttatgaagatggagtgcggtacacacacgggaaggttgccggcctgaggactatccgcagtgtggttaataggattgtgagagctactatcctccctcgccttggtaacaatgatgatattagggggtggcttggtatgtcatcgatgcaaccattcagggctgtcagttcgacattgtgtctctcatgatgcaagagattgccatctccaaggggaccttcactcagggaatctattatgccccttacatcatgaggttgattcaagacaagcttggggctgttgggcaaaatttgaagaagcacaagcagtacaagccccaccttcagcttggagctccccgtgctcctagggcggtgccctcctctcatcctggagctagctcaagctcagcacctcctcctcctcctgggtatgatccaaatgctttcttccatccacaatatgcttattttggaatgcaacccaacgagtacttcaacccggtacttggggatattaataccctaagtgaaagcattcaacgcttgtctaccgggcatgaaactttgcatgacgatattcgtggcttgcgcacggatgttggagacttgaatgcttccatgggccgattgcacactagagtgggtacattggattcttgagtccaaatgttggagagctcccaagcatttgtgtatcatcgtcgtcatgatgctcctcatccttccacttcggcgcgtcctccttctcctccacaagagtgaagatctttttggtgcttgatgccaaaagggggagaaaagtgtgctatatgttttgtgggttgggactagtagtagtaaggatagtgccctcatatctaataggctaaggtactttacgctatattttgtatgggtatgggatatttctctatattgtgtgttctttgtcgttttgttaaactctatgtcatttggacccttcgtggtcttgtaatagcctatgtttatttgtgagcccttttaggatgatttgtgacttttgtgatttgaatggttaagtgatgtgaacttgtgcgatgatggatggtgtatgcgatattgatatatatgtgactatcttatgcttatggatgaatatttcttgaagttcacattgagttattgcttatgtgtttgtgcttgttggaatatgaaattgaaatgtgcatcggctccatatttgtgtctatgattgatatgcacatgtttaggggaagcttttgatttccattgcaatatatatccatgtgttctatgtttgatcatacatatatttgtggtgtttgtcatcaattaccaaaaagggggagattgaagcatctaggcccccgttgttaattttggtaattaatgacaagcactaattatggactaaccattgtctttgagctatatattttaagttaggaccaagtcatatgtgtgcatggatgattattgatggattaaaattgacggcgcaaaagctagtgcttttatttagaattgatcgaggtgtagggcgatcaaatttgctagtttatttgttagtttcgccgtactatcaggggggtaatgacctagcaaagagatgattttaatttccacattaggtcattatgcatttaaatttgtgctcacactatcacaacacacacttgctatatatattggtctctgtttcactgggttcggcctgaacaggggcagccagaccggccacactggcagtctgaccggcgtgccctggccggtcgcaccggcgccacaacggcggtctgaccggcgcataaggccggtctgactggcggcacatgcgcggtcagaccggccccctggaggctgggatggtgctactcggggtggccgatacaaagccgacggagctgtattcattcagaccgagccgacggcggtctgatcgagccgaggccggtctgaccgcccactcaacgccggtctgaccggccaggccgatggggccctctgacagcactacaacgcctagttttctagccgttgcagagtagcacggtctgaccggccacatacctccggtcagaccggcagagcacaaagttgggggatttcgcccccaacggctagttttggttggtgggagtataaatactccccctccagcagcaagggggctctcttggcacctaattcaattgcatacaccccttgcacctctctcacacccacttgagctttgtgttcatccatctagtgtgttagagggttgattagccaagagtcaagtgcattgcttccatttgtagagctagtgtggcacttgattgatcatctccacgccgggtcattgcttgttactcttggaggttgctagctcctagacagcttgtggaggagttgcccggtgatctctccgagaagattgtggaggaggcccggcgccggtttgtaagtgatttggagttcaccaccttcggagtgaaggaagaactaccctagtgatcgaggcttgggtagtcctctccgtgggctggctcccgctttgcccaccccttgacgaagggggcgtgcggtggcttcgtggttgagcggtagagtttggctcgcctcaacggggagtaggaaaccggcgagtttccgaacctcggtgaaaaatctctcgtctccttgtctcatttgattgtcgcatttatatttgtgaaatttacatttctagagacatacttgagatcatatcaccctaggattgctaaactttgacataggagtgtgatttactttcctagaggtataattgagtcactatcaccctaggtttgcaaaacataacttagttgcttagttagagttgaccctcaccaagcctagcaacttaggttagttttgattaggtgtcatt

SEQ ID NO: 44996 - DNA, 1456 bp, Oryza sativa
aactcacagaagatgatgtagctgctagtaatagctagctaactagtatgtatgtataaggacccgtttggtaaggctccaaacttcaactcctatctctaaacttccactccagtgggagctggctcctatgagagttgcagaacagctaaaaagtgtttggctagcattcagctctagatctgaaattgaaaaaaaaaatgaaagaaaaaaagaaaaaagaaaaaagaaaaaaaaaccgatctggacactgtcccggcgcccctaggggcgccgcccacgcgccttccccacgtgcgtagccagccaccgcgcatcttctccccaccgccgcgagccgcctgcacgccgtcccgcaccgccgctcgtcttctccccactgctgcgcgtcgtccgcacgccgtccccgcccgcgcgtcgtccccccaccggcgcgagccgcccgcacgccgtcccccatcgacgtgcgtcttcttcccaccgccgtgcgccgcccgcaccttccccccaccggccagttaggtgatgaaatgtcactactacaaaatgcattctcccaaatggcaaaacctatttttaggtgaggttaagcaacccatctatccgaaaatgtctgagaaaatcactatttttccatgcgggtggtgcacccgtacgtgaaaaatccaatttttgcatgtggtgcttatatcatccgcacacaaaaataaaagtccaaaaaaaatccccaaaaatcaaaaccctagctaggtgcggtctaccgccgccgccgtcgttggatccgggcgagggacggccactgctgctgaatccgtgcgggggacagtcctgtcactgttgttcgtcgcgcgcccgccgaaggcgcccaaggtcatcattgccgcctgccagtcgcccctcgccggcgcttgggaggaaagttgagggagagagaggagagaaggtgagaaacaagagaggagtaatataaggaggagaggaggtgagagaaggaaggatggtgacttaaaaaagttttgaagtgtgctgagagggaaagaagaggtaagtgaaacttctagacagacctataagagtcctgcctgtgaaaatacattttccctgccgtttaagaggcccgcctgtgaaaatatgtttaatttcacataaaacttctcaaagagattctcttatgaaattatattgccgttttggattcggaaccgagtctccttacaatatcaactttaaacggacctagccgttgatatagaaggaatttaggggcacatgaatacttgttggaaagcttatggaatatactttcatattattttggttccatgtaaaattcctgccaagttatcaggtatctataaaataggtgacgtatctcatctaatccaaatctgatttaggccttgggccttgtgattgtgtcataggttatgcacaagggatggatgccctaggacta

SEQ ID NO: 44997 - DNA, 4959 bp, Oryza sativa
taaccttaaaatcttaatcattcagcttcaaattgagtgcaatttgcattattcttacttgtattcttcgttgattcacatgtagggattagccttctcggcgaggtcaatcgggtttcggcacgattgataaccaaaagagacatggtgattgcagggttcgaattgcaagtttctgccaaatcgatagttattaatacatataggaagatttggacctagttcttcatcagagatcaaaacaaaactcaagaatatataaggatcaagctagcgaatatcggagacgttaatgaaattttagagggcacgtagggaattttctgaaaaataaacatcttcctccacttgatcctcattgatacatatacatcatgaaaatgatgttaaaaaatttacaacatttgcatgggggaagaaaagataaaccccaaaaaaaaaaggtgtaaatctttcactaacaaacatacgatgggttttcaattgattggcaataacctcattttattaacctgtacaactgaatttctcagggtatgtcaaaatcatctctgcttttttaagcaaatgaaaagatgaaatttgtcctctgcatcgtacgcacaagactgcaatgcacacgtctcgcgtatgaccattttgtgttgtgtttcaaagaaaatatataaagggatttgaaagaagataccagtcacactcgcaagggtgacatatatgatatatccgctatttgtgaatcagaataattaggccctgctttgattcaggttatttaaaaaaatattatcatggattttctactataaattaattattttaataattaaattcaataaatagcttgaaacaagttttctttaaattcaataaatagcttgaaacaagttttcttaatgatattgtggaaggatgtgtttcaagaaaatatatttttctaaacatatagtaaataatccgtttcaataattcggtgattaataatccatttcaaatagtgaaaatatatagtgcaaaccacgtatgtaatgtaaacctggaaactatagttggatctaacaatggacgcctgagatttatccatatcactttgagtataaattttatttgcagattcaatcatgaatagaaattttgttaggaataaaaagtttactcttaatggcgtggataaatcttaggcgttcatttttagatccaacgatagcttttaggttccattatatatgtggtttgcactctatatttttccaaagaaaaaagctaaggagagagaagacaaagcatagccagtaacttgggcagtttacagaattactacacatttgaacacatgtggacgacaggcatatatatagggagtcaaactagatttttattttattttttgagaaatttgccatgtgcaagttgacatgataattactatttgagacaagctaaggcccctgctggaatatctggggaactacaaccaactgtgttctggaagcaaaggtacatgccagccctaatatattaattaatgctaatccctggttaactttgttgtttttttgaaagatctggttaactgtaggttattaagccccagttgacaatttggtcctaaatggcaattctagctccagcaaccttgacagcacagcatgcacatgcatatatatttacatataaaatatatgttgttgtcactgaattaatggttgaaatgatcagacattcatacctttgccaagctaaggaagagaaaattaagaaataagaaacgcgtgatagaacgtacagtacgagtcactgtcttcagatgagatgacaccagtgggccgctaaaaatggtgaagatgctgataaaagccattgctttaattaggaccttgacctgccaaaaaaaagagagagaaagaaatcagtagtattttctttgatcactggtgatattttatttttgatattgtaaatccatttcaattttgtcatgtgtataaactatatatgcagaaagcactgaacaggtaaattcgtgagtgaattaatagatagtatatattaagatggatgaattaattatttagtttttcgtatatatatagagcataacctacaagatgtgtaagcctgcttgatgcaaactttaggttaaaacacaatgacatgtttttttttcatctcggtctaataagcatcaatatatatataatttagagcacatatatatcgtcttcttcatgtgaccatctgaaattggcagtgtgtctcacctctgttcagttttctgtacggctattttggattgctaccaaaacgtgccctactgattctttagcaacttaaataatagtgtatatggaccattttggtttgatgtcttactaaaattttgatagtgctaaaacttgaacaaagtttggtaggataggatacgttagatgtttatttgaatataagccaaagagcatacctataagaaacacctgtataagagacaagtttcagggaaattctataatgttggtaaggtaatatttggagagatatctatactgtgctctctaatagactattattctactactagcattattcatgatatctaccgatgatttactatatgtagaaaaaaaactattctacaattaattttggtttccttgtataagtagatatgattcattggattaaaagaaataaatggtctagatttgttttgctgtcaataaagagcactgcaaaacacctctaattggagatattttggtttgctaccctaccaaaaaaaaaattgatttcgaatgaagccaaatcattagtaatgacatgcatgctccattggcaacaatctaggattgtctttcattacatcaagtttactgatagcaaaccaaacatacacctctacctttgaagaattggcagtatcaaattttacctagattttaacattattgaagaattagtagtgcctagagaaccaacacgaccctacattgctagctgcaggtacaacatcaaacagtagggcaaaaaacagagcaacggacatcacaaacctccaggtgggccaatgcaaaacacacacagagagagagagagagattgactgatgtgtttatagaggggagcacacctgctatctacttggattttttccccataacttaatagatgtgaacttttaaattcagacaaatgttgcttcttcttcttctaatcatttttaaattttgaccaggctggttctttactcaaggcatagattttaccatattattaccatgttacagatgtggaagatgcagtgtttaccagtggccagtgcttggataatttaatataggtgcatgcatggaactgtcaaaattttggtacaggtaaatgcatggtgtttgggtaaaatggatcttactgaaattcatacttttacataagggccgtattgaaggcaatgaaccagatttgcctattcttgcagaaatattagctcatatttggaactggacagagcatatattgcatgcatgtagtactgtacatgtataaccagttgcattttgctgatatctacagctagccaaattcctccccccacaaaaaaaagggtcgctgtgcctctacactcctgcactacagttgacagaggcaggtcaggatgaaagagaaagaaagggatttttggagagagaaagcacagcctaaattctttcttagggcatatgggatgaaaaaaggtgagaggagatgtagcatcctaagcacacgagctcaatcccacagcttttactactccgacattttcctccacaatatacaatatatatcatctaatatattatatatatgtatgttgtattttcttcgtagtgtagatgcaaaaggcattaagtgtttgcttttgactcatttttggtccttttatgtatgtcgttttcgcgtggctgccctcaaccaactttggcctctcatcttatccggaaatcagaaccctaaccgaataaatcccctttatatgtatttacacttaccaccttttttttccgaaataattctctcgctttctccgcgtatgtgtacagatactagctatacctactagttctactactaccctcctcccccttcttcttctctctcatcaatcaccaaggccctttaagaccagtacctaaccccagacaacacatgaaaccggttccattccttccaattcatccatccctccctaatgtctcccttcttctcttgagatagagagagaaactagagagagaaagtgtagagagagagtatacaaaggttagtagtagtaccctagtacaagtactcaaaagattgtggatgtggttgtagaagcttgtacacacaaaagagaggaatttgagggagagagagtgagagagaagcctagctagctagcaagcacacaccacacacatctccaaattaagcacaagaggaaacaacacacaagccacctcgatctctctccttcctctcgatcccaagaagcccaaggaagcttcctatacgtttagtggttagcgcgctcgctcgccgccgcgccgcggcgaaggagggacgacgacggacatggcgtcggcgacgtcgacgacgcccgacctgtcgctgcacatcagcctgccgagcggtggcgcggcggtggggacgacggcgccgccggggctggggaacggcggtgcggttggtggtgccggcggcggcaaggcggcgggtggtggtgacccgtggcggaggctggatggctccacagcgtcgacggagctgtcgctgtcgacgccgcagcagcagcaggagggcagtacatcggcggccgatgtgctgccgtggcggctgcggcagccgacggcggcggcggcgtccgtgccggtgacactgccgacgataccgatggatggttcggcggcggcggcgcgcgcgccgatccgtggggtgcctgtgtatagc

SEQ ID NO: 44998 - DNA, 9441 bp, Oryza sativa
tctgaagtttggtgaaaagttgaatcatggaagcgagtcttttacagagtttggaccacataataaggattaatctatggggctttgaatgatcttcagttaagtagtactggtaagtggacaagtctaccaggacctagagctaagtgtcattgttaatggagtttttgcctcgcaaatgcaggtatgcaaaaccctggagcatactttgccactgtttgccactaccactgatgcactgattcatgctgaaccctgtgtttactttctacggcaactcacttttccgctggtgctcctgctttcccatgcacacgcatttggtaaatcatgagggggagggatttcatcctttgagtagacatccattcattcctcacataaatagtcataataaaataataaaatggaataatatgagatatatcattttacaaacatccaatgttaaattcgacttttacaaattataacaaaaggagtaatctaaactttttttataatggatagaaatatgatctctatatccataagcggatatagaatcaaggaacaatttaaagtgaaactagtatacatacatttacactagtatttgttatttttgttataatttgtaggattcaaatttaaacttgcatgttgtggagtaatatatcttatattaatctatcttatcaatcttttttttaaaaaaatgatgattatttaggtgcatgaaagaaacgaggaaaatgtctcctcgaatgatgaaaatcatgatatcaagcatgtgtgatcaagtgagaaattaaccattgttgatctgattaaccatcaaacactcattgattagcaatttagcaaagctagcacgctacctactgccaagtactgaatcatctcatgccatcctaaggcagaagaggttacatcttacaaccttgcaaattaacctctacaaggatcgatcataatatcatcatatctaatcatctcatcatgccatcctaaggctgagccgctgctgcagccatggcgctgccgccgccgccgccgccgtcgacccgtcatgtagcacatcgaatgccattgctctcgggcacggcggcggctgccggagcgagccgtcggagtcggtcgacgacgacgtcgacgtcgatgtcgccgtcgtgaggctcccgcccgagcagttggacgtgaaggggctactctcccgccgcttgttgttcctcctgccggcggcgcctccgccgccgacggccagtgtcagcgctagctcgtcttccctggacgacgccggcggcggcggcagcggcgtcgcttggccgccggcgtcggccacgacgatgtactcgtcggcggggagctgcaggttgagcgcccggcggcgggtgtgctgcttgcgccgctgccgccgccggcaggttagctccggcggcgacctgttgaggtcgctcatcagctgcttctggacgcggtacagccggtgcagctcatacaccttcagaggcatcgagacgaaaagaattttgttggttttgtttggtagaattttagagttttttctttttgttctttgcagtgatgatgattgtgatctttggtttgcgtttgatcgatatatatctaacctgctgcttgaaagtctcttcatgcttgagcatggccatcttcatgacctccatgtcgcactgcctcacaagcttctccatctgcaccatcatcttgagcttcactttgttcttgttatgttcttgtccttgactgagatcagcaagctgatggtactaccctgcaaaaaaaataaaaaaagaataaaaaaacagatgcaaaatgcaggcttagaaaggagctagctagcttttcagttgctgaaacacatgtactcgaactctgagaagaatcaatagatagatcataataacaagtgcaaattaatcagttgcaagatgctctgatgctggtgtgtatatctcaatgcataaaaaggtgaagttgtgcagttttcagaacacacactgaagcaaccacaaagatcacaacacacaacagaaagagctgtgcccccctgaacctaccgccctattcagcaagaaagcatccaaatatatgctcttgtcccttcccttgtttctcctcttgtcttcgtctctttaacctactagattcctcaggggatttacactggcaatgagacaaagaaacaaaaggggagagagagcaaagcaaagatgttgccactgctgaaactgagaacttgagaagggctttggttgggggtatgggggtttataaacattgcctctagagaagtgtggtaatgagaatgcaaagaaaaaaaaatgcaagagatgtgttgcaatgcaatggagtgcaatgatggctcaagagaacatctcacttggcaccttttctgcatgccaaacaaaggggatggcctatagccaatggcaatttgggggaccttttgggggtgcatcctttgcatgagatgctcctcccagagcagacaagttggcagggagcctaggtttaggccctgacccacacccacagggtatggcccgtacagtttcctctcttctgtgtggccatgctagttctccctagtagctgcagtgtacctcactgacagtaccatgtacgtgtacatgtgcactcttccaggtcccatgatcgtcttgctgcatgatttgacgagactccttttcaaccatgaaattttgggggatttccgcgagaggcaatattcctgtaaaaagagaagatcatataaatatggatctgattggtttactaattaatcctctttctcaaacctgatcattactctaattattgagggcctaaaacttgaccactcagagcgcgcagctgtattctttcaaacgggttgggaatcctttcttctccttgcaaaacaaaacaatagattagcacataattactcactccatcctaaaatatagcaacttttaactatgaatttagacacacagttgtccagatccataactaaaaatacttatattttggaacggatggagtaattaagtagtagctaaaaaattgaaaaatgaaacaatatgatttatacaagaattttctaaaaaaaattgaaaaaaatgcatcatttagcaattcagaaaacgtgtgtgtataaaaataaggaagggagagaaaagaacacaccacccgtgcatattattgatttccaaacgaattcattggcgcaagttctgatcaaattcaccagagaaattaatttcttcctcaagtcctcaggatcacctacagtgcatatatactccatatacttaagtatacttaattagaagtactgagtgctgatataacttctagattgctctttttcttctctctctactatgacgagatctacaatgatcacatgctttgaccgtttttatatatgacatgtatcatatatagcgaggctggaccgttaagtttggaccatgcatgcgtcaaactgatcaatatgcatgtatgcacccccacacgtaaacagtaggcagtgtcagcactgagaaatccaccgactaaatcattgtcacgtacacacagtacagtggcacacagctgctgcttgatggtcagatttacggtatgagttggtcagaattcagaagctcgtcagtgtaccatccccttccgagttttctcccttatcaaacagatgccaatttgtattgcgcgtggtccaatttcaaaaatctggagtcgtttggttatatatgtgcaaaagattgcaaggatttgatacgtgaaaatgatatcggtagataaatctgtcatgaaaacgccttattgtatatataattaaataaataggacgtattttacctctgtttttgttagcatgctgtttacaatgttaaacattatgtattttgtgtagaatttttctatatagaggttgttttaaaataccaaataaatccattttgaaagtttgaaataagtaaaatcaatcaatcgtcttttaatttaatggtttctcgttttaggtgcctgtccgtaggccttgtttagttcgcgaaaaaaaaaataggtatcacatttgatgtttgatcagatgtcggaaggggttttcgaatatgaatgaaaaaaataatttcataactcgcctggaagctacgagacgaatcttttgagcctaattaagccgtcattagcacatgtgggttactgtagcacttatggctaattatgaactaattagactcaaaaaatctgtctcacgattttcatgcaaactgtgcaattagtttttatttttaactaggaaggtggcccacgcgatgcgcgggcatccgtactattgtaacgtaatattatagtttctttagaaattatatcttataaggacaaactatatatcgggcatatctgaaaaccattgattgacttagaagatagatcaaggtcatgtgacttttgaattgacttttggaccgagtgagtaaatatcatgtataccatttgaacacataccgtacaatattgctacaagtaaaaaatgcgatagcaaggaactcaaagttattatgatcgaatcgtctcatgaagatgcatgatttagtgacaaccaaattaagatagattaacggttggattgtttttctcttcgtagaagttgaaatttttcatattcttttccaaagttttaaagaatttttgttaggacacaaattgcaaaattgcttggttgggtagtgcaaaatatcagcaattgtttgaagctattgttttttctttttcgcatgtttgatagttttcttcgaaacacctaagctatctcaggtacgatgctccatcatacatgcagaagataaatgtgcacacgtgcgaggtctttagaagtttttttttatttttacaaaagatagatatgacagtcttgttaataggtccttaataggtctagttaataggtccattagtttaagtgaaaaccgacatcaaaatatttttattaaaaatagtataaaatattaggttcattaattaatgtaaagaaatagttaatatagaccgtaaattggtaatttactggtacataatataattacgtaacatctatattaaacaatgtgtttttaaaaatttgatataaaataattgtttgatataataggtactaccttcatcccagaatataagcatttttagagttggacacggttattagtgaaaggttgtgattggttgggaaagaatgttggtggagaagtagttatattttgagataaatcttgagggctaaaagttgttatattttgggacgaagggagtacatcggtttaagtaaagaatattatattgttaatataaagggtaaaattatatagttatataaaatttattttcaaacattgtggagctaatttagacatatatatgatgatatatataatctatgtttataaagttataatttcttaaaatttattttcactaataataattgcaattttgtctatacatggagaagagaaggaagaagaaggaaacaaatgtacgtttttaatgatataagtaatttatatttttatgacttttgccactttatctttttaaatgtatgttacagttgtatatgtattttcggtttttttacaagtcatacgtacatacctttctctcgtcggtgcgctaagggagattctgagatagattattaataggatttaatctaatggtccgagataacggatccatcaatttaaataaaaattgatggctagatattttagtttttttctcacattttctagaatttgttttctaatttattagagtgtatttttacaacttaaaatatagttaatatgaatattgattttctatctcatctagccaaaaagggaaaaaaagaggaaataacaaagagggtacgtacatatgtacgtgcacatccatgaagagatagattctttttccagatgaacgtaatttcaaaatcttaagatagatctatgttaactaaataatagaagaagttagcttaaaatgaagagttggagggtggccagagggagagagtacgtactcgcggatgtatagtggagggtgaggctaccggatttttgagtgtcagagagatctaatggttatccccgcaaaaaaaatctaatggttaaaattaatggattaaccaatttaatagaaaattatagattttttctaatttattataaagccatgtgacaacttaatttggagcgtttttagagcatttacattatacatgccgttaggagtctcacgtgacgacttgagagcatctataggaagcttagatgttagtggccttctaatctaggccattcattttctttaaaatccatgcagttttttaaaggagggtaacatatgtacaccggatattctttttggctttttttagtacttatgtatttatatgtacgtgggatttttttttgggaggaattattttataatagatgtgatctaatgctataaaataactgaaaatcgaagattggaatttataaaatttcctattataattacataatttttatacgaagacgaatgatctaatatacacccaaatagtgtcaatagcatcaaaaagtagaggttgttgggtaaaaatgggttaaatgggggagtaaaagaaagatgggcacgtacctttcctgtgtacaaatgggatgaagcagttgtacatacatgcacgcaggtgagatgagagggagggactaactcttgttttaacctaatctaatgttctaaaatatggacccgccaatttacatctcacgtagtaaaaaaaattattcggtgaataatggagtactttttggctttcttcaggtgaatagtactatatatttatacatacataggatattctttttgatttggaagatattttttttatagatataatgtaatgtataaaataacttgtccatctgatttaagtgaaaatcgaggatcaaatattttattttattctcagaatttcctattataactatacaatttttatactaaaataaatgatcaaatatacgctcaaatgtcaatggcataattaagaatgaggtgatataaaaatattgtagggtattctagataaaattaaataaaaagtctaagggtgggggagtaaaaaaggtggggcacatatattacccgcgtgcaatcggtcaggatgagggaggcgtacgtttatctagataaaaacttgttttttaatctaatcaaatctaatggtctgaaataatggacccacctttttaagtgaaaatcaagggctagatatttctcatatattaaaacgccacgtggcaatctaggagcgtttttagaaatcccatgtgacggcttgagagtgtttgtaggaagtttaatggacttttagtatataatagaaatagatagatagatgttctatgcatatgtctaaagattcgatgtgatgtttttaaggaaaaaaatttagcaactaaaccaggccttaatcttcggtcgccatgttgtcctacggggcctatagtgtcaactgtcgtcaatgacaagagaaaaaacgaatagattgagtgagaaaaagatgcacgagatgagaggaacaaaatgcgtttgtcagtttccactgaaaacaagcaaaggcgtacacacacgttggggcgtgtgtgtggatgcatgcatatatagtcagcaagtagtagcatgatccaacgagcgtggtgatgagtattgctgacaggccaccaggggcgaggctttttagggcagagaaaactctattgtttggaggaaaaccaagcaatcaaagagcatgagctgagctagtagcaaatgatgtgcatatccctttgagagcaagcaagcatctgtatgtgttccccttgttggcccttgcatattccaaagatcattgctcccatcaaaccatcatattctacccctgaccctgatgtgatgatggcatcgccacatgcagctagccaggctcatgtttaactcttggagagtgcttgtatatattctttgttcgagtgatggatgcaacagcgaggagagcaacggaaagagatgtacagtgggcgatgcatgtgagctcgaacataacacatcatgccaaggaaatgaaaagagaaaagcgcgggtttggtttttggatgggaacgggccgggagtagcatggccgggtagacgaatgatcgattgagaggggaacaagggacagtggcgcacgcgctgccggcgacgggaggcgcagcccagccgtacgagggggtggtggggtacgttggcccgcgccacgctcgcatcgatcgcatgggaacaccggccgtttccctctcctttctgggctcccactttcggtccaacacgtacagatgcatggcgcaacgccaataacatgccccgtccgcgcgcacatcaacttgccggccggcctccctctcgtggccacacatcgatctctcgcgggggcattcgcggtgaaaaccatcggcagcgcggaggaagaggatagggagtttagtgggcattttcagtgctgcgctagcatcggcaaggtggacgcgtaggggagtgtcgactgttggattaatcagtcttgtgctcagcatttttattttctgttagcttgcatatgcagctgagtcacggtggcgaggccagtcggtcagtacatggcaaactgcaagaagtgtttcctgccgagaggataggtcctgaggagttcttttttttttcaagaacagtcagactattgccgacgtttatataaagaataagttttcttaattttttatataaagaataagttttctcattttaaggagaaaacgataccaaatcttacggtacatagttaattaagagaaactatacgaaaaccacaactacagcatcaaacagaacatgataaacctaaactacaaggctatgaaaactgaaaagccatgttcaacaaatgctattcaccacaagccttgcaaaagaaagttgcaagctaaaagatcaagcaaggctcctcgcataggcagatacgtaacgttattgtcatcacatcatcatgggcgataggaaaggcttgctgatcaacaagcttgctacccacactgtagcaaaaactcaaatgtcctgagaagtggaaccttgcatggcatatacacgttgtggcgtaagactagcttgccatggctggtagttaggcatgtgactagtttacttgcatggtaattaacttgagtgattggctaggtgtaattccttgcatgtatcttatcgatctctatataaatgaaaaccttctagaaccagtgtgtggcttgtgtcaacaaataatatttgtgttattgtgttctttcgtgtgtgccaccacacacggaaaaaaaaggaattgctacatatctgtcgccaccagattttctttttttaaaaaaa

SEQ ID NO: 44999 - DNA, 5953 bp, Oryza sativa
ccaaagttacatatgtaattttaattttaatgtatttacactataagtttcaaaatctatctattatatctttaaagtaatagaaaaaggagcctccacgttcgctctcatggcctagaaattctcacattaatcctaaaaataagaaaaaagaaaaatagaactagattagaattagttaaaaactgaagaaaaaaaaggcatattaagaaactcgaatcggataatcggtaaaaacaaaaacaacctaatcatactacccgaaacggaatcggacaatcggtctaaaacaaaaaaaaaggaaaacttaatctactggaaacggaatgtacaattggtcaaaaacaaaaaaaaagaaaagaaaaacctaatcatactatacactggaaacggaaaatattttaggaatacgcgtgtttacatcacttttagaaacattgaaatacaaaacaatcctaatcaaactctgccgtttccgaattgtattagtattgtcatgccaataaatacataaccaagccaaaaattagcaagccaaaaatacataaccacgttcgttgtggaggctagaaattcccacattaatcggagaaaaagaaaagaagagtctaaatagaaatacaatcaaaaatagctgaaattcggaattaaaaatatgcaatattgaaagagaagtccatataggaacccaatacatgattaattaaaattcggaataaaaataaaataaatttcgaaattagaaaaagaaaaaaaaagaggagttcgagtaggaatacaatttaaaaataactaaaattcaaaattaaaaagaaataagagtccatataagaatccaatacaagattaattaaaattcagaatgaaaatttaaaaaaaaatcaaaattataaaaaaagaaaataatagttcaaggaggaatacaatttaaaattaacttaaattcgaaattaaatataagcagtattgaaaataagagtacatataacaacctaatagtatattaattaaaattcgaaataagaaataaaataaaatccgaaattaggcaaattaaaaagagagttaaagtaggaatacaattttcaaacaactgaaattgaaaataagaaataaaaatatcaaaagaacacaatacgaaaaaataaaataaattctgaaattagaaaaagaaaaatactaggaataccatttataaataagtaaaattggtggtaaaaaatcaagactattgaaagaaaatatcatctaaaacacatggcgagattaattaaataacatgcctataaaggagtagagtggtggcggttgatatgacatataaaaactgttaataaaacaccaaatagaatcctaataacgattgaaatgaaggacgacgggtaggccgtgaagcaatcgatcaaggcggttgccgggacttctagaaagtaaaaaaaaaaaccaatgctaatcatattcatttttaaaatctcaatgagaataaaaaggagaagtagtgggcggggtgtataggagaaccgccgacggttggcgagacttctagaaaataaaaaatgaattccaacgatagttatgttcgatttttagaatcccaatgacaataaagagtaggcggcggatgggccatagaggagtatagtgacatcgtttaacgggacttctaaaaaattataaaaaaaatgaaaccaacaaagactataaagtctaaaaactacgaggtccaatttttataggtttggaacttctaaaaagttaaaaaaaacacaatgataatcatgttcgattttaaaatcttaataacgataaagaagggaggtagcgggcgtgccataaaggaaaacaatggcaaagccgctgacggtttagcgggactttagaaattaaaaaataaacccgaacaataattatgttcgatttttaaaatcccaatgataatatagagaaaaaaaagttgacggcccgtagaggagtataatgacaacatttgatgggacttctagaaattataaaaactataagatctgatttttaaaggtttcaaggaaatgaatagaaatagtggtagatcaagcaagcaaataaagaaggatatgacagaagtaaggggtagtagctggtgtgacttttaaaaactatataattagaaatacgggatggtaagatttggtctttcaaagtcttaagacaacgagatagctatttaagaaattttaagtaaaattatactgaaaaatatatgattttgtttgggtgctagccgcgcaattgcgcgggccacccaactagttatatatgtaagtaccaaaattacatatgtaagttaattaatgtatgtagatgtaaattgcttggttttctttttcttctagcatcattgacgtgattaacgtccggtgactaacgtgcgttgatatgttttcatttgaaccgcacttggtggtggcttgaaaatccgactgattttctacgaaaaatctgtcgaatgatttttagacagcaaaaaaaaaaactagagtgtttgtgataaacaccaaggagcaggagagattcctaacatcgacggcgcgtgtgtgggtgcatcaggaaggatgggaggaagatagatagtgattaggtttataatacttggagcaatagccgttcaaaaatgactaagatttagtcaaagttgggggaagagttataccttattttacagttgagagatgcaattctactgaggaaaagaggtgagggaagaaaaataaacttattccggtccaagcacagcagcttctcaacttctccacgttttcttgatgtatgcggaagcccatcccactgatctggcccaactggattgcagccaaaatattggttccctttcatttctccttgaataagtccacttgacatccctcaactttatgtcgagtttgtatgacgcccctaatccccaataccagaaatatcgacccctcaagtgtttaaaaccgtgcaaaataaatctcttgacagtatagatcatattttcccggtttttgctggcgtggcatatgtcggggctcatttgttagtgacccttatctcttcacctatctctctcccttcccctatgttcccatctcaccagggcagcggccggtggtggactaaggagcaacagccggcggtagacggtgaggagcggcaggttggcagccgatggggaggacgacacgaacgacgagcggcgacggcatcttggtgatgcgctgcacgatcccgtagtacatgtggtaggtgttgttggggttcaccaccatcccagggaggaacagcagtagctccggtgtcctcggcctctccaacgtcacgattctgccgctggtaagcccattcttctaggctggtttggggagagggggggtgttcttggcaatgaaatcgttgaggctgacctcgccggcagggaatatgttggtgagccccatcatctccttctcgaatgtgtccagatccacaccctccacagtcggcgcctctgtgggcttatcccaagaaatggtggtcgtagtggatggtggcgcggcaggagaatcgaaggtgagctccttgcggatgccgacctcgtcgttgcaaagttcgcaaccaacgacgacgtcgggaatgcggaaggacaccgaggaggttggcgagggaggggtaggtaaacgatgtggtgaggaggacgtgccatcctcctcaccgtccgccgccggtctctagggcctgctctgcctcgagggctatccagtgattgcaagttcggttctatatttcggaccgcaccggcaaatcaatatatcgaccgaaattttcggattttatcaaatgtttgttgaatttggtcaaagtttatttaaatccagtcaaaatatgtagaaagttcaatccgaaaagtgccgaaaatcacgaaattttgtaaattttggtcctaccgaaattgaaaatgcaaaccctggggctatccgccgctacgtgtcggggccaccgagtcaacgctccgttcgaggccgcgccgtcactctgccacgaggctagaccgccgcacatgttggggtcacgcccagaaatttagcccaaattttcagactattttgtgtattaaatctctgtccaggaccagccagggtacacaaaacgacaagtaatatacagttccaaacgtaaataaagcgtaaaatacttacagaaaaggcacttagtcctcacaccgaaacaaaagcagcagcagcgaaaaaggcaatcctagcggggcttcagctccactccacaggcaaaactcaactggggtctgagccttggtcctctaactccatcttcagctcagaagcactacacttctgaaaagggggaataatagcaagactgagtacaaccaccgtactcagcaagccacaccaacgatgcagacgtgcaaggggatacaaggagggtttgtggctatttgcatgaaggcagttgtaaaacactttattgagcaaaacagtaaaactgttgagtaattaaagtaatattgaatctccactgatcaacgctaccccacgttgaacaggcccaaccaacccacctgaactacagtgtattgggtcgatttattaagatgggactaatcacggtgaatctggtcgaccgcccataaccgcgggcacggctattcgaatagttttactctgatcagaggtgtacaactgtacccacaagacacagccccacgacacgtttccgtgcgccgacatgccaccacgacataccggaaagaggccgtgacaggacccttcgcataaccccctctaaccaagcacaccacacctcaggtttcacccccactcctcgcaaggcagcgggcagtcccctctcgtgcctaggtgaatccggaagccgcataggccgtcgcagggcccatccaaactccatcacgcccacccttgcctggatgcgttggctagaggaaagctacactacaagcccagccgttgcccacgctggcttgtggtaagtacgataagttcttccagggcatcccgcaaaccggtccttaactgccatgggtgcgaccagcaaaaccatgcacccacagcccaccattcagtcgcattttagttggataattacgaccatgaagcatggccagatgtctcgagcacgcggctcaatctgatactaaaagggtctaatactgtaattatcccatcaactgagctagtggtaattaagcatggctaagcatatagttctagctaagtcacataagtaacatgagctagtcgattcattacccaaagttgacaaagaacagatatcaagtaaacatggcacaagcgagcagataggtaataccctgaccccatgtaattagcaaaatatgcatatttatttgcaaacagtaaaacatttgtaaattgggatcaacatgctcaaggggaatgtgtgacttgccttgcttcttcactttgatcttccgaactcttttcctcgcgaccgcggtcttccgaaacgacggaaactacacgctggcacgcaaaacgaggaaaaactctaataaaaaccaaggaaacagtacataaaaactaaacaaacatgtagagctcaattttagatgaattttgcaagttgaatggctcaattcggagttcgaatgaattagatatgaattttagaagttttgagccatttaaatgaatttctagaattatcatcgaattatgacgcaattattatttatttttacaaaggaaatggtcctcgctgacgtcagcaaggggcggccggcgccgacacgcgggccccacacatcagcgagtcaaagggggagggcgcacggtggacatggtccagacgtgcctcgggtgcgcgtccaccacgtggacggcccagatcggccaaggccgatcggacggctggggacagccgggcggcgcggccctggccagcgctcacacaaagctgg

SEQ ID NO: 45000 - DNA, 11577 bp, Oryza sativa
ggcgctgggatgcagcgaatgcggtggaggcggtggcgcggcgtgaagtagatggggatggcggcaagaggcggccggttggcggcagttagtggtggggctcgggtttgcggcgggaatggtgcttcgggggtggatttgaggagtgggccggtggccgggatgcggcacggagcggcggcgctgtgggaggcagccgcacgaccgggcgaggtcggtatcgccggcggggagcggctggagacggagggaagagcggcggctcggttttcacggtggggtggtatttcggtggtggtttgggggaaaaaggagtggaggacggggtagagcttggcagggcgttgccgacggcgcaagcggcgaggtgcggcgacgactaacgcggcggcagcggccggctgaaggcggtgtgtggcggtagtggctcggcctcgcgatgggaaggtggttccggcggtggaggagggagatggagtggatgccggggtgcggcacgacgcggcggagctgtcggtgcaagcggcgcggcgcggcggcggctacagcgacggcggcgtgcagccggagcttgccggaaagcggcggagcgcgggagcaacgtggggagagcggtagggagtgcagcgggttcgggaaaattggggaaatgggaaaggagaccacggggatcgtttttattggctcggggcggtgggatcatggccgcggagggcggaatcgaccggcaacggtcttcggagtgggctccggcgacgtgggcgaagtggggtggttcggcgccggttttggagggggaaagtgggggaggagagtggaggaggtggggcgacgcggtcccgcggtcggggcgagcgcgcgggtggaggaggaggcggaatcggcggcgacgtggggaggccgtggcggcggtttcggctgagggagccggaggttagggatggccctgacaggtgggacccacctgtcggtggctcggggggaaggagagaggaggagacggttgggggaggccaagtagacttgcgcgaaggagggggcaagccgggccgatggcccaaagagaagggaggaggggaaaaggagggcggccgggcccaagaggatggagggggagaagatcttgggccgaaagcggcccaaagacaaagaggggaaattttatttgttttctttttattctaattgatgcaatgatctttgtgctattaaaactatttctcgagctccgaaaattcacggaaaattccggagagtacattagggcacaaagaatattacaaaatattcccggccaatgatttttaaaggaaaatttcaaattctcccattatttcacttgattaaattgatttatcttttatttaatttctagaaaatgcattatttaatgatttttaaacccgaacgaaaatcggggcgttacagtcacccagccggcgcgccgtcgctccgccttgaggcgggctgccaccgctccgtccctagggatggcaacagggcggggcggggacgggttggataagaactcccccgccgccactccctgcatttgccccctgccctcggccccgcagggacatccgggtgaaaatcgttcgccggccctagcctcgtaggggacccggcgggtgagcgggcccccgtatcacccggggtgcacaaggctgccaatgttgaacggcaactcagaaagaatgaaaagatggcatgaggtgttactagtccagtcagtaatcagtaatcaatggatcacaaattcacaattagtagtaatatgcattctaggtaggggacggctaatggacgcctagcgatcaccggcccacccctccccctatatgctaccttctctctccctttctcctccccttcttctcttcttactacagtacaccatataattttaaaaaataataaaacaaagttggaaaaatttatgtatagaaatacaaatactatacataaaaaaattgaattcaaattcaaatttaaaatgggtatgtaaacttttgatttataaactttagatctataaactaatatttgaattcaaattcaaatttgaacgggtgtaaacttttgacttataaactttgggtctataaactaatatttgaattcaaattcaaatttgaatgggtatgtaaacttttgacttataaactttgggtctataaactaatatttgaattcaaattcaaatttgaaacgggtatgtaaacttttgacttataaactttgggtctataaactttaggtgtataaactttagatgtatagaaatattatatataaaaaatatttgaattcaaatttaaatttgaatcggatatataaacttttgacttataaactttggatctctaaactttagatatgtaaatttgaggtgtataaactttagatgcataaatttactaaaataggaaagtattacggtaccaaaaaaggaaaccaggtggaggaagtgggattcggatccaatcgccctgggcgatcgctcgcccagtagcaattcccttctaggtagccggatgcccaaatacacataaacacaagtactaatgtagttaagtggtatgtatgataaatacacaactaccaactcacaagcaaagcagcagccagccaattagcagtatactagtagctttgctcgaggttgaggagctggtcgcaggagtcaagcttagctcgaggttgaggagctggccacaggagtcaagcacttggacagtcggatggcagacctgcaacgcgcggcgatggcgctccactccggctcgatgttgcgggctccggcgctctggtcgccagcatcgcgctccgcttcaccgccacgccgccgtcgccgccgcacgcaatgggcgcctgggagctaccaaactgatttagggttatcgattcttcagattttcttttaggaataagttcactttaggtccctctatttgtcgtccagtccgattttcgtcccttgaccgtaaaaccgggtatgacccatccccaacttacgaaaaccggttaaacgtggtccctcggcggttttgaaggcggttttggctgacgtggcgcctacgtggcttgtttgactaggtcttcatcccaagtggcattgacgtggcgcttacgtggcaattatatctcggaaaaataataaaaaatgtggccccacatgtcatctgtaaaaaaataattttaaaatagtggggtccatgtgggccccacatgtcagccacactcctctcttcttccctctcccttctctctcttcttcccttttccctctctctctccccttcccgggcagcggacggcgtgggtgggaggcggagcaggcgagctccggcggtggcggagggcgtggtcggcaccgccccctgaccggagcaccaccggtccgcgtgaaggcagatctggggaggtccggcagccagcgctacggcagaagctcatctagatgctactcgaccccaacccgggcacccgcatcaccgtccctggccttctcgagacgccgtggttccgaaagacagcgcccgtcccgcgccccatcatcgccgaccccgtgccgacgccggtacacgcatggcaatgccgcccgaggtctgcacgcggttccacctaatctccctgtctgagggcttcgacctgtcgtcgctgttcgagcatgaccccgccgtgtcgccagggcgagccacggcgcgcgcgggcagcacgcggttcgcgacacgggaggcggcaagcggcgtggtcacgcagctagaggcgctcgcgacgggcggcgccacgcccacgcgcgtggcgaggagcggcgcgcgcggggtgcggctcgccatggcggccgatcgacgtcttcagcgtggcaccgtcgttgctcgtggtggtcctggtggacgtcaagaaggatggcggtgacactatggagtactggtcgttctgcagcgaagagctccggccggagctcaaggacatcgtctggtcgccggtggcgacctgacgacacggcgggacgtcgctgctgccattattgcacgtcatcgaatcgtatccgttgctatccaatggggtgcattattgtttggtgccggggtgatgtctggctcgctcgtttgtccgtagcaactcgaagtcaatggctgctgtagcctgctagtgttgctggctagagtagcttgctgccgcggatgtagtagtaggtcggtatcaagatcatgggccttttcatctccaaacggcgagggcggggacacggcggtggaggcggcgaagcaggccatcgccaccgggcacgtggaggccaagagcgcggcgaacggcgtaggcctcaccaccttggagaagggcggcggatggctaggtgagcggcgcgcaagagagagatggctgccgccaccccacacgcctcgtgcgccgtcgcccgccgccggccatgcgctgtccatctccgcgccgcccgccgctgccgcggtccgccgccgcctgccgtgttggacgccgtctggcgagaggagggaggaagatggggagagccggagagaggaggaagaagaggattggatttggtcatttgagaatgacatgtggggcccacgtgggccccaccatatttatttttagctgacatgtgggacccaccatttttaaattattttttttctatggctgacatgtgggtccacgatttttattatttttccaatatataattgccacgtcaacgccacatcaatgccacgtgggacggagaactagtcaaacaagacacatagacgccacgtcagccaaaaccaccttcaaaaccgctgaaggacctcgtttgcccggttttcggaagttgggggacgggtcgcacccggttttgtggtcaagggatgaaatagagggacccaaagtgaacttattcctttcttttatactatgctgggctgttgggatgttgggctattgggctgacctttgtgggcctatttcgcacaaattttaacgactgggctacataccctggggccccgcaggtacccgcgggtgggaatagccacctgcccccgcccccgcataattccgtgtcacgatcagtcagcgagattcgagattcagacagatattggaagcaggaatagaggaagaagacgagttcagggaagaatttgatagcaggaagagagaagatttgaattgagttgagatatttttctattacaagccatctctctctccactgccgacctttatagcacaacactattaggtctctatcactgactctggccccagccgatagctactggacccacactccacccatatatctcgtgttgggcttgggttgccttacggtgcgcttcatggacctcaactgttgaaggagtagaaatagactccgtgacattctccccccgttgagatgaagcttgtccccaagcttctgaagttggaaagcgtcgacgcatttcttggaggttctcccaagtaatggcgcgaggttcctctccggaccacagaatttgaacttgaaccaccatcttggagcccttgcgaatgagacggtgatccaaaacctgaagaggaacagatgcatgctctgcactggaatccaagacgggcaaagtaggttgcacagactcagttggcgctaaagcatgcttgagctaagaaacgtgtactactggatggatcaaactgcttgatgcaagagctaagtgataagccacagtgccatctttggccaagatctgaaaagggccatagaatctaaaagatagctttcggttggcacgagtaacaactgattgctgcacataaggttgcaatttgagatatgcccaatcaccaatctcaaaagaccgctccgaacgtttcagatcagcctgagctttcatgcgaatctgtgaccgcaacagatgttctttgataagagtttgcatcttcatacgatcctgtagccaatccgataattcggacgatgtgcaagcagcgtcaatagatagtccaaaataccgtagcttgtgtccatatagaacctcgaatggtgaagtgcccaaagaagaatgaaacaatgtattgtaccaatattctgctaatgccaaccaacgactccattgacgggggcaagcgtggacaaaacagcgaagaaaagtttccaagcactgattcacgcgttccatttggccgttggtctgaggatgataagaagagatcatacgcaattgtgttccggccaattggaacaaagaagtccacaaggtactagtaaaaatgcgatcccgatcagaaatcaaggactgaggcatgccgtgcagacgatgaatgtgttgcatatactattctgccacttccaaagctgtgaagggatgagataaagggacaaaatgggcatatttggagaatttatccaccaccacaagaatgcaattgaaagaaacatagcgggacaagcctttgatgaaatccaatgaaactatttgccaagcgtgattaggaactggcaatggttgtaacataccagggtacttaacgtgttccgatttggccttctgacaaatttcacaggcttgcacaaattcaaccacagaatgacgtaagcctggccaagcaaacatttgcttaatccgttgacaagtgatagcagtgcctgaatggcccccaatagcagcagtatgaaggttggccaaaatcttctgttgaaggctgacattgttcccaatccacattcgctaatcataacacaacactccatttttcaatgtataacgaggcacagaagcaccagcaatacacagcgtctgaactttactagcagcatctggatcgtgctgatatcctgccaccacctcctgaatccaatctagaacacaagtagacaaggctgatagttcaacaatcgcattctcaggatagcgagacagagcatcaaccactctgttatttgtccctttttttgtatatgatcttgtaactcaaacccaacaacttagtcagggccttatgttgccaaggtgtggataaacgttgatcacggagaaaagccaaactgcgatgatcagttttaatcaaaaactcatcatgctgtaagtaaggtcgccatttttccactgccaacataatagcaagactttctttctcatatgtcgaaagaccctgatggcgcggacccaatgcacgactgagaaacgcaatgggatgtccattctgcataagtattgcgccaatacctttgtcagaagcatctgtttccaccacaaaaacttatgtaaaatctaacattgccaaaactggtgtagagacaagagcatgtttcaaagcctgaaacatagcttctttatcggaagtccaaacgaaaacttgcccttttcgcaacagattagtgagtggtttgctgaggatgccaaaatgtcgaacaaatttgcggtagtagcccgctaagcccaagaaactacataaatccttgacagaagttggagaaggccaattgcgaacggcatgaatcttatcctaatcagtagaaacaccattagggctaatgatgtgtcccagatatgcgagtcgttgctgagcgaaagaacacttgctcttcttgactttaagttgatgacgatccaatatctgaaagacctgttgcaaatgctgaacatgttcctgaagagttctgctataaatgagaatgtcatcgacgaaaaccaacacacaacgtctcagcaaggaagatagaatactgttcataactccctaaaaagtagccggggcactggtgaggccaaaaggaatgactctgaactcaaaatggccactatgagtcttgaatgctgttttatgttcatcatcaggatgcatacgaatctggtgatagccggcacgaaggtccaatttggtaaaccattgagcacctgctagttcatccaatagttcatcgatgattggtagtggatacttattcttaatagtaatagcattcaagtgacgatagtcacacaaaaacgctacgacccatccttcttcttgactaaaagcactggagaagagaatggactggcactaggccgaattattcccttagtgagaatatcctgaacttgagattcaatctcatccttctgagcaggtgtgtacctatatggtcgcacattcactggttgagcaccatgaatcaagggaatggtgtgatcatatggtcgcgaaggaggcaaaccagtaggcttatcgaagacagttgcataatcttgcaataccttctggaccacttcaggaatttgctcgactgtaactggtgttgacaattcacacagttgcactagatgggccactgcatgacgatctccaaatgcttgcatctgtctaggagtggctaaagcacaagtatttactgctggtttgattccacacagagtgatggactgcctgtgagcactgatagttagaactctgttacaccaatcaactgtcattggactatgggtagctaaccaatcaatgcctaagatcatatcaaaactggtcaagggaagcacacgcaagtcagtgcgaaaagtgtatccctgcgtgaaccattcacattgagtcacaatcgaatcacagtgtaagacaccaccactagccacctgcactttcagtggagttggaagagaatgcagtcctgataatccagtagccaatttgctactaatgaagctgaccgaactacccgaatcgaccaaaatcagcacctcaaaaccttgaacatagcccagaattcgcatagttcccacagattccaccccttgtaatgcaagtaaagagacaaccattaattctgaccgtgcagggctctcgacatctaagatatcagctgaaacactgtcctggggatcctgcaaatgggcaaacacctcctgaaccgcatgcagttgcacagaattagcacatttatgattgtgagaccatttctttgcacagatataacacaatccttgagcattgcggtaagcacgaagagtagccattttgtcaggggatggtacagccttgactccatcagatttagcttcaatactaccagatggtcggggtggtggcaacggcaaaggataagctcttttgacctgagctcgagtaggtgcaccaccatcataacgcttgaaatcagtcggactcttagccatctcctcttcttgtaatgaagcaagaacaaaagcagtctcgaggtcgcgaggccgatgaagtataactgcaccccgaatctcttttcttaacccattggtgaacttatgagtgaaatatctatcattagccgctaggtcataaaccaagagctgattggctaattcatcaaatttctcataatactcctgaactgtgcctaactgctttatggtgtccaattgccccaaaacccaatcatgcagtttatgtcaaatttacacgctactgcaccacaaaactctgcccaccctagataacaaacatgagcacgagacgaatgtaaccaggaagctgctctacctcgaaaataaatggtggcaattcgtacccacggatttggagatgtatcgcaaacatcaaaataatgctcgcatttcatacgccaatcctgtgggtccgaaccatcaaaaatcggaaaatccaacttaggcattcgatgattgaaggacttttcccaaaattgcgtcccaaaatttccctcaccactctcccaattcccagcaaaattaagatgagagggggtggcatcgtacgtactcttgatcggagtcaggaccagggatgtgaccacccccgatgcccttccccggaaattttgtggtgcgcggtggccattggcccacttctctgctcctcccgctgcagtcgtctccttcgtcggcgaagcgggcgtgggaagcagcgacgccttcctttcctcatccgtcaacggaactcgaggggaagatgccgccgtagaagtttgcaccgccttgccgaggagatcaacttgctgacgaagttcgccgacctcctctcgcagctcctgcacggcctcctccacttgtggcctccagttgttcatgcctagatccagcttgacgatggcagcttgtgtctcaacctgagcccgattcaacactacgagcgactcctggatccggacaagcaccttgccgaaatcgatggtttgctttccatcgcctccacctgcagctgcagccgagatgtgtagcgtggcttctccaggatttgaggctctgataccagaatgtcacgattagtcagcgagattcatgattcagacagagattggaagtaggaacaaaggaagaagacgagttcagggaagaatttaatagcaggaagagagaagatttgaattgagttgagatatttttctattacaagccatctctctctctccactgccgacctttatagcacaacactattaggtctctctcactgactctaggcccagccgatagctactggacccacactccacccatatatctcgttttgggcttgggctgccttgcggtgcgcttcaactggacctcaactgttgaaggagtagaagtagacttcatggcattccggggccccgccccgatggacccgcggggtgaaatttgcactccccccccccccccgcgcccccgtaggggggccgtcgctgctcccctcgagactgcaccgttgctccaccatgagaccgggccggcgtcggggccaccacccagccgccgcgtgctccccctcgaggtgacgaacctgccgctggcggtggacccggccgtcatcaacctccgcgaggatggttacaaatgccgcgcgcgcgaaagacagcaagtggccgactctggagctgtggtggagtggtcacagtgcttgcgcggtaaaagtggcggttgatcgctcactagctacattcactctcagcccaccgaaacccatttcatttccacgtacgatttatacttcttccgatcctcaccattaattaatccacctcctcctaggcctagctctgcatcgatctgtccgtgcgggatcagaggaggagctaataagctaggtaggtaggtgaagaagaatggtgaagatctgctgcatcggggcggggtacgtgggcggcccgacgatggcggtgatcgcgctcaagtgccccgacgtggaggtggtggtggtggacatctcggcgccgcggatcgaggggtggaacagcgagcgcctccccatctacgagcccggcctggacgatgtcgtcaggcagtgccgcggccgcaacctcttcttcagcaccgacgtcgagcgccacgtcgccgacgccggcatcgtcttcgtctccgtcaacacccccaccaagacccgcggcctcggcgccgggaaggccgccgacctcacctactgggagagcgccgcccgcatcatcgccgacgtctcccgctccgacaagatcgtcgtcgagaagtccaccgtccccgtcaagaccgccgaggccatcgagaagatcctcgcccacaacagcaagggcggcaacatcaggtaccagatcctctccaacccggagttcctcgccgagggcaccgccatccaggacctcttctccccggaccgcgtcctcatcgg

SEQ ID NO: 45001 - DNA, 12673 bp, Oryza sativa
  unsure (1)..(12673): unsure at all n locations
cgagctgtccaagctcgccgccaacgccttcctggcgcaacgcatctcctacgtcaacgccatctccgcgctgtgcgaggccaccggcgccgacgtcacggaggtggccaactccatcggcaaagactcgcggatcgggccgaggttcctctccgcgagcgtcggcttcggcggctcctgcttccagaaggacatcctcaacctggtgtacatctgcgagtgctacggcttgccggaggtggccaactactggcaccaggtgatccggatcaacgactaccagaagagccgcttcgtgaaccgggtggtgtcctccatgttcaacacggtggccggcaagaaggtggccgtgctgggcttcgcgttcaagaaggacaccggcgacacgagggagacgccggcgatcgacgtctgcaaggggctcgtcggcgacaaggcggtggtcagcatctacgacccgcaggtgacggaggagcaggtgcagcgcgacctagtgatgaacaagttcgactgggaccacccgcgccacctgcagccgatgagcccgtcgtcggcgaagcacgtcgccgtgtcgtgggacgcctacgaggcggcgcgcggcgcgcacgccgtctgcatcctcaccgagtgggacgagttccgccggctcgactaccagcggatgtacgacgccatgcacaagccggccttcctcttcgacggccgcaacgtcgtcgacccggacaagctccgccgcatcggcttcgtcgtctactccatcggcaagccgctcgaccactggctcagggacatgcccgccgtcgcctgatcttttttttttcttttcttttcttcagttcagatttctcagggacatgcatagaagtagcaccgttacagattttcggtttttttttacgttagatttatatgtgatatccattgcacattcaaccttctagcgtcttccgtaatttgtaataagtttttgctctagtttactctatccgttttctaaaacatcgcgcaaaacctctatttctacaggtgcttagttgtcggtggttcgacaaacacgtgcaaaaaaatatttttctatacccgtgaatggttttttcgcattaattactacttactacatcctaaaataaacatagtactccctcttgttactaatatattatgtctttatattaaaatttattgatgaccagaggtagcaaattttttgtgtaagttattactctaaacaaataggaggagactagggatcggacgttcgatcgatagtgtttcaccgtatatgaaaaagttctattagatgttttcctactcagtaaattttttttcaacaaaaaaagtatttcacatgtttcattactaagaaaaatattttattgcttgatgaagaatgttttaaccaaatataacattgaaaaaagctaatggcaacatcaaataagacatagccatcatgtgaatcgtcccaataaaatagagtgaaacactctaagacaaaccaaatgcaacaaaaagaaacaatgtactgcaacaaagcctacccgtctgcaccaatatacgccagtgacgtctcaccccgtctcatgtccagcctccccacggcggtgctgccactgccggctagcttggagctctctccggccacgacgcattccgctcaacctcgcacgaagcctgctcacggcacagcatccacaaagcctacccctcgtgtggctctgccactgccggcgatctcggagccctctccagcgatggtgccttctgctccactccgcaaagagcatcttcatggcgctgcagccgctaccagggagcttgaggccctctccggcgccgcctctgcctgcggttcccacccgtaagcctccttctcgtgtctccacctgtctcctcctcgcgacggcggcgatgacgagtttgggcttccacgagattggatcctctccgacacaacgtgaatcataaaattagagaaaggagatgaggtagaggaagaggaaatggggattttcgaaagcattttcgaaacaaacacatacggatatgctcattaacctactcactattcagttttgtgaagtacgtatctttttctttgaccaatccaatacgaatccgaatctgaagtgaactagctggccggaactcaacgttttataaacccgccacgccaacctagcttcctccttgcttaattagcttacgatcgaactcaagatcttaattcttacgatctcagctagcagccggccccgatcgaacaaggaccgaacgagagcacctcgatcgagaagagaagcaagatggatctattacctgcgaaagtgatttcatctctcgaatggatatcccttgtttcttgcatgccaactaaatagtcataaaaaaatttagaaaattttggtaagatatattaatatgaaatatatcactccacaaacatgttaaaatttaaattctacaagttgtaacaaaaataacaaatatagctgcgaatgtacgatagataactattttcagtttattttgttcttttcgttgtaacttgtagaagttaaatttgctctgcatatttatggagtgatatatattttatattaatatatgttgttattttatttaaaaaaattgataactatttagatgagatgtaagtaaagaggggacatccctctctatggatgaaaatccatatccctattacccgacgacatgatcgcggaggtcctccggcgactcccacggtcccactgggcagcctcgccgcatgccgccgcatctgcacgtcgtggcgcgcggccatcgacgaccgcctccgcgaggacctcctcccgctctccctcgccggcatcttcctcaacctccacgacctcttctaccccacgcagttcttctcctgccccaccaccacgccacccggcggcggcggcggcgccgtctccggcaacgtcgactacacgaggcgcaggtccaccttgcccgactgccacatgccctcgatcaacatcaccgaccactgcaacggcctcgtgctggtcaacaactgcgtgacctacccggcgacacggcggtgggagcggctgccagactgccagttgccacgccgccacccgcgccacgtcgcgagcacggcctccgccaggttcgccgccgtccgcgagcacctcgtgttcgaccccgccgtgtcaccgcgcggctagctacgaggtgttcctgatccctcacgttgcccctcgcgagcgcgagcgcaggcgcaggcgcagggacgatgagttttaccccacgagcgatggatcggaatggccaccgtcgccgtttttcttgtccgtcttctcgtcggagacgaggcagtgggaggggaggcgcttcgtgcgggacgggccgccagcgggcaccgtcgctgccatgaggctgcatcacgcaagcgaagtaggcacaggtattcactgccaaactaattttgtcatgaggtaattaatttctaaatccttcacacctaaaaacgagatttggagatttttttttttaagaagaaagattttggagaagagtcgtcctccaaacatttttttttaagaagaaagatttggagggacagatgccctttcaaactatttttaagaagaaattttgagcgtgttgagtattgaacgtgagaaaccaaacaccccttaccactgtactatcaagtgcatctctaatcctttactccttaagcattattttcacctcttttattcattatatttatggtaattgatgttggttgtttactcttatgatctagtaattaattactaatttttgttcttggtatatgttatttttttctcccagaatatcattgtcaagtgaagtaccaagtcatcggaccgccgttaagttttgatgtgtgcagatacaaagaatttcatttaggacgatcagagaagggtgtgtattttgcacttttgagttcaaatcaacttttgaagaatcgtgtggccagataggttgggtattaaagcttgacaacaaccttaagcccatttagccacatttcaaagatggcaaaattaagtgatgatggaccatgaccttacaagatattgattattgcgaggatcctaatgaagacgacgatgcacaaagtcaaacagtacaagcagcatattatgattgggactttgacaatggtgctaagtctatcgatattcaagataatagtgttcaagggtgtcatagaggttttggcttccttgcattccatcctttcaaagaggtggttttcctacattatagcttggagagagaactagcctataatttgaacagcttcaaggttcaagacttgggtaacttatgcccgaaagattatggatttgacactgaaccatatgtagaatcttcttttccataccatgctggatggaggtgtttcctgaagaacaaatttgatatttaggatcttttttagttgtaatctgttcctagaacagaacatagcctactcaaattgaattgcacactaaagtgctcattgtattgtgctaatgaaatgtattgactgaccatgtccctggaaatgtaattgcactttagtatgacttgcctattatggagtcacctgcaaatctgtatatagcccattattcatctagtattgaattttgcgggcaagcataataaaacaataattttggaaccacagtgagtgcagcttcatattttgcttctagttttggttttcaatcagagaatgcagcttatataggctatttggtcaacttcatccataataagaatagcacattctttcatagtttcatggcatccggtattcctgaagagcattagtaagcacaaggaaaatacgacataccctgtgatctaaaacacagcaatcagcataacaggtaagttaagatattgatgggtatttgcagatcaaaagatggctgtaccaacaagaaagacttcatgcattaccttttggtagcttaaccggaaaatttgtaagatcccataacttgtcatgtttcattttaatacttctctgaagataagtaatgaagaacaaattaagttaaaaagggttttgctccagagtccagacatccagttcctatgccttagaagctacagacagaactcctaaaaatcaggtcattttaaagagtgagaaaaagtataactgtgcctaaaatttctcaacatcctcagtatgagggacaaatatgaagtcaagttccagggctcaactacatctaggtacattcacttctgaaatcaaccgacaagttaagccaaagcgagccaagctccttcaaacacaaatgctattgtgatttatgccccagcttgaacttttgaagcacgtcagaaaatatcacaatgagagtaaaatgaaataaaattaatcactcaaataatgctgtccacttgaagtaaccaaggaattcaaatcgtgagattgtcaaaattgtaacccaaataaacttctaagccatgaagtgaagataagatcacaaaactttgtactcagttacctggaaaaatataaaaatcaaacaaatacttgtcgatgcttttcttaaaccgatataacttttgaactcaataaaatgctctgagtcagatcaaggcatccgcatgacacacaaaatgaagtcatttgttgcgtaaggttttatcaacctcaatacatgcataaaaattatgttgtttggcttgagcccctgagaaaatattggtttgaaatgcaaacaattcatgcaaacatactgaaacatattccatataccatgacatttaagtattgaagaagtaaaactgcagaatatattgcgtcaaaaaaaaactgcagaatatactgcgtacttaacaaagataaatacaggcatgagctgaactagagtggaatccatacaaggtgaaccaaaatatagctaaaaataagcaatgggctgaaccagtttgggaacaatagcaactgctacagaagcatgtggcaaaaaataaaagttaactacaacaacctgaataggacagctctcccattgggaacaactaaaacttgaatcacatcccacactgcaaacagaagcacgtcagtataccgaaacagggcatcagattctaaaaactagttttgcaaagtcaatgtaaagagagcattggtggtatcatattcttgattcttcaactatctattagtaaccaaaatgttgttgctgccccttgactggtgcagaaactgtacacatttcagacaacacccatcattcgctcactctgaatgctgcttgcaacccaccatgggttcagttcagactctgtccttgtactgctgcagtccctgttactgagagctggaaggttgagttcatgcaactcattttgcacttcaagcagctgttttcttgatggagtcacagaagttttgggaaatgttgcaacctttttatgagcaggaacactgtgggacttcatgtggcctcccaatgcagatccagatgccaagaccttgccgcagagcctgcactcatggatagctgttgccttcaacacatttgaaagactgccaaacttgatctcctcataagaacttgaattttctggctttatcagctcagtatcaccagttacaccaagacgataagaactcggctccatctcagtcttctgcggaccgcattccaagcttccatccatctgaggatcttcatccagagaatctgagcccttgtaagcatcttttgaaagcatcacaagaatgcaggcagcatcctccacctgtgtcccatgtgtcaccaccactaccggggcagggaaaacgtccatgcggatcctcttcgacctcgctctcttacagtgagcataagatacagcagcaaaaccatggtcaccatcatcaacaccgcagaaattagcagaagaagtctttctcgatgccctctgctccaccatcaccatcttcctcccatggtggccatgcgccttcatgtgcatcgacagcgcgtcgcaggagtggaaagccttgaagcacagctggcattcggccttgggggccagcgtccatggctcgtcgtcgctggaggcgtgatccggctggctctgcggcgccaccggcctctggcggcaccgctcccggaaatcgtacctgctgccggaggcaccagtgatcggtggagcctttctcgggctcggcggcggcttcttcttcctgcgcctggtgctgtggaggttcatgtggcctccaagtgaacaatatgaagggaagctcttgttgcagagcttgcaccagcgctgcttttctgcttgtgccatgcctgaacggtgacaagaattgaggtaagaacgggcacaacaagatgatcagagcacgcatgcaagacacgattgaagtgttgttacacatggacagctaaatcctgctcctttacagcattttcggagaaactaagatgcatctgagcagtttttagtgccaaaaaaagatcttattttttagtggcggaaaattaatttgggaaaaccctttcgttttgaaactcgattccctttcccaaaaaaaaaaactctattccaccttactctgcgaaatttattgaattgcataaaaaatatgtatttttatctccccgttgtcgagattgttacatcaaaatgctcaagtacggaaaaaaaatcaaggaatggagggagcagagctaaaatcagagagaaagtaagagcggccacaaaaagatgatcggagcacgaaacgattgaaatggtacacaaggatagctaaatagtgcttctttgcagtattttccgataaaacaggacgcatctgagcagtctcttagagccgaaaaaacaccttttttagtagtggaaaatgtataaaacttgtccttttgaaactcgattcgatcttagtctgcatttgttgaaattttgctaaaaaagcttcaaacttgttgcccccattgccgagattgttcgatcaaaatgctcaagaacggcaataaaaccaaggaatggagggagcggagctcaaatcattggacacacaaccgaatcactcaagaaacccactaacaaaaacccacacgtcatccaagaacagggctagggttcaactcgattgttagcaaaaaaaagctttcatctttgccacgaagcgagcaaatcaagaaccccccaaatcagtgcacaactgcaaaaaagaaaaaaaagaaaagaaaaagatagagagaggctaggcaaagaaactaaaactagaaaacccacctccaactccaatctcctcgagtgggatgcctcgacggggagccatgaagagagagagagagagagagtgagtgagtcttggaggagtggctccgttcgctggatggtgtggtgtgcactgcggtgagcaggtgagggagagccggagagggagtgaggagagtggagagagaggaggaggaggaggcttgggttggaggcaaaaactggggggatatgggggaaaattttctagtgcgcggctgcgcgcccgttgcgattggaggaggatatttggaggctttggagggcgtataatcggacggcccagatcgggccaactgctgcctgcaagtgcacaggcatgaacgaacggaccgtcgcgtcttgcgctttttggaaggatgttttttgatgggaacttttgctgcaaatgctttttattgttgggagattttttgtctagggctctaggcccactcttctcgttttcatcgccgaattatcgccgtggattatttggtccatatgtctttaaaaatatctttttttaataaaaaactttgttatgttatgttgtttagatcgctttttcaagttatgtattcgatttatttctcaaaaatttactttttctttatcaattagataatctgcggcagtgaaatatggacactcaccgttcctaaatatttgacgccgttgactgttttaaacatgtttgaccgttcgtcttattcaaaaactttttgtgaaatatataaaactatatgtatacataaaagtatatttaacaatgaatccaacgataggaaaagaattaataattacttaatttttttaataagacaaatggtgaaacatgtttaaaaaaatcgacaacgtcaaatatttaaggatggagggagtatctttcaaccaccgttttagccaattttgcattttagtataactattgttaacagtgaaatttggtaaacccggagtagtcatcggcagtcagcatcgacttcgaagtcctgagattagccaatgagagttgtcaagtcggattcttgctatattcggttaaggaaatcgatcacctaaaggaagcttatccagcagagaccgagttcaaagagaatgcggcatggcaagttatctattaattaagaatagtttattagtttccttttatctttaggaaagtttctttcttgtccgacaaggacttgtatcaacccatgggtataaatatgtacgcccgaggtctatgtaatctatcttcacgatcaatataattcggcgcatcaccaccttttaccttttctactttatttcatcatccggcgggacttggcacctgacgcggggctgcatcggtgttcgatctccggctaaggggtaagtccaatgttccgccggcccgggcaattgtatcgtttacgtcggcgtcgttcaaggctgcatcagtacattcgacctcttggattgctctggtttggatgatatatttgcctacctatttatcatatgtctttgttaatctagtcttagcatatcaatttagctctatcggctgcttctcgttttagggtttctgccggtattggctaaatcgcgttgctagattagattagcttagacatctaccacactgaaaactcagtcaacggcttgattgtctagatattatatttcttttcatacttagtgctgcatcagttaagtttgatctactaagtcgtgcttagaaccacaatctctagcctgcttcttgattgccaataagggtttcatcggggtttcagccggtgagttatctggacgttgcatcggctcataaggattacatatacatataagttcgatttagccgatgacaacaaaagtttcactgtttaatctaatcttgtggatttcatgacatcggacctccagccgatgtatgcttttaaccttcggatcgatgcttatttatcatatcattatttaccgattggtttatactggattatattgttattttattacatcatcatcagccgattgcctttatatcattatctacattggacatatagccgattgcttaagccctatcgctatcggctggtatcaacatcggctattatcggctatcggctggaactactccatcggcttgtcagccgatcggctgttttgtctattatttgcatatcttgtcagttgcatgatcaaactgactggcacgcccgcatctttccaacctttggacctgcactagagctaagcagatcttccaggccgatgtgttcgatttttttcgtcaacaactataaaataacacacccagtgttcctgtatagcgcccaatactgggagtaacaaatttacttgtgtatttgagtaccaattaccaaatatatttattggtaaaattgtcaatattgccacaagacaatcaaattttgtgtaatttgctaatagacataaaaaacgtgttatagctgaaatacatcctaaaaaactggtaatttgctataggacactttggactcagttgaaaagataaatttttaagaaagacgagaatgtacccattgagtgctctacctcgggccatcgacctcatacgctttaatgcccttagggccacatgcttcaaacatgacattagagtaaaaatttaaaaattatgtaactctaaatttactatcaccccaaatacatcaatagcatacatcatattacatcttcacttccgtctaagctcaaaagcttttaatcctagaggcatttttgtctttttgaagaatttctctctccaattaagtcgaaagtgttttttagcaaattaccagtttttaaagtgtctttcagccgtgacacatttttatgatgcctaccagcaatttacacaacttttaagtgtactgtagcaaattttgctgtaaaatttatctcatcccatctgagaaaaagaaagaaagaaatgggccatgctcctggctaggctttatgaggatgcacctgccaataagctcttggtattatctgaggcatcgagaagatatgacatatgaagtgattaaagatctatctatgccatgacaacagttcccttcctatcaaaaattgtaatcaaagaagaatgcacagctcattaattccaaataggatatatgaaattttttcgtaactatctagttgacatgcaatagacgggtggacgtccactcgagctattagaatcctctcccctactctctatcatccacagaatactgtgaaaaaggacaatgtccagattttcattgacatacttcataaaagaaattgtgaactatcttcttgtgctacagttaagtatggaagaccatgaagctttcctccattcctaccaacatcaaagaccggagacaattacaaaataaccaaacaatatagacactctcactaaagaaaactagaaaatgaaacttaatccaaatttttaactgaacatcaaaactgaaagaacgaaagatggaaaaataaagagaataaaatgagataaattacccatgaaagtatagtgatcaaggtgaaagaaaaatattcagtgtatgctaggcattgtctggggttatccaatgtaatgctgaactgggtagcaattgagaaaactgagggagggcaaatcatggtagtgttggcgtgtacttctgaaaaaatggctcaattgcagatgaattacagattaccatgttcctgatcaagaatctaaatcatgcaggatcttttgcgttatggagtatttacacgatcttatcaggatggcagactacaataacacattacataagcaacaatatttgtatttaatattgacaggtaaacagtttgatactcatagcttacgtttcagtggacaaccaggtaaaaattgcagtaatatcaaagactgaaaccaagctgaaaacgtctggatttttgggttacagcaatatttgaatatctgattttcaataaatgctaaaacatcacaagattagtagagcactgcatgacaaaagtctcgagcaatgttcttgtgagcacataaaacacaacaccaagggcgatcgagaccgggagggccggcaatgccttacggtagaatgctagtagcagcagggtgataccgagcccagcaattatggcaagataacatgcatacactgtcatgtagtcatacattgctgccctcccgacgagaacgctgtagaatatgaagtcccccaatcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45002 - DNA, 1469 bp, Oryza sativa
taagtgcttccagctttgcagcttcaatcctagttaatctttttcctccctgtttaccttttgcaccagacggtggtaattgatgtgaaaataaaattttattctctttgtcttgtgaacaatctcggccgtgcttgcttttttcatatgattccctggaattacaactccccacggaaccactgttacagaaggattctgactgagcattgtaaaattcagattctttgctggcatctttctccacatgcgcttctactttcttgcagctttcttccaagagttgaatgcgtgtgttattattcttcttcgcttctagaatctccttctcaagcttcgacacgtgcttcacaagaatgctgctcagatctgaagcagaatctgttgcctttggattcctgcctgtaatctgtctttgagcaccttgtgcacaagaatttactgaagaggcttttctacctgcttctcttgcttcgtgaacttctttttcaagctttgaaagatgcttgaccaagaacttgtccagacttggtaactcagatgtgacttctttctttggttgtaggacatcaacaaagctagctgcagtggaatatcttcttgagtgtgccctttgtgatgtaaagctgttcacagactcagtttcctgatatttgcccctgtcactttgaagtacagcatttaagccagaagtggcaacaataactgccagagaagcaagttcatcttcatgaagagcttttagcctttccagcataatgttcacaagatcattggattgctgaacgttagtattgtcaaagtcagatggaaagatgcctgttcccaaggtttctttattgaatttcaaattccttttgtcttcactgttacagtccccctgatgctgctcatcttcagaatttgcatcaatctcagttacatcaggattttggctaattttccataaaagctccttaaactcttctttgtttgatgaaatagaagaattcgcaagttgaataaatgccttcttaactgcagcggcaacctccatatcaacctcaaaaccagtctgaaaggaagcagtgaccttatgagttgatcgtcccccagtctgtgacgatgattccacctcatactgctgacttgaacaatctggtctgtcgtacatcattacgcctattactctagcttcttcaaatgcttcagttgcccgaaacttggccttttccataacttcttcagcgtccttcttttggatcctgttgaaaagtagaataaaaatcagaacaaatgagtgtatcaaggaaaatacacacaaggctggacatgatggaataagataaccatgattttcaccttgctgcatgaagaattctgcaccacgatgcttcaaccatggcagctttgcgagcttccattgcctttctggctgcttctctagctgcaattttctcccttgccattcgcgtgtagtgaggattggc

SEQ ID NO: 45003 - DNA, 4848 bp, Oryza sativa
aagtacctgaagacgctttatctttctcttcaagtatggttcagtcttcttccgagggaccaatctataggggaaccacttttacgattaattgacttcttgaattgggatgctgatttatttacagaattcaaaattgaacttccaaattctcttgagcttgaactctgcagaaaacaaatgagaagattgatgtagctaaatccacataaaaagaatgcttacaagcaggaaacagagcatatgaaaggatgctttttaacagaacatagatgttatgtcacccaaaaaatacggaatgatgattccttaagaaaaggaatggtaagagggtatatggcagcccatgctatgtgtgctaggctgctctcaccagcagcacacatggtgacctcctacttattgtgctcatttgaattagattgattctcgtaggtaagctttccaactgaaccatgttgtaatccttgctatatactccctctgttgttcattgtatcgttgtctcgttggttagttcaaacgtcaaataaacaaaaatggaggagtattactgtaccaaatcattggaatgattattgcgtgccattctaagagcatttggtctatcagagatacctctgttaacttatggaagcttaacccaacacttcaatggtcacatatactgaaactataatcaattgtgtaatagtagctatactttggataatactaatcgacaaaaaaaaaaacagttgccacactgaattgtctgaaaggagcatactggtgtttgatttcttccgttgacaataattttgatgtctacttagctgtcaagctccatccaacccgtctatagaaatatctatattatggagtacagagtaaacctggatcatattacagagtatagatcggactaaggagcagaacaagaataatataaccacataaataaattgaatgaaagaggcaagtacaaatgcacgaaccaccaacagagctcacatcagggtatggtgcgcatcaacttgaactgacgaaaacaattaaacaaagagttgcccatgtccattcacgcaaacccgtaaatggaaccaacctttaattagtgtttttagcaactccaagtccaggttgagaaatcactttaacaaactaatgctactgcacatcaacgaaatcacattagggacagcgatcaagtgctactgcacgcactttcgctaaactaaggtccaacaggatcgaagttatagcatccatatataataataggacaaatcatgcatagtaaaactgctatataccggagtttatgtggttggatacaccagaaatgatgagaaatttcgattcacagataacagattgcagagcaccaaccaaatacagggaaatcaaggtccccaaacactaggttctaagaaattaaacggaacacgcatgacacccaaactccgcccaaaactccccgtggagatccgaaatccaaaaccaaaatcgctacgcagtaccccccacccaaccaacagacctacagatccgctcgagttctactcctgcagttcgcgcggagtcccagccgaaacccaacgacctaaaattcgagcccgcgcgggctcgcggcagcgtcggacgcggaggtaagggggggcggggatctggagggcgaaccttgcgggcgcttccgccgctgcggttgggggagcccttcctgcggagggagggcgtcggcgaggcgcagcttcgggcctccacgccgtcgccgacctgctccggcggagtaggatgaggaggaggaggcgaggccaccatggcgagccgcgtggagaggggcgaggtggtggcgaggaggaggaggaggaggaggacggcgtgtggattcgaacggaattggaggggggagagaagaagtagccgtttctgccgatgtgatcgaaatggtaaggtaggcttataggcagtgggggtgtgactaggacagggagcgctgagaagggttgtcgccttgtcttgtagggcctacagtactatgtcaaatgggccctggaatatggcggcggcgcgcgcatctggcctattgggcttttgtcaactgggccctgagcccatctgggctggttgtgtaggcctcttgacatactgggcttctcctctgtccactgtcaaatttcgttaagcatccaaaaagtcagatggaacgacaacatgcacaggagattagggaaagaaaatgcatttttatattaggaaaagaaaatgatgtatttttttgctgatcacacggagttactcgcacgcacatcacacatgcatacgcccacgagaatgaaagtgcgccccatgagccatgactagccaggcaattggcataggtttatatttgttttctttcatttcataaattatttgttgaaaattacggcaatatcaaagaacttagtttattacgacgacatcaacacgtgtgctagatattaaagattatatttttctgcttagtaagaaaaattggagcactacaattacgccgattttttatatctaggcagagggacaccatcattaacacaactgggtggcccgcgcaattgcgtggctagcacccatataaatttatatatttttaatatgattttatttaaaatttattaaatagttatctcgttgtcttaagattaaatagttaccaaaccttatcatccatgtgtttttaattttatagtttttaaaagtcacaccagttgctaccccttacttttatcatattattctttatttgcttgctcgatctaccactgtttctattcattctccttggaacctttaaaaattggatctataaacttataggttttagagtttattggcctattgggcttctttttttataatttctagaagtcctgtcaaacgctaccattatactcctctatgaccgtccattgcatcttctctttattttcattgctattttaaaaatcgaacatacttatcgtttaggttcaattttttactttccagaagttccgccaaaacatcagcgactttgtcactgtactcctctacggctcgctcgctgccgcccttctttattgtcattgatattttaaaatcaaacataattatcattggggtttatctttttactttttagaagcccgaatctttaaaaattggaccttatagtttttagagtttattgtctcgttgagtttcatttttttataatttttagaaatcccgtcaaacgctgccactatactcctgtacgacctgtccgccgcatactctttattgtcattaggattgtaaaaatcaaatataactatcgttggaattcattttttactttcttgaagacccaccaaccattggcggctctgccattgtactcctatgcgacccgcctgtggcctctcatttttattgtaatcgagattttaaaaatcaaatgtgattatcattgaagtttattttcttactttctagaagtcccgccaaccgccttgactgattgcttcacgacctgtacgttgcccttcctttcaattgtcattttgattctatttgatgttttattaatagtttttagatgtcccatcaaccgccaccactctactcctatatagacctattacttaattaatctcgtcatgtgtttcagatggtcttttctttcagtagcctttattttttttcaccaattttagttatttataaattgtattcctagttaatatcttatttttatttttctaattacagaatttattttattttttgtattatgttcttttgatatttttttttttaattttagttgtttcaaaattatattcctaccttaactctcttattaatttgcctaatttcggattttattttatttttattctgaattttaattaatctactatgctcttatatgtactcttatttcaatattgtttatatttaattctgaattttagttaattttaaattgtatttctacttgaactcctctcttcttttttttctttttcctactttcgatttttttcatttttattccaaattttaatctcatattggattcttgtatggactcttctttcaatttttcttatttttaattccgaatttcagttattttaaaattgtattcctactacttggactcttctcctttttttttgctaattttggattctattttatttttatttcaaattttaattaatctcgtattgggtttctatatggactcttcattcaatattgctcacttttaattccgaatttcagctatttttaaattgtttttctactttaactcttcttttctttttcttcgattaatgtgaaaatttctagccccaccgcgaacgtggtgccttctttcaaagctgttttaataatataatagatagatttattcttccatttgttgatattttatactccctcagtttcatattacaagacattctagcattgtccacattcatatagatatcaatgaatatagatatacacatatatatgtcaagattcatttatatatatatatatatatatatgaatgtggacaatgttagaaaatcttataatatgaaacggaggaagtaaatataaagattccttgtttttacaccaggatctctttaatactttctgtcaacatcttactccatccgtcccaaaatataagaacctagaactggatgggatattttctagtacaataaatctagacaatgtcccatctgattctagattcttatattttgaaatggaaggagtacttgaattcgactgagtaagtttaccataagaaatgtaaccaattaagaatggaaaattttgctatatgac

SEQ ID NO: 45004 - DNA, 10081 bp, Oryza sativa
ttcgcgctacgtacataatattgatggtattgagaaagatatcgaattaatcttgcaaatgacgcatcatccgttttgtccgcgttgaaataaagtgtcaccaaataacacgtaacagaaacacatttcttgatcaaaggagaaaaccacaaaaagtgattgattgattgatcattgcggcccatcagctgaccataaacacatggagcttgcccatcatcaggccatgacatgatcggtcatcgatcgatcggtccatcaataccagcgtgtataatagcagtacggagtacttgcaaacgtacgctaactataattagtcgtctaattaatttcttaaccgaatggaatcaatggaatcatgggtgtggctgcatatatgccccacaggtcgacggtttagccggccggtctaccttgcatgtactacacgtgctgcttatatattcgttggtggtggtggatactccaaaacagatcggttggtgctccgagcggctgattaattaacaggaaccaaatattactcctatcttcatattagaagattttctagacaatgatattaatgaatctagacatatatatataaatatggataatgctaaaaaatttcataatacgaaacgaagtactatccatattttaatgtatgataccgttgaccttttgatcaatgtttgacctttgttttattcaaaatttttgtgtaaatataaaaatatttatgtcatacttaaagaacatttgatgatgaatcaaatcacattaaaataaatgataattacataaattttttgaataagacgaatgatcaaacattaaaaaaaatcaatagcgtcatatattaaaatatggaggtagtaacagggagccggggctactcaacaagcgatgaacaatgtgctagccagctgctagcgtacgtgcgttttgttggtgcgtgactgagactgcgtacgtgtttgctgctgcgaaatatccacacatgcacttggctaataatagcaacgcgcgtcgcggcgttgtttttggtgatagatcgatcgagtagctgccggtacttagtgactcagggttgttaatgtttggttaatttgtagtactagcgtacattgacataatttgtcgcactacagattaggaaggttactttgactaattaagttattgtcaccttgtatccaaggttccaatgttttgttgactgaccatataggagaggatctgaattgctccacggacgcccgataggagaggagagcatgtttcggcgttagatttgcggagaagaggcggaggcggtcgggctcatcgcgtctcgtcgcttcgggcagaggggcggggtgttggttggccacggtgtcatgtatctggtgggctgcatgggctgctggaggaatgggcttggcccagctcacatactgaaggtgcaagcaaccaagcagtacaaataccaacagtggtagtgagagaaggcatcgataaattagaatctgatggctgtggcctcttcttcctcctcttgatttctcctctaatcccctactctgtgtttctctgattccctttaccccctgcttctcttcccaatctctgctgctagttcttccaatatgtatccctgaacttaatatacagagttggagaggatatattgctcctgtgcttgtgttcaccagtgggattcatgtgggatcgtgacacacggcgaacggcgagatcaacggcgaccacgacaggcctcgggtagggcggcgtcggcttcacaggcgcggatcagtggcttttgcagcattgggcgcagacacggctttttgccacggcttgttgtgctcatcggctcagcctgcacgccaagtgcttgttgaaatgcctgcaaggagggagggagagagaaaggatttcaaaggaaggagagggagagatggggcactggtgcggttggcatgtggggtccagagctcctgggctcaccggtcagagagagatagggagaggacagggagatgcattctaattgctcgagtggacgtccatccgtttattgcatgttaactagatggttatgaaaaattttcaaaaaaaattgataagatagatcaatatgtaatatatcactccacaaatatacaagttcaaattcaacttctataagttgtaacaaaaataacaaatttaattgtaaatatacatatagtaatttaagttttgtttattatttttgttacaacatgtagaaattgaattttaacttgcatgtttgtggattgatatactacatattatctatcttgttcatattttttcaatttttttcataaccatttagatgacatgcaataaacgggtggacgtccattcgagctattaaaacagtttcccgagaggacatgaggagaggtgaggatgaattttctggaaattttggagaaggctgagagtttgattattgtttttcggatatgctacaccgctcaaaggcttgtgcaaatattactggaagtttgtgtggtcatgaacttcatttggtgagtgtttgagattcttctcaaggttgtttatttttgaagattcaaagaaaccttgcttttttatatttttaattaattgtgaatgtttttcacatttgtaactgacgcgcaacactgaattataaatttaaacctttcctgtacattattcaaggtgcctaatgtttatcaaacaaattctttttttgtcaatcctctccacctatttgtttatatctatgcaaatacatcatgagatgcatggacaatctaacaacaccaaatgaattcaaaagacagagacaaaatcaaaataaaaaatttactaattatttctttattttcttttctttgtttcttttttttttacttcaaaattccaggtatgttacatttgatgcctcagttttggccactcatcaaccccattcgagtacttctgtcttcttgagagacaggccaataatcatcaatggcggccacttactgaatgaagaacatcgtgtggcatatgcatagtatttcactgtgttaatattctgtaagtggtaccaccaatgcaaatacagtttgttgcattattgtatatatataattgattgatcggtgcccgcttatatcccttgaggacagattaactattcctcacctatgccattgcaggtgccaggggccgatggctaagattgatttttctcgtcaggaaaagtcgattgtctggtaatgacacttaatttttttctccctgaggacgagtcgacggacgacagtgctgatatggtacgtctagctggtagcctggtaccaagcgaccgtatatgtagctggtgtgtttagtgtgcatgtcctataaactagaaactgggatatctcgttaataattgatagtttgatactgcatcaagagaggagtcgttgattgcatcgacagatgtcggcccaggtgttcctatgatcgtgtatctattattgcatactggtctctcgatccatccacgaagtcaaggaggaaagaggaccacacatcagtcaattgaaactaaaaggtaatttatctatctatctatcttctattatatactaaaagtccattaaactctctacaaacgctcttaaattgccatgtgactctctcaaaacgttcttgtattgccacgtggcgtaacagagagaagttgagaacctcctagggccgacgcgtgcaatacatggatttatcgtgaaacttaaaccaacgaagattatagtttcataattgactaacaaagattagtcccataaatatatgtacgtaaggcaagatttaaaatcaatctcaaagcaaattttaggcacgtgcagcccatatatttgtcgtgaaccaagagattctataattgtgtacgtgaggcaagatttcaaatgtctcaaagcaaaatttaaattacatatccagtcaaaataaattaaattacatatggcaagattagtttcacgaggcaagattgttaattacaccaaaaattagttctatacacgtgaggcaatattcctaaggcttacatacatatatatatatatatatatatatatatatatacatacaccccgccagcaacacgatcttgggacattagtcaattccggcggacggagcagaataggtctgcggcaccttgcgacattagtcaattccagcgactcatctttggcataagaacacaatcatgccatcttctattaattagggctacatgatcttgcaactaggaaataacataagcatttatacagttttgtcataatattttcagcagaagaaactaaaattgcacctacgaaagaacacaattacgatatcctgtattagttacatctacattatgttgcatctatgtatactgttttgtcacattctttttcagcacaaaaaagtaaccttgcacctaccaaagaacacaattatgatgttttgtattaattagttctataaaataacataaacacgtatgcaattctctgtcaaatttgtttagtaactatatgcaatactaatcatctgcatataacatggcaccgggcaatttgaatactgcattaacaccaaagaacgataggtggagaatcaaagtagaagctattaggctatgcgaggcggttaatcctacaatggctgatgatttctatggtatacatatgattgtactagatgcagaggtatgattgttgtataaacatgtggtttaatatattgttctattatgtaaatacaatctttttggtgcagggcaactcaatacatgcctgtatctcaaagcaattggcgaaccacttcaggccaaaaattaagattaactcaatatatattttcaaaaatttcaaagttatggaacatgataagtaccgtgtcctaaaaaaagtgttgcaacgtataaaaacatttttggatcgcacacattatacgctttgttttaggccaaaagctcatttattccttccttttcagtcccagcctagcccgctatctctctgcttagcctacctctctttgaaatatcaaaatctgagtgaatctataaaactcggaataaaaacggtgaattttaaatggtaattagatccggtaaattaaagcataattaaaaggaaaaatcataaggaaaataatgaggggtagtgggaatcgatttttgcaatcaattagaggaggaacgcatgggaggaagatcgacgtggcggccgcgctagggtttggccaggctaggcttgctagattggtttcagttttatatatttcatctatgctggtatcttggtataaggtggtatcgaagtattagacgatacgcgttaggtttaccccatcggctatgctagcatcatacataatccctactttaggacgcatttagatattgtgtaatttatactatctcaacgcggtgaccgatctatcccaatcaccctatctaaatatgtcccatttgatggattacgcatcgctaacatctacagccgatcaagtataccgaacaatctccaagtttttatttgcctctgccgatctgacgcaagttacgtcggcatggcctcatacgatacgtcatcggcaatcctaccgatcagctatcgttgatggatttaactctttgtccttttttctatcttgttggttgcaggatcaaaccagctggcacgctcagaatccgaaggcaattcttttggacgtgcattaaagttaagcagatctctcagaccagtgcatgttttccgcgtcaacactaggacaatgaatctggataaagggtagtctagattcgttgtcctaggagggatcacatcctctcctagattgatttttttttcggagggagtacttcgtagcagctaacatagtttcaagaaaggatgacagttgtagcaggttagtgggtgggtccaatcatgatttgaccgggtcgaaaccatcgaagctacgtctgggggcagtaatggacaacctgggagtactctgtactccctccgtccaaaaaaagacaaaccctggtttttgtgtccaatgtttgaccgtctgtcttatttgaaaaaattatgaaaaaaattaaaaagacaagtcacgcataaaatattaatcatgttttatcatctaacaacaatgaaaatacgaattataaaaaaatttcatataaaacggacagtcaaagttggacacggaaacccatggcctttttttttgggacagagggagtagcagctaacatagtttcaagaaaggatgacagttgtggcaggttagtgggtgggtccaatcatgatttgatcgggtcgaaaccatcgaagctatgtctgggggcagtaatggaccatcaaggttgtgtttagattcaaaattttttcttcaaactttcaactttttccgtcacatcaaatatttggacatatgcatagagcatttaatgtggacaaaaaagagccaattgcacagtttgcatgtaaatcgcgagacgaatcttttgagcctaattatgccatgatttaacaatatggtgctacagtaaatatttgctaatgacgaattaattaggcttaatagattcgtatcacagtttataggcggaatttgtaatttgttttgttattagtctacgtttaatacttcggatgtgtgtccgtatacttcaaaaaattttggcacacaaactaaacacagcctaagcttatagtgtactcccaccatcccataaacatctcatatcaaaagttcatttgacctaatagcatcatcaagaaaatgagaataatccattcccacaattttgttattgggttttctagaatgaaaataggaattgaaaaaactcatcgttccaagagaaaccctaaatttaattcccaaaaattaaaagtgagcctttccattaaactaccaacagaaatatcccgttttctatcatccccgcaagaaaaaagatcgcgcggcccatcccacgcgctcctccctgccctgacgccgcgccttttgtagcaagccacaacttaccttaattgtgatttggcaatgttagccactaaccaaacaaccccctagacttggtatagttgaattcgatgagaccaaactcattgatcaaggtacataaaagagagtagaggaggcaaataattacactttttttaaacttttttccactctttatcagatcggtctaatctctttcacaacaacactctttctcataaagtggaaaaagttaaatatttcctacataaatgatgaactaacatagctgaaggcaagattttcactgggagtgctcatgtatccttttaccaagccgaacatgcacatcaatcgccgttattgaagacgttgtaactaactattccctccgttccaaaataaagcaacttttagagtttgaaatttgcctcaaaataaaccaacttctaccttcttacctaacaccaatccataaaacgagaaatttcattactttaatacccctgacctacctatcaaacaataaaactttcacattaattaaaggcattatggtttctgttcttaaaatcttctttaaggccttgtttaatttcaaggggattgagggggaataattgcacatcacaataggtgtagaataaattccctctaatccatttctcatggggattaatcgatctcgcattaagggtttgagatagagcgagggagtaaatcctacgagtagtactccctccaggttgataatacttatcgttttgaacaagggcatggtctccaattaaaaaaacaactttaaccattattttttattataatatgtataaaagggttaacaatatatgatcttattaaagtactttttaagaccaatatatatatataaatatatatatatagtcatcatatttgaaagagaaatattttgaaaatgattgataatcaaagattctaaagtttgacctcacccttgttcaaaacgatgagtattatcagcccggagggactatctagtagtagttgttgcctttttctaacagatccaaacggtttctcacagcggttattattcattggcctttctggcacgtctatatatacaccggttgaccgttgacactgaaaagcgaccggggatgggcgctgcgtgatacggtgatagccgatcaagatggatgcagtgcagctagcactcgattggtagcacgaaacaaacactgcaacaagccaacaatgcaagtaagtcgacgtcggtcgacgcagattaattcgagcgatcgatgaatgtacccatgccaattttatttgcactgattggatgtcagcgcagacaactaagggcctctttgattcggagaaaaaacatacaaattttagagaattttagtcttataggaaaatttcctaagaaatcctttaaaacaaaggattgaatcctatctaatcctttgaaattcttgtagaatggataattctatagagattttggaggaaatttagtaagagcttcaacctcttgataactttcctttgagtccatctctcccatccaattcctgcgtttttcttaaggttcaatcaaacggttattcctatgattttcctgtatttttacaattatttgttttacacttagatttctatcaaaatcctatgtttttcctattcctacgtttttctaatcctgcgattaaagggacgcttgtctacgaaacgctcaaaaaaaaaaaaactctccgagaatcaagctcaatcgatcgctagctcgcgcacatggactcgcatatcgatcggccggccagctagctgaacagcacgcacactggaagctagcagcaaccaagcaggcaagaaacacgcatggttagttgtattccatggttattggttggagcagagtcgtcagagaggtaagcagtaagctcgatatccagtgagacgaggagcccacactttggcgcgagttgcatgctttggaggtattagctgccccgtttggaggtttgcgtgcacgaggccggcagccgggcaccactcgcagaagcaatccaagcaacaggccgtgactgacgtgtggactccaacacacatacaggcaatcacattctatggccctgctatgagatgaacacacgcgcacaccagcacactctaccctttacaagcaattccgaaagactgacactactacaaaacatcaaataggtgtcgacactaaagataccggaagtgctaaaaccaacacctatagaccttttcccacctccgtagtctaaaaacacaaaaaaccggcacctttaagtgattataggtgtcgctctataaaaaaccgacacctttaattcattataggtgtcgatttttttaaaaaaccgacacttttaataaattaaaggtggggcccaccggtcaaccgagccgagcctaaactggaggtgtcaacttttaaaaaccagccgagccggtcaactgagcaggtgggacccaccggcgctcttttatctctacctctctctcgttattatctcttcctctcgaactctctcggttcttctctctttctcttcctcctcattcctctccacttcttccttccctcccggcgcgacccgacagcagcagtggcgtgtggaggtgggaggcggcgtgcagcggcgggagggcggcggcctcaggtgaaggcggcagcggcgggagggtggcggcgggatgggaggccgggcagcctccggtgaaggcggcagcggcggctgcaccctcccctccgccagatccagtgggagggaaggcggtgacccgacaacggtgcccgctggtggcggtggtggcggtgtcgacagtggtggtggagactggcgcgggcgaggtggcggccggcggcaaccgccggatccggcgatggcggtggcgttgctggtggaagaggctggcacgggcgaggtggcgaccggccgacatgaatttttctctttttgagttcttgagttcttcctctcttttcttctcctccatgtccaatttgttgagttcttgagactttgtacatgtagtggtgtgctgttcaattttggataaggttgatgtg

SEQ ID NO: 45005 - DNA, 14768 bp, Oryza sativa
ggttgcaaaccccacaactggcacctatatttgttataggtgtcggtttacaaccgacaccgataacggaactcatatgtgctatcctcatggtagtagtgtgagtcgacatatcttgagattgacgaagtcaccacagacaccgggctgtcaatgggtatgtcgcctatcactgaaagaataattagccgtaaatgtgagcacccgtgtcaaatctaggatttgaatctgagtgggatagattcacacttccaccacaaggaacggttgagctacgctcacttcgcatgagacaaccttttaaatttcatcaaattattgacacagattgtatatttgattaacattataaactaatattttaaaaattaaattttgcaaatagcttagaatatgtggtctaatcaatcagtaaaaagaatgttcttctaagaatcctatctttggaactatggacgaaataatccgtgttaaaaatttacgattttgttatatatttgtcaacaatttttttctaaaaagttaacaaacgtaaatatagtacaatcacaatgtaattacattgtaacttgcatgtaactacaatgcaattttgagccgttcagtttgctttaaaatccatgcagggaggtagaaaatgatgacaaccttggtaccattataccttcattttatgaaaaatagcatgttacctagcgatttttaaaagttacatataagttatactacaattacttacaacatacaatgtattacatcatgattctactatatttatatctttcaaataatttagttaaaatttgactataaatgtatagctagtctaagatatttttcacaaataacccttgtgaaaatatatattacaaatacacccctagtgagaaaaatattcccttaagaatagaaatggagctttctaataggtagaaggtctattttcagaagaagaaaaaaaatcagaggttcattgtttgctaaaaatggttttaaaaataggaaatttgtgaataaaactacacgttaccattgatcatttttttttcgaacggtcaggccgttgccgacattttatataaagaagaaggtgtctcattttaaggagaaaacgagaccaaaccttacaatgcgtagttaattagggaaaactgggcgaaaaccacaacactcaaacctaagctaccaacaccgcgaaaaaagaaaaaatggcggagcccaaaacaaccatcgataaagaacttgttgaaagcgacacaaaggcttcgacttctcggggcaagtgttatcgttgctgagcttgttgcctagcgatacaacagcttcgactccacagctatcacatcatcgttgccaaaggcatcacagaaaacgagcaagacaccgaatgaccactttgaacatcagcccaagccacttgagcactactacttgtacacagctaacaccaacctccctcgaaaactacaacgtgttatcgttgccaagcttcatcgcatcccaataaagcagctccgacttcacctagaagaaaacgaagaaagttggacgcttgccacatccaagagcagcacccaggagacgaaggcctcgccaaatagctaggcttatagagcttcgacatgggggatccacgaatgaccatccttgcatggaaaaggttcttggtagcgagagagacgccataacgacgcctccaaggaggggaacgacgcttaatggcgtcgccgtcgtcaagccaaccaaaggctagccaaggctttcgccagcgtcatccaaaaccacacaacccacccgcataacgtacatcgctggaccgccacatcatccctctagccaccaagcctagcccaccacccacaacataggtaggctcgcgagtccgccgtggcaccaacctgtcagcatcctctactgcactgacaagatctggccaaggcggccatggatccggccgtcgaagctcggcaggccaacgtcactgcgagcgcccacactccactgcaccgtcgccaccgcaaccgccggtgggcgcagccggtggctgccactgtctccgcgccgacaagggcctgccgcaaccaccccctccgtcacacgcgccagactccctccgtggccagcctcccgtagctgtccccgcgccagcgaggccacgccggcccccacctcacccttggcagctcgttgtcatcacaggcggcggatctggcaaaggggcgccagaaccggccgtccatcaccgggccgagggccaccgtcgccacggccttcccggccggatcccggcgcttggggcggatccacggccgccctcgcaggggtgcgccgcttctgccctcgccgagccaacacgccgccccatgcctcctccggtcgccgtcgccacaagctccactgccatcggggaggccagatcggccgccagagggggcggatccgactccgccgtgcccggagccgccaagccgtccgccgtcttgccgccgctgagcagcccctcggtgtcccgccgctgggcttctcgtggggagagcgccccgccgccgccgtccttgcagccgtccggctttgctgacgagccactcaggcggcggcaaggcgaagggggggagggtggggaggggcggcggcgaggttgctgtcgccgtccgtgtcgcccctgggacgggagcgacgcggacgaggacacagtctcaccttctgaaattactgttgatcaatttttagagcaaaaatatctgcttggtccactcctcttcttggtccactcctcttcacagttcacagtacacaccccatgtaccttatcgctgatcgtcagcgtcccgtgacgaaaattagaggaccacattttagaagcacatacgcatcatattcatgtcacctttccttttcctctggtgatgctggactgctgcggtctctgcagctgcaactagcaagtgctacgtcccaatcatctctttgtgaccatgctactacgcccgtacatttaaccagaagaagaaaccaattgtaagacaaatcttgaggatcaatctatcatcttatactaattacagtacattagttataatttttttcgctaggagcctaggattattgggaattagtgaaattaaacagctaggataggtgggatgtttgtgagaaagaaggtgaaaaaaattaaagagatcattggttgagatgattttttttttttgataaagaaggaaaacggatgaatgagtagttggtgtattctcagataaattttaaacgatagaagttgttttttttaagacggaagaagtacaagtatcattggaccatttggacggtagaaaaggagaattaggttcctttcgcagttgctttttttaaattcacagttgctttttgacgggttaggaatttcgccacattgatcacgagttcacgacaacaaggaaaacggatcacaaatgtaatcgtgttgtgaacaatagtactccacatgtttgtgagccacgcccttgtttggataagaagacttacctgcaatccatttagaatgcgatgaaaattaaataatggatcaaacggactgatctgaaggttttttttttgtccttttgccaaacaacccctaaataaacggatgatcccgaccattgcacctccgtatcagaaagtaatactccgtaaaacagatgaagaaatttacacctcttctctgttgtgtgttagggtgcattcgagttaggctaatttatttcacgtaaaatgagacatgtcattatcaaatgattaattaagtatattacctattacgctccccgttcatgtttgatcatcgcatttgttcatggcagcaaaaccaagaaggagaagaaaagacgtcatagggtctgtttgggggagcttctaactgctacaacttctcccagaaccagaagctccctaaatagtctagcttttggtccagattttgagaagctgtagttataaaatccagaaaatgaactagaagccagaagctggaaacccagcttttccagattctcagaagctggttaccaaccagctgcttctcgaaatcttaagctctcctaaacaggacaatagtctattttctgcaatcgttcctttcccgggcttttcggcatgtactactccgtccaataaaaacccctatcaggctagtcccaacccaaaacactagatatatagtttccataaactccacatcatcaagaaactaggactagacactactctttcaatgcaaacactactcttccatacttaaatttaatggtacttatctcacatgatgtcttagatgttgtgtagaaactgttgtgaaacaaatctctaggagataagttttttgtgggccaatccgaaccggagtagagataagatctatctcctcctaagacccctatatatacagaggcagggtgtgacatctatggctaatggctggcttttactacagatgagatctataatgaagagagagctccaccctacatctgtgttcattgtctacttctgcaatgttcttgagggtaaagggatgggagcgggtgttctacatcatctcacgcctctactgctgtgggagggacagggaatggatccggtgatctgctaataggcgcgttggtttacaacacgttatcagcagctctgccatcaccggcttgccgttccaatctaattgtcgttattagattgttaatcacagattgatcttttgtgtttttcctgtatgattgcatgtagcgcagccgatagtggagccgccgccgtgcttgtgttggccatcgtccgttgggtcgacaccgacgccagcaagcgtacgtgcatcaggaaagccgatgctgaacggctgtgtcgcacctcgcacgcaggcatggagtccaaccaccttcgtgcgatccaagctgcacttgcacgagcggcctcacacgtttgtgtggctccttgccgaatgttctgctaaacaaaggtattggcaaaatagcatgaaattaaatatgcatttaacgtatttgggaaatccataaggaggtcttgaatagactccgtcgtgaaattgcagcatgcaaatctcgtaccaataggtattccggtaagagtaccatctcccgttgggagaaaatctcattgacggaattttctctgagggtgagacctcattgatgaattttcctctgagatacaaaaattagtaagtctgaacacatcaaaaattgtgtaatcccttggagggatgatgacccatttgtgacccgataagattacaatgagaaatctgatgagatcaaacagacggggtctgtaggcacatgtgcttctcacgattatcactggagtatgtacactcgtgatatctgttctacccgatggtatgaatggtggtgtcctctaatacctgctaaggtatacttggtgttattggctgtgtgttatcccccacagtgcttgagtttttcagactagctagttactctaatcgttacaacatgtctttggaagacttgttgatgaggacatcccttccaacgatacaaccacgcctattgcacagcaaggaccagtgactagagctcgagctcgtgaacttaattatcaggtaaagtcattcctagctaatcatacaagttcttctcagaattgggtgctactaagttattgttgtgatctacttgttgttaggaatatgggagaggaaccagatcgcaagcagcactagcagcgctgatttgatgaagtcaatgctcttctctccggagggcaaatggggaaaatgagtacttgttggaaagatctcgtcctctactttcagctatgtgtggtctcaccatcagatttgacccaggctggtcagaatgacgaaaatagtttttcacattagaaacttgggcttgggccttgtatctttaaagcccattagaggtccacaaaacctagggtttgctcccacctcctctcctggtcattcctccacctatataaactcctagcagccaccattttgcattttgggttttgtttggatgtaagtttagctgcagctacttccttgtactcgcgtgtgtcggctagaccacccggatgcttgtattcagaacaccactttggtttgtttcaatttcatcatttgacaagtactatgagctgtttccttgtcaacttgtttttgcttgtttttcgattgcttgcaggttcaaggttgttcttggcacgacaagaacagcaacaacgtggagtcggtgtaccggttgctaaggcgcagcacccctgtggtagttgtagtcggaccgccaacgttgtgtcctctcccaaatcgaagtttatcctcctctcatcaaaagatcgggaacccccgttgctgcatcacttgtggttgatcttatggatccccaatttttgttgatactgtcagagagagttgcaataatcaaggcttagttcttgatggggtcatgcccaggaggtgcgtgccgttgtgaattatttatcccctaatcctttggaaggatgaaacagattgtgttgcacaacagtatggtattgtggtacatgatagtgatggaatgcattactctctatgttccctattcttactttaatggtgaaatgagataagtcttttaagactaatggtttgaggatctgaaggattcttgcctacgcatacatctgagagatgtttaatgctatgggaacatgacatgtgacaatagttgttgtcagggggagtatgtgctatgtgttgattgtcatttgcaagacattgaaatgtcttaagagtatgcccggggcattgactcgatgatgatcacttagacctatttctaaggtcctatcataagaagatttgtctttattgactgacaccaaatacaagtgggctacctcacagactcttgaggcaaggtgaggtgagtagcaattcaagttgagtgataatctagttgattgatcacctagtttctcccaactgttagttctcggaagctgtccggagaattgggatgagaagacttgaggcttgctaagttcagggggagagcacccgagaacatgacccacaatatggaccggttagtccatagtgttgtactccttttcccttgggtgagtggagctgttgttcctcacataaggtttttaacgaggcaacaacgtgcaatgcatgagcgataactatgtactctttctcctagcctttttcccattgggttttggtaggagtgttgatgaggcatgagttggtcgcggattagtccaagggggagtgttgtaaaataaatctctaagagataagtttcttgtgggccaatccgaaccggagtagagataagatctatctcctcctaagatccctatatatacaggggcagggtgtgacatctatggctaatggctagcttatactccagatgagatctataatgaagagagagctccaccctacatctatgttcattgtatacttttacaatgttcttgagggtaaagggatgggcgcgggtgttctacatcatctcacacctctactgctgtgggagggacagggaacggatccggtgatccgctaataagcgcgttggtttataacagaaaccatgtctcatgcaagacctgatttccttctcttttctcatttattcacttgccacatcatttttcatcctaggtggcaatttatttatggtaaattggaaccatgccattataattttgcagagtttgagatatgcccccggtatatcaataacatgtaggacccacatgagtcaatggcatgtgggtcaggatggcatatcccaaattttgcaaaattataatggcatggttctaattttcctatttattttaagagagaatcccttatatactactctaaattaaccggctcccttatatgccactttaaattggcttctcccttttatgccaccggttcaagtttctcctcccttttatgccattgccgtcagtccaccgtcagttgaccgttaactttattgtaaaaagacgtatttgccctttagaattagtatacaaccaataataggtattttagtactaatatagctattggatataacatatgaaaattgattttttctgcatcacatgcaattttagccatcaccatcacaaataaattttcaatgtaagcatgaaacatgcaattttccaacaatatttttaatataaagagcatttttcactggttctgacaaaattttgttcactcaaaaaggatttaaaataaattagttatgattttttgaagtttacacattttttagttgagagggcatattggtcatttaagaaaaaaactaacctttgactaacagtcaactaacactatagtggtgggagtggcataaaagggtggaaaaacttgaactagtggcacataaggaagaagctaattttgagtggcatataagggaactggtcaaattctagtggcatataagggattctctcttattttaatgctatagacaccattctagtcattgggttaaaaaatggcctcatagttacaaatctgggcacacatgtgtctagatttatgattaggattgatttttttttgacggagcgggtatgtgatttttatgcaacggattggtcaaagccttcgcatgccaatagaatagctagcgcatccttgcatgtgaagcaataaaggccgagtttagttctaaactttttcttcaaacttccaacttttccatcacatcaaaactttcctacacatataaatttccaacttttctatcacatcgttccaattttaaacaaacttctaattttggcgtgaactaaacacacccaaatccgcattgccgaaatctgcatacaaaactagacgcgacaggtaaataggctgatcaattttgaatgttttgtttttttaacgctatgatcaaacatgaacagagagagtgttgatggtcgttatcgatcagtttcgaccgtcaatattaccaaaatagaggagaactagtaatgattgcaatgcatacatatgttagaataataatatttcactagtattaggtatactaacctcttgcagggaatgatactaaagtggaggagaatcgacatcaacatagacgataaatcaatcagacgatgtcgataatcagacttatgaatgaaagggccaagaacgcagaattgacacgatgaattaggacaaaattcacaagtctacgaagtgaagcaacggaggaggccaccagccgaaattgggctagattgggccggccccaggttcggccgaacctccctcgcctccgttggatccaggttttggctggacggttgatataaagccccaatgacggttggagggtattaccgaccattccaaccgtcacaatcgtcatagttcagctataaaaggacttcaccttctcatttcactcacacaactcaagcaatagctctctcatttctctcaagtttagtttagtagtatctagctggtggaataggaatagagtagaaatcaggagtccgaaagccgtcggaagagttcgggtatggctctagcagctttcttttcctcttttgtaagctttgtacttttattagaatactcttctaaatacatttatggtattggaatactttctaagtatatgagtacctactttatattatgttcatgttatattgaatatacggctagcttatctgggagatgctttggtgcgagtatagtgtttgcttatgcaattactctatgtcatgacgatgatattagagtagtatctggtagtttagacgtggtgtctagattacgggatatcattatttggggttatatattgcggatgagaggtgggtcacttttggtgacagctcagtacgggtattcctccgcgccggtatataatcctaagttaattccctggggagggtattcctccgtatttagccctggtcgtatggtcatgacggactgtcgtaaggaactcggcagtcaggggtggcttctcgaagtaccaggagggcatcggatagagggtattagctagtatatcagttaactagaatgtatgtatactatgtatattagaagtataggattagattttctttctcttttcttttccacttagctcagataatatattatgagaatgagtagtaatgcttgtgtgtcactctacccttagattatcttaacccctgcttaggatataattatcacatgtaatatataaattattagttgatttctctctacatgatcttccacgggataaaataaatacgatacccttggaatactctcgggtgaaatgctacaatggtatatccgtgcgcttgcagatgaactctgtaaccataatataccaggagtatttctatgccatttctagggattatatttctagtaatgtcgttaagaaataccaacagggagtataatcttgaaaactgaatttatttgatttatttaaaacattttatatataatgtttttgcacgaaacacatcgtctaggaatttaggaagcatgcccttataaaaactgaggaaatagaatagctactaagtagctgaatcaaactcagcctcaatgtcagtaaggcaattgctctgacaccctacaaattgttgttttagaaggtagaagaaaaatatgcatgtaaaatatagagagttggattggcatctgtataccaatataacataaaaaaaatggactagttttactaaaactggccatctatcatgcaaaccgtcaagtcatccattgtattagacgatgaatgcacatatttaaggccctatttagatcacacctcaaaatttttcaccctatcacatcgaacatttgaacacctatatatattattaaattttaggcttaaaaaataactaattgcacagattacgactaatttgtgagacgaatcttttaagcctaattgctccatgatttaataatgtggtgctaaaataaacatttgctaatgacggattaattaggtttaataaattcgtctcgtgatttactgacggattctgtaataagttttttttggtagtgtccgaacaccccattcgacaccctatataatacccgatatgacacgctaaaactttacacccctggatctaattaaacaccccctaagtataaatattgtgttgatgtagtaagcccacgtattctttgctaatagtataaataacatgcatcttttaatagttaattggctaaatagttaaatgattttgtgataactatccatagtacaatgaagcgaattaactcagagtaaatttcataaaccacgttttatagtcaaagtttcgtaaaaccacgggtattataatttttggcacataactacaagttttatgatgtaaatgttttataaagctccacttttattaaaatttcaaattttcaattaattttagtatatctaaaatattttttttaaatagcgaagagttaaaccgataatcaataactaaaagtttcatatacattctatgctttaaaattttaaataaatatttatcaaatatatataggagtctggctttgtgaaactttaaaaccataatagttgagattatgtgtcatcggtcataatgtgtggtgttttatactactttaaccataaaacgtgagatttgctgatttttttctcattagcttattatgaaatcgaaaaataaattaaaatattattttaaaaaataatatatatttttattaaaaaatcgtttataagcttggaatgcatgccggtgaattaaacagtcattataaaaaaaagcacacccgagtgtgttctatgtataaatgggggatgggatacatagctcacggtcttgtcaggtttttctagtttcgatagattccatgctgattgttgcagctgctgactggattctttctcttaccctgcctatcacattatccaaatccatcgattctgctagctactgggagaagtcccacagggttagttgcatcatcacgtcaagcatagcagataaacaatggtatgatattggatttatccctctgatgattttatatctgcaaattaagaggtcgtttgagtaacctcatggctcacctttgtgtgcacctttctaaaatctcccattttccatcgttcttttgatgttgcaattgtctttcgtttcgggttatgcgtacatgtgcacggttggtaagaaacaattcggaatgagcacaaagaaaagggaataaggccatagctagctaaatagaaaaattggcatgattgtatgaattaaagacgtacacacaccatcatgtacgcatatgtaattaagtacacgtatataagtacggctccttaacacagaccgaaatgggggcataaatcaaagacaatgaaattcgatggtgaaagccatatctgattaatgagagaacagattcgccatggccacaagcacgcattagtaacagggaacaatttggttccagaagatcatcatttcgtccaccttttcagaatccatttgccgactcaaattgccaagcttaattaattatgccaaagaatcatcgcactataccattaccatcaatcatgcaagggagagagaagaggtggaatcgagcgcaacaatatagtacgatatgctacatgcggccgcatctgtcaaactgtcaatgtgtcattatattgtgtgtgggcttgaagcaggaaagctaccgaagcactgcacagagtcacacaccgtcgatccagtggagactcagaagagcgagacacacgatccacggcttaaatcttatcttagctaaagctacgctttggtaacagctgaggctactccgaaatctgaagaatctgcactgcagcagtgcattgcatatgcttggccatggagatggccagggccagggccaggcagcccgacagattaacagcacgggggggccgggccatacgtactgcgtactctgaatttcacgaaaaagcaagcaacagacagcacaaaagtcccaaagttagggaagaaaacaaatccatgtgaccatgcggtttccgctctcttttatctccctttcccttggtttaattacccgtaagccatcgcttaaccacacaaacaacaatacttcgtctcacatttctctctttcttttatattgattttcttgctctttccgggcttaattaagcttgcacgcaccaaccgtccctctttcgctcacactcttccttccactctcccaatactcactcactctctctaagtttttgtgtataaatatgtacacgtcgttgtagtggctctgtgctcgctagcttcgtcatctaccactgcaatttacacgacggccatgatgaggctgctgctggtggcggtggcggtggcgatggcggcggtggttgtggcggcggaggagagggcgacgtacatcgtccacatggcgaagtcggcgatgccggcggagtacggggacgaccacggcgagtggtacggcgcgtcgctgcgctccgtgtccggcgccgggaagatgctgtacgcgtacgacaccgtgctccacggcttctccgcgcggctcaccgcgcgggaggcgcgcgacatggcggccatggacggggtgctcgccgtcaacccggaggcgaggtacgagctgcacaccacgcggacgccggagttcctggggatcgccgggaacgacgggctgttcccgcagtccggcacggcgggggacgtcgtcgtcggggtgctcgacaccggggtgtggccggagagcaggagctacgacgacgcgggcctcggcgaggtgccgtcgtggtggaagggggagtgcatggccgggacggggttcaactcctccgcctgcaaccggaagctcgtcggcgcgcggttcttcaaccgtgggtacgaggcggcgatggggcccatggacaccaccagggagtcgcgctccccgcgcgacgacgacggacacggcacgcacacgtcgtccacggccgccggcgccgccgtctccggcgccagcctgctggggttcgcgtccggcacggcgcgcggcatggcgcccagggcgcgcgtcgccgtgtacaaggtgtgctggctcggcggctgcttcagctccgacatcctcgccgggatggacgccgccgtcgccgacgggtgcggcgtgctctcgctctcgctcggtggcggcgccgccgactacgcgcgcgacagcgtcgcgatcggcgcgttcgcggcgatggagcagaacgtcctggtgtcctgctccgcggggaacgccgggcccggcacgtccacgctgtcgaacgtggcgccatggatcaccaccgtgggcgcggggacgctcgaccgcgacttcccggcgtacgtctcgcttggcaacggcaagaactacaccggcgtctccctctacgccgggaaggccctcccctccaccccgctccccatcgtctacgccgccaacgcctccaactccacggcgggcaacctctgcatgccagggacgctcacgccggagaaggtggccggcaagatcgtcgtctgcgaccgcggcgtcagcgcgcgggtccagaagggcttcgtcgtgcgcgacgccggcggcgcgggcatggtgctctccaacaccgccaccaacggcgaggagctcgtcgccgacgcgcacctcctccccgccgcgggcgtgggcgcgaaggaaggcgccgcaataaaggcgtacgtggcctccgacccgagccccacggccacca

SEQ ID NO: 45006 - DNA, 12398 bp, Oryza sativa
gaggagcgcgcacccggagtggagccccgccgccgtgcggtcggcgctcatgaccaccgcctactccacctacgccggcgccggcgacgccaacccgctcctcgacgcggcgaccggcgcgcccgccacgccgttcgactacggcgccggccacgtcgacccggccagcgccgtcgacccgggactcgtctacgacctcggcaccgccgactacgtcgacttcctctgcgcgctcaactacacgtccaccatgatcgccgccgtggcgcggagcaagagctacggctgcacggagggcaaggcctactccgtgtacaacctcaactacccgtccttcgccgtggcgtactcgacggcgagcagccaggcggcggagagctccggcgcggcggcgacgacggtgacgcacaggcgcacgctcaccaacgtcggcgcggcggggacgtacaaggtgagcgcggccgccatgcctggcgtggccgtggccgtggagccgaccgagctggcgttcacgtcggccggcgagaagaagagctacacggtgagcttcacggcgaagtcgcagccgtcgggcaccgccggattcggccgcctcgtctggtcggacggcaagcacagcgtggcgagcccgatggcatttacgtggacatgatgagcgccgccaagtcagagtggtcaccacacacacacgcacactaccacggttaaagggctggagtgtaaaaaaaatatttgggtggatttgggagggggtttaaaaatttggtggtatttcgaagtgttcataatgctattaatcttaaagtttagatggtgatttttgagagtgaatgttgatgggaggtcttgggtgatgggttggatggatgttgctttcttggaatcaaattattagagttaggttggaatcttggggctcttggctagctaagattggggccagggcagggctggaccagattgcaacttttgcaagggcagctacacactttcactgtaacaagaggaaacttgttggggggggggggggggggctaaaacataaatgtcctcaacaagttcccagcaaaatgtttcacctaaattattctttgttcaatggcatttcctggagtgttaaaaggtgattttgcttgtgtgatgattgtttttttcttatgggctgctagttactctcagcaaaattactacacatctacatcaaatacatcaatgatgtaatgcagtggacagcacgatgtaatggtgcctttggggcgaagcttttgtgacgaatttcaactcaagtggattgaaacaggatccatgctgtgcgtaatcgcactagaaactctttgctgtttgtcgcgtccacgatgttttcttggctgttatttatttgagcttgtacgacccatgacgtatgcttgcataatataaaaagcatgtcatacatgtgtttgtgtactcctatatacatgtattttttttatacttatctgtactgcatattttttttcatattttggccaagaatcatgaatatatgcatggatttgccctgaagagtacaatcatagtatcctaaatctattagattttataatattattctaatacaaaattgactatcaaagttttaaaaggtctgataatatattgtactactaaatataaacactaagtaattatataaacattaaatacccctataaatcatttgttgtcacgcttttccttacaacttaactttgtactccctccgtcccataatgaggtatgtccagattcgtagttctagaatgggtctcatcccattctagattgcaacattacgggacggagggagtatataattaacgctcccacaagtcaatttctcttccatatttcccttcaatatctcgtgccctagtaaatctccaacatggcatcctacacaggaaatttgccttaaatatttcgattgatcgatatctcaatctgtttacatgagctcttggtttccagttttttgatatagagacatcgtctcattggaatcggagcagatgaacggcgccggtaggaggcacggccaacacaaggccttcagcagtagtggcagcaccaatttggcatccttaacacctcagctgcggcgacaagtgactaccatcacatttcatcaagatatggattaggaagatactcgtagatgtggtgtgtttctctgatcttagccttttgtattgacgcacttccagcgatcaacgttgaacgcttactagctactctctccgtcccacaatataagggattttgagttttcacttaaaacgtttgaccactcgtcttattcatttttttttgcaaatataaaaaatgaaaagttatgcttaaagtacggtagataataaagtaagtcacaaataaaataaataataattttaaaattttttgaataagacgagtttcaaacgttacgtaaaaacttaaaatctcttatattataggacggagggagtagtaggtatgagaagtttgagtcagccataagaaatcaaaagaaacaaagagggaagtggggtgatggaagagaaattgacttgtgatgagtgttttgtatatatagagttaagttgcagggggaaagtggagaaaacaagtcacttgcagggatactgggatcgattgcttattattttatagcctatctctagaataaataaagtagaggactaatgggggataagtttgacactcgtgtgcgtgctagctctagcacattctaacacacatggttggagtgtttggtaggaaaaaaatatacaaataaatcagaggtaaattcttttggaccttgtatagtcgtactcttaatttgagtccaaatttgtcccatgaattaagaaaactagctacaaattgggtagggagagaaacgtcaaggaaaaacattgttcaaaccttaaaagaaaatatgtctggctgccagaccttgacctgctaataaacggcggcatgacagtcgacctcatggatcaactcatcaccatatggaatgttgtgcaacaggttcattttgccgaaggaaaggaagaccagataacatggaaactcataaatcacggtgaatacttggcagcctccacctaaaatgcccaattctttggctcggtccaaataaagttcgagatgctaatatggaagccatgcatgggcactgaagaaatgcaagtcctttacatggctagttatgcaaaacaaagtatggatatttgcctaacaacaccttttgctcgctatgccggcatgaacatgagacatcctactaggctaccacctcctcgccagttgtaggaaaggatatggaattatggagcatgcttgctgcctggacagcattcaggtcactagacccgtcatcttggaagacgagaatgcatgaccgtgcacgagtggtgggaagggccgtcaaatgtggaaggagtgcctaagcaagtgctaatattgtccttacctcgtgggagatctagaaagagagaagccaaatagttttccaacataaataactctcaacgctagctatcatagcaaaaattaaagaagagacaagaacttgaacttggacactggcagtggcaaggtgattatcctggactaccttaggcgctcatctcttcctttcttctgtagaaaagtctttattaccatatgtgtataaattttactttatctttattcaccgaaattggcgctagcttgttcggataaaaaaaggccttattaaataattttcataattttaaaacctgacaaacaataccatatactccgctactctgtcgtatcaacgtcaataattttcattggcatgacccttattaaatatttgggatcatttgatatggacttaatcaaatgacatccacaagaaaaatgtgttgttttttccagctttaaacattaaaagcaaatgtgaattcgggaagtgtttgttgactgaaaatactagcattatcctaaattaaagcaccataaagtatcaatttggaagcacaatatgcaagaaagagtaacttaacgtggaagtaaacaatgagatggtgtggcattaaagatgcaggaagtctataccaatgtctcagagcatggaagaagataataaacgagtcgtcttaaagcacagccattcctaagatagagggaaagcaggaggggagggagagagagagacatctcttgatgaacagacatcttggacgcaacttaccatacaatatatgtacacatcatattcgttttattagatgacacatgactcatgagacatattattgcaataattctttcagtacaatccatatataatgagaagcacaatagagacagaaattatccaagctaatattgtacatgcttttaaagcctgtacagtgcaccttaaacgtatggcaatttaattatatttaatttttctatcactagatgcagtctatcagcaatcatgtcttccctaattaagtgcatcattaaacaagctgtgtaaggtaaagagaggcaggagcagagcaggccagtgaggctatgaaaagaaggcgaataaaagccggaccgctggttcaggtggtgagaaagcaggcaacccaaaaaaaaaagattaaaaccaattaatggcactgtgacagtggtcactttaataaaagcctaaagtgtgcagcatcctcgtgacatttgccgcttaaacaacagagagcgatgagtaaagaagacagagtcagagagaaaaaaaataaagatttgctagtagaaagatggatggatacgacgaataaagcaaagcaggggaaaacaattgttcgtcgtcacgatcttgtgcttggaatcgatagacatgcatggccccgtgattttaacaaataatgcagggctttgatagatccccagctggaccagtgtttgttgtgccttttgatagccttctagagaggccaagttctttttaagatcagggggttaattgtttgttgggatgaaccagaaatgtgggcgatggtgttgtttaactatgaacaaaaatctattcattgtattattcaggttactaagagaagtctgaatatttgctgttgaagtgaagaaattaccgcattactttattcttctttcaaaaaaactagtggtggacgtgggcggtgaatttccccctacacccacaaactccctaccgtttttaacgataaaaaaaaagtgcctgggtcaaaggcttcacttatcagatcaaaggtataaacataaattaaagagatgtatgtatataagtgatagtaaaatggattgatgacattctacttttttttttgcaacacataggtaatatgatagttaaggggaaaaaattaatgagaaaaagttgttccatcgatcgtatatggttttggtctaggctatatcacgtagatgctacatatggatgcaaaagcaaaacaaaattttatttttaaaacaaaagtataggtcgtatatcagaaacatttgtattttcaactgttaagcttcacataatttaccccagcggctttgagtttggaagagagttaataattgtcaaaatgtcaagcccacatgcacatatattcccactttgttactaaatctctttctccaaagtcgcaatgagcatccactcaaagcatggggtacaagtgatgagaaaaaaaagggtgaggagattatgtttgaagcatgtgacaagggcacgacttaagccatgacatttaaattctagtactatattcactcacacgctaatatatattttacgagtattataacattcagaaatctatttgtcgatcactcaacctcgttaaatgcctcctgaacttttacaaatgtggtgtttacgtgtggtggtgacgtggtatgtatgtacgtccatattcagttctatttagtagatgagaaaaaaaaggcgagcagattattttaatgtaactctgttttcaacgaacttttaaggtaacacttttatgttgcaaagaggctaatggtagaagaatagcaagagaactagactcaaaagtatacctgtagagcatttcggccccatcataattttcagactgcatatgagcccaggcaaggttacccaacaaccttcaagacaaataagagcatcagaatgatatgtttactggttgaataacaatgtatgaaagattttaaataccatgctttttcatccctgagagacaaataaactactcttccatgagatttagacaacttagttttccaccggccagaagctagctcctcatcaacaaatatcaacttcaatgtcagcatttcaatctgctcttttgtcctgtcgcatttctggtttcacattaaaatgactagtatcagaacagaaatggtcacatcttcatctaaaattaacatgtcatcagtgcagcaatttagatgtgtttaggatctactgctatagacctaccaaatcacagaatttctttacaatagaaagatttagctcgtaggttcttggtttacaggccaatataccttgtataggtcaagaagaatattgtcaagagatttctaagcttcatttgggcaacgatcatgaaaggatcttattgcctcaatagcctcttcagctcaatttgcttgtttcagtacagtagccatatccttcagtgcgctctcaattcgatcaccactgtttatagccgcccagaacaatggaactgccttgtttgggtccttttcaatcacctgcagataaaacaagacgagaaaacaaaaacctcacagatctagcttatgaaaatttctagattcaggattattacatgcattttcgttcacaagactgaaagagctatagaaaaagaaacgccgtcactttgcaaaaatgcaagtaacatgtactgaattatttagcatgaatatgttgaagcaacacttaagggaaaaattaatacccactacagttactagttagaatagcatgcatagtggcaacccaagtagtgtggctggtgtctattcaatcttttttgagatggtctgttcaatcttttggtacaatagatttctggtaacaagggaacctagtcatgagaacacaacttccatgtcactttaagatttacactaatactggttttgttaaagaagcccagaagtagttttgtctgttcatggaaactaccttcgtattctctcttctggttcaattaaaagtgttttttttttttttgaaaacagagaagcagagcttcccctttccattactggaaacacgttcagattacagagttctagaaagcagaaactaagcaaaatgctaataagcaagaaaagcttcacaccaaaacgatgccaatcccatcgctttttgtaaagtttttgccccaggatatcctaaattcatttcaaacatatcatgaatcaatggaagatactgtaagtctgtaactaaaaaaagccacaaaatgcttttgcccttcctgctcccttacaaactactcattagctaaattaatctagcacacacagtcaacatactgagaatgcttaagtcaccgaatttgcagcctatctatctccagagtaaacgaaattgcatcgtccacatgatgggttgcttccaattacctgagcctgcttcgcccgcacgtagggcgaatccaccgacgacggcggcgccctaggtggccgggaacacccgccgctcgtcggcggcgtgacgcggtagccgtaacacccgccaccgccgctcgctgggggcgtcacgtgggacaagcacccgacgctcaccgggcggcgtggcgcccgcaggtgtgcaggggctccacctcggcgcggcccccctcggcgacatccacggcggcagccgcctccctccactcggcattgcggaattccgtcaaacacctggcacgcacacaccaaaatccaccaaaacgaaccagatcaaacataaccaaattaaccccgcatgcggcgtcccccacctcgatcgagaagacgagaacccgccgcctcctccgccgcgctgtgctcgggctcgacgcggatcacgccgccgcggagtcgaagcgagtgggagggtgacgcgaggacggaacggcggcgcgcgcggggaaggaggatttcaaacggggaggttggggcgatgacgtggactgggaggtgggccccacggatgcctacgtggacgtcgtgtcacgggtttcggatgaaacggcagagtaggtgcaggtgcagctcatgtggctcctgtgatgtgagattgcgtttgtgtgaaccacgcatacaatgtgttgcttctggcttattattgataactttgtgtgtgaaaaaacacaaaacaaatgtgctacttactgcatgcattttcaaattggaatttcttaacttactgcgtgcatttccaaagtgaaatttcttaacttactgcgtgcatttccaaattggaatttgtttttgtttgaaattgctgtgtacatggtgactgaataaggtgcgaaagaatctgacaaatgaggcacgaagaaaagaatctgcttttccgttatctgaaaatatatgtgggttgtagcttctgttgaagcaaagaccgggtttaatatccattatctagagatgcatttgatagtgcaatggtaaaggatatatggttccaaccctaaggtctcgtgttcaattctcaacacgctcacaatttcttattaagtaattgtttggatatatacatgcaatatgtgttataatgtacaatattttgaaacatatcatatactaataataatgaaagagtgaaaaaagtagtgatgacctcatgttctattaaaaattactagtaatatgcccgtgctaaacgctacggtgcaactctatttttctttaataatttttaaaattttcatgttagcaaaaaaaaaatattatatgaactgtgcatttgagttttaattcaatttatgtcatacatcaaatatatttcgcgtaaagtataataatatgaaataccaattcatgcagatatataatgcatatatctataccccatgttataatacataattatatgatattaaagatatatgataatgtgtatatctatgccttaagtcatattgcataataatatgatatataatgcatatatccaagacacgcaaaataattcacaatagcattgatatcaatatttactcatctcacaagcgttctttttgtatgtagcgtgcgtgtgtgtatatatttgcgtaattataatgcctcacaagtgggtggtagtttttatataatatagtgcattttcatattataattatttttatattacatgcccatgctaatgctatgaggtggtatttgatagctcaaaatgaaaaggatataacaccacaatgactttaaacttttgatattttaaaggcattacatttccacatagaacggatgttattaaggttgaagaaaaaaacataaatagttactccagtgacaatcacgtggtaccgtatatgtttctcctgacgtgctatacaaaatgaaatgataattgtcagcaggattcaaatttttaatttatttttctaaaacatgaatgtaaaccatgaatattgaaatgatcttttacaacaaaacttaaaagcatgtgttattacccgtcattgttcaccaatccagaacatctttatacacgatatttcttgtgctccttcttgtggggtccaccttttttttaaggctttgccaaaatctttgtcgttttccttgacacccctcttgataatgcaacataaagctgcccttgcgagaatacaggctctagaaaatagataccgacatgtgttaattttataatatggtcccaatggccccatcctccttttattcagcatcaatgctcgagacactaatgtgaagggacaataacaatgcacattttagtgctctacatttcggacaacttaatgtttattaaaaattaacttgctctgtacctcctctcggtggcggagggaatttgggttggctgtggtggcgcttgaggcggaggaggtggcaacaacgtgttggcggagcagaccggcgagggatgcaatggagttgcggtgcggagatcagattggcgacgatatgcaccagaatccgagcgatggcgatctggcggcgtggagatggagatgaggggcgagatcgatctggactggatccctattggtaattgcaaggtgcaaaataataattaatattctagggatcagagaatcaagagaataatttaataattactaactggaaaatagctcaatttggaaaatatctcaatttggagcagtacatgtacagccaaaataacccatgcatggagttcccctagtcattcatgagtagtacacaatgcgcagctaatatatatagttccaaatggacccgtgctaacgctacggtgacatttaaaatcaagtaataaaaaaaggcgtatcctccaacaatcaggatgacaagacatgttaggacaaccgaaaattaaccatgacacgttccataatagtaatcattccataattcataatagatgcacaagcaatttaatttgtaaaactctttttcacatcgtaagtgcccagataaaattaatgtggcaccaaatgaaaactattaaacatagttatgagccaatggcattaaatacacgatttcctccactgcatttacactcctgtcactatgtttaaactcaggactaaaagaataactcaagagcagattcaaccacgtgaatgatgggtacaaataactctcctatcaccaaacacatattatatttaaatgttataatacaccacaatatggttgtgcagcaaggtatcttctatactctcattactgaatcttgattattatctactgtacaaaaccatgtcaaatatatgagcaacaggttctgttgaagagctaattattagtaaacgatacatctgtgatgggtcctccctagtagcaatatattgaagaggatattttttcggcccgtcagagatgactcatctttgacgagttgtgttggcccgtcacagatgacccgtcactgaagcccggatccgtagtagtgctatttggtttcctgcacttcacactatctcaattcttatcacagtacttgggaacatcaatctccaattcagtttagtcttgaaaatagttttgcagtcgagtatgtcagtatttctaatatgatgctgctcgtaaattgaaccaatttcttaaatttgccaaattcagatttcttaaattgaaccaagccaaccctgcccatctgattaggtggacttctcatctgctggaatagatgtatcagttgatctcagtttggcagtaaccaaataaaccagaaaatgttgtaaaaagtacttagagtgaggataagagcatgtgcacaataattcagatgtttctagcaccacagaaatacaaataaacagtaccagagggacataatcaagcacaattcacatatatttgagagatgagatatataacttcatggaattgacacaagagaaggtttcttggactcaccttggagagagcggatagtaggacgatcctgatggagagcaacactgatagggaaggtagaattttgctttggtatatatttagctcagtatctacctaaatgaaatgaaacaaaatcagcgagggagttttaaaaataaaataccgctgacctcctaaatgcagtaatcacagctacagcaaaaccaacttcattcagcttggatgttttcattagtaaaatcacaactcagacactaccgcaaaaaaaagataagaaccaatgttgaaatccaatcatcagaagaacaaaaacgatggagtatagtataacagtggaagtacagtaaatatatatgcttaattctctgatcccatacttcccctattgtcacatcaataccgtacacttgatgatttgaaattcgaatcgtcatatactgctatacatgtggcaaatgtgaaaaaataactgaaagatcaaaaatctgattttggagatcttaacaaatgtaaattgtctaaaataccctagaaagaaaaagatgctcccacaatcacatggtcactcattgaaagtcacaatctgattaggtggacttataatgtactgcaatagatgtatcagttgatctcagtttggcagaaaccaaataaatcacaaaatgttgtagaaagtacttaaaatgaagataagatcatgtccacaataatttagatgtttctaggaccacacaaatacaaataaacagtaccagaggcacataatcaagcacagttcacatatatttgagagatgagatacataactgaatggaattgacacaagaggaggtttccaggactcacct

SEQ ID NO: 45007 - DNA, 16459 bp, Oryza sativa
acctccccgttccaccccacggttgatctcacctccatccccgccaccaccgagttccccgccgccaccagcccttccccaaacccaccgccgcccatggagctcccttcgccttcctccccttcattgccggtgccgcaccgctgcgcctggctgcgccgctccctcctctctcgccggcagccggccaccgcgtgccgctgcctctccgtcgccgggagagaggagaggagagatagatgaagaggggagatgtggagagaggaggaagaagaggagggtgagttggactgacatgtggggcccacatggatcccactatttttttattattttatgtgtgagactgacatgtggggccacatgggtcccacaactttttttattattttgtatgtgagaccgacatgtgggtcccgaggattttattatttttccggctcgaattgccacgtaagcgccacgtcagtaccacgtcagatgaagaccgagtcaaattagccacgtaggcgccacgtcagccaaaaccgccctcaaaaccgtcgagggacctaatctgcactggttttgatagttgagggacttgttgtgtctggttttctggttgagggacgaaaatcggattcgttgataagttaagggacctcaaatgaacttattccttttcctggcagcatgctggcctgggcctgagtttgaatcctttgaatgtaggttttctcaccattttctagccttaaatttagagttgattttgagattttttcatcatactttatttttcagtctttacttttagatcgctaagaacacacatataaaagttttatttaccaattttttttcgtttgcaactatgtcgtttcgcttattccgtcaataaacgaaacgatggcctcgagacatttttttacttgaaggcacatgcacgaatctttaaataataacgaatctttaaataataacgctgtcagcaaatcgacttatttttaacgaaaatttcaacagatatatagcaattcaaatgtgacggttaggcaacgatatgttgcatatgcttgttcaaactcagcttgatccaagaaagtccaaaaactttgagaaggccagagaaagcctcaagaaacctaagggcatgttcaatacgtgcccctggagagtatccctagcccttcgtcgacggccgtttgctttttcgtccgcggcgtcccccgcaatggaacgtatccctctgctgggggacgagactctcttcgtgcctcgccagcttttcgtggggagtcacagccaggcgccgcgttgagcatgtgtggagctcgtgggcacggcgtcgttcccccaaattttcctttgcaccctcgcctcactctcgctctcccctcggtctcattgtgccgcgcctccttctctgcctcgccatccgccgtcactggggtcggagccagatgcatctcccccgctagatccatccgcaccgccaccaaccgatgcgcccaatgagcttgacgaggagctgcggggttgaggggtcggcgccgcgcccaccattgctggcaccgccatcgtctccatcccaatctggccgcgggaggaccaaatccgctagctttggcgctagatctgctgccctcggctggcgacggcgtgaggcggaggaggccgggaaggacaacgacaacagagagagggagagagagcggtggagctcgcccgccatcagtcaaccacgctcgccgtcggccaccccgcgcatcgcttgccgtccgccaccgcgctcggcaccggcgaggtggatggtgatgagcggcggggaagagagggggagatcgacgacgaatggtggcaggagagagagagaggcctaggagagactgacggatctggtgaggcaccggtgagacggacggcgacgagcggcggtgggctggcgacggcgtggagtagagagggagaaatcaacggagtggaggagaggagacgagaagagacgaggagaggggaggaagaaaagaggagcacgccggtgggctgatgggcaagcagggaggggtactttcagaacttttcacttaggactaccttgggccgggacacccattgtgggctaaagtatcttcatcaaatggcctcagattttgaagaactcattaggggtgtcctctattgagagatgagtttcctaaatagtgtctttagttagtgagggcactttaggagtggctttggttgtataaccttaataaagcctggcctagaccaagaaaggcaagcttttttatgtcaattcaaacctacattttctggttccctcatctcttggccttagccaaatagaatcaatttagtcctaaattcaggtatatcagctcctctaaatattaaaaccagtacaaaacgactctctcggtgtcaagctctccaccactagcccgcaattctgcatgggcatcgaactcggctcctcatggaaccctgccacggctccgtccgggcgtccccgccgggcggccgccgggacgaccccacgcccgcgcctaagctgctccgggagatgcagccggcgctcaagcccatcgaacggttccggtggtcgcgtgcgcctattgcggcggtgcacggcggtgcaggccggcggcgtcgagatcgtggccgcctgcgacatgcagtgctgctctccaaggacactacgtttgtgctcaaggtggtagacatggccatcgatcgtcgccgtcgtcggcctccaatggcgggaaagcttggctgtacaagacggccccgagctagccggctagtgcacggatatataacttctcccagttcttcacctgcttaaccatgtgttgcacaccatgtgctcgagcacgctggcgatcgatgctcctgaaccggatggatgtcaagtgaaaaaggattgcttcgtttggtcgcgtctccgtatagaaatggcaattttcggttcactcggtgtatgatgcgattgtgaactctagtgtgacggtccgcaagaggatctcttatataggaggttgaaggtgccactgaaaatcatagtatttatctagttgtttcatatcaaaataattctaacaaaggataaccttgcgaaaaagagttgcgaggtgataagcaatgttgttttttagtgtgcaagagacaaccaacccatattctttgaatataacatagcacgtttttctcggggatgtgtattctttgctttcaatattactagttgtggagattatggataccccatatcaacataacagttataatttagtcggatatacggtaccaaatatagatagaatatctttatgaggactcgggttagtttctaacttgtatgtcaaggaaatacccgagatcttagtcggttacgattgtattttatttgtaatcgcatattccgttagggatatggactgtattttgtaatacggatcccttcccctatataaggaggggtctgggttcctctcgggacgattctctttttcccaaatcatacgatcaataacatactcggcggaatcatccccggacaggagtagggtattacttcttgaataagaaggcctgaacctgtataaaattccttgtctccaaacccatccacttttctagcttgatagccacccccttttagtattgtcgaaatcttgtttcgacagttggcgcgccaggtaggggtagcatcaagttcttcgccgattagtgcgatgggttccctctccggcatcgacgacctcgtcttccccccgggcaggcgtttcggttcagcagcctcgacttcatcaccaacgacttcggcaagatctctctcctcgactcggatccaaaccagtcgggagagaaccaggtttcagccccattcggtattccgaactcggccaagatctgctccaagcttatctcgatcgagttggcttcaaaccactcgaacgagatccaatatacttcaacttcaccagatcaaaatgatggggcctacccgccaatcctgatgaaactccacgacgatttggctgccgtcttcactacaagggcgtcttctccccgtaggcctaggcggaagtcggcctcaacaccgatcccgcctagctccagggaagtcggcgtcatactccagccactcagcacgatttcgacggatcaactcgaagtctaccttagctcccccggcgtcgactcacgaccaatagagatcgtggaatacgacgaattcggctaccgctatgacaaccacaacctcgatgacttcgacgagagctttgaagacaattacacccctctctacttcggcgtcttcatggccgacaacgagacggaagaacaacgccaagcccgagaagcagaagcacgtgtacagtaggaagccgagcgacgccgactggaagaggagcgccaagcgcaagaacaagaacggctgcggtgagagcaacaagaacacgaacgggctgcaaaggaggccgaagaccgacgacaacgagccttggacgcagggcaacaagcacgagatcttatcgggcaacaagacgttgaggggacagcggtcttccgcaccccccaacagaacgccgtcgccgcgatcacccttctcgacaccctcctcaaggaagacgcactcaaccaagccgatcacgtcgtcaacattttgaaccagaccaagaccatgatcgccgcttcagttccggttaactccggcagcgttcgcacgccgactggtagccgggttccctatctccgatctcatgattatcatcagccaagcctcagcatcatcggcacaggatccaatcgcaggagcaggggccacgacgaacgatctgttcactcgcgtcccgaacgtcacagggaacgccgagtcgaacggcctcgctctccacctcgccagcgtcccgtcgatcttcgcgacatgatcaaccagcgccgtgcagcatgaggtcaccgccattcaccagatcgctacgacgacgacgtggatggagtagctgccttcactaatgacctgcgtcgagtggattggccagccggcttcaagccgactggaatcgagaagtatgatggcaccactaatccggagtcttggctcaccgtctatggactcgcaatccgcgcagcaggaggagacagcaaagccatggcaaactatctacctgtggccctagcggattccgcccgatcctggctccatggactaccccgtggcacgatcggatcatgggcggaacttcatgatcacttcatcgccaacttccagggcaccttcgaacgccccggcacacagtttgatctctacaacgtcattcagaagactggaaaatcccttcgagattacatccgatgcttctccgagcagcgcaacaagatctccgacatcaccgacgacgtcatcattgctgcctttactaaaggcattcaccacgaggacctagtcggcaagttcagacgcaaatctcccaagacggttaagcagatatttgaaaaagccaacgagtatgccaaagccgaagatgctattattgcgtccaaacagtcgggcaccacttggaaaccgaagaaagacatgccggccgcaggagagaggggaagtaacaatcgcaaggatcgcaagcgtaagcccgaagaacttgtggcgacaactactccatcttcccgacaacgttcccgcgtcaacaccttcgacaagataatgaactcccagtgtccgcatcatcccaactccaaccatgtggccaaagattgcttcgtctacaagcaatttgcggaacaatatgccaagaacgcacataagctttcagacggagatcaaggcacatcaaagaagaaagatgacgaagacgatgccccgactggttttcaggacttttgcaaggagcttaatcacatctttggcggacccctagcttacgaatctaagagaaagcagaaactaaccgaacgggagatcaacgcagttcagcccaacacgccccaataccttcgatggtcagagatagcaattaagttcgaccgctcggatcatcccgaccgagtggtccacccgggccggtaccccctggtactagacccagtggcttgcaacgtcaagctccgaagaaccctcatcgatggtggcagtgcgctcaacatccttttcgccaagaccctggacgatatgcagatccctcgtacggaattaaagccgagtaatgcaccctttcacggtgtcatcccaggattatctgctacaccactcggccagatcactcttccggttactttcagtactcgggagaattttcgcacagaaaacgtttgtttcgaagttgctgatttcgagacagcgtaacatgctatactcgaacgaccagccctagccaaattcatacctgtccacactacacctacatgatgatgaagatgcctggtccttgaggagtcatatccctacggagcgacatcaagcaagccgtcacatgtgataaagaaagttgcgagatggcccagacccgcgagatcacactcgcccaagaagagatccgactggctgcaaccatggcaagcgaaggagaagtgcccgcaaccaagatgcccaaaagcggagaaagcgatgccaagaccaaaaagattcctttagatccctctgatcctaataagattgctgtaataggcgctgagttagattgtaaataggaaagcgcgctcatcacctttcttcaaaataataaagatatctttgcatggaaaccatccgatatgcctggtattcctagagaggtgattgagcactctttacatgttaaggaagacgccaaactcatcaagcaacgactctgccgttttgcacaggacaggaaggatgcgatcatggaggaattaaccaagctgttagcagcgggcttcattaaagaagtcctttatcctgactggctggctaacccagtcctggttcggaaaaagacggggcaatgacgcatgtgtgtcgattataccgacctcaacaagtcttgtcccaaagatccttttgggttactcgcattgaccaggtagttgactcaacggccggctgcgagctactcagttttttggattgctactcgggatatcatcagatccgactaaaagaatccgactgcttgaagacctcatttattacgcctttcggggcctactgctacatcaccatgccctttggattgaagaacgcaggagcaacctaccaacgcatgattcagaggtgtttttcaactcagatcggccgcaatgttgaagcttatgttgatgatgtagtcgtcaagaccaggcagaaggatgatttgattacggatctcgaagaaactttcacgagcatccgcgctttcaggatgaaactaaaccctgacaaatgcgtcttcggagtaccgtcagggaagctgcttggatttatggtgtctcacagaggcatacaagccaacccggagaaagttaatgccatcctcaacatgaaactgccgagctctcagaaagatgtccagaagctgactggatgcatggcggcgctcagccggtttgtctcacgactcggtgagcgggggatgcctttctttaaactgttaaagaaaacagacaatttccagtggggacccgaagcacagaaagcctttgaagatttcaagaaacttctcactactccaccagttttggcctcgccacacccacaggagccgttgttactatatgtctcggccacccctcaggtcgtgagtgcggtcctggttgtcgagcgagaagaagaaggccatgttcagaaagtccagcgaccgatctacttcgttagtgaagttttggctgactccaagacaagatatcctcaagttcagaagctgttgtacggtgtcttgatcaccgtcaggaaattatcccactacttccaaggtcactcggtcacggtggttacatcgtttccactcggggatatacttcataaccgcgaggcaaatggacgaatcgcaaagtgggccttagaactgatgtcctttgatatatccttcaagccacgaacttcgatcaagtcccaagctttagccgactttgtcgccgagtagaccgagtgccaagaggacacgcccgaggaaaagatggagtattggactatgcactttgacgggtcgaagagactttcaggcactggagccggagttgttttaatttccccaactggagaaagactgagttatgtgctgtggatacatttttccgcatcacacaatgtggcggaatacgaggcgctccttcacggactacgaatcgcaatctctttgggcatctggcgactgatcgttcgtggagattcccagttggttgttaaccaagtcatgaaagagtggtcctgccttgacgataacatgactgcttatcgacaggaagtacgcaagttggaagacagattcgatggactcgaactcacccacgttcttcgacacaacaacgaggcagccgacagattggataatttcggttcaaagcgagaagcagctccttctgacgtattcgtcgaacatgtttatgagccgactgtaccaagtaaagaaataatcaaggctacggacacccaagatgtaagcatgattgaagccgactggagagagcccctcataagatttttaaccaaacaagaactccctccagataaagatgaagctgagcggatttccaggcgcagcagactttacattattcatgagactgagctgtacaagaaaagtccaacaggaatactgcagcgctgtgtgtctttggaggaagggagacaattgttgaaggatatacactctggtatttgtggtaatcatgctgccgcacggaccattgtcggcaaagcttaccggcaaggttttttttggcctacagctgtgtctgatgctgacaagattgtgcggacatgcgaaggttgtcaattttttgccagacaaattcatctgccagcccaagagttgcaaaccatcccgttgtcctagccgtttgcggtctaggggcttgacatggtcggcccgtttaaaagggcagtcggcggttacacgcatctctttgtggctatcgacaaattctccaagtggattgaagctaaaccggtcatcacgatcacagcagataaagctagagattttttcatcaacattgtgcatcggtttggggtacctaatcggattatcactgataatggcactcaattcactggaggagtgtttaaagatttttgtgaagattttggcatcaaaatttgctatgcctccgtagcgcaccctatgagtaatagacaggttgaacgagccaacggcatgctactccaaggaataaaggcatgagtttttgatcgattgaatccctatgccagcaaatgggtggaacagctgccatccatactctggtccttacgcaccactcccagtcgggctacaggccagtcgccgttcttcctggtttatggagcagaggcaatgttgcctagcaaggtagaatttgaatctttgcgtttccgcaactttcgtgaggagcgctatggagaagaccgagtagatgatctacaccgactggaagaggcccgtgaagcagccctaattcagtcggcccgatatttgcaagggttgcgtcgttatcataaccgtaacgtcttattacgagctttcttagtcggagacctggttttgaggaaaattcaaactacacaggatcgacacaagttatctcctttatgggaagggtcgtgtataatctctgaagtaacccggccaggttcttatcgactaaagcgtgaagacggtacacctgtcgacaattcttggaatatagaacatcttcgtcgtttttatgcctaagttcatttctctatttccctgttttgaccgacaacatcaagctttcccttgaagttatctgtcgggggctattatgataataatggagtgtgatttttatcaattcaatttgcttacttgatttatcattgccctgcttggtctttcaacttagtcaatgaggactgaaggtttttaatagcttttgcgggttttaggttcaataaggcttgacaaaggcttttaagaaatcagaagctaagtatggaataccaagcgtagcataaattcatcagtattgtacaaattgtgcctccatcatcattaatcatcaaaatcattgttatatcaaccagtatcagtcttttcatcatcagaattaccaggaccagtcggtcggagatcgatgtcctgaaatctttcaactacatcgattgctatcttatcggcagatttttgcgcaccactgatgaggtcaagagcagcttcttcgctcgtcccgtctgcaaagccatcaatggcatcaatgtcaactcttggataaagggatttggtcatcgccaacgccagacttgctcccatacttccagcttctttgatgttcttgaaatatgtatccggagcaactctcagcttgtcgaagatttcagaagcattaagtgtactcgagccattgttattgaagaacatcgcttgaacaagtggggtagcagcgttagcgacttcatcccgagctccttcaagttttttgatcttgccaaccaggacgtcgaattgagcccgcgacttgatcttgcggtctgcatcaacagattcacattaataagtcagcatatggaagataatggcttttgaggtattgattattggtaccttcaacctcctttaaagccaagtccctctgtcttgccagttctgccttgtcattttctagagtttgaatctacttctccagttgagatatcttggcagcttgcactacattaactctggttaatcaagattacaaagataacaacacaagttagttgggcagagcttgtgcgtaccttttgatgagccgctcagttcaaaattggattcctggagctcagcaatccgatccctcagatcatgttcattcttcctggcaagttcttttgtttcgtgcagttgattcctggtggcttcgagggttctgagatgagggactaacctctctaaggctgtcgttttagctttgttcctaagatgaatcctctacaagacagtttaattagcgcttgaactaaacaacagacgaaatggttgagatcaggcgccaaagagcttacatttacaatgcaggttgcctgaccaagtgcctttttcagtaggcataactcttcgtcctctttttgcttgtttattacgattccttgaggctgcatgttgtcatcctaccacttgactagaatgggagggcgcgaatcctcagctgctcgtatccggaggatttcttcttcctcaccaattattggccctagtgtatccatgaataaagatgaagcaatcaaataaagtctgttggatcgtaatgatttcagatagcgtgtttacctgtgatgattcccggtcggggacgagtagactcttgtgtcttcgcaggagatctgatttctgagtcattgccagcacccttcccgggaggactgtttgtttgagcttcaacctcgggaatcttttggcttggccctgtatccgattggtttccagtcgggggctcctggttaactccgactccagcttcggccgactggcttgcagtcgtgggttcgtcgctgggttctacattgtcgctggcttgcggattatcactcgggtgatcttttgcagacggcccggtttcttttgaggaatctgcttccaagttagttgggtcagagtctttctcagaaggatctatgtcagatggtttcctacaagttttgccatcagtgttattttcatgatgggagaatattgatacaaggaagattgttatatgatttgtacctggaagactttctgatttttgggaaaggacgactggaggttttcttcttcggattagttggcttcggaggttttccggtcgttcctttatctttgagctttccggtatcatcgccttcatcgtcacttggaaccagcttcctcttgcgagaatctgactggccgactggatcagaagcacttggttgggtttcagaccgaattcttggtcccccgcttccctgaccagtttggcggtgaggtgattggtgctgggcgattggaggatttgacttcatcaatgcgaactcctgagcataaatgtcgagcaattcaacaagagacgaaatcatgtttttgaggaaggttggaacgttagaatacataccggtggaggaggattgaatgcattgaacggtacgactggcagcaagtgtgaatagctgacaacgatagcatttgagaagatcttatacatcctttccttcatgaccttgaagtcaagagaatctggatcttcacggtttgggtcatgcttgccgtcaaattcgaaggctgtgcgagatctctctttgattggagctaaccgacacttgataaagtgctgggtgatctgttctccttgaaggccttgttcttttagctttatcatcctctccatcagttccactgcttgcgcagcttcatctcccattgccagtgagttccaagtatcccgataaactggaggaagacaggagtactcgggaagagcaggctcagggttttgaacataaaaccaatttgcgtgctagcctttgtttgaggttttgaagggcatagagaagtatttttggcttaaggttcccctgagttggaaaccagccccccccccccaacaacacatggtttgctcttgtttggctgaggcttaaggaaaaagatgcggtggaacaaggcgaaatgtggcctaatacctaaaaaggcttcacaggcatgaataaaattggcgatgtgaactatggagtttgggttcagatgatgcaggctaattccatagaaattcagaattccccgaaaaaatcttgaggttggaagggagaaaccgccatagaagaaatgagcaaataccacgacttcatgcgtatcgggggtcgggaatgcttcaccgaatgccggtcaccactcgatgatctccttcatcggaagaacgccatgcgccaccatctccttcagattatcttccgtcacatcggagggcgcccactgactctcgaagctttctctttcttccgccatgaatgtgaactggatggtttaatttggtccgagatatggctggaaagagatggagaatcggagcagtggacgtggggggaaatttcgtgaagtttttaaggatggattggagtggattgatgaaccctagttttgccggcacagttttgtactgtagcaggaaatggggaaaatggcgagagtctcggcggggaagacgaagagacgtttcattttacttcggtgttattagggtatcaggagtactaatgggcttgggcctaaacacagtatttcggcccaattttattttcagcatgacccgttgtgatccctagggatttaggcgctttttgctttggcaatttgtgctcacaatgatgtggcccaatgctgttaaaatccttttaatgcggtttgataattctttggaattaacacgatgcaaacaaaaggtgcccgacaggaaggtgttatactatttttgtaagccttatgaggttgcaaaagctgtttgggttgattcgagatgactaatttattaagggtcattctcttagcatgttatatgcttaatttggttatggtgagagtcatagcttaggctattagactcgttgattaccatgatttttatcatgtttgatggatcattttaagagtttcttactcggattcatatcaaatatgtctatttttggaccttttaagtgtttattactcggcccttttcctattttttatccttgatatgttcaagttgagaagaagtcggctgagtattttattgagtaccatgcatgcttcgttataaaaccactcggttcttgactacatgtttagtttttcaactaatcacatagtcaggggctacacctaagtaggtgcatctactcgatgcaccatgttttatttttgcccttcacagtcttttagcactcggcaagctagagcaagttaaattgaagcactcggattactgttttttgtttcgagaaggctattttgtcaactgcgaaggtctcgggggctactgtggagattatggataccccatatcaacatgacagttataatttagtcggatatacggtaccaaatatagatagaatatctttatgaggactcgggttagtttctaacttatatgtcaaggaaatacccgagatcttagtcggttacgattgtattttatctgtaatcgcatattccgttagggatatggactgtattttgtaatacggatcccttcccctatataaggaggggtccgggttcctctcgggatgattctctttttcccaaatcatacgatcaataacatactcggcggaatcatccccggacaggagtagggtattacttcttgaataagaaggcctggacctgtataaaattccttgtctccaaacccatccacttttctagcttgatagccaccccttttagtattgccgaaatcttgtttcgacactacttctcggagcgccaaaaatatatttggaaattggtttatgggagtgcccagcttaaacaaaatggttttatttgggggccagtagtctatgatcaatttggtattactgaaatgataatattttttataataaaggattggctaatctatacatattatcttcacatctaccagctagctccacatttgatctttgacgctatcataggagaagcagaatattatgcgcactagtgctactcttatatataattgataactagagtttttttttcatttttgatggcatagcccctataaaattacttgcaagaatatatactggaaaacacattttcacatacaacaaaaatgccttttctcatgcgggttcagtatgctccttgacctgagatatgggcgcgtgcacaacgactgccctctctgctgcttgtcgccaccttcgatcggtggccatcgccagcagatctgctgctaccgacagagacgtagccaggaaattttccttagtagtcctagttcgcacggtatgtcacgtggtaaaattttcttttgcaccataaaactgatatacaaatacaaatttagtgaaaatgtgatagaaataatatcttccaacatccataagcagcttacttaacaagcaagttcaaaatgtgcaaatattcacgtactcactaatctctagtcacaattcacaactcgatttaaccatttaggcagctattcgttaccttcacaactcgatttatccatttaggcagctattcgttacctgggctgagccacggaggggaggggacggcggcgcggtgcggcgtcagcgtggacggcggggaggccggagagaaggggactgtgcggacggcggcggtggcgccggcacggagacgcggagtggcggcctcgcggggaggggaggggacggcagtggcagcgctggcgtggagtcgcagaaggaggggaagggatggcgcaacgccggcgcggacagcgggggagccggccagccgagacggcgccggcgcggagtcgcggaggctagcagctggcggcatcgggctcgggcgaagtggcgctggtggctgagacgctgactcgctgagtggctggaagtccctcaaccctaatgtttctgggctatttgggccaagcaacctatttgggcctaatttttttttggggtctgtgggccaaatttggggttagtcccgaacccaccgggactacccctagctacgcccctggctaccgagatcatgtttatcattatttgaataacatgcatgcaaaaaatgaaggatatctatttttttgaacgcgtaaaagaattatgcgtcaatatattagaagataagagtttttgttatacaatacagtccgccaaatcgactatgtcagggaaagagagaaaaggcagaacaaaagctgtagaaatgaaggatatccatacaagggacaatgatgcatccatacgatgagaagctagcacaactgtatgaatgcatccattacctggacaatttgtacgtatcggcatatttcgcatccacaggatcgctatctctccacgtacaataattccgtttgcatgcatccatagtagtatttgtttggagcacactagtgtaccatcattcacacacctcccccacgtacgctgcaactgccaactacgaacagataatatgtttcttgctctcgtgatactcctcgccgtggcggccggctcgtggcaacctgcggcgacctccacgccggcgacggtgagtcctgctcctgccgtatcaccggtggcggcgccggcgggagaactcggcggcggcggcgctggcgcgcggcgagatcaggacagggagttcgtccgcggctgctgcgctcgcacgctctacccgcgcctctgcaccgcggcgct

SEQ ID NO: 45008 - DNA, 7246 bp, Oryza sativa
  unsure (1)..(7246): unsure at all n locations
ggcgtcggcggccgacctggcggcgcgcgcggcggggcggctggacggcgtcgagcgggccgtggccgggcccgaggtgctgtggcgcgtccgcgacgcgcagacgtgactgagcgccgcgatgacgtacgagggcacgtgcgccgacgctctccggccagccgcgtccgccccgacgccggtgagggccgagctgcgccccggggtgcgccgcgccatgcagcacaccagcatcgcgctcgcgctcgtccacatgcttatccgtactagcgcctgaaaatgaagcccagctgtttgttcagctacgggttccgtttcttcattgcttttgcttgggcagtttgaggacaacacccacctgtgtacgtatgatctgaagcactgtcaaatttcgtaaaacagaaattttacttctcagacccacagaaacgcgtggatggtacttctagcgtgtgtttggttctgggactaggtgggatgggatgaaaccatccctgattttaggattgggatgattccattcgggtgtttggtttgtaaaataggacgatcccagttttttgtttggttgaaggaacaagggagggatgggatgagcgccgtttgcaaccaccgacaacgccgtttgcaacaacgatggctgacgccgcacctgccctcacctccggacgtggtcgccgccggcctccttgatggcatcgatgagcttggtctggtcggggacctgggtcgcgagcaccgcggagatgacggcgtcggcatcgcagacgagcgggcggaggagcgcgacgacaacagacgggatgacccaaccgagcactggcggcgatggtgtcggccttcgcgcagagcagccgcggctcggcgacgacgacggcggcgaggtccgcgcgggagagggagagggagaggccggtggagaggagggcgagcatggccaccatcgtggtcgggcgggcggagaagcgcgacgacgcacggtcggcccgccaccgagttccccgcctccggatccgtcgccgcaaccctccccatcactggatccgccgccgctgccttccccaccactggatccgccgccaccgagccccccaccgccgccgtcgccgagcccaccgccgccgctgtcgcccaagccgtctactgccgccgtcgcccgagcccaccaccgtcgccgtcgcccgagccatctaccgccaccgtcgccgagcctcccgccgccgccgtcgccgagcccaccgccgccgccgtcgccgaggtccgccgctgtctctcgaggacgagcgcgtgagcagggcagcgagcgtgctcgctcattcacgccgttcgctcgtcccacttgggacgagttcgtccgccagttttggccggatcggttggtcccaaatctgagaggaatattcctctctagggaccaacccatcccactcacccctgaaccaaacactcctaaaaatgggttcatcccatcccatcccatcccatcctatcctagtgtaacgttaagtagtcagcagtaatggaaactttaatcttttggtgtgatggttacactataactacaggaaaaaaatgcagtaacagccaacataattttttttttcttatattgatgttttagctaggtttggttgctttggtgataaaattgaacaggatctctgtatgctcataattcttagggcatcaccaatgtttactacctactttaagaataagggtgggccatgtgtcagtggatattagttgttgttgtagctacaatggtgaaataacaaaagtgggtagtaagctggaccccacaaccattatccatgagagagggatgagagaaatcatttgtttattgcttatggctaggtagtaagcatattacctagtatttgttacttactacttccacaatgtatacaacctggtagtagtagtattttatttcttactacccactttatatgcatattgtggatgcccttactgcatgtcatctctactcaatcctccgatctatcactgttcaagtattcaacaattaatgaggatttcttatttacgttttgatttgtatattaatttatcgttttatgtactctgacttgattcctaaacagggatttatacacaaaatagtctaaaaattaactaaagttttgggcgtaacaacggagatggcgacatggcggtagagcttgaattgttccagaaggacagcaaaggcagattcccttgggggtaaatggaggcggcgaccaagggcacagcacgagctcgctcgaggttggtgcgatagatctcgaggttccttagcaaggaggacggtaaccagcaaaatgcacgagctcacaaagggagtgggcaggaagagggccaccaccattgcgagcttctctttcaagttatggatccgaaggttggtctccatggcgatggatctcgaggttggtcgctgcattcgcctccttgacctccaaccatcgcatgcttggtcgagctcggctagcacgaagagggagacactgctaggagagagccatatgcaaagatgagagaaaaagaacattgttgatggttcttaagtaccaaattcaattatcaaataatacataaaagcaaatgaaaggatacaaaatggtataccaaacttagagttagtggttattactaaccattttcacgagatgtcagaaacaaaccttttcatttaagatcgttttcatgtccaaatattcgttgtaaaatctaaaacctattttaacaacactacattttaagcgatatcagataaaaataaactttacatatcatcgagatcaacaacattatggtttattacttttctatttaaaatcagttggagtgtcgaacaagcattactagtttattaaacaattaaaactagcgaaaagggtttgaatacaaataaaaaagtttacatttagatccttaatgtcctgtggaagggcgatttagaaagaacgtctcaggttcaaattctagattagacatgggtgctcgtatttaagactaattattcttttaatagtatgcgacgtatccgttgatagcgaggtgcccgtgctgactttatcaatctaaagatataccatcccagccattcagaggtgcttacaggggcaggtgtgtatgtgtacgttcataggtgtgagtgtgcatacgttgtgaatacttgcatttatattgtgtttctataaaaatgaagcaattttttttaaatatttcaataaaaaaagggatttgctagacaactgcctaaaaaaatgtaaaaataatttttttaaaaaaatccgattttcacatgacacgtggacaggtcggctggtttgaaaagcccgtgaacactggagttagttgacccggcccatgtgaactactccaggcccactaaaatctggcccacgtggaggagaggcgaggcccatctccatgcggcggcgcccctgcctaaccctaaacgcgatgcgataaccaccaccaccatccgcttcttcccccttcggatcgagaaaaaagcgaaaggacctcttgaccccccaaccacaccgaggccgccgcggaggaggaggaagaggaggagatcgaggatgtttttcagccgcttcgatccgtggccggtgttcttccggagggagtggaagcgctgctggcccttcctcaccggcttcgccgtcaccggcgccatcatcaccaagatgaccgccggcttcaccgaggaggacctcaagaactccaagttcgtccaggcgcacaagaagcactgatctgatccgtgcctccatggtaaatccccccgcgcgcctccttcctcgatctcgtctcccctccggctgagatctggttctttccgctgtcctgcggtagatctggtttgtagaaactatttgggggttattattgtttgttcctgctttaagctgggcatggtatggtgtgatttggtttcgatttgaatcgaatcgctaggattgcagcaacatcacttcccgcgaaacgggagagtaatttggggggaatcaggagataggattaggggggaaaatgtaggaatcttctggcggcacattctctatgatgtgattattaattagtccatgaaggtgaggattaggcaactttgctcatcgatattgctccgtgatcaagatagcctaagttttctgaaaaatgcattaagggcatagcaagtggctaattcttaaagcatggttgagagtacaattcaacttcttttttgtagacagatgtgcttttgtagcctgtttccttttgaagggtagcagaaagtcccgattgttcttagtgtgctaattttaccttctaaacttggaagaatggaacatacgcaaatgataaatgtgcttctttacatccaggcattcgtaatcagtatgaaaaggatgcagaatacattgacgctacattttataaataaggttttcttttctaagagaaagaagggtgcgaaggaaaataatgctgcgttccaatcctattcataatattaggggaatgctacaggacggtatcccgttcggacaggatgatacctcagaggtatcgtctgatacccaggtatgccaatacctagtaggtattggcgataccttgaggtatcatcatgtccaaacggggtatcagccgataccttagatgatcatcccgtctgaacgggaaaccgtcccgtagcatttccctaatattattgtgatacgtcttggaacataatgtttgggcagtacatagggattactatttaataatatacgaatgttgaaaaatagtttcatgcaaaagttggaaagggtgtatgaaatgctgtaatacggaaggaaaggtggttcttactccacgaacgcattttctagatatttatatcaataaaatttcctcaatcaaggtgctcatgtacctgtagatccgtttattgttgcttcccttttatttttcaaacaaaagctgatcacatatcaatttctaaaccagctaactgtgatttaaatttttgttgagtattgcacaagggattccaatcactaatgtaaatgtcttgtatccttgtaattcaaacctatctgatgcttcagagcccaactaattatgatcaaaccactgtttggagttactgtatatggttccttccacatcaatggtatttttgccactcatgggtgttgtatactttctggggctgggagtattatctcagaaactgttattgtattgacctggctggctggctatatgccctactctgtttgattttatcagcagctcatattaccttcagcacgctcaaattgttaacatctgtgaatgtgtatttgtttattgaggtacttaaggattcattgagcaaatttgttgtccattggacacaagcttatcttagtgtgcttccagaaaaaaaaatgttttgtcaatgtgaactttttttgtgaatgttttgaattgtgcatttctgctatgcactgcaatgatcaaatcaagctgtacagctgctgcttttgtttgtaattgttttgaagccctaagggaattgctgttgttattttttctagaaccataggtagcaagtaaaaacatgaaggcaacatcattcatactctttgcttgatagtcatttggcgtattttgtaaaatttggaaacctttctttgcatgcatgacatgtcaaattggagttcctaatttcaggtatcctgtttatggaagtacttactttgcttaaccttaccatatctgcaggtgaaggaacagctggtattgcctaagtcttcagtttggcctatttttctgttccaaatgaacctacctgttttttgtttatccatttgggtggacaaccgctccagttgtatctaataagaggcgtttgaatctttggaccaaaaaatttgagcttctggtataaacctgtaatactcttcaagtgccatcctgcttcctgatttattttttgtaaaagcttgtatcgatggtaagtatacatcgaaagggctttcctggctggttgccaaacgttgggcttaggcacgacatagtttcttgggcaagacatttggttcattgctgtaacttccgcacacttgtcttaggcacgtttcttttgccaaactttgtctaaggtgaggcgagtaaattgctagacacaccgtagacaagatttggccgagaagtgtcgtgtcgaaatgaaccaaatctgcccgtaaaacttgcagcgtttgttccattcccatttaaaacacagctttgggtttatttgtttgtgtgaagcccaatagaaaaatttcagtcttccggcctagctacgtaccggtttcagccctacttgtaaaagttcttgttatgcatcggtttgcacagcaacagcaagactacaaatgcaaatagaacaaggctgcagagttaagatcccattatttctgcgtggtcttgatcgaacaaaccagctcatagctcagattactctcgaaagacaaatccagcgtccgtcgaacgttgacttgaaaaaactggctctgcagtgcacttgtatattagaaaatgcacatgctccagttcccataggaagaacaagttaaaaaagaaagagcgacaaaagacgtcgacggaacggacactaaaacaactccaaaaccctaacgaaggcctacaatggtagacaggataactgttgccaagctccagaatatacaacagtttgaccttgcaggatgggtgtgtgtgagttccaagttcccaataggtgaggaaggactaagacagtggacttgagaatattagtattcctcaatcttagacagtggtttcttctccccacgaagaacacacacccctaagaataaaactattgctcacatcaagaaataagaagggagtgcaattccattaatgccaggggcaagaaggtatcaaggttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45009 - DNA, 1252 bp, Oryza sativa
atgatataaagaaatagtagcttttcactatgagagaagactgaccaaaggtttcttcattataaggaagcgctgccttgacaagggtgtccacaaacattatagcaagttcaccaccacaagttacctgaaatcaggaatttttaaccaataaggcaaaaatgtgaaggtttaaaatgatataaaacaccaatctaggataacacatgtatgtaactacagcatagcacccaataaaaacatcccataataagatgtgaatcactaccaccacatcgacaatacacacattaaaaaaacaacttcaaatgaacacgtcaaggtccattggctggttgcaacaaatcgttacgaagggagcaatgagcttttggttggctctctcttctcttttcttttgggaggggtgttactttgccatcaaatgtagcgaatattttttttttacttagatctatgaaatttagctttgatagaacctgcccatgcttcagttgaactaaagctcctgactgaaggatgtccaaggcttccaaatacttctgagcagcaatatacctgcaagatatgagacacaattaatcaaaattgtattcctgaattggcactttttgtctacaatatctttcagacaaagctcatgcccctttcctttattaagaaatcaataaatctagtcaaagaaaatagccattttgtgcatgaataacatttttcattgtgatcatatgaaacatacttgtaggatccagtaatactgcttctatgcaaatgtaaacattctggtcattgttttactttgaatttgtttaatgtcctaacaatcctgacattaactatttttaagatgctgcattagccaaataactatgataatagacggaagattgtataacaaagattctaaattcaatcaactcatattatttagcagatccaatttaagttataaaaagtgaatggttgatttctatcatatgctaagcagttctgaaatagacaaccataagcaagatggtcaaatgcaagttaaaggggaatcaatcattgtggcttcagttaaattattcacagagtaccttgcaccggttgacttgtacatttgttgggcttcataataatttccttcagccaccatattctcaagcttttcgattgtctgaaaacaaacacctcacggttacaaacatcaatccaaagggaaatatactcaatgttgtcaaagatgggtatgaggaaccatgctgggact

SEQ ID NO: 45010 - DNA, 6420 bp, Oryza sativa
acttgggtcaaggtgcaaatcttaagttgtaatggagcaatgttctcactgatagtttattttttcaccgggccggcaaaagaaccggccaagttttgtattaagaaggagagagagttttacaacaagaacaccctaagccaggaatggcttaggctacagaaaatcgtctcagcgatttagactacaaacaaacacagctgctaatatatatttcagtctcactgataatttcagtctttagttatttctagtgtgcttcatctgtcagtgtttggtaatgtgagcctgtaattgtaggttggaagctgtgttaactattggaactcatctaataccacacccaagaaaggttagtcattttttagataaacatattaatatattactcttctggtagtgtttttttccccttcatactcaattatacaacagaagcaaccattgtttgatatttgaatgttcttcaaattctgaaggctgagactggcggagaagatgctttctttgtgaacggcgatgatggtggagtgtttgccgtcgcagatggagtttcagggtacaccatcttcgctgcaatgaattgttttgtacttttgtccctgaaaagaactgcttcaataaattgtagattgtgcttttgtttccttccttttaattttgggttgatttcagcacttctcaaaaaaatacatggtgttttcagcaattcgcattaacacaaggtttttatcctgctagtcattctcttgtctactgacagatgggcagaaaaggatgtcaatccggctctgttttctcgagagctcatggcacacacttctacttttctcaaggatgaggaggtatttcttaattgacatcagtactgatataaagtcacgtacactatacgtcaatttgcatatcaaataggagtttctatccatcacaggtcaatcatgatcctcagcttcttctaatgaaggctcatgctgcaacaacttctgttggatctgcaactgtgtaagcatatatctacattgttatgttagtacaactttacaggtcaaaacctaatgacttctttggaacgctaacagaatcattgcaatgcttgagaagacagggattctaaaaattgcaagtgtgggagattgtggtttgaaagtaattagaaaaggttagcatgaacaaatttatagatttcttaaagtttattagcatacttatctgttctcttcttcctaggccaagtaatgttctctacatgtcctcaagaacattactttgactgcccataccagttaagctctgaagcaattggtcaaacgtatctggatgcactggtatgtgccttattgtaggtcagaataatagagctgtgtgtgtgacgattgttttattagcatactcagttctaggtggttgcccatatgttacaacgagtccaagacatgcacattaattatttcttaatttgaaaactctatatgatctcaagtcatgcagatattttgcatgtgtggacaaatcaaaattatggggaagatcttacaagggacacgcatgcatgcgcaaatctatccataaaagataccactaatgcagtggaaacataataccaagtgcttcactacagtaatcaagatagtcgtacaagatttaagcattatttgtagaaccttctgattttgatccagttgtctaccaggtttgcacagtaaatcttatggagggtgatatgattgtcagtggctcagatggattttttgacaatatattcgatcaagagatcgtttctgtcatttccgagtctccaggggtagatgaagctggtaagtggtaaatatctcagttttgaattgggggccaccaaacacatgttccagtcctcccaaattccaatccttctgaaagtttgatgttttttccacagcaaaagcactagcagagcttgcaaggaagcattcagtggatgtcacctttgattcaccctactcaatggaggctcggagtcgggtgcgaaacatatacccctcaacaatcttttctgttcagattgttacagccaaaaagggatgacagaaatttcttcattctgatcacttgaatgcagggttttgatgtcccctcgtggaaaaagttcattggagggaaactaataggtacgcatgaactcatacacatactatcatgctctactctatgcagaacgcaaagtaatctcatgatgcctaaatttcatctatgcaggtggtaagatggatgacattacggttattgttgcacaggtgaaggcagtgatgatcccagatgatgaggtgaacctacaaaatcttccaatcttgatatgcagataaggcagtttcaccttgggattcttactgttgagtgaaatttacagggtgttgatgaagaaaagggtcaaggggatgagcaaggcagtgctgttgccgttgcatcctctgaacagaaggaagactcaattaccacataaacagtaaaatcaatgataccgcaatcacaatgtaactactgattcttcaaagcgacgttcttcgtgcgccgccattttctattttatgtcttcctccttatcttttctctaaggatgtacatttgtaagtttctactggagggaatacaactcaatcaaaatactcatgtacagccgaattccctgcagaattgagtcgctacgaatacacctctctttcatttattgctgaaaattgtgactttccttttatacaagtcacccatttacatatgcattctatctctttttttccctcctttgtcttttattttttgagaaattgtctgtattattgttgagaatggcagtcgggcacgacgggcacgagtagtgactacccatacccatgcccacgaggtaatttatgctcgcgggcatacccgttactacatgatgagcaaggaacactactcatgcccgttacccgcgggtgctatgtgcccgcgggtatgcccgtttacccgtcacaaactcacagttcaacatttcaaccacaaatctccacaagcagagagacattatcgcaatttaaagaaagggtacagttgtatcaagttcaacaatacaagcattacaagttcatcaatactagatggtggcatttatactaatttgaccgagggaccacatatcagttggtttttgcgggtaaatgggcgaagcgggccagtgcccgtatgcccattgggtataggttttgacccaataaaaaacccactggtactaaatggagaacaaacccaactttattagggtttttacccacgggtaaacgggcaaacggtttaaattgccatccctacttgagagaacttgtgcagagtagaagtgaattggatggaatcggtaaaaaaaaaattaattgaacaggctgttgggcagtggccttcgggagaagaccagggtttcatttaccgccggggccgcggttaccgcgccccggcggtaagcacggttaccgcacggtaaccgcggtaaccgtgacaaaccgcgacaaaccgtacaaaatttatcaaaaattcaaattattttttaaatttatttgaatttgacgcggttaccgcggtttaccccttaccgtacccccgcggtaagcgcgataaccgcggtaaccgcgcggtttaccgcggtaaatgcaaccctggagaagactacgcggcccaccatcacggcccaatcgatgaaccccccggaatccctaaaccaacagcaagaggaagtctctcctgctcaagcggcgcgacgcgagtagcagacgcggcggcgcgacgccatgtcgtcttcctcctcctcgttggcggcggcggcggcgcggaagcgcgcgctgacggagcagaggttctcggagctgtcgcccgcgctgtccccggaggtggtgaaggccctgaagggcggcgggttccggcggtgcacgccggtgcaggcggcggccatcccgctgctgctttcgcacaaggacgtggccgtcgacgccgccaccggctccggcaagacgctcgccttcgtcgtccccgtcgtcgagatcctccgccgccgcccctcgcctcccaagccccacgaggtctgctcagtgctcacggctccaccccatcctctcttgttctgttcatgcgttgcttgcaaagttgctggattgcattgcatctcttgttcacttctgatcagaaaaatgtatggaattttgcaaggttcttggaatcatcatctccccgacgagagagctgtcttcgcagatatacaatgtggctcagcccttcttcgcgacgctgaagggcgtctcatccatgctactggttggtgggttcgacatcaaggcggagctaaagaaactggaagaagagggtgcaaacatactggtcggcaccccggggaagctgttcgacgtaatggagcgcttagacactctgaactacaagaatcttgaggtggttttggaagcaattgaaaattcatgtgttgttcttttgtgcttgaaatgcaaatctgacataaattgttgttgtgtatgtgttttcgaagcagattttgatcctggatgaagctgataggctgttggatttaggattccagaagcagattacgtcgattatttcgaagttgccaaagctgaggagaacagggcttttttcggcaactcagacggaggctgttaaggagctggcgaaagcagggttgaggaatcctgtgagggttgaagttaagacagaggtgaagcccacaggtaaagatggtgctcaacaagagcttggtccatccaaaacaccgttgggtcttcgattggaggtatggtgaggaacttttgtacaagcatttggatagttattcgtggctgccaatgattacatgggctggttgtaacatatacttattttgttttactagtgactatgcctgttgattgccttatgtacttgtcaatttaatgtaaaccacaaaatttctttgttctttgcagtatatgatatgtgaagcatcaaataagtcatcgcaacttgttgatttccttgtgcagaacaatggaaagaaaataatggtgtaagtagacagcgaactaaaatttgttttcacacacttaccttaagtgcctagttgtgtagcattgtgttagcttgtgggctttctgatcttacttgaatgcaggtacttcgcaacatgtgcttgtgtagattactgggctattgttctcccgctgttggactcacttaaaggttctccaataattccttatcatgggaagatgaagcaggttacagagctaatacatgcatgatttgttgtacatggcgcttccaaaagctttccttcatactgattgctaccgcgctattttcctggtatgtagggccctcgtgagaaagctttggcatcattttcagctctctcaagtggtattctagtttgcactgatgttgcagcaaggggtcttgacataccacatgttgatctgattgtgcaggtaatgctttgaacataactccctaaattgtttccttgtgcttgtcattagttgatataaaacatttgtttcttccccagtatgatccacctcaagatcccaatgtgttcatacatagagctggccgtactgcacgttatgatcaagaaggagatgctattgtattcctcttaccgaaggtacttgctctgctttgacattatctaagtggaagtcagtagttgaatttcaaagacatatttggctatgcataccatgcacatgcagtagtgatttgatacaatggattgccttgttagtaaaatgcttagcgctataattgttctgtaggaagatacttatgttgagttcttgaagaggagaggtgtacccctcactgaaagggagtgttccacaaatgctgtagatattgtaccacaggtgagtttcttattgttatagatcatcttaggttgtctgcctgtgaaggcatctgaatccagaaatgattttttttcttgagagaaaaatttagtgtttaaaataaccaattacccacttgtctgtcacagatcagaagtgctgcattggaagaccgaaatgtcatggagaaagggcttacagcttttgtttcgtttgttcgggcatacaaggagcaccactgttcttacattttcagttggaaagaccttgaaattggaaggttgggtatggagtacggcttactccaaattccatctatgccagaagttaagcaccattctctttcattggaagggtttactcctgttaaagatgtcgatgttacaaaaatcaagtacaagtaagcctgcaaacctaacatttcactctgttgccaattgtactattgcatcaacgcactactaatttgacaaatttatattggtatattttatattaaaaggaaagcccatattcaaaacgtagatgacacaaaccataa

SEQ ID NO: 45011 - DNA, 786 bp, Oryza sativa
tactatataaatgagtctaactgcaagttagaactacataaacacaaatcttgacgcaaaatcaaatcttgacgcaaaatcttatggacaaagtataaaaagatagaagcccaaaaatctatcgcaagtaaaatagcaaacctgtctttatggagaataatgtagctactaaataatctccatatatatcatctgcttgtgtagacaacctggtattgcagtgccgttaaggacagacacgggcagcacgttctgacaaatctcaatatatatcttcatcctgaatattttcggtagtctacaaattcttaactaatcaccaagcagatcatgagcatgtgatttcttctcttaaaagtgccttacagatcaatcgttacagatcatttatttcgccaggctaatcattatatatattgtcaaaatcgactaacaataaataaagtttgatctgttaatccaaaatcagcacaattaatttccatctacatgtccgcacatttagtccatggtatgcagtatataacccacatgcctctctacgtttcggcacagccaaagcttcaaaacagaatatctcagtcgaccacggagcacagcaagctagctcagaggctcagagcaatggctgccttccatcctctcgcgatcatcgtgttcgtgtccctcctggccgccggtgcaaccgcaaactatggctacaccacaccatcgccatcgccgcccccgccgccgccacagcagcagtacaccccgccggcccacagcgacaagctgctggtaagg

SEQ ID NO: 45012 - DNA, 2122 bp, Oryza sativa
gtacattttgtgagagagctccacccaactccactcccagttttggtggagctgaaactgtttggctgagctccagctccaggaggggtggagctggagctggagctgtgccaaacagggcctaaatcaactgaaatccacggctgattttaccctgtcttgaattcctgatgcgcttctccttcctccattcccatggtttgtcagggttcggcaaagaccataaaccaatttgactcgcttttgcctgattctcccactgaaaatttatgtctgtcagtaactcgtgtttatgcttgaaaaaaatgttcagagcatggtcttcagtcaagtaaacttgagctgtcaggtgttccatacttagtactggacaatgcattgcttaccctggcaagctccggtcgttgatcataggcaatgtagtgccatgcaagccctttcttcagcatgtgttccttttgaaaaataaagaataagcttaatatatttcgtattcaaaatgtcactaataactctctaaaatcagtgctagaaagcatgtgtcttcttcagcacaggaaattcagaaattttcttgcaggatttagatcaaagcttgtgtctgtagctctgacttatgctcttatcaaaaactctaagcatgtcatgatcctgaatacatacatttcgttgtacatggaagaacctcaatgaaacagttgtaaacttgtgatcacaagactagagggcccaaacatttcagtatgctagacctttcggacagaactccagggcccaagcagaccgcaatgtgatttcttacctgcacgaataccccattgcaatcgacatctccaactaatcgactgtaccggtcattgccatacacagaaatcttcagtctctttccctgcaccagcattgttagctcctcctttgcttctctgccataaggcattgaggtctctggtgcatcgatgcctctgcatttcatacatttcattacattatatcagcccagttggaaagaagtacctcactcgaacaagaatccagaagccagataaaccttagcctaatccggtatttcttcatgagaacctgtccacctcttgagtcagtaacttgcctgcactgaaaagtttcagaagtgtcacaggcagaaaccatgtgaagaaaactgaatattgtgctgaattctaagcaaaacaacctaaaccctgcatcaagtatgatcttctgcaattcatcagccctctgataattcttggtcatcagtgcttcggcacggtcagccgctgttctctgaacttcctggggcacattcaaagaccccgggtgatcagctgtgacaacgtgaacagtaatcgtgtcgccgtcagttacagccttagaatccacctgaagaaactagcacacatttttcagacattcaactaccacagcattgctaaaggatatgccaattgcaaagagagtgaggcctcacggggagcgtgtgcagctcatacttaacaccttgaggtttgggcgtcaacgacattatccaattaaatccatggcttgataccttcttctgcaacagcaaagtaaaacgaccaagaaatcgaatttaggacaccaagacattggagtttcttcaccagctgaatctacaacggttccactatcaatcttagacagtataaacaggtcaacaaaaagaaaaatcgacagatttcttcagatatatgtagatctgtaatttcagtgctaatttggaagggaactcagctaatcagtggatttaaacgcgtcaggaactcagcgctcatttctcaatacctgcgggaacagcccgtggcaggcatttccgacgaggacagcagcggctacaaagcagaacagcaccggcgacgtaccgcgccgctccttagctcctcctcctcctcctcctccgccgccgccgccgtgggcatgggcacccctctcgtggcgatgcctgtgagcggcgtacatgccaccaccaagcacccgagcccgtggtgcaccacgccgttccggtccgcagatctggccctggaggaggaggaggccagccagccacccggcgcccaggcggcaagctcttcccgctcgccgccggcgcaggcgagcggaagcc

SEQ ID NO: 45013 - DNA, 12907 bp, Oryza sativa
cccaaaatcccttatatttatagagaaatgaaatggtcaaaatatttgtatgtgtggatggagctagtattctctggctaggggtggatctacagtataagtgtcggtgtcagacaccgacggttttcagcaaaacctatagcaaaactgtttatccatatattataacaccatgatttaagcataattagcatactatggcaccgatagacacgttatgacaccaacgaatcgattttctgtatccgccactgctcccggcaaaaaaaaaaggtacaatatgctgctttaagatttgtgctctttcagagaagggggatagatgattacttatattcagctttatgaagttcctgaacaacattgaattcacttggacatcctctaccagtttcagttttacaacaatgcaattctcaaatacaatacaacacacaaatcacgatatgcacttaatcaattatagtacacacaccaatcaacgccctcttcttccttgacaacccctctgccgatgtactagtgtacacactacacgatctacacttctactgtggtgtaaagcatatattgctccgggctacaagtctgaaagagctaatattataaatcaatcatctgttgttcatggttcatgttcatgctgtaccattgcgcttgtccctcctccattcccatggcttctgtggccttgacgccgcccacaagcccttcctgccagattgcgcctgtttctcccactgatagattgaaaaatcaaaggctctcatttagaaatatgatacagaacaacctgaatgttcatggtgcttttcactcaagtgatctgtgtagctgtatggtttcaatgtaccttggccagctctggtcgttggtcataggcagtatagtgccatgcacatcctttcttcaacatttgctcctgttcagaaagcaagaggcaaattatgtaccttgtgtaagtatggaagaaagataggcttcaggaaaagataaactttttcagtacgtgtcatgtgatgaaatattttcacagttccttgcagaacgcggaagcaaaagttttaaaagaacgaattaactttccttcatattccagttaaacacctgaactttcatgatcctaagtaacactccattaaacaaaactgcagtataacaactgcaagcgaaatggcacatggcgcaaactatcgcagtagtactttctaagcttctcccattggtgcacaatgtgccattgcaattcaacaagaacaaaagtgttctaacgatgaaattgatttcactgcatgattacctgcacaaacaccccatcgcagtagatatctccgacgcatctaccataccggtcctcatcatacacatagaccttcaggctctttccctgcaccattttcagaagcgcctcttttgcctccttgccgtacggcatggcgctctccggcgcatcaatccccctgcattttcatttcatttcatacgaccacctcaaacttgagaagaagaaaaacggcagaatcatttgctcattgatcgagtgatcaagagatagtagcacacagaccttagcctgatcctgtacttctttgcgagcacttcctcgcctctcgcattaggaacttgcctgcattgaaaacttcagaattgtcacacagcctgaaccattaaccatctctgaaaatttaacaaaaaactgattgatcgatgtgaagtgcaagctgatgacctatatcctgcatcagctatcatcttctgcaacccgtcggccttctgataatccctggccgcgcgcgcccttgtccgttccgccgccgctttctgaatttcacggggaacattgccggactcccgaggatcggccgtgtcaatgtacacggtgatcgtgtcgccgtcggccacggcctttgcatcgacctaagaaactagcaggtgcacttgtcagtccaagagcctttcttggcatgaaaaattcagatgatatttgttttttttgcgaggaaaattcagagattagaaagtaataatcagtctcaccgggagagtgtgcagctcaaacttgcaaccttgaggttttgggacgtgtgcagtgtgaggcgcaggggtacttgctgctgcatttggaattggaaggccatagaaaaccaagaatccctggacaagcataaacaggcatgcatcgattgttcagactttcagaattcaagcgcctagaatatgagtatgatgacattggaagtttgaatctttgagatatacctcgacgtctgctttctgatgattcttcagcgtggtgacgacgagccgcgcggcttcctccggcgtcctcggcgtcggcctggctttcttccatgtcactatcagcttcttgtacctacagcaccaggaaattttatcacagtagtactagactactagtgtccagggcttacaaaatcatgcgattatcacgcgatttatcgcgtctaataatcttttcagtttttaaaaccacggtaaacacggtaaacacacggttaccgctaaaccatgaggtgacgataatcctgatcccaaacgatttagtaaaccctgctagtatcatggcagcggtttgaggaaatcctaccgtgcctactggctaatgacaattactgcaagcatttatgactgatttaatttaccgaattctccactgcctgattaagcttcactcaattattgcggttcagtttagtaaagttatctctcgatacccctcgacgtactgaaccacaattccgtcaccaaaatcagcgaatgatatattttgtttcttcttgcttgaaaaagaaaggaaattctcttttccaaaagaaagaaatgaactttgttttttcaaaaaaaaaagaagagttattttcctcttgaacacgtcgctttcaaaattttcacacgcccaatccctcgcgattacgacaaagctcatcggctctgatccatttccagctcgaaacaaggaggaagaaaacataagtaggaggaattgaattacgcaccaattagcctgcgctttcttggaggagactacatgccggctcagcccatccggaaccttaaaaattcaaaacaaaccaaattaaaccccccaagaaaaaaaaatcccatcaccttacgacgccgacgcatcgcaaaatcgaatttcatcagcttcagcctcacgccctcacctgcgaggtggcctcgaactgctggatgtcccggccgagcgccgcgacggcggggtgcgcgccgtgcggctggtactccggcgacggcgagcagaggccgcacaggaacctgtatatgctgttccccatgcccccgacctcgccgccgaaacaatcctctcaccggagaatcgactgtgggtttccgtgcgcgaatccgcttcgggatttgaaaacttttccggtggttttgtatggatctgcgcgaaagaggcagtgtgaaagcggttttagccgtttcggaatcggagctctcttcacgagggaggaaaagctgttaagctgtcgagtcgaagcgagatttgccacgtggagggcggtgattggatccgggcggtgccctggctggacggtccggattcactgtggagcgaatcctgtggctatctatgtgtgcttttgtgttgtgtcaatgtcttgatgctgatgtcgagttaggaattactgaattaggattatgttctaactaatctgtccaggcgtcgacaggaggtttgttcccggcgaattcaggattctttgccttcaattcagggaggaaaaacgaattcaaaatgctttgcttttcttttttttggtgagatttcagaaagtcgtcgtcgttgatgctaggtggcatgcgaacaaagcagttgcgaatggcgatttggacgactgcacacgagccacctcagacgtcagttagcagcagctaagggagcagattatttgatggtgaggattctcgtgatttttaacggtcgcagcgcgtcagttcattccgttactccacggctgcactcaagatgctcaattctcagttcgagcgtgcaaggccttgctggaacctgacggtcgtgcatccgttcacgataaggattctattcacgcgagtgaatgtccgtttgtttattgtatataatctattttttaattttttttaacaaaatagattaatatgtaatatatcacttcacgaccaaattgtaacaaaatagttaacaaattaaactttagctatgtaatatattcaatcaaatttattatttttattataatttgtagaagttgaatttaaatttatatatttgtgaattcctgacaaccttgcattggcaaggattttggatttagcatctgaaagaagaaactgctggaaggcttcacgaagtggctaacacaaagcatggaatttatttatttgttgagagataaaactggaaatattgccgtgactgatctgcctacggactcaggattacttgctcacgattatcaagctgtacaaacttaatctttcctttgccatcatgatgccaggaaaccggacaaggctctcctggtacagcacgagtcgcattgaatcgtcgtcgcccggccagcaatggaggccatcttccggagactgtcggagtccgggtcgtagatgtgggcctcctgcgcagtggtcgcgagaaggagcttcctcctcctcctcttcttcttctctgccatggagagatcgccgtcgtcgtcaaggtacctgagcgcggcgacgagccacggcggaaggaatcgtcggcggcgagagccgagaaggagaggacgccgtgggggcttgtcgaggtagtctgtcctgaaactccagtggaggcacccgtcccgtccgccaacaccgggtgcatgcacatcgctgtcgatgctggcgtcgtcgtcggtgaaaccgaggaacgcgtcatcatggttgccgatggcggccggggccctccagcctcgggcatcgccaacggtgagcacaatggcgtgcaggtgcagtttgcccacctctacgcctaaccgcaccaccttgaactctttggccgtcacgtggaagcccatggcggcggcacagtgaggtcggtgcgaccgcgccagatgcagaatctcacctgtggtggggctgcatacggagtagctagccttcgaatggcctagcgacgagccgacgagagcgaggacacaacagggcttggaggctggagccgatcaccctcagactgtcagacagtcgaagcaattgccaatcgccatgtgcgtaggtgtgcggcggaagcaccggagatcggcgcaggcggcgggcgaattcgcgagaaaatgggagttgagcccccggggggtgtcacgggagactatagttggccataaggcccgaggcccgacggcccggcgcaaggcacgaggttttggcccgacctaagcacggcacaacccaatcgctgtcaggcccgtgccggcacggcccggctgttgggtcatgtctggacctatgcctcagcacggtgggctagcctggcaagtcacgaagtttagagaagtgaaatagacttattttcaaccataggtaagacagggcacaaagaatagagagaacaaatagacatattatatggcacggcccaaagagtagggacgcaaaatagacttattttagctatatatatgtcacagccgaaagagatggagggtaaatagacttatttcaaaaaaaaacacgatgggctgctcgtgccttcgtgccggcctggtggagcacgtgggccagcactgcatgagccgacgtgtaggtcgggtcgtgccggcccgacaaatcttggcccgggcacgacaggacctagggcgggctaggatgggccctatgaaagtaggatcaccgactctatgccaagttctcaaaagtgttttcttatatagaaatcaccagaaaagccccgatcgagcacttgagaaagactaaagcttgaaaggggcttcacttctgggacttcttggctaagaggatgcttgctataagaagtataagtaggcggataacgtttcatttcttccatagaatctcaatatggcgaaaatgaagcaaggcaattaaagctacgagccgggcggcccatttggccatctatacgggagaccgttggtccagctatattagtagggagtgctgtttgggccaaattgaggtggagtctcactttggcacgacccaaagccgcccggggttgcttgttggatcaaatcacgtggctctagggccacgagctcacaaacaacaagctatttgtgggatggaaaaagtctacttcgactcccttaaaagtcggtcaaatctaattcatgccccttaactagaaaaccggataaaatgactccccgaactaatgaaaccagtgtaatttgactcccttagtggttttggaggatgatttcactgacatgacgctgttgattgggtctttgtctcatgcggcattgacgtggcgcttatatggcattaaaattaaaaatactagatgacaccccgcgcgttgctgcgggacattcatgtacacattgctatatatttcaatatatatatatatatatatatatatatatatatatatatatatatatatatatatatatatatatatatatatatatagcagttgtaaatcttagtaaaaaaataactaagtaaatagaaaggaaaaagaaagactcaagtagggttggtcagatgtccagtgcactgccactcaggtagcaagacccacagcgctgaatcttaggcacaatatcttgtaatgtaatggaaaatgatgctagtgatcattgtttttttaccgaatacacgcatatttccatgcctggtcttacattctttaataatcaaattcctctgacattgtaaagataaactaaacagaaaaaaaaaaagaaagcggaggaacttaatttttgcaatccattcgatttctatagacatgtttcatagacagttatttggaagcatgaatatcaaatcaaacaattaaagaataagatttttccaaaaagaagtaaggatagactaactgtgctgatacgtcgagaacacactccgctggagacttgtatatgtcatgaagccagagttatgtgataccctgaatatgaattgaaaaaacaaaatcatttctaccaataatattttcctgcgtgctgtaaggttaaatcaaccatatatttcgccatcaaaaacaaaaataagccaaacattaattccaagacagaaattcatatttcagtgatgtaccgtggtttgaatagaatgagtctacaatctataaagcttgcattcagtccatagaaccaccacacctgcgaccaattaggcaaaagtcataaagaaaaaagattgatcaatctctccattagagcaagtttaatagtatagccaactacaggctccaattcatctatagccaatctaatagctcattcatacaatagttacatactacactattaatatctggttccacctatcatacacacacttcgtcttggaatccgtgctacagctggctacaaatatatagcctgctgcccttctctctcctcatttatctgcttaagatatgtttgcagttggcttatagcctgctattgtacctgctcttactgcagcagcagctccgtcagttcctgaaggcaagacatgttcgctgaggtttcgcaataaagcggtgtgtatgcatccgccgcgggctgcttcagctcccatcgtggtgtttagcaaaaggagatgtaacagatggaaagttaattagcgtgaaaaagatgagcgatttactcagcgtacaaatagctattgtcgtcgattcgtatgccgtgttagatggcagccgttcctctaatacggagatgacgcagcagactattggaagggttccgcatgacctggtgaccactcgtctgcaggggaaggttgaaggactccatgcctcattgcctggtgggctgagaagaatttccaatgctcctaatcgagtgaatgggccacataaaggagcatattggagatgatcagatggttgagaataactccctcgaatgatctaacggttgatttttagtggatgacatggcttcatagaatttgagctttatagcactaaatgatctttagtgggtaccaattatatataggaagaaaggatatttgtgggacccatttatcattcacacaaaaaagatataatgggcaagaggaacaagtccggggaaggggatattcgccggcgccggtaggtctagccatttcccaacattgccctattggtgggtccgcttggggctaaatacacgaacaaattgtgaatatttctgcgaggggatcggtgatgctgcgcgcgcaccgcgctggtctgggtgtgctgcggcggcgcaaccccgttctgggttgcatcctcgtcggcagcggggcgtagggatacggatcttgcgtctgcgtgcctacttgtcggcgtcgacgaggacttggaggaagccggaggaggggtggatgaagctcaacttcgacgggtcttccaagcactcgaccgggatcgcgagcatcagcaccgtgctcaggcgagggctcgagctggcggtgcagaacgggtggcgcctcatttgggcggagggcgactccaaggtgatggtcgacgtggtgcgcgaccgtgccgacatgcagtcggagaaggacctgagactgtgcagggagatcgccacgctgctcccgcaactcgacgacatggccgtgttccacgtgtgccgcggcgggaacaaggtggccgagctcggccacagggtccccacctgggtcgccggggcgtcgtacgttgccctggccgccgtctccatcgtcgttgtgccgctcccgtacccgcagctccagcattgccacgcgcgctgtgccgttgttcgccattggccgaaggggaagagaaagagagagataaggagagaggaaggggaagaagggttggagagagaggatgaccatgtggccccacatgtcagtgggtcccattgtatatttttgtgtgaatgataaatgggtcccacaaatatatttttaattttaatgctatataagcgtcacgtcaataccatgtgggataaagacccaatcaacaccgtcatgtcagcgccacatcagcgaaaccgtactccaaaaccactaaggagtgaaattacactggtttcattagttcagggagttattctatatttctatctggttttttggttaatgggcatgaattagattcggtcgacttttaagagagtcaaagtgaccttttccttgtgggtttgccttgtcgcgcgtgtatgactggtagaatcatcagtagcatgcctttgtgacggcgcctagaaaaactattttagaaatagatcctttttcagctcgggcctcattggcgccgaggtcattaggcttgacagtcgacaccaattacgttggcagcgagactcataccgctgtggcaccataggctcgatgccaatgaggttggttgtttatgtagcactgattctcatcgtatccatgacttatctaccatagagatcgagggtgtagatgacagtatcattagcgtggagacgctaaaacatcggagtcgatgatcgtggcatagagaaaaaaaaaggagcattggcgaaatcaattttcgtaaagactcatttaaaaaaaacattgttaaacaaaagaacaaataaaatgtagtaaaaatcacagtgcaagtgcaacccactcatccgatacaccaccatgtccccaccttggctggaactggaagcctggaaggcgtggtccgccgcgttagaaatccaatccaccactcactccattagtttaaaaaaaaaagccgcgttagaaatccaatctaccactcactccattagtttaaaaaaaaaaagtcgcgttagaaatccaatccaccactcactccattagtttcaaaaaaaaaaaacagagagagagagaagaaaaaccctaaatctcggcaatggaaggcgacgaagagccaccggcggcggcggcgatggcggccgtgctgacggacgatttcctgctccgatccatcctgaagtgtctgtgtccgagggatgtggtccgcgcggcccttgccaacaagagctggcggcgcgcggcggccctcgccgtcccccgcacaccgccgctcgtcggctacctcctgcacccggagaaaatccggtcggcccagatcccccccgtcttcgtccccagcgacgcctcgttcccgcgcctctccctccccttggctcccgacgacctctccggtgtgtccgtgcacgatgtccaccacggcctggtccttctactaccctgcgagcttcccgacattctcctgctccgcatactggtgctcgatccggcatccggacgccgggctctgctccctcctccgccgcgcgacgctctgcccgacgaccagtggcgccaaacccggcgcatcatcggcgccgcggtgctctcgcgcgcgcatcccagtaggctgcacttccaggcggtctgcgtcaccatcgacgacgaccgccctcgcgcctgggtcgccttcgtcaacggcgaggattgcctctggtgcatccttccacgctccaagcatgttagggttcttcgttttgatctcagcatgtgctgtgccgcccacgatcagggacagatctgctggatcgcctccaactccaaccaagtgctcgcactggaaccttcatctttggagtttcagttcataacttcttctccagctgctgtgccggttgatgtatttgcatattttctgtcttggccacctgcatttcttagcctgctcgaggttgttttctcacggttccaacctatttaataatttagatttgtccatgcaacaattgtgtttgctaaactaatttattgttgctaaacttattttaggagaatgatgatgcgctaactgacagcttgatgagtcttattaaaatagtcttctacaatatatgctacgtgagaggattgttttctaaggagttcttctctgatatgccttttctaccgacaggttgaaatcttatttgaatctatacctattcttttgtcacacttgtagcaatgaactgataagtttgtttcttatgacagggatgcagataaaaaagcttacgccgatggatgacgagtcccaaaggcttgttgattggctagaaaaaggtgaaaagtacccgacatagcatgagctccttaaatactttgcttgtccagcatatggttatgcgtgaaaaaacaatttcttatctgtccatttgattaacttttggtatcaaacttaggtgtttatgatgctctgaaaaagaagttcctcaaaactatcatcttctctatctatgatgagaagggccctctgttggaggagtattgccgtaagtttctgctagagtggggctttggcttactaatagcatatcaagctgacatggctaatactatcacacatttacatttcttttgcagtatcattcacatacttcagcgaaattacaatcgacttacggctgacgggatccactcaaagtatatggacaatgaggtccgatgcagctgagagctttgttaatcaaatttggtgagcctcttatacttctactagaacttcatggttcggacaacacgacatgtacagcagtgaaacaggtcctgaatggggcaacatgtgaatgaaatgaaccagattttgaatagggcaaaatgtgaacaaagtgacatgcataacttgaggtgctagagatgaacatcctttttgcagtagaactgaactttcttgatctttcattccatactcaggattataatacaacctagcccagcttcgactggtatttcaatatgcaatcaaaaccaactaactggttgatcagcaaagtaaagccttgtttacatattaaaaatgcatgtgggagtattgtttacataattggttaaggatattcttctagattactatttcacctcaaaaaattcttctagattagtatgaccaaaaggcgcgtgcgagaaaattgtcatgaataaggagacccttctgtatttccagtgacctatgtggctatttcaaagtgaaatgtattatgcctttttgttcaactgaattgagtgaaccatgggtgttttctccagtagtaatattaacctgaaaaatattttatatctatcactgctgaataatttagttcatacactagtagcttccactgaaaagtactctacccatatgctagtacctgcatcctctctattctagttatagttatatatattgatccatcctgaaattctgagctgctacactgatgtactatctctatgcactgacagaaaattgttccatacaactttgttactggaaactaacacaaccttcttttccccctattgtcagcctctggactatgaacctcctttttttgagagttatgatgatatgagaaaacgttgtccgctcccactacatactactttatcagattactcacaaggtaattgtatgagtcattttaaactagttctgaacattggtctctatagccctgagtaaatgtctttttgtgctcattattcagatttgatcagtttacatgatgtaaaatcagtgctctccaacaatccctttcattccaacaaggtgataatttatctctatttatattcttatgttcaatgcatgcacctttcaatttcttttcgcctgaacaacctctgccgtctcattttaattaggtttttgcaatggacccaaaaagcaaaatccaacaagggcaccttttttgcattactaagaaagatgtccacttctattttgattctggtgctagccaccacatgtgtgatgatgata

SEQ ID NO: 45014 - DNA, 13878 bp, Oryza sativa
gacccatctttgaagcatacgaggaatgatggagaatgcatacagaagttgaagcgtccgcggcaagatggatcctctccatctagtaggaaaaggactgcgtaaactggatagatgtgttcattttgtcttttgtaaacatgagaagaataccacccaacatacgaagatttgatgtgctctgttgtttcaacatttttaaacctcgttcttacagatgatggttgcatgctagtaatacccaggaaaatgctttttccatttgatttacattggctcgcgttagtatagccctcaaaaaaatctaaggataaagtttctttatagatctgcattaaggtttttatatgtattgctactggactgtcgagatggtccggattttaccgtgaccgaaaacaagggagcttcctttgaggcataatttgttgaggcgcgtccaatgtaatactgaattttaacacattttggtaaataccaaatgttgttggtgttgagatgcatttggtttacaactttgcaaccttaccagatcttactatattttgccaatagtaaagggtctaatctctggcatttccaccattctacctttcctataattcccatgtgtagttttatgcggccgagtagcaatagaaactaatttaaaaatataatattcatttactagcaaatatgcccgtgcgttgcaccgggtgaatatcaaacaaatatggatggttaagattacttgtgtacttataacacgtgcacaaaaatattgaatttgtacataccttgcaaatatctccaagttttatacatggaaatatcaaaacatatctcatactgtatacatatttagattcaggtcgtatctcaaattttataatacatgcgtgagatattccaaattttctacacattcagaacatattccaactttcacaaaatttcataaacaggggcagttatagctctgatttcaccatgctctacaaaaggaaaaaggtaaaggcatctgcaatgggaaagaaacacactttgtagtatcaaaataaaattcactaaaaaatctttagtggaatatgtgcgaattttgacatgaaaccatattaacgttggtcaaatacaatatcatatgattaatactttctagataatttttttgttggtttcatttatctaaaaataatctatgagtgattaaataattgatcgtaatttcccagtaattttaaatggcttaaaatagtagcaaacaaatttatgtaaatataaaaaataattaaatcagttgcttagaaaaataaactgattttggcctagcattgtggtttagggatgaatttcaaattcggggacaacttgcgggaccaaatttgaacttatctgtgcggagtgtatacatggcccatgaggtggcccaattatgtggcgacctgggaacggcaacccgacgcgggagaagccgcaaccgttcgatctgatcaacagtcccgattgatccggacatatatataaagtcggcagcccaaaccctaaccctaaaatcatttcccctcccccctctctctctcaaaacgacggcgtcagcggcgcctctccccctccgccgctccccctctccctcccgtttcgctagcatggcacgatgttggcgagtgctcgacgcaatgcagcgaggtgagggtacgacgaccatccttccatttcccctctccccgtcggcctcgatggtggggctacgagcctacggcgcagagacggcggcgacggctgtccttctctctttctcctctgtttccgagcaggaggagagcgctggagggtggggccccggggtagagggagggggtgccagcgcaattggggatgtggtgaatgtggccgtgcccggctggccaggctatgacaggagcgcggtcgacggcaatggtgacgagctcggaacaactggatccgacgggaaactcgctcatttgtgtgattttttccctttttctagggttctcaatctgtgtaactgtccgattggatgattcttattcttttagattctccgtgtagttctattcgataggatgacttttttcaggttctcagtccggtgtagttctgttcgataggatgacttttttcaggttctcagtctgtgtagatctttgatttgattttgtgctttatccatagtacatgattggtatatagatgatgaggacatcacttcatcggatacgctcataacttcacacgttacaatgataattccaagtccaagtccagttcggccttcggagacagtactgacttcaaacggacctagcgccttcatgccaactctgatttgggtgatcttggacttcgtggaaagcttatctcgctaccttcaaacgcatccggtctcatatccaaattcatctcgagtaaacgggaatagccaaaacaagacagtgctgttgctgaaaccgaacttgggccttgggccttgtaatagactaggcccatctcataagtgtctccctccacctccacgaattagcacttaaccctagctttattttcctctataaatagctttctacatcctcaaaaacttttgggttttgtttagttgaattttgccaagtgccattcaccttgtctctagtcctcgttcgattagtcggcgactattgattcagagcccccaatagttggtgtgttgatttgccgggtcgattagatctaccacttcaatcgcaactatttctttgtgcttaattacctattcgcaatatttagattgcatcttatcttgttcttgcagtgttctctcgtttgcattgcagggatcatcaaccgcgcgtcacggttggtacgacatcgtttgtggtgtaccgattgcacggcatcctggacttgttctggttggtagccacgtcgtaaatgtcacactcgatcaaaacgagagttatcccctcaccagaagatcgggccacaagagagagcgtcatcagattgattaacttgtaatgcttgtattgaacttggtactactgtaccttttctttaaattgtgacattgtctttgcttgtgggatatggttgaactgatatttggacatgtaaacgggcatgcccgcgggcatatggcgtccgcgggcgacgggcatgggaagtactcatttcccgtcatgtagtaacgggcatgctcgcgagcataaattacctcgcgggcacgggcatgggtagtcaccacccgtgcctgtcgtgcccgactgccatccctacacataacttaccctaaccaatgcatttcaacccaaatcccccaaaatatccctaaatcagctagggtctcgacggtgaggttagcggaaggaggccgagaggtagcggttgtagcggcctcggcggtgagattagcggcaggaggcagcgcagtgcagcggggttagcggtggtacagtgcggctgaattagcggcgggagccagtgcaatggcaattgctaatcgggactgcattttctatacatgcaaggagaaaaatgagagggaagaacgatttgaggatttttttttttgggattctggtgttactatatagctacaaggagatatatgcgacgtgttgtgatgtggagggggttgagagcaaaagtgttacctacgtggcatgccacgttggcggtcaaatgcaatcaaaggacgtttggaccaaggtggtacattaaaccaagttcacggatctaaacgtgcaatttttaagttcacggacctaaggccctgtttgtttcagcttaagattattgtaatctagattatcgagccaggttactataagctagattataataagccgacataaaataagttgttagctgtttgtttctctggattattagttgcttgttagctattagccacccaataatctaaaaaggcacctttagagtagattaccatattacattaatctggcttatagattgtaataatctgttataataagatatctgtttgttttagcttacatctaataatccagattataataatcctaagctgaatcaaacagggcctaagtgacaccaccacacaagtttaggggccggccatgtatttcactcaaaaggttttatgctactagaatgttgctgagtacatagattcctattttctttcaaggaagagcgaggctggtttgaactattaatttactgaatcgagtgaagctgtgttgcgtaacaagactataggttgccaaggcctataagtacaagtggtcgctctaatggtcactctcaaacttactacttgagtgactttcgtcacttagcttctttaatagggttcaaacaatataagaattcacaatatgaagaaaaagtcaatgaaaaagtttataaattaaagcattatgattgctataaacattataattgaaaattttaatgaaaaatcttcattgttttggactgaaaaggaaggaaaaatgggtttttacccataaactaatgaaaatattagtcctcaacccgtttctctttgacccagcccataagtgaagccacggtatcagttcgaacaaccctcttcaacctccggctgaatctttctcgatctccttaaattggttgacaaatcgacgtggagacagctgcggtagagtttggcccggcagcgaaccgtgtgaactaaaaaacagcgaaaaaggaaagaaaaaaagacagaccaaaaatgcgtacgatacgaaagctttacttatttattaattcggtacggatatatatatatatatatatatatatatatatatatatatatatatatatatatatatatatagatagatagatagatagatagatagatagatagatagatcagttcgcctgcaccgatcgatctccatatcccgcgtgcgtcgcgtacgtcctgctgcttcgtccgccgccgccgccggcgtacgcgtacgcgcgcacatatatagatcgatccgtttgtgggtgtgacatacagtacgtacagcaacgcgatggcgagcccgcgaaccaagaaaaggaagacgggcgatgagcggtcggcggcgtgtggcgtcacggtcacgctgcccgaccacgtcgtgacggaggtgctcgtgcgcctgccggcgaggtctctcgcgaggctccgctgcacctgccgctcctggaacgccgaggtgtcgttgcccggcttccaagacagacaccacgctctcgccgccgccaagttaaccttcctggagcctgcacctacgcacatggggtcgtaccgaataagaagaaggctcagtaggcggactttgccgtggctcagcaattgcttcgactgtccgagagtgatcggctccaagccctgctggggcctcgtcctcattgccaggccgtgcgaaggctactccgtgtgcaaccctaccacaggtgagattctgcatcttccccggtcgcaccgacctcactgtgccactgtcatgggcttccacgcgccggccagagagttcaaggtggtgcagttaggcatagacgaagaggtagtgggcaaactgcacgccattgtgctcaccgttggcgacgcccgaggctggagggccatctcgtcgttccagctcggcctcggtttcaccgacgacgccgccagcatcgaccgcgatgtgcagccggtgttcgcggatgggtgcctccactggagtttcaggacaaactacctcgacaagccccacggcgtcctctctttctcgctcgccgacgagtccttccgccgtgttccccagccgcctttctcaatggtcgacctcgttccggtccacttgaacggagtcagaaactaccgtctgttgcgagccaaaggcataaggtccgggagcggcgaggaagtggccatgccggttgggaaaacgctcgcggagctcgacggccgcctgtgcatggtacgcgacgtccgccaccgcagcgaccacgacgtgctgttggagatatggaagctgcaggactacgacaccgggagctggtcgctggactaccgcgtcgacctgccagcgccgggccagcgccagcgccagctgctcacggcaccgtggctcgtcgtcccgctcacctaccttggtggctccccgccgggagacaagaagaggaagcttcttgtcgcgaccacggcgcacgaggctcatgtctacgacccggactccggcactctccggacggtggcctccattgacagctcgggggacggggacgacgattcaatacgtctcttgctgtaccaggagagccttgttcggcttcctggcatgcagcatggcctaggaaatattaagtttgtacaactttccaatagtgagcatatgtaatcctgagctcgtagctaggcagagtgaatacttaatatatttgcatccaccgcgtccagagttaatcaagtgtggccagttttatctctcaacaaacaaatatatccttaatcgattttgctatatctcactcgaaagattttttcttatctctcactcgattttctcactcaaatttacagtgcattttcttgtaagttacagtgtaatttataaaacttacactgtaacttttgtaagttacactgtaatttttgaatttttgcatgtaaattttaaattttgtattggatttggtctttttcttgaggatatggtaatttagtgtccattatggtgtttcttaattgctttttgctttttattatatctatcggattttaatctaaagattaaaaatctgtgtgatacgatcataaaaatctttcgaaagatgtataggtactcccatccttaattgctacaggattgtacgtgttagccactttgtggagccttcgatcagtttcttttttagataaagtccaaaatcgttgccaacgcaagggtgcgaggaattcacaaatatatcacttaacaaaaaattcggcttctaaaaattataaattatcaacaaatttgattgtggataaattacatagttatagtttgatttgttaatcaatttgtagaaatcaaatttaaacttgttattgtatcgtgaagtgatatatttattacatactagtgaacgtgcacgtacaaagcacattgatacatagaattgttgatcatttactgatacattatctctttttttcccctccaaaaattgtatgttccaggcgtaaaaatgcacactttgaaaggaactttagtggaagtgtcaggtttcaggtcaacaagcatttttaggactccattcaggatattgccccttgggggaacaaaaataacatacaataagagaaagtgcaaagcataatttgtggcttttatcagctgaaaaccagcatagctaatagttggcacttaattaataaaggttgttctcttgttcacatattagaagacaaaaataacgaatctaggaaagcatttccccccattttgatttaggcagcaactgaaggttacatctgggagggggagggcgccggccgtctcgcccgccacgctgtgccactcccgccgcgccaggccggcaccccgccgccgcgccccttgccagagcgccatcccgtgcgcgcggccgcgccaggctggcaccccgccgcgcgccatgcccgcccctccccctctggcgtggagaatcgagaagaaaggggagaagagaacagagaaggagataagaaagagagagaaagaggaagagaagaagggaaagaaaaggaagaggacacttacagttgggacccaccttctttaatccaatgaaaaactttgaatcgaattttatcgtagtaaatgaactcatatgaaaaagttgtcaaaaacaaagttgcagaattcattgacatctaccatttttattttggtaatttttccatccgagttttattgaactatagaaaatttgaattttaaaatatatgaaattgaaataattttttgggtagtaaatgttttcaaatgaaaaaaactgtcaacaccaaatttgtaaaacgcatcaagatctacaacttttgtttgggtcatttttctatgtgactttgtttaaacagtttgaatttgaatttcaaaatatgataccttcaaacaacattttcaaatactaaatgatttcaactgaaaaagtcatcaataaaaaagttgtataactcatcaagatctataacttttatttttgtcatttcttcatccgacaaagcgatagttacattttttacaaaatttacatatctcacatatggtttcataagttataagagagatatgtaaattttgtgaacaatgttactattgctttgtcagatgaagaaatgatcaaaataaaagttgtagctcttgatgagttctacaacttttatgttcatgactttttcagctgaaattatttaccgcttcaaaatattatttgaagttgtcatttttttgaaatccaaaattttaattgataaaacaaagtcacaagaaaaatatggccaaaataatagcagtaagaacacaataacacaatagagcatgattttacaaacgtttaggaaaaagaatcatccaatttggagttcatatgagtgcgataaactagtcttaaggagctgcatgagaaaattaaggtcgatttttgcatacaccgtcaccctcaaccacaaaattggatatagcaaaattattaacactaaaatttggaaatgttgatatgttctattagaaaaaataatgaattatatttcttcgttgatttgtgatgcttagtttgaggggtttttatgttccgattaatattcgtcaccgtattcgtttcgtttcgtattcgctccgtatctgtattcgacaatattcgattccgtttttgtatccggggtttccgattccgattccgaaaaaaatgtgaaaatgaatatggtagagctagtttccgtccgtatccgatccgttttcatccctagctgctaagagatctctaagagcaagtttaatagtatagcccactactagctttaatttatctatagttaatttaatagtcaattcatacaatagttgtttactatactattaatatatggtcccacctgtcatacacatattgtgttttggagtctgcgactacagatatgtaacccactacttttctctctcatcttttatcttattaaaatatgtttacagctcactaatagtctactattgtacctgcttgaggatctgaatgaaactcaacgcaagttgagcgatataaactgaactttatcccctgcgaaaatcagaccgctacaagtctacaactggtagcggttcaaactgggcccttcaaaggtatagtaggcccagaaattaacttggaccgcaggaatcaggatcaatcgagcgtgaggacgacgatcagatgcagagctcgcgtgatttccaaggagtattcatgaattagttcccaaatcattgccgggaatctcagcgtccatcgatctagcattgcctgctgccgtggtatcatcgaaaccgatgggtctcgttgctgtttatctgaacttctttttttttttcatgtacaaaagaaaaaaaaaagagggccggggttgggggggggggatccaacatgacacacaacctcacttcatgagttgagttcatatatatatataacttgcaagtggtttaattttcatttaatttcgcatcaatcagagctgccgacttgtttaattttgtatgaacaagttcgttcgctttggtaaacccaaatgaactttaaaaagaagttgcaaaatgttgttcgaagatacaagaagatagaatggaagtcgctttgtgcttcgaaaattatacacagttgttgatttcagaatgtaaaatcggcacatcactaacacaaaaggtgaataaaaatatttaccgggcaccagaggaaatttacacaccaggcaaaaaaaccactgtgaattcagagaagaaaaagaaattaagctaggcgctagctcagggatcctcggtgatgcacgagaggtgcggctgccacggcgaggcatggctgccggtgctcatgcgccgccggtgttggtgctgctgcttctgcgccctcatcatcctcgtcgtctccggcgacgcgctgccggccgggctgcccaaccgatcggcggcgacggcgctgccctccgacttgctgcggacgtggtgcccgcggccggcgccgccgccgccggtgctcgtcctcctcttggcgtcggggacggaggcggcggggatgaggaagtagatctcgccgcgctccagctccgactccggcgacacgatgagtatccgccccgccgccccctgctgcgacgagcacggccggctcagaacgtggttggggtgcgccgccagcacctcgccggcggacacggcgcggccgtactcgtcgacgcggccgctgaggtgcacgatccggaccaggtccagcgcgccgcacggcagcacgcacgccaggcagcatctcaggttgttccccatttcttcttcgctcctcggtcgaacacttggcgatcgagctaacccaccacctacctactagcttagcttctcttctcttctcttcactgtgttgagctcggtgaggttggccatggattgtatatataggagaggacaaaatgacaaattaaggacttgtttagttcgcgaaaagaaaatttttaggtgtcacatcggacatttaaccggatatcgaaagatgttttcggacacgaatgaaaaaactaatttcataactcgcttggaaactgcgaaacgaatttattaagcctaattaatccatcattagcacatgtgggttactgtaaaacttatgactaattatggactaattagactcaaaagattcgtctcgcgatttccatgcaaactgtacaattaattgtttattttatctatatttaatgctctatatacttgtccaaagattcgatgtgatgtttttgtgggaaaaaatttgggaactaaacacgcctaaaagaagcaaaagagagagagatagatagagagagagagagagagacttaacaccattaacagtagggttttcatcacttcaccgtttggtgagatcacctcatctcacctcactactactcatcagtcatgtgtgccatgaccttatctagatcctaaacaacaattaggtttgtctaatcatggagagatgctgggttctactaagtactaacccatgttctaatgtttttttccttttttcaagattagcagctagtgccttaattagttaattgtgctgtgtttttttctttttttttcttctgctggctgcaatgattcgagcatcatggacacagccatgctgccttgctgtaccttggttgtatgctaatatgctatgccatgctaccctctgatgagtgtgcttccattgcatgcatgcatgcatgcatgagtgctgcaagctagctagccgattatactacgagtgtgaatgctcaattggatatataggagtttaggtagcatggatttgtttaagggcctccattgattagttgtttggtgccttcatctatataagttaattaacatatgaacctggccgtgcaacatcttaattttttttcgtagtagaattaaggtgaatatggaacagaccatatgctagcctacaagctaagaaagctatagtgttgttacttctgatggattgtatatataatggctacctagctttttgagacgatgattagttagtatgttaattcgacgtgctaccatacgctgaactaatcgagtgattagtcgagctgaacgcaacgacaagccaagctgtgacaaaaattattgtgcaggtagagtagtagctctctggcttagatcatcagtgcggtcaacgcattgcacgcgttgatgcttgttgccaccgtgtttcagctagattgcgttgcatgacaagtttgcattgctcgatcgctagctttacaatttagctcgacagatcgaccacagccgacgacctgcataattgttccatccatgcaagtagaggcagggcgaattaagctaggagaactattatggctcaacttcatatataaatgtatgacaccccttactactaggtataaattaatataatcttggtatttataaatatggttgtgtacatctaagtttgtgcgcaaaaaagaattacttaaaaatggactatacatgattaaaaaaactttttgaaatggaaagtattcatatattagaatatgtgtatatataaatacagtgaattttattgtaaaaaataaggtgttccacatgctgcctttcctgcgtaggaactgagcttttatgcggcacggaaaccaaagcaagcaattgacctataattaattaattattaactattataaacttaaaaaatgttcattcattttttttaaaaaaacttttatataaactttttaaaaattatatcgtttaattaacagtttggaaatatgctaacggaaaataaatgagagttaatgtttacaatatactacccctctgtttcaggttataagacgttttaactttggttaaagtcaaattgctttaagtttaactaaatttgtagaaaaaagtagtaacattttcaacccaaaacaaagttattatgaaatatatttaattatttatttgatgaaattaatttagtattataaatactactatacttgtttataaacttagtcaaacttataaccttaaacggaaggagtagaacggaatctaattatagtattgttatggctactcatgtggatccactgcgagtagattcctagctcgatcgcggcattactgtgtttgagctgtgcgagagatcgatcggcaagttgcgagtttaaaacatgctcgtgtacgcgcgtacgaagaacggtacgttcgtaggcacggccacgcacgtacgtttgtccacacgtgggaaggaaaacaccgtgcccgatcggatccgtcgcgccacggactgacacgtgtgcgtcacgtgggcccggggtccacgtgggcgccttccctgtccatcgcggtgggtgcaccaaacatgtgttttcccatttcctactttaagattcggactccaaccgttagctgtgcatgacgtagctgattagtaaattcgagagtttttgatacgtagactcactgggccgccattagacgttagtgaaatccgagcccagacttgtgcagttttgtttcttaagatcactttgactccctcaactgacgaccgaatctaaatcgtatccctcaaccgcaatgccagaaatctcgacccccgaacttgtaaatccagtgcaatttgactcccttgccggttttgggaggtggtttcgctgacgtggcgccacgtggcgcttatgtggcgatattgaccgagtctttggtccacgtgtcgttgacgtggcacttacgtggcaatagaattaaaaaatatgcgtgggacccattagtcattggcacaaaaagaaatgtgggcccactgacatgtggggcccacatgtcagacctcttcctcctccctatctcccttctctctctttctctccccttcttcccattcggccgatgggcaggaaggcggcgagagcgagctggcggcatcggggcgtatcggaaccgaaccgggggcggcggttggcggctaggacggcggcggctcggccgcggtggctcacggcagacggaaacggcgacagcgggagggaagtggggatggaggcggcgaggagggagttggccggccaacacgttgtcgccgccgccgccgccgttgtccttccggccgttgctcttccgcgaggccgtccccaacgagccggcgctccagccgtcctcccccgttccagcgccatggcaagcgacgagaatcctgcggcgc

SEQ ID NO: 45015 - DNA, 9944 bp, Oryza sativa
  unsure (1)..(9944): unsure at all n locations
cttgccgccttcggcctactcccgcctgttgccgtccactcctcaaccgcgtctccgctgcttccatagccaccgccgcagcgggctcgccttcgccgccacgtgtcgtcttacctcacgcggctgtcgccgtgctccgggagccccgccatgggcgtcgtcctgctcgtgtgcgtcgatggccgccgccgctccggttacgctgcgccccgatgccgccgccgctctcctcgtccgtgcgccgtcgcgatcatcagtggaccccagcggtgcgccgccgcctccccaccgaggccgagccgggccggccgctcgctctcgccgccctcccgcccgccgccgaatgggaagaaggggagagattgagagaaagagagagaagggagatagggaggaggaagaggacagacatgtgggccccacatgtcagtggcccacatttctttttgtgccaatgactaatgggtcccacgcatattttttaatcctactgccacgtaagtgccacatcaacgccacgtggaccgaagactcggtcaatatcgccacataggcgccacgtcggcgaaaccacctcccaaaaccggcgagggagtcaaattgcaccggttttgcaagttcgggggtcaagatttctggtattgaggttgggggatacgatttagattccgtggtcagttgagggagtcaaagtgatcttattccccagcaagaagtgagtgtcattgccacgcgatttcaaaacaggcccaggaacagaattgtcattcccgtgataactgaagatttcgtcagctcagttgtgcctttccgggagctgtaaggcggtgttcttttctcaagaaaaaaaattaagtgttttattcaaaataagttggtatttacgtatgattaattgagttttaatcattacaaactaacaaaaatagattaatttggtattttatagtaactttcatatagaaagttttcatacgaaacgtaccgtttgactgtttggaaagtgtgtcacaagtattcaaaattttatccaatttttattggagaaaagaatagaccctaagattttctctttaatagaggaaggagctcaaaattaagcaatttgctgggtagtcaacgggtgaaaccaggttacctagctataattttctggattacatagcaactgattatcggaggttgcagctagcagagctcccaaacagggtttaggtcctgttttttttccaagagttggaagaagattaaggttttcatggcacgtttttcaagctgctaaacggtacgtttcacacaaaaactttctatataaaagttgctctaaaatatcatattaatctatcttttaagtttataataattaaaactcaatcaatcatacattaataccacatcgttttgcgtaaaaaatttagttttcatcttcaagagaaaagaacaccaccttagtccacgttcggttggagaggttggaaaccttttctctggacacggaaaacagggctatttattaccatatgattattaagcattagctagaaaataacttaaaaattgaattaatatgattttttacaataacttttctatatgctacatcttgattaattagttgataaaatggataaaattaaaggtgacaaccacctcactataaaacttgctcttaaaagtttcgggagaaggtacagctacaaaaagctccaattagagctttttagctcttgtttgtttcatagtcactcttatgacaagattctttctcgttttttaatccaaaatgtcaactgttcaaaaaagtgtggcgcaatcctacttttactagttaaaggtgtgactcacctttttttattagctaaaatttatacatgtatgaaacaaaagtatagaaaatgatgacaaacttagtatggcatccaaccagaagttttcggctaagccggcttagctgccatgtaagaacttcacacatggttcttccggtcccggcctagctgtatactcgaacggtatgaagaaccatgtgaagttttcgcttagctgcatgcctacttacatcagttctttctaatgttgagacgacgacgacgacgatcaatacagtcagctaagacaaccgatgacaattttgacgattagttgtgccgtagctttcgtgggtgagctactgactgtgaatgcacccagccaccacctcgtcgtagaggcatcctgacaggtctcactcactcacggcctcagacgggacacgggcatgtgcacaggggctctgatcgactcatgccgtttttgggtaaatccgttatctgtctacgatagatgcggttcgtgatcactgatcgccgtgttcttccaaattcgcgaaacacgctagtctgtagggctcactcccgtttgctttgcatttacgcgcggtactggctgttaattatcgttcgaagttgacacttgacactcacagatcaagttggtttgtcggtgcgcattgtgaacaattcaacgagatgaatttcgtacaaatttcataggagatcgacagatcgttatattctcaccagatcgaatttttatttattttttaaaaaaaggcaataacacttctggactattattaccgctcactaggttaattttcaagctgaagcctatgtccctttgtcaaagagatatacactctcgaggctagtttcttaacgtggtgtcttcgataatgtgtgtttggttgaaaggatattttgggataaaaaatgttgatggaacttttatgcatgtttggttgatgtgcaatgatggatagggtggtcggaaaagggaatatttcacaaaggtgctggatgagtgtatatgttcaaattaatcgattagcaataattaatatatttggttgttaattactccatccgtttcacaatgtaagactttctagcattgctcatattcatatagatgttaatgaatctagatatatatgtgtgtctagattcattaacttctataaatgtggacaatgctagaaagtcttactacctccgttttttaatagatgacgccgttgactttttctcacatgtttgaccattcgtcttattcaaaaaatatacgtaattataatttattttgttatgagttgttttatcactcatagtactttaagtgtgatttatatcttatacatttgtataaaatttttgaataagacgaatggtcaaacatgtgaaaaaaagtaaacggcgtcatctattaaaaaactacattgtaaaacagagggagtaataattaacatgtcattattaatgtttgattagatataactggtcaatgttgttatttattagtatagattagggttcaattagtgataattaacatattttgttattaatatttattatttttatttcatccattctcatacatccaacgaataaaaaaaaattcttaaccatcccacgataaaaaattgaataaccatatccttgaaaaaaaaactgagacatcgtactcgtaagcacgatgtccctcatcatatcaggtcgtgtttagtttctccctattctcaactttccatcacatcatatcatatcaaaaaatttcttatacacataaactttcaactttttttttccaaaatctcaattttttttaaacttccaacttttctgaggaactaaacacacccacaatacactgttaataaagaaaacatagacctgtcaactttatttcatgtcagccgtcaactttgtcaaactttttgtcgggctgtaaagtcctaaaaatccttctacagtattttccctagcactagcctcgagcactcgatggagtagcgcgcggagaagcaatagtggcgacccaataggtttacaataggattttattgagaacgagaatatgtcacgggagtataccaaatgacgtattcacaggacgtgaatgtagtgttccaatctaaacaaatatataccatgcgagcaattattcaattaagcgtatctctcatcttttattaccagcaaggaagttttgtaataaaaaaaatggtttacatctccgaattgccaatgagcaaataattcatattcattgtgtacacgaggtaaatccattcaaaatactcctagaactacaaatctagacatgttcatatctagctttatagtactagaatacgtcacatctaatcaaaatactttatatttagagatagagcatactcttcctctgtccctaaataactcaaaccctagcttctcaaggagtttttaagaagagaaacaaaagaccacgatgcccttaattaatgtgaatattgtattgaataattggtaggtaagggtattaaagtaataaaatttctcattttgcggattagtggtaagtataagaaggtagaagttgatttattttggaataaatttgaactcttcaagttgatttacttcctcattagnnnnnnnnnnnnnnnnnnnnnnnntaaaacgtgttgttttgaggtttctcaccaaaattagtatccagtgcaaatgactgatttaccctcatttatttcattcgccacacacaaaacaaaaccgccgttggagggtggggggaggcgaagagaaagacgaagccgccgtcgaggacaccgccacaggcgtgctcctcggagtcgagcacaaagccaccaccgggatgcccgcgtcaaagttgtagccacctgcatgttgctcctcggtgagggagtagacgccgtcggcgccgagcgcccaaccaggacttcgcctgcaacctcctcgttctcatccacttgcctttgcttgatgcgcatcgacatccgcttccgccgcctgtccattgcgtccggtcatgctagccagctgcattgtgatctccacggcggcgacgaccggtgaatcaacgcgcgcctgccgcgccactcccgcgttggagaggagaggagataggtgagggagagtgggatactaggattggggattgcatgagggacggggagggggggtggtggcgatggaggagttgaggcgagagggatgacggagaagtcgatgcgagagtgcgagacagcgagaggataagatcgcattaagtggtgagaggtcgctcgctggaaaaataataataaaaaagaaacgagtgattgagggaagtagacttgagccgttaaaaactcaaaagttcgaactgacacaggcgagccgtacacactgtagttatgtggtgcactggtcggttccgctgaccacccgtgactcttaccacgaccccgtccccggtgtggccccacctaccagcgacacacgcaggcggcttcttctcgtgagctcgcggtgaacccgaccacccgccgctgataaacgtcgccccccttgccacgacacgcgctacgcccacccatccactcgcaccccgcgccgcaccaacacacgcagaggtggtgaactggttgatcgatgcttgctgctgctgcgcgtcgaggcggctccatcggcggcaaccgctgatcgatcgatcgatcccgcgggtttcgtagcacccgagcaggtgagcgagcgagcgatcccctcccgcgcggccgcgcctcgatttggtcgcgattggtgctggattttctctctctctctctctctctctctacctttcctgtttcggtgggggttttggtggggttttgtggctcgaggtggtcggggatttctggggtgatgggagaggggctcgcgtggtggtggattgttcgctggaatggcggggaatgctgtgccgtttgggggattgatgccatggtgatgggtcgaaatgctggatggggttgagtttgttcaagtggttttgaattggaatctgtggagtttggggggaaatggggaatggggcttcgagtgcgcaaaggttttgcatgtgcggaattgcagctcgaggttttcgctggatttaggcgtagcttctgtgcgcgtgtttgtttagcgattttagcagttcgtgggctggtgccgccgcgtgtttgaatggtttagcgctttatttaccgttacagttgatgtctgcggtttttctggtgatttatgccagtttttagaggtgaatcgctgtgttttgggggaattctagagcccagggttgggtttatgggggcgagattttagctgttggattttaatcctatattgcgagaagcatgggagaactgcgatccgtcgtcagaggtgaacgctttcgaactctgatggttttaatgtggcagatattgtgaagcttatggtagcttcgttaacttgatcgacgtttttacttgtgctgctcgtgcgttgtggtagatttggcttgtgagagagcaggtggatggggtagattcagattacagagtggtttactgcatgtagcgatgtgtttgagttgtaacttgtgaggctgtaagattaaaatgttggcatgcgtggggtttttgggggtaatattttgttttgtttttgtttttgttttttgctagtgttttgacccaatccatctcccccatctttttttagtggaaaaccgctccctgttggtactactcaagtaaacttaccagaattacaatcctccaacaaaggaataataccctgtgctgtttgttgtgacaacttatctgtacatgatattgctagtttgctactgcagtatacctacatgctcacttatgtttgtttcttttagataatgtcacttatgtttgtgttttgcataatgttgataatttctcgaagaatgggtgctggaaagaagactcagaccgagaacgagttccgtgagctcccggaaaaggagctaggaggggtggtcttttgttgcaataacaacacattcgatgaatgcttcactaaacagttatttggttagtaaaagtcccttttcgcctgtcctaatttcatctaaatgatatgtaaaatccatacgcgtgtgattacttttattcaagaacattgacattgctaatcaacattcttttgaacttctcgtttaattgggaatccattcgtttgccttttgtttgataggtttgcctcaacgcaatatcttgtatgtgaagaatgttaaacctggcttgcctctctttctgttcaattatagtaacagacaattgcatggcattttcaaggctacaagcactggccagcttaatatcgaccgatttgcttggatgtctgaacagtctaatgatgcaaagacaaatgcaaagacaacaccatttcctgcacaggtataatagaaacaacatatactggtctttgttctggttatagtttcataagcattgtgagtatttgtgttcttcaggtccgcttctctaccaggacagagtgccctccacttccagaaagcaaatacaaaagtgtaatcataaacaattatcgcaaggataaacctagccacttccgttttgagctagaccatcgaccaacaagagatttgatttctttgtttctacctgctcctgttcgcgctaatcaaaacaaacttagtattccaaaacctcctgctaccgctcatactgttccaaatccatggaatcgacctctgccatttcttacagcaaaagcacctgttgtttctgataaagtgaagagtgaatccaatgtgaaggatgtggatcagttcaatgtttcatcacactcacatgatattgttcctcataccttgcctgatgtagaagtcgaccttgctagcacaagtacaacatcaaggagcaaccttaacaaagatgcttctggctgtgatgacctggttgctggtttgatcaaggaagataaagaatctgtggatgatgaccagcatgctaaaatggatttaccagtaaagctgcaagagctgtcttctttacaacagaaggaagccaatttcttggaggatgctcctgtttctacttcagctcaaagcatacgtcaagatacacggtttgctgctactctccccaaagattcatttaatgccacatctcaatgtgacacatcattgaaagatacatcctttgtgcaatgccatgaatatgctgaggtgccttaagctattccatcccttattaccattttcccttacgcaccatatttcagtgctacaacttatatattttggtgcgatgtttatggcctgctttttggcatttgtctgtagctgtatcaaattatcaatgatttatccaagaagaccgaagaaatggaaaagatgaaggtacttttcttcttgcttaaaatcagtaggatcttctcttttaaagaagaaaaggtataaatagatgaacccgttttcctaattggttttatctcttgtcagtatgtctggttttgtgggttttaaaccatgttcaaattttaaccggaaaaccaaactagtatatatgtgtttgatattgagttaattacgctgttcaagtgtgcaaactccgatcttgattatggtttgaacgttctaggttgattcagatcaagaaattttgttgttgaagaaattggtaaaggttatggaaagaaaagttgaacatctggaacagcagcttgagaaatcgcatagctcttcagcaccactcttcggtgtaacaaatgatgatgtagaagggccatcaatactcctaacaggtggccataatggcattaactggctgtcatcccttgatcatattgccctgcaacggacatactagaaactctaatgccaatgagctcagcccgtgcatatgcggctgttgccacattaaaggaccatgtcttcatttttggtggttggaatggcattcgcagttgtggtacaacacaggtaaacattcttcaatatgccaaacgtagtgctctatataagcaagctgttgaccatctgcatttgtttattgcagtggagtgctacaacaggggagccaataagtggataggattgccctgcttgaatcatgagaaagggcatcttgctggagctaccttgaatggtaaaatatttgctattggtgggggtgatgggtctcagtctttttcagaagtagagatgtttgatccagcagtggggaaatggatatacagtttgtccatgcagcaacctgtatggttctacttctactcccttataacacttgtatagagtagaatgtaccagcctttttggccaatttaatagggtcctggtcttcgctatgttctcactgtgattttcttgataaggctcaagatttattagatggcccaggaaaaaaacatgttgtgaagagaggctgtttgaactgcatttcctataatcacttacatctttgggttcttaatcttttacaagatgaatagtgctgctcacagaacagtttctactattatttcaatcatttcttacgtgtcgtaaatcagtaaaaaagtttgttctcgtggtgaactatgctgagtgatttagaatttagatagctgtttgagcagtagtgggcaagctgactgtgagttggacattcgcttgagcactagtcttacagggttggttggaccatttgcaaatctaatctaagctacattttgagcacttgaataggcaataaatatttttcaaattcaggctatttcaaattatggaatgcaaattgcaattcatgtaatttcatgggatttatgaggcatatacattgtaactttccagttcaccttgcatgaaatattatcccatatttttaatgtatttttatttttgaccaatatacccacctcaccaacatgtattttattgttccagcgatgtgctcctgctgcggctgaattaaatggcgttctctatgtaattggtggttatgatggcaacatgtacttacagttacgatccaccctcaccattctctccatgctttacttgattttgattctgagaccttcctattgaatgattgatcctcatatgcacaggtcagcagaaaggtatgatccaagggaaggcttctg

SEQ ID NO: 45016 - DNA, 4314 bp, Oryza sativa
attgttataatctatagtagaataagctgatagttgtttctttcctaattattagagcctagattattgagtttgcaagtataatgagggagtggggtggcatatggtgggtaatttttcacccaataatctagaaaaagctcacctaaatgagcttatcggattataataagctgggctccagattataataagctacttcaataagttgtctgattctttcagcttactcctaataatctggattataataatcccaagctgaaagaaacaggaccatgacgcgaaccgcttttctgcatttctgggttcattagagccatttttcctgttgccaaatgctggctccgagatgcacgagcttggatcctacaattctcaataagatcagacaactgagacaagtataaagcaatactcgattgagaggtaaatcttgaagcttgacggaacggaagcaaagagtgagatgcatcaggttccaattcccagtcgacacacaagctaaccttcaagtcacaaatttggtgtcgttaggcccttattgaaccgagttatccagaatccatccaaactaatccattccacccaaccatatcgttctttccagctttcctgtttagagccacgttatattctcttcactacaacattagccaaccaacttgggtttgatatatcatattaccgtatagcagttaacttttggctttagcacctgtgcaaagcacaaatgaagattcttcaaactccaattaacaacaaagattcctcagctcaatgacttgatttcctcttctaacaaccaagaatccgctttaccaaaaattatgccgtgcttcattagactcagtcatggatgagccaaaattttatctgaggaaccatcatctcttccatctataaaaccacaccaatactgggatactcccacattgcaaaacaagctcaagttttcaacaacgtaatggctcacagcttacctcttgatgtatggggttggatcaccaacctgcctccgttctcccaatggcgctccaacgccatgtccctttgcatctgccccacaccatcagcatcagaatcatcacagccatcggtgaacctatcagttgtcaaaacccctcccacccagccctcctttgtcaccttctccatctttgcaaattaccgtgtgccaatttctctgtggacgtcaaaaccagtccacctgaaatcatacacccagcagtctctagacgaacaagagatgttagagttgtttgttgacattgtggactgggtgctgagatccggaccaaacaaaaagctgtcctttcagtttcccagggcacagattcatggcaatctaaaggacgtgtttaacatagttttcttgtccctggccttcctagtttgcatctatgaggctccccatgctcttcgctgtcgatgcctcgaatccctgaggactcagctgactgggccaaagtgcaaagatgctgcaaagacctttgtcagaatgttgggagcaaaccttgaggagcaatggatgcagacaatgaatcttgcagtgactaactggattgttgagcaacgatcctcacaccattcatttggggtgccatcgccactgttctcatatgctctttcagcaagtgggctctggaaggtccagctatactgcccactcattgccatgagcatggaagatcctgcagtgccaacacaggatgagcgccttctcttctcgcttacttatcagcaacttgaaggtgtgattcagctcgcctacaaaacaatcagaagggacaactggattgatgtcgagataaaggtggacaacataaggtcagtaatttattcaaggatttgattctatctcatatgaactgtatacacacttactaatttaggtgaaaataaaaaacctactcatcctgaggtgacagtagtatcactcgggggaaccaattaagtttgcggcatgcaaagcgtagctgcatatgtttggtaaaaaaagctaaaggtttaactagcaaataatttggttggtgcctacagtaaggtaacattgagcaagcaattatgcatagttcggtaacatgcttctccctgtataccagctgcagaagaactcaatttaggtagttaaatcagagttttctagaccttgaaaagcagtctatctacaaactgaattgtttcaaagttacaattaactgcacaaggaaaaaaaacaaccatacgtgtatcatctaaaaccaagagcggcacttacagtggattcatctcaggtgtgatgtggactctttggtctccgagatcctcatgactgaacgtggacatggctctgaggagaagcactttccatcacgtgttatgctgcaaatcacacctatgcaacaatcagatgtcctgtcggtttcagtcagcaagtcctccgacaaccccacgcatgagtttggccttgagaagggcattgaaggttcattcgaccccccaaacacatttggactaaaggcatcggtcagcgaaagcctcacactgaccatgaaaccctggaaatttgaacagtctgtgcatggaaacactacaaccttgaactggtttctccatgatggtgtaaacggaagggaggtttattcttcaaagccttccaagctctccctgcttcagccacgggcctggtttcgtgacaggtactcgaccgtgtatcgcccattcacgaagaagggtggtgtcattttcgcacgtgatgaatatggagacagcgtctggtggaagatctgtggtgcagcattagggaagaccatggactgggagattagaggctggatttggctgacctactggcctaacaaacagaagacctttcacagtgaaacaaggaggcttgaattcagagaatgtctgcaacttccccttatgaaatctccatgatgtatcttttggtactttgaatgaccatagagcgctataatgcgatagtagtatgtttaagtatttaaaattccatatgcatgcaaatttgtactatcatagtttgtcatacttttatgcatgcagaaataaacttcctaatatacctgtttgagaatttaattcgatcctaaagtctttgaagtatctgccactcgttttgaatatctaacctgagtttaaccacactaaaataagcaaaaatattgacagagtaagctcattaaatatagattcatttttaccacagtgcactcaacacacagtacaacttcttgtaccagttggcttatagtatatataaagctattacccagtaagacgaaaaccgtaaatgactacaaagcttcaggttgcagatatttgaagtatcccctagcagctagaatgaaatattcctattgacccgcagcatgactactactctaataggagaaaaggctaaacccatcatctccctcttggtactcttcatgtacttccgttttctgatcagcacttaattcaacaattatcatctcaacaacttcatggacattgaaataatcataacttatgttcacttctttgtgtaaaacgatcccttctgattcacatacctccatattcttccgctcctgacaaacacgtttcaagccattgctcccttctgttttaacatcctgcacctcagggactacacgttccaacacatccttcttatcaggctgatacaacacagctggcccattagccacgatgaaaggaggagattccagctcatccttctcatcagaaggtatagtggccggcccattagacatcatcaatgaaggtgctgatgtgcagccagagttggcatctgtggaattatctgcaaaattgacacgtgctgtgggaccatacattgcccttgccgcctcatcgtatgcatgcgcagcctccagcgcagtaggaaatgatcctagccataggcgccttccacggtttggttcacggatctcagccacccacttaccccatgtccgttgcctgacaccgcggtaagcacaatttgaattttccggacctcctttcccagccatgcaccctttcttggaccccttggctggcgctttcctggagctattctcctcctggagcttctggttttgctccttccaccacttgatggtttcagcgattgaatcagggccatcgcttttccttcgcgttctcttcttcctgacccaatgaggtaactcaataattccacaaagctgaacattgcaagacacaaatcgaaacagcatgcaattgaaattatgaaaaacaacaaaccaaaagcggaatcttttcatttgtccaaaaatcaaggaggctatcagcaatcaa

SEQ ID NO: 45017 - DNA, 3051 bp, Oryza sativa
gcgaggcgggtcaacacacgagttgtgccacgggcacccgcaaccgcgtcctgtcacggcatctccctctcgcgttcgcgtcctcgtgtcggtgacaacacgtccccgtttcgataatcgaatttcattacgaattctcctgccggaaatttttgaaacttacggctgctcgtgtttagtacacctcaattacccaaacttttaacttttcatcacatcatatcacattcaaaacttttctacacataaatttttaatttttttcatgaactatatacaacttacaacttggatggatggtctgtcgattcatccttgaaaaattccaacttcgaatgcatcgcagttaaatctaaaattgaacattttacagtattatgaatctagataagctcttatatttagaacgaagggagtatgttctttttttaaaaaagaaaaatgagtgtgtgtaaaagggtatacttttgtgactgtgtgcgcgtataataggtatctgtggtgttgtatattttccgtgtaacagggaaaatcattacgtttcgttcgtctacagttgattataagactatagggtgtgttcggatgccatttttctcatctcatctctctcgtttttatatgcacgtttttcaaactgctaaatggtgtgtttttttgcaaaaagtttatatacgaaagttgcttaaaaaatcaaattaatctatttttttaaaaaaaatagcaaatacttaattaattacgtgctaataggccgccccgttttccgtacgcactatgcaaagttcccatccctggtagcgaacacattatcaagaaaagaacttatgtgtacaacatttatatattgtgtgtactgatgacttaaaaatcaaatgataaaaaataaactacgataaataaataatcaaataaacacaaaaataggttttaaaattttaaattttagttatgcctaataatacggagggtgcaaattggactgttgatatagcgtttgacctggttgttgcgttgagcgttgatgtgtataccatggccgctgatctacgtggcggcagttcggtacaggtggtgataggagacgagtcggcgggttggctgatctgttcacgctgacgcaacagacgcgacgcgtcgtgccgtgccgtgccgccctagcaatcctcctcggcggcggcggcgtccagccaaatggatgttgatgggctgtcacccacccccgctaatgggccggcccgtctcgaatctacccgggcccagcccacccaccgacagccgcttcgccatttccgctccgcgctttcctttccctcctcgcctcctcccgttttgaattttttcctctccattttttttcttttttttgctcgtctcttcctcatcctctcaccgccgccgccgccgcgagcgatttctggctgtgccgccgggatgcagaggaggtggcaggtgtgggggaagcccgacgggagcctcgtctgggtacccgcctccgacgggccgccgccaccggcggcggcggccagtgaggcgccgcttcctcgtcccgatccgcagccggctgcgacggagctgggagaggcgcgatccggcgatgcgattcccgaaggttcggtctctccctctctctctctctcttcgaggtactattcgttcgtggaatgagcccccgcattattactgatcccctttcgcctcgaaaccctaggccccggcgccgccgatggatgcagcgtcccgtcgatggctgacctcttcaaccaaggtgccgcactgccgcctcgtccacccatctcatctccactcgtccgtgtgcgggcacgcgcgtgcttgcctcccatttacgaacttgttatgccactgcattgtactaagtgtcatgtttgtttgctgtggatgtggaaatcgcagctttggataagctggttgctgctgatggaatggccgaagcgatcgaggattcagggaaaggtgcggtgttctgcactgggttggggggatcagttgccgtcagcgagagggctgtagagagggccaaggcattggttggggaggtcgcggaggagataagtaatgagagaagtaagaggttttgcggtttgcttttttcaaagtgttacattctcacaacaattttattggtcttgtggccctccttttgtcttttggggacacataatatccgcacatcttagatatattagaagaaacgaagacaacaagtcattgcagtccactgaattacaaacaaacaagagaaaaatggagcaataaatttgaattatttccaatcttctggtcatgccctttcctctttagttgctgtgatgatttcctcgggctactactagatgaagatacccacacacttttctttttcttaaaagttgctgcctatcttttctgaagttttgcatttcttgctttgttgatagcatggaattcaatgtctttctgttctctttctccaagacttgcataccaggctgatacttgtatgtattgcagggcaaccatttggtgatggttctaatttggagtgcggattgggagaaagtaatgtttcatttaaaggtaagttttgtttcaatctctcttcttggagatcaggttggatgattcaactgtaggtagaagtacaaagttctgattagttacacattctcgaggttcaatggtataattcgcctttgcatcttatgaaattcaggtggtgtacataaagatagtttgtctccgatgttccaaaccggatcgggtaaaatggtttcactgagcaagggctcaattcagaaggctagagctgttttagaaggtaggaagtttgtcatctgcttactttctgtgtaattacgcagaatgtttcatttctttgggcatggtgacatatatttggctctaattaatttaggatagtttgagctgtgtagcactcgacaatctatcatgataatgaatcttcgtaatctattattcaggaaatgccgagaattcttctgtcattgctgtacagtctatgttccatactggatggttaggccagaccca

SEQ ID NO: 45018 - DNA, 1407 bp, Oryza sativa
tttgtgtgcaggcttgtatttttttactgcataatgcacaaggtcatcagctttgcttatttttctattgggttcaggacatgaagatactaatgtctccaccactacttttcaaactgaaacaccaacgtctgttctgatgagtggtggcctgactatgaatgatagatctgttacacctgaggggggtgtttcaatgcaaggtacatggttttctgaagtttcctgtaaaaggcttttttttcatttcatttaaacctgtgttactatctagtcaaatttggaacaataaaaatatttactgttgatgcgttttagatatttgccatactaatcactgtcatccaacaggaaattttttggaggctgatggtcacttgccattatttcaaactgggttagggaggtccatttcagtaagtaaaggctcaattaagagagcaagtgcacttctggagccaaggaacattacaaaagaactggaaggtaggtttcactcaacatgttgcttactgtggttttgccattgaaatgtgtttttattagtctaccaaggataaaggaggcatgtagcatgttaacaaaaagttcttcatctgttagatgaagctcactcagatgatggctgtgccactccaatgttcaaaactggatcaggaaggtctatcacagcaagtgaaaattctagaaagaaagcccacgttgtcttagagggcgaggaaccagtaaaaaatggtaaataaatgttctcaattcatagctccttcacaaaaaaagttggtatgaatagcttttcacagctaactctcagtttaatattgatttcatatgtgcatatcagtaaataatgacactggagaagccattgctccaatgctccatgctggaatgcagaagtttgcaccccaaaatagaaactcaagtcataaggcgatcaccctcatggagcaagggagctctatgaaagaaggtaaaattttaattgctgggttgcgctttagcgtgtctttgcacagttaattcaaatttttgttcagaaaaaataaaagcaaaccaggtatatttgttttctgttccattaacatgcaccttttttctaagaatacatagaccgtggaaacgaaccaccaatgtttcgaactggatctgggaagtcagtcttgattagtcacagctccgtgcagaaggcaagggcggttctggaggaagaaggcaatatgaagaaaggtgtgtataatgccaatggaaatattctgaggttttttttttttgagaaatagatccaccacttgtttcacctcacatctttccaccaatctttgcatttctccgccatctctgtacttcatatccatgaaaatgagtaaaagtagggtgtatctgtacagatttctatttaaagatgca

SEQ ID NO: 45019 - DNA, 963 bp, Oryza sativa
attatctattctcgtaggaccaaagtgaaaaagtttactacataaggactaatcgcagaataagtggatttccaagggggttcgagtaagaatccgggtcaaaaacgggggaactgctttaaattcgcgcgagcacgatcgacgcgcacccagccacccacccgcgccccaaatcacgaggaggcgaagccgcccatctcatcgccggagctcgcgaattcgccgccgcgattccgaccaccgccgcgccggcgcccgcgcccgctacggtactccgccgccgtgctgagatcgccgggggagccatgtcgcggtccctgagcatgaggtcgtcgatgagcatgaggtcgcgccgcgacctgcctcctccccagcaggtgagggatccctcctctccccgtgccttgggtattgcgagtgtaacatttgcgcgaggtgcgcgggattcgctgttgcgtgcgcgatgcgctagtttgatctcggtgtttttcgaccttggggcgtagaggggcgagggggtcgattacccgactcttcgtggcgaatttgaggaaactagggttctagtaccgaatcatgtccaattgcgaatctcgccattttattgtgtggaactactagctggaaaaatcaatcgtaatatttctaagaaaaattaagattacttattgtggtttgatgatgataaaaaaaggcatcaatgatttactctccgcagtccgcaccacctggttgtgcgcataatcactagggccttgtccggttacgcccggattcaatccgggccgggaatgacaagtacagtaagaaatttatgatagatacaatgagagaccgggaattattccgggccgggagccaatttactcatgatagagacaataagagaccgggaatcaatccactagtcaagaggtgtggaactaatccggatgttttgttgtccctatcatgagtaaatta

SEQ ID NO: 45020 - DNA, 11640 bp, Oryza sativa
  unsure (1)..(11640): unsure at all n locations
annnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctggggagatccctcaaaaattagcatccttggacttcctatcaacattgaacctatcaaataatatgctggagggaagaataccagagtcacctcatttcttgacactccacaatagttcatttataagaaatgctggtttgtgtgggcctccactgtcaaacgaatgcagcaacaaatcaacatcttctgaagagaaatctgtagacgttatgctatttctcttcgttggattgggttttggtgttgggttcgctattgcagttgtagtttcatggaaaccttgcattggcaaataatctttgaaggaatccaccctttttttatatttatctgttcaggagtctgccagtctgcttccccttgtaattttagctgtaattgtagctagcatgtatataatactatgtgcatggacaacacttttccatcatgcatgcatcctataagattagttgtttattaccttgaaaattttatacaagccaacaaacaattgttatgtctgaaacaagaaaggaattgaaatgcatgacctgtatgtggcattattagggtcagtttaacttgtagcatagatcagtgagctatatatcatgatcttgtgtttgaagtacatacttacgcagaacttactttgagtaccaaacaaccatactagaacaaaattttctgtgtgaagaactgaagtctgaagatcacataattacgcgttggaatgaaactttctgtgaaaagatcacttgcaatacaattgtaatcagagttatatgctgttattcttactagttgtgtaatactagcccgaatcttgtatgtggaccaaattaggtaaacatataggaactaaaactaaatgatgtcatccgagaacaatgcacaagcaaagcttaaaataaactgaaataagaaaacgaaattcattaataaaaactaaaactacacgattctttattaagtatcagctctacatctatatctaaaactaaaacggcgtcatatatcaggtcgcacattgaactgctagtctcctaataggccaataccacagcagagcaggaaaatcaacaccggaacactaagctgcattcgtaatttggtactagaatcgtagtaattccaaaatgggttcataatattcgagaaatcctagatttcacacactaacctgtgcaatgcagctgatggcaggaccattccatcaaacacctggcgtgcagagctcctgaggacatcgccatatggtgaccacattggttggtccaattggttgggatttcggtgtacgggctgcggtggtgggaatgggataggggagttcgccgagtactccaactccaaagtgggatgaagcggaggaggggacgacgaggggaagggctcgcaagtggtggccgctcctctctctctctctctctcgggtagttaactcatcatatcttcctatatagttgtacccactaaggagcatttacttgtataaagcaaagcatataagaaaccacatcatcaataattctaagccatcgagttgtattagtacatagttatcagccgttggataaagaagctactcatccatttaatttaatcattgattactcatccagtcacctccatttaactcataatcacgcgtgacattgttatccattttgcgcataatactatgttttcttctcccaagtcatccgagataatgcaaacttatctttttctaatataacttaaattattgtataagatgcgatttttgttttgttataaacaattggataacataaggtaattagacatcattaacataaacctatttttgaaacaagcttgatataaagcaaagaggtgcaggatactctaatagacgacatccagattgtgcatgaaaataactttcgtgcatcataagaaatcacaataacgtttaaaaaaataaaagatgaatggtattgtaatagcataggctatatattaagccacattatcatttattttgtatatatacagagttacatctaatcatttaaaatattgattttatttgacgataaaactagcaaatcccgcggcaagacgtggggtgccaactagttcatcatatgacaaaaccaatgaacatgcaaccaataagtactaaaatgatttcttgggttccgataaaaaaaattaatatagcacatagtgactacaaataaaatgacttcttgggtttcgatcaaaaatttaatatagcacagtgactacaaataggacttagacttttggaaaaaccaaataatgaaataggactttggcttttagaaggagggagtacatcgtaggcgtacagccgtacacggcgaccggctacatcctgtgcatatgtgggtactatgaagtgtcatgtagaacgaaactgctcccgaaataatggaaggagtcgattttcagtcctttttgtttcgggttaaaattattataatctagattattaagtcagataataagctggattataataagggactatcatatatctgttgacagaaaatcccatcttctatctttcgaattttggaccattggatatgctttcagattcgtgcagaacccttaaccataactcctctcctcctcccccgttcagatcgcgccgccaccactcctcatcccgtccctcgcgcgattccccgccaccaccccaccgcacctttgcccgcctcgccgactggccggaaagagtcaacggcgccggcgaggacccctggtgagccctctccccttcccctctcccctctcccctctcccccttctcccctctctttcttctcaacaccgcgacggcgaggatgtgaggtgcccccgcctcgctgtcttccccgtatctggtggctccccgccactagatccgcaaccatcgtccaccgcctcctaaccgcacgcttgcttttcccctgccaccaatgccagcccaccgtcatcctccatccccgcggctctggcactgccgccggcgcctcgccgcccgcccgatccgccacccaccgccaggctgccgcctcccacggccctccctctaaagccagtgagctccccctcttctccctccccctcccacccctcccacctccaccacgtcctaggaccctaacccgtagggtcctttgctggagtctagggtgtcgccagcgctggagaagaggaggaggtcaccagagtcagaggagaaggcctggagcacgaatcgcgcagctcatccgatggtccaaaatctgtaagatttggggatatattttttgtcgacagaaggttagcaattccgttataattaactaaagtagaataatctaaaagattgtgagggtatatctgattttgcaattaagtgagataaaataaacttaaattatggaaggagtcggtttccactagttttaaaaggagttttttttagaaatagtacaactttaatggaaaattagagtgaattgcactttgggccatgttttattaccaaagtttcactttggaccaccctgtacgtaatcttttcgctttggactaggtaactttgcctttgttgcacagtgaactaccctaactcttttcgcttgtgatgtctagcgtctctttagacaaaagtatgtcatgcatataggtatgaaagtttgctggcatgccgttaacaatttgctcgaagttatcgaagaaatgaaaatgtgttttggggtggtccattgtgcactagtccaaagtgaaaagattagataaagggtggtacaaagtgaaactttggcaataaaatatggcccaaagtgaaattatctcggaaaattataaaagtaaatgctggttgataaaattacaaatttagcatcttgtcaaacaagcattgttcaataagcatacctgtcaaacaacagcttgggccgttcgacaggttagttagcttgatttacccccctaaactcgaaaatcggacatttgacaccctaaactcttaagaccggacaaattaccaccctaacatggttcgaagcggttttcagcctacgtggcacacacgtggcgatacagtcagcaaagataaataaaaaacaagtgggacccacttgtcagcgtttttttcccttcccttctctgcctctctctctcgattcgcagagaagagagcacacggctacggcgaacgtgacgcgctctgcctccgcctccaccaccgaccgcccgaactcgccgcctccatcgccggttgcccgagcttgctctgtgttcgccggcggatgtggttggacggccacgatgccaacgaccaggacgacggaccgttcgccgcctccacctcgtgaacaagagaagcagagaagggaaggggaaaaattgccggcttccccgacgacctctgcctcgccggcccgcatggcgtgttttgtgacgacgacgacgatgatggcaacgcgtcccatgttgtcagcatctcgctcggctacgtctctgacttctctgccaacccgagctgcgcgggcgccctccgcctccgtcaccgccacactcctcacgtccggcctcctcgccgcctccttcccgcgcctatgcagcctcttcgtctacgactgcttcgttggcgacgataacacgcgaccgctcccgccgctcaagtggcagctccctcccacgcttcagtccaggacctcgtgctcgtcaataaccccacgctctccggccgcctcgccatctccaccgctagcctcccgctcctccgccgaacgcggaggcggagggcggagctgggaggcgagtggcggtgcgcatggctaggtcgctccggccggcggcgagcagctgaagcatctaggcccccgttgtgaattttggtaattaatgacaagcgctaattgtggactaaccgttatctttgagatattcattgtgagttaggttcacttattatgtacgcatggatgatcaccgaaggattaaaattgacggcgcaaagcgaaggaaaagaagacggtaaaactagtgctttagttttaaattgatcgaggtgtaaggcgatcaaatttgctagtttatctttagcttcgccgtactattaagaggggtaatgacctagcaaagagatgattttaattgccacattaggtcatttgcatgtagacttgtgctcacattttatcacacacacacacacatatgtattcactgtgtctcggcctgaccaggggcggtcagaccggccacatagtggcggtctgaccagagtgccctggccggtctgaccggccccaagtgcgcggtctgaccggtgcataaggccagtctgaccggaggcacttgtgcggtcagaccggccccctggaggccgggatggtgttgctcggggtggccgatacaaagccgacggagtggtattcggtcagaccgagctaacggcggtctgaccgagccgaggccggtctgaccggccactcaacgtcggtctaaccggccaggccgatggggccctctgatagggctacaacagctagttttctagccgttgcagagtagcacggtctgaccggccacatacctccggtcagaccggcggcacacagagttgggggatttcgcccccaacggttagttttggttggtgggagtataaatactccccctccagcatcaagggggctttcttggcacccaattcaattgcatacaccccttgcatctctcatacacccacttgagctttgtgttcttccatctaagtgtttgagggttgttctagccaagagtcaagtgcatttgcttccattgtagagctagtgtggcacttgatcatctccgagccgcgtcattgcttgttactcttggaggttgccgcctcctagacggcttgtgaaggagttgcccggtgacctctccgagaagattgtggaggaggcccggcgccggtttgtgagtggtttggagttcaccaccttcggagtgaaggaagaactaccccgagtgatcgaggcttgggtagtcctctccgtgggccggctcccgccttacccaccccttgacgaagggggcgtgcggtggctttgtggttgagcggtggagttgggctcgcctcaacggggagtaggaaactggcgagtttccgaacctcggtgaaaaatctcttgtctccttgtgtcatttgattgtcgtatttacatttgtgcaattacattcctagagacatacttgagatcatatcaccctaggattgcaaaacattgacataggagtgtaatttactttcctagagaattaattgagccactatcaccataggtttgcaaaacataacctagttgcttagttagacttaaccctcaccgagcctagaaacttaggttagttttgattaagtgtcatttaggtttttaaatcgcctattcacccccccctctagtcgacatctcgatcctacagcagcggcgggcgcgacggccggggagaggaaatcgttggcgcggctgtgtggctccggttgacggcgacgacggttgatggggatgacatggatggacggcgaactcgtcgccgtagcgcaccgcctccgatgccctcctcggcgcctcccaccatgccctccacgctacgcgcgccactcgccgcgccaccccgaggatgattcatcgccggccgcctgcctgagcagagagagagagagagagagagagagtgggagggagggagggaggccgtgcatcccgctgactccccgtcggaaccgagaagaggctccgcacctctctccgccgcctccaacaccctcctggcctcctcggcatcgcccgttgcctgccacgtcctccctgcgttctgccgccagcccgcgcgcgccgaccacccgtccgccccagcacgccgccgcccgccgctcatcaccggcccccgcgcaccgactacccgtccgcctccacgcgcctccactcaccgtgctgcacgctctgagcccgagagaggggaaaaggatgaggagaggggaagataaggtatgataggcgggtcccactattttttaaaaaataaaatgctgactggattgccacgtgtacgccacgtaggacaaaaccgctctagattcggtcgaagggggtaatttgtccggtattgaaagttcagggtgagcaatgtctggttttcgagtttaggggggtaaatcatacaaccgcgatagttcagggaggtaattcgtactttttactttttaaaaaagaaaatagtacatgtgcatgtgcagcctaccgaactccacaacccactcgatgcatgtgcatgcatacacatcccaaattcccaatattttaagcccaatcgaacaatctgttcttcgacagtgtgctaaatttgtaattttagacaaccaatatctaattttacaattttcgttaaatttgtattatttctaaaaaagttcttttaaaagattgtgagggcacatccaattttgcgattaagggagataaaacagacttattccttctcaaataacagtatttccaacggtaaatctaattggagaggcctctccaattagtcttaaccagagacacccacgtgctagtactttaggagttttggttgctattagtatatccaatagtgcatatcttgttttcttcttatagaattttctcttaaactaattatccaatctacaatctgattacaccattactttcgttgcaattaaatatttacaacaagatcttacatgattatattacgatgaaaaatatttatatttataaattacttttattatatacgtaagttacttttatcatatatatataagttacttttatatttgactaaattacttctatacattcataatactctaagttgattatttttattattgtttttagttaattctatattttgtggactttataaatcttctctactttactcgtgaatttactctacatagtttcttatttcagttcactcacaatataattatttctactatagagagttacttcctccgtttcataatgtaagtcattttagcattgcccatattcatatagatgttaatgaatctagacatagttctaaattaaagttactttcttttttgttataaattacttctataatatatgtaaattacttttaagctttactaaatttacttttatatgtctaagaagtaacttagtgaaatctaaaagtaatttagacatatcataaaagtaatttatgatttttcatcaaaatataatcatgtgagatcttgttgtaaagatttaattgttacgaacacaacgatgtaatcggattataaatcgtttgagtaatttaagagaaacttctttaagaagaaaaaatatatagatattgagtgtattagtagctttttttgaaaagaagggtgtctctgtttagtactatccagctagcactctcggtctcagtgtagttgtgtactatttccaaacgtagcacgattagtgtccgaggtgaattggcggatctacggctacgcgacgtgtcacgtgtgcggcactacagccatctgcaaggagcggatatgctctcggattaatctgttttcgtccgtaagtgctacagtttgtgatttgtctgatcatgacaaaggtctacacgcatgtacacctgttcacataatgacacgatcaaaacatgttaagtacgtcccatgtacgatacgactacgatgccaacggcatctttgattgatttgatattagtatatatcaccatcacactatcacaattcacagtcacacaagtcaggcttggagtattgaacaggctctctctagctctacatgtatacaatagtcattcactcattctcactcagccgccacccgccaagatgtcccctcgggtagcccaacgagagaacgagccattgttacttgtactcgtcctcctcatacaaaccttgatcgcgagctcgcttccatgcttgccggaccaggcctacctgaccatcttgcaccgtcttcatctcattttagatctggtctacttcctaactttttcttcaaactttcaactttttcatcatatcaaaactttcatacacacataaactttcaacttttctgtcatatcgtttcaattttaatcaaacttctaattttagcgtgagctaaatacaccctaaagcttagcgtacatggcaggacacgtcctcgaatcttttctgcatcttcgtcaggccaacaaacaagagccacagagaagatgctcctttttccttgacccggagagcaagtttaatagtatagctaactactagctccaattcacctatagtcaatctaatagcttatttatacaatatttatatattacactattaataattggtcccacctgttatgcaaacaccgcgttttgaagtccgtgctacagctggctataaatctgtagcgtgctactcttctctcttcttatttatcttcttaaaatatgtttaaagctaactttgatcctgcaattgtacctgctcggataaattgataatgcggtttaaactttctatgccattgcactctctctgccctaaaatgatcgaccaatgaatttcaacagagacatatccagattcgttgatataggatgaatcatatctcatctaagttaagttattttagggcagagggagtacatctcaagtctaaataatctaagtatagaaaactcatggctacacttattttacgatgaagataactcatggctatacttattttacgatggaggtagtaggtccgtttcgttccagatattcaaacagtctgtacgcaaaaagccattcaacggccgcgacagtacatgggttgaacgttaagcttacgctaccacaccgcgacacgggctcatatttcattttctaaagactagccatgcagtcatcgacaacgacaggactaaaacagaggcgtcatttcacaacagaaaaattcacatgtaaggatcaacggttcaacaccatcttcagaagaaaagaatatgataaaaattaagtttttttatgtaaaataagatgatattaacgtataattaatttaagttttaattattataaacttaaaagatcaactttcatactgaaagttttcgcacaaaacacaccgtttagtagtttaaaaaacgtgccataaaaatcttaatcttcatctaacttttattggagaaaaatgaaggggttccaacactgcatgaacagtgtcattggtttttcttcttgactttaaatgaatgagcttaccttgacttcgcccgccattcccacggagacggagtgaactccacgtccattgatgggttgctttaccagatcgtaggaagcaagatgttatgtaatctcactagccaacatagggtgcgtttagttcacgttaaaattagaagtttgattaaaattgaaatgatgtgacgaaaaagttaaaagtttgtatgtgtaggaaagttttaatatgatagaaaagttaaaagtttgaagaaaaaattgggaactaaatcaggccataggccatagattgtacagaaacaggcctggatgacacgggatgtcaagttttcacacggagaggaatgaaattcgcgatatatatgcatggtcaggagccaggatgtcaagttttcacatgattcagtaagcaagcaccaagtgaactcgcaagatgaactacacgcatagatgcctccacagccacaaactccctcttctcatcctcctcattgccatcgtcgtcatactcatacagccatactccatccatgctgctgccaacagcagcaacaccaccatcagatgcctgacatctcagtcatccgccctcctccagctgaagagctccttccacgacgcgagccgcctctcgtcctggcaaccggacaccgactgctgccgatgggagggcgtcacctgccgcatggcttctgggcatgtcgttgtgctggacctcagtgatggttatcttcagagcaatgggctgcaccctgcactgttcaacctcaccttgctcacaaacctcgccctcagtggcaatgacttcatgggagcacaactcccagattctgggtttgagcggctttcgaaacttgtcagccttgacctctctgcgaccaactttgctggccagatccccattggcattggaaatctgagcaacatgcttgctcttgacttgtctcataaccccaatttgtacctcacggagccaagttttcagaccttcatagcaaacctgagcaatctgagagagctctaccttgatgagatggacctctctagcagcggggcaacttggtcaagcgatgtagcagcttctgctccacagattcagatacttagcttcatgtcatgtggcttgtctggtttcattgatccctccttctcacgactccgttcactgacaatgatcaacgtcagactcaatgtcatcagtggcatggttcctgagttctttgccaacttctctttcttaacaattc

SEQ ID NO: 45021 - DNA, 1003 bp, Oryza sativa
caggtggtaatactgaatagaacctactccttactttaaaaggttattgatgttttagtattttgccgcattgactaggaaatgccctagatcacaagtaacttaaaaattagcttctactccagtgagtccagtccatttgcactgctacttttatttatatttataagagagcctacaaattatagcttgttgactataactagatgtgtatgcaggaacaattccaaagtccatcttcgcacttcctgcgttgcaatcactatatctagattctaatcaactttctggtcatttagaagacatccctgttccattatcttcatctgtgtatgacattgatttaagcaacaattggcttcatggccccattcccaaatcatttttctgtcttccaaatcttgagtatctcaatcttgagtcaaatcacttgaccggcatagtggaacttaggcctttctggagactaagaagcctttattttctgggtttctctaacaataagctgtcggtgattgatggagaagattctccatctcaatatctccctaagattcagcacctaggactagcatgttgcaacctcacaaaacttccaagaattctgagacatctatatgacattcttgagctagacctttcaagtaataagattggtggagttataccaggatggatatgggagatttggaaggacacccttggatcattggacctctcgaacaatgcatttactagcctggagaactctccctctcttgttacatttacacatctaagccatctaaatctcagtttcaatagacttcaaggagaaatacccataccagccatatcattgccttatggtgtagttgtattggattactcaaacaatgggttctcttccatactacgtacatttggtaggtatcttaacaaagtagcctatattaacttgtccaaaaacaaactaaaaggctatgtacccatttccatttgtagtatgaagaaactccaattc

SEQ ID NO: 45022 - DNA, 18725 bp, Oryza sativa
agaatgctaactacctttaaagcaattgatttctcaaataactcatttgttggagttattcctggaacgatagggagtcttgtttcacttcatggacttaacatgtcacataataatttcactggagcaatcccgcaacagcttggtaacttggctcagctagagtccttggatctctcttggaaccagctctcaggggtaataccacatgagttaacatttctaacttctctttcttggctgaatctttcgaataacaacttgactggaagaataccacagagcaaccagttcttgtcgttttccaacagttcatttgaaggtaatttgggcctctgtggaaggccactatccaaagattgtgatagttctggttcaataactccaaatacagaagcttcttcagaagacagcagtttgtggcaagataaagtaggggtcatcctaatgtttgtctttgctggcttggggtttgtggttggctttatgctgacaatcatatttcaactggtttgccaggtcaaagggggaacctactgtatttgttagaaatatcactgaatctactttgctttggctttggaaaatagtgtagttattacttaaaagcagtttgccccgtcactgtgtgtccttacctaaaataatagcgtgaacttagaaatgaccttatttcccaggtatcacttatgagtgctatataaaatgcttgttgaaattaaggtctgggtttcttgtagatgttacttattaaaagaatgttatggttttcttaattggtaaatgagtccaacaaagaattagaacttatgaaaacagtaaactgttactgggtaccaatcagagcagccagttaaattttgtaatgtccaaactacaacaatttttttaagaaatagcacaatctccaagtgagctctcatacaccttgcatactgtttttctacagagcaaactagtcagctaaacttttatagttttatctcacatccacagaagctattagtttccagtttcttattttccctttttatggcttcatagaagaaattaacaggcattctaaatatgatccagtgttatgaattccatttaataaaaacagaagccaaaagtccaagctgggctcgtctaagaacaatgcaaaatcaaggccgaaaataggctgaaaaacaaaaggatctaccaagcaccaagtactccctttgtccaaagaaaaggtgtatcttgccttgtacatgacaattgagacattgaaaatgactagaatagctacaattattatctctagtgactatatctattgcattcatgaatggaaaaggtaaagctggatggttactaggggaataattggaatatgaaatacatcctatatctttgtgcatggtcattggaaagtatgcctgatattttggaggaatggtataactctaaaaatattgattttattgtatgatcaataaaagagctatatgtcatatttgtccgtgaagttccttatgatttctcagaaagattgacaatgacctaatagaagacaacattttcagtattagagataaactattttcttataggccaaatgcagtgagaattgaaatagacatgtgcgtgttagcatgtaggcgatgataccaacagaaagtgacccaagagttcgtcattgtaggtgctgaacaatcacatatgcaagtaaactgccattcctaataccacggcatcaaacatccagtaagagctcgttttcgatagatgctaagcacaatcaacaatggaagagtattctaggaatcctaaacccaaatactgcaccgcatacaccaaatttggaaaatgaaacgcttcaggtgctctcacctgtacattgcagccgctgagaggcgcatttcctcgaacacgtggtggtaggagaggacgacgagaccgatggcaataggatgaactgcgcgcatttccttggacatgtccatggccatggagaccccgttaattgccgactgcgacgatctggaaccttggataccatctctctccctcgtcgcctcctcaatctcacccctctaccaccacacgcccccattccgccgagtacttcgagtgggatgaggtggagtagaaggatgacgaggagtggaagtactccagggcgcggcatgcgcttcagccacggcgtacaggagagggagatcgccccgagctcgccacgaggatggccgggagagaccccgcccgcctgcagccaataccgcctccaaccgccgctgcacatcttcactttctctcaattcggaggcgtcgcagagaggcaaagcaaccggaggcgtacatggccgcctcgcgtctggtcatctggtgttgtaaacggcggcgccggccatcctcgtcgtcgccgggcaacatcctgccctacgcctccccgtcgaagtagttttttttttcaagggcttttgaggccccaatttccattgacagagatgagatagtatcatagtaaagctagtactcccttcgtaaaaaaaaaaaaaaaaagaaaaatcctgggtttctgtgtgcaacgtttgaccgtccgtttcattttaaaaaattatgaaaaaaattaaaaagataagtcaagcataaagtattaatcatgttttatcatctaacaataatgaaaatactagttataaaaaaaattcatatgagacggacagtcaaacgttggacacaaaaatctaagatttgtctttttttaagacggagggagtacaagattcttaaaggaaacaaaaggactaagcgcctgttcaccattttcaaccatactaattttttttaattaagttgtcaaaaaaatatctacgtttaattgttaccatatttggtaaatacataagaaatcatgtcaaaattttggcaatattaccatcttgcctttggtaaggtttactttggctacaatctaaacaggctctaaagaaaacaaaagatccagaatttcaacgcagcaacctcaagaaaaaaggggaactcggtctaagggcaacctcaagaataaaggagaactcggtctaagggcatctacaatcagaacactctaagactaccctcactaactgagagtactctctgggaaaccccccctcacaatgaaagataccctagtagcctaacgagtgcccctagcccaaaaagcccacgtaggtattttactatactacccctctgttctccccccccccctctctcttctcatttaccggcgcgcctcctcccctccgccgctcacctctctctccttctccctctcgttgccgccgctcgccggagactcgaggcgtgctcggcgatggcgcggtccttggccgcggcggcctcgtcggaccgggagcggcgtcatggtgcgtcacaggagcagcgggagcgacggcgaggacgacgaggagggccgcctctcctgttgccggcgtccaccaccgcccctctctcttactctctctcccgtcggcgtcctccccggcatcctccgcctcgcgtcgtggtcagtcgggagcgccagatccggcgccgtagtgggtggatctaggccccccgtggcgccggcggtggcgggcaaggcaccggcggaggaggccgggcaaggcgcgcgaggcggcgagcacaggcgcctcaagccatctccgcccgtcgctagctggtggtcgatggctaccgcggcgcgcggtggccggatccggtcgtcgccgatccatcgtcatcaccgtcgcctctctcttctctctctctctaaggccgacggtggcggtcccggcggtggtaggcgcggcgccagcggtgtcgggcgcggcgcgacgagaccaaggggagagcgagagagacaagggtgtaaggggaaatttggggggacgacgccgtgcccacgagctccacacgcgcacaacgcggcgcctggctgcgtcttcccacgaaaagctagtgaggcacagagagagccgcatcccccagcagagggacgcgttccatcgcaggggacgacaccgatgaaaaaggggatgtccgtcgctaggggcacgggctgaagcaccgcattggtgatggcctaaggcaacacaaaaaatctgcagactttcgacaaaactatgttgccatcggaactaaggctgtgttcgggaaccctcattccccgtcatgcaaaacgaagcagcatttagcatgattaattaagttttagctaattttttttcaaaactgaattaatatgatttttaagcaactttcgtatggaaactttttgcaaaaaacacaccatttagtagtttgaaaaacgtgcacgcggaaaacgaggaggagaagttgggaacatgtcccaccgaacgcagcctctacatcccaccctaaaatttttcaccctgtcacatcgaacgtttaaacacctgcatgaagtattaaatataggctaaaaaataactaattgcacagattatgactaatttgcaagatgaatcttttaagcctaattgctctgtgatttgacaatatagtgctacagtaaacatttgctaataacggattaattaggcttaataaattcgtctcgcggtttactaacggattttgtaattagtttttttttattgcccgaataccccatgcgacaccctatataacacctgatgtgacatgccaaaactttacacctcttaatctaaacaccccctaacttgcaacaaaagcctaaaaccaaaaggatccagtcatccagaacatcagcaaccgtcgtctttaagcaaagaaccaaggagcatttacaatgcagtgcaaaagtagtttataagcaataaaacattacatttagccacctacaaccattgtgcaactggtccatataaaaaaaataacaaaagatacttgtatgcatatggactacccatatggaataaataatattatctatctcgacttctctctcttctcttaatgatatcttgtatttatacattatgaggattgctatatgtaaagtttatttatatagatctcagctatacagatattggttgataaaaatcacaaatttagcattatatcaaacaaccattgtttgacagacataaatttatacctgacgaacaacagccattcgacaggttaggtggcttgattataaaaaaagagagcaagcaagtactatgctgcaggtctatattgatggaaaacacgaggcctaggagatctgcttaactccagtgcaggtctaaaactcgccttcgggtatgctagcgtgccagttgatttgatcctgcaatcaacaagaaatagaaacaaagaagccgtggttaaacccataaatgatagccgatcggctaagtgccgatgacatatcatttatctttgagccgatgtcatataagcattgatcggcagtcattgataagtaaaaaagaactaaatctacccgatcggctgtagatattaacaatatataatccttatgtcgatatatacttaaatcaagtgattgggatagatcggtcgccatgccgatacagtataaatcacttaaatcgaaatatatattaacaacaaaattatatatgttcatagcatagccgatcagatagatctagcatgcatcggctaatactccaataccgctcaatattaagatattaaagcaagtagaacataccaagcagaagcctaatatacttaaaagcaacaagatcttaacataaagggcagatttaacatgtcgatcaagcatatagaataactatagttaaatcaggtaagatcggctgaaaccccgatgctatcctaatcggcaaccggaagacaggctagagattgaaattctaagcacgatttaatagatcaaactcaactgttgcaacattaagtatgaaaaaaagaacaatatctagacaatcaagtcgttggatgtttcatagagtggtggatatcttatataatccaagctaacgtcgctatttaacctaatcggccgccttctattaacagatgttagccgattgtaggttagatgacgatattaccgaagattatgtaagatatatgataactcgataaattacataaacaagattagagtgtcataaagatggaagcactaatcccgagaacgcaagccgtcataacaagttttacctcttgttgaagatcgaaaccgatacagctcaacccgaaagcaagaactcgtcgaaataaaacgaaagcaaaaagagtggcgatgtgccgagattgtattgaacgtatgttgtttgattacatggggttcgggtctatttatacccgagaattacaaaatatgtccataccggacacgactcttatctctaacaaactctaagatatcataagtctttgcggcagacttttgcccaaatatatctctaaggaaattacataaaatatcctaattaatagatacaattgccttctcaggactctatccatgcgtggcaatcatcttgaagcatatcaacccaacctgatgttgtacaccaagtcgtattatcgaaatcggctgcattacctaaccaagtctgactcgaacttagccgatccaatcgtagccgatccggactccagccaattcttgctctgttcccgcgacaatcctcatcttagattccgcttcgatctaatctccctttccgatgctgatattatcaaatttggtcgttaacaatctcacaacccactcacatgtatgcacacacatcccaaattcccaattttttaagcttggtcgaacaacctggtgttctataaggtgctaaatttgtgatttcagacaaccacttacaattttcattaaatttgtattatttctaaaaaaagttcttttaaaagattgtgagggcacatccattttgcgattaagggagataaaagtagactattccttctcaaataacagtatttccaaacgtagcacgattagtgtccgaggtgaattgacgaatctacggatacgcgacgtgtcacgtgtgcggcactacagccatctgcaaggagcggatatgctctcggattaatctgttttcgtccataagtgctacagtttgtgatttgtctgatcatgacaaaggtctacacgcatgtacacctgttcacataatgacacgatcaaaatctgttaagtacgtcccacgtacgatacgactacgatgccaacggcatctttgattatttgcatttgcattgacttgatatagtatgtcaccatcacactatcacaattcagtcatacaagtcaggcttggagtactgaacaggctctctctagctctacatgtataaaaaaaaatcagtttcaagcatcatacaatatagtcattcattcagctgccacccgccaagatgtcacctcgggtagcccaacgagagtacgagccgttgttacttgtactcctcctcctactacaaaccttgatcgcgagctcgcttccatgcttgccggaccaggcggcggcgctgctccagctgaagcgatcgttctcggcgaccaccgcgtccgccaccgcgttccggtcatggcgcgccggcaccgactgctgccgctgggcgggcgtccgctgcgacggcggccgcgtcactttcctcgatctaggcggccgacgcctgcagagcggcggccttgacgccgccgtcttcagcctcacgtcgctgaggtatctcaacctcggcggcaacgacttcaacgcgtcacagctcccggccaccggattcgagaggctcactgagctcacccatctcaacatctccccacccagcttcgcaggccagataccagcaggtattggaagcctcaccaacttggtttctcttgatctgtcatctagcatctacatcgtcaatcaaggagatgacgatgtcagtatcatgtcaaatttgttacccccctggggcttctcgagggtaaacttcgagaagttgattgcaaatcttggtaatctgagggagctctatcttggattggtgtacatgtccaacggaggcgaagggtggtgcaatgctctggctaattccactcctaagattcaggttctgagcctaccattatgccagatctctggtcccatttgccaatctctgtttagtttgcgatccctttctgttgttgacttgcaaggaaatgacctgtctggtgccatacctgaattcttcgctgatttgtcatcccttagtgttcttcagctttcaagaaataagtttgagggtttgtttccacaaaggatcttccagaacagaaaactgacagctattgatattagctacaactatgaagtttatggtgatttgcccaattttccacctaatagcagtttgatcaaattgcatgtcagtggcaccaagttctcaggttacataccaagctctatttctaatctcacggatctgaaggagctgagtctgagtgcaaataatttccctacagaactgccgtcttctctaggaatgcttaaatccttgaacttatttgaggtttcggggctcggcctagtaggatcaatgccagcttggataacaaatctaacatctttgacagatctccaaatttctcattgtggtttgtctggatctttaccatcttccataggcaatctcaagaatctcagaagaatgtctttattcaagagcaacttcactggaaacataccattgcaaatctttaacttgacacaactgcatagcttgcatcttccactaaacaacttcgtggggacagtggaacttacctcattctggagactaccatacttatcacaccttgatctttcaaataataaattatctgtggtggacgggttagtcaatgattcagcagtgtcctctcccaaagtaaaattcttgagcctagcttcctgcaacatatcaaagtttcccaatgcattaagacatcaagataagataatcttccttgacctttcaaataaccaaatgaatggggcaatacctccatgggcatgggaaacttggaaagaatcgttcttcttggacctatcaaataacaaatttaccagtcttggacatgacacgttgctccccctgtacacaagatatatcaatctcagttataatatgtttgaaggacccatacctatacctaaagagagtacagactctcagttggattactcgaataatcggttttcttctatgccgtttgatctaattccatatcttgctggtacactatctctaaaggtctctatgaacaatgtctctggagaagtcccatcaacattttgtactgttaagagtctccaaatccttgacctttcctacaatatcttaaatggctcaattccttcctgtctgatggagaattcatcaacactaaaaatattaaatttgaggggaaatgaacttcgcggagagttgccacataatatgaaggaagactgtgcatttgaggcattggatgtcagctataattggattgaagggacactacctaaatcattagtaacttgcaaaaacttggtggtacttaatgttgcgaacaatcaaattggaggctcttttccatgttggatgcatcttcttcctaaactccaagtccttgtcctgaagtccaataagttctacgggccgttggggcctactcttgctaaagatgatgaatgtgaactacagtatctccgaattcttgatctagcttcaaacaacttctcgggagtattgccttatgaatggtttaggaaactaaaatccatgatgtcagtctccattaacgaaacattggtcatgaaagatggagatatgtacagcacatttaaccatataacatatctttttactgctagatttacatataaaggactggacatgatgtttcctaagatcttaaagacctttgtactaattgatgtctcaaataatagattccatggcagcattcctgaaactattgccacactaagcatgctcaatggtctcaacatgtcacataatgctcttacaggaccaattcccaaccagcttgctagtctgcatcaacttgagtctttggacctctcatcaaataagctttctggggagatccctcaaaaattagcatccttggacttcctatcaacattgaacctatccgataatatgctggagggaagaataccggagtcacctcatttcttgacactccccaatagttcatttatacgaaatgctggtttgtgtgggcctccattgtcgaaagaatgcagcaacaaatcaacatcaaatgtgatgccacacctttccgaagagaaatctgcagacattatactatttctctttgttggattgggttttggtgttgggtttgctattgcaattgtagtgaggaaaccttgcattggcaaataatcttcatcaaatccacccatttttatatttatatgttcaggagtttgccagtctgcttccccttgtaaatttagctgtcattatagttagcctgtatgatttatagtactatgtgcacgtacaacatttttttccatcatcatgcatcctataagattagtattgaaaattttatacaagccaacagaaaattgttatgtttgaaccaagaaaggaatagaaatgcatgaccacaaatgtggcattattagggtcagtttaacttgtagcatagatcagtgagctatatgccgtgattttgtgtttgaaatgtatacttacacagaacttacttaagtaccaaacaaccatactggaacacaaaatttctgtgtgaagaactgaagatcacttaattatgtgttggaataaaactttctgtgaaaagatcacttgcaatacaattgtaatcagcgttatactgataatgttactagtagtagtcacactaatactaacctgaatcttgtatatgcaccaaattaggtagtaagaaatatatatatgaactaactaaatgaggtcatccaagaacaatgcacaagcaaggcttaaaataaatggaaacaagaaagcaatgttaaatttacccgactgtttattaagtatcacctctacatctatacctaaaattaaaacggtgtcatatatcaggtcgcacattgaactgctagattcctaataggctaataccacagcagcagcagcagcagcagcaataagctgcatacgtaattccgtagaatcgtagtaattccaaaatcggttcataatattcgagaaatactggatttcacacacaaacctgtgcaattcagccgatgaacacggaaggaccattccatcaaacacctggcggacgacaagagcccgccgatgcaaacctcctgggagtgggacatggacatccccattgtgaccgcattggttgtcagctggtcacccaccccacttgggctcccaaatcccatgacggccaccttgtgctcaacgcctcaacccggtgcccgtgcccccattccggtggcggtggttggggattccggtgtacagcctgcggtggggatgggattgggagttcgccgagtcctccgagtgggatgcacgcggaggagaggacgacgtgaggaggggctcgcaagtggcggcggcggcggcgcaacccctccacgacggcgtgcgggcgcctgcgccgcatatggacatatggtgtacatcgaaattacagattttgtatgggcctcagacatctggcccaacaagggtccgactcattcgctaatttctgaaatacgtactccgtcggaccaataatacctgtcgtttgggcaatggtaaggttaaactttagaatctttaattatgtatcatttttaaaatatttgtctcttaaatatgatgactacattatagattcgtcttaaaaagtattttaataagatcatatatttgttaacacctttttacatattataatagaaaataatgatcaaagttgtttttttataccgtgtccttattcaaaacgacaagtattatcaatcgtagggagtaacctctattatctgaacaagcaaattgttacgtacgtattcaaaatttaaaatttaatgcatggttaaatttatcatggtgttctaaactagttagtggtttttaatttctcgtatatattacgatgcttgtaacaacaaatccataattatagaaaattacattcaaatgatcagttcaacggtattacttttatcaaacaaaatttaaattatattagatttatggtttgtcagatattactagggttgaattaatatgtgtgcacacattgtattttttttttgggaaagatggtacaaatgattgactgagaaaccacaacaagttttcttaatcgaaaattacatcaagtttcatttgcggcaaactaataaaatcataagaaatatgaaaaactatcacacgagcaacagcaattaaaacagaaacacaaaagaaccacgtatacactgtccaagtagaattccatgcctcccgaattgatgaaacgcgcaagctcgcaagtgtaagtgtcacaaatgcacgcacatttatcgggtgcctagtgcttaggagggcacatcaccggccggaaagcgagcgggccagtggcatacatgacattatagtagtcatggtcggaccaccgcttgccctcgtcacggagtggcgcaccctcaatgctagagtagttgatgtttgtggggttgttgcattcgaaatccggcgaggcatgaagacgcacatagcacgccttacgcggatcacccatgtagaagtcggagactttagtctcatcgagctccgcgcggaagtagccattatcgtcggcgacggcctgatggcacctcaccattgcgcgattcttggcgtcgtggcatatgacagacacctccgccttagacagcggcttcgcgtcttcgaggctgtgtgtttctttgcacgcagctctggcagtacaccataccctccaacctcaccaacagcttgtcgctgtgggccggaggggtgtactgctgcggcggcggtggcggcgatggtgatggtgtggtgtaaccataatttgcggtggcgccggcggccaggagggacacgaacacgaggatcgcgagaggatgcagggcagccattgctctgagctagcttgctgtgctccgtgctcgactgatgagatgttttgttttgaagctttggctatgtcgaaacgaagaggcgtgtgggttatatactgcatgccatgtactaacgtgcggacatgtagatggaaattaactgtcttgattttggatgaagatcacattttattttttgttattcgattctgacaatatataatgattagcccgcgaaagaaatgctagcatgtaatcattgatctgtaaggcaatttgaatagaagaaatcgcatgctcatgatctgcctggtgatagttaagagttcgtagtattcaggaggaagatacgcaggtttgtcggaacgtgcagcccttaacggcactgaaataccaggttctccaccctggcagatgatttttgccgatagagctacaatatttatgtcagtactctgaaaaggagtagggcatgtcatttcctactcctaccgtcccataaaaaacgaatttaggacgggatgttacatattctattatgatgaatctggacatatatatatatatatatatatatatatatatatatatatatatatatatatataagattcatagtactagaaagtgtcatatccggtactagattggttttttatgggatggagggagtatgtaaaatatatgcaaattttgctacaggacattgcgactttgtggttttagctataggacaccacgtaaagtgacttttgggagaagacactatgtaaatatggttatttaccacgagacaccgtatccattaaattagtatttttgtgctgacgaggctagaaggggcccactttgttaaacatcatgaccgaattgcccctcttcatcttcctcttcctctcctctcttcccctctctctccctcctttctctcttctctcttctccggcgaggcattcaacccgcaagcggcggcgcgaccaccagagctgcagcggcgcggggaaccactcctcacggcgccacccaaacgtgaactgcaggtacgccgcgagcagcagccatgccacagcgcgcaccgccccgacaacggcctctagtggtatgttcccggtggcgaggaacaccgcgatgtcgctgagctcaacatggaggtacgagaatgagccaccggcggatgggatctccgtggtgagcggaggaccgagggcaccagatccaacgcccccgttgagctcagaccatggagagaggggcatgcgacgatggtgggggagggggagcagcggagagaaggcaacagaggaggagcggcatcgccagtcatgagagtggaggggagggggagaggcgccgccgggagggagggggaggtggagctcgtggtggggggtgggaggggaaagtgtgattagggttagggttataggcagcaacggttttgatggatttagaatcgatccgagtcatccatcaaaacgagtggcttagatcgatcctgtgtcgggccggcctccatctcgggccacaacactgttgggccacgcgctcttcatgggccggacgcgcaatagcaggccgatagggtccaatgggttttttttttccttttttagaacctttttatttgtaagcaatatattttttatgggctcgtaatatgaaaaactaaaacctaattaatcatctaatattttatatttgctataattttagtttactcgtagcaacgcactggcatcttttctaacaaaatttaatttatattagatttatggttcgtcagatattactaggattgaattaatatgtatgcacaccttgtattttttttttggaaagagggtacaaatgattgattgaaaaccacaacaagtttatttaatcgaaaattacatcaaatttgatttgcagcaaactaataaaatcataaaaaatttaaaaaattatcacaccagcaacaacaattaaaacagaaacacaaaagaaccacgtatccaccgtccaattataattccttgcctcccgaattgatgaaacgcgcaagcgtgcaagtgtaagtgtcacaaatgcagacacatttatagggtgcctagtgcttaggagggcagattgccggccgaaaagcgagcgggccggcagcgtacataatattataatattatagtagtcatggtcggcccactgcttgccctcgtcacgtagcggtgctccctcgatgctagagtagttgatgtttgtggggttgttgcattcggagtctggtgaggcccgaagccgcacatagcacgccttgcgtggatcacccatgtagaagtcggagacattggtttcatcgagctccgcacggaagtagccgttatcgtcggcgacggcccgacgacacctcacgatggcgcgattcttggcgtcgtggcagatgacggacacctccgccttaggcagcgatttcgcgccttcgaggctgtgtgtgttcctttgcgcgcagctctggcagtacaccataccctccaccttcaccagcagcttgtcgctgtgggccggcggggtgtactgctgccgcggcggtggtggcggcgatggtgatggtgtggtgtagccatagtttgccgtggcgccggtggccatgagggacacgaacacgaggatcgcgagaggaaggaagtcagccattgctctgagctagcttgctgtgctccgtactcgactgatgagatgttttgttttgaagctttggctgtgtcgaaacgtagagaggcgtgtgggttatatactgcatgccatggactaaatgtgaggacatgtagatggaaattaaacttgattttggattaagatcacattttattttttgttattcgattctgacaatatataatgattagcccggcgaaagaaatgatagcatgtaacgattgatctgcatggcacttttaagagaagaaatcacatgctcatgatccgcttggtgattagttaagaatttgtagactataaagtatattcaggatgaagatatatatgcagatttgccagaacgtgctgcccgtgtctgtacctaacggcactgcaataccatgttgggcagatgatttttttgccgatagggctacccctactacgaaagtgatttttgcacacggcccaaaagagattttcgtgtgcagtagggtagcccgctcgcactaaaagatctacgaaaatagctatttttgcgtgcaggagtttgagagaaagtgagagagtagtatgtggagaagaggaggtgagagagaggagagatgataaggatgacttagaaaaaaaattaagtgctaggagggaaaagagaaggtaactcgaacttccgggcggacctttaagatggccgtctgcgaaaatatattttcccgtgcagccccttaagaggtccatatggaaaaataatcttattttcctgtgcagctacttaatagggtcgtctgcgaaaatgttagtcgatttttgtagacacggatacttatggtccgtctgcaatatattgaggagctcatccagaaaaatcattttttatggtgattatttatatcagtagctacattattctccatacagataggttttgctattttacatgtgatagatttttgggcttctatttttcgatatgttgttcataggattttgcatcaagattcgtgtttatgtagttataacttgcaattacacttatttatgtagtacgtttcatgtagtattaaagtaccatgacgtcttttttcttagcgcctgaaactaacggaaagaaaacgagtgtatttttctcattgttttgtagaaaggagttacataggcgctatgccagctaaaattggaaacaataccaccaagaaatttcgtttgcacttgttttggaagttggaggatgtgttctatctggttttcggtcaagggacgattttgtaattcggtgataagacgagggatctccactgtactttttccacattgaaattacagattttgtatgggcctcaaacttttggcccaacaagggtccgactcattcgccaatttttgaaatacgtaacctctggtatctattttttagataatggattttcattaatccggcctctatatccacgatggatatagacagctaaaatgatataagagcacttaaactcaaatctcaataaagaggagaacacacaaccaaaaaacaaaaaacctacaacctcgacacatccctgcatcccgacattctctcctgaaatagtcaaaatcgatgagtggaagtcgtttagtcacaaccgcccctagtacgttgtcgctgcgaatctccactggtgccttcttcatctgcttcaagtgaaccgatgccacgcaccaccgagtagtccaccttcatccatcgtcgtctagtcagaactagccaactagacacgggctgaaaggatctgcttcaccggattcctaagcctctgccgcccatagggccgctgccaacgtcggaatccttctccgcctctccgattcccagcccactaccacctctgccaacgtcctttgccgtggtcagagaggacatcatcttccgcccggactccaaggcctccgccgccccaagggctgccatcgccgattggatccaccttcacctgaaccatctgcatcggtgattacgccgccactgcctctagggctgcagctgccgcaaccgaggaggtcattgcttggactcgcacaccgccgctgcccctagggtcgcccgctagctacgaaaccaccttcgccggaaccgccttctccttgccgaggaccggacatcaacgcttacgtcgccgttctccacagcatccaccgtcgcccaaagaatcgtgtcgccgacgtcttgccgacccgccgccgcactgcctcccgacccctccactgctgcgcgcaaggtgcggttcggccaacgccgctcgccaactcgcgcgcctccgtacctccggaccacctccgcagccgcgctcggcccggccggccaccgccgcccacggccccgtcaccttccacgccaccagattttgggggccggaaccccagactcggtacagccctcagccgcgtcgtggtctccgccgaaaggccccgctgtcgccttcctcactgccgctcggcacgccggcggcctgctcgggcggcggcaaggcgaggagacaaggaagcgagaaggagacgaggaaacgctgtgaggcgagataatctaactaagcaaattacctacgtactcaaaattcaaaatttaaggtatagttaaatttagcatggttttccaaaatatttagtgattttaatttgtcctatatattacgatgcttgtaacaacaaagccataattatagaaaattacattcaaatatcagttcaacagtattatttttatcacataaaatttaatttatattagatttatggttcgtgagttattactagggttgaattaatatgtatgcacaccttgtattttttcgaaagagggtacaaatgattaactgaaaatcacatcaagttttcttaataaaaaattacatcaagtttgatttgcagcaaactaataaaatcataaaaaattacaacacaatcacacaagagcaacaacaattaaaacataacacaaaagaatcacgtatccaccgtccaattagaactcca

SEQ ID NO: 45023 - DNA, 6818 bp, Oryza sativa
aattcctgcagcccaaatgcagacacattcatagtgagcctagtgcttaggagggcagatcgctggccgcaaagcaagcggccggtggcgtacatgaagttatagtagccatggtcggcccaccgcttgccctcgtcacggagcggcgcaccgtcacggagcggcgcaccctcaatgctagagtagttgatgtttgtggggttattgcattcgaagtccggcaacaaccgaagccgcacatagcacgccttgcgcggatcgcccatgtagaagtcggagactttggtctcatcgagctccacgaggaagtagccattatcgttggcgacggcccgacggcacctcaccatgacgcgattgttggcgtcgtggcaaatgacggacacttccgccttaggcagcggcttcacgccttcgaggctgtgtgttcctttgcgcgcagctctggcagtacaccataccctccaccttcaccagcagcttgtcgctgtgggccggcggggtttactgctgctgcggcggcggtggcggtgatggtgatggtgtggtgtagccatagtttgcagtggcgccggcggccaggagggacacgaacatgaggatcgcgagaggatggaaggcagccattgctctgagctagctcgctgtgctcgactgatgagatgttttgttttgaagctttggctgtgtcgaaacgtagagacgtgtgggttatatactgcatgccatggactaaacatgcggacatgtagatggaaattaagcttgattttgattaagatcacagtttattttttgttattcgattctgacaatatataatgattagcccggcgaaagaaatgataacatgtaacgattgatctgtaaggcacttttaagagaagaaatcacatactcatgatctgcttggtgattagttaagaatttgtagactataaagaatattcaggatgaagatatatatgcagatttgtcagaacgtgctgcccgtatatgtccctaacggcactgcaatatggtagggcagcctgctcgcgctaaaaaatctacgaaaatagctatttttgcgtgcaggagtttgagagaaagtgagagagtagtatgtggaggagaggaggtgaaagataggagagatgataaggatgacttgaaaaaaaaaattaagtgctaagagagaaagatgaggtaactcaaacttctgggcgggcctttaatatggccgtctgcgaaaatatattttcccgtgcagccccttaagaaattcgtatagaaaaataatcttattttcctgtgcagcagattaatagggtcgtctgcgaaaatacaagtcaattttcacagacacggatacttatggtccgtctgcaatatattgaggtgctcatccatgaaaatcatttttatagtgattatttatgtcagtagctacattattctccatagagaggcgtgtgggttatatagtgcatgccatggactaacgtgcagacatgtaaatggaaattaagcttgattttggattaagatcacattttatttcttgttattcgattctgacaatgtatgatgattagcccagcgaaagaaatgataacatgtaacgattgatctgtaaggcacttttaagagaagaaatcacatgctcatgatctgcttggtgattagttaagaatttgtagactataattctataaagaatattcaggatgaagatatatatgcagatttgtcagaacgtgctgctcgtgtctgtccctaacggcgcttcaatatcttgttgggcagatgatttccctaatggcctagccgcatgtgaaaataattgctggccgtatgtaaaaacctattatgtagtagtggcagtatgtggagaagaagaggtgagagagaggagagaaggtgaggatggcttgaaaaaaaattgaaatgctaggagggaaaagaggagataacttaaactactggacggacctttaagatgatcgtctgcgaaaatatatttttactactggacggacctttaagatggccgtctgtgaaaatatatttttcctgtgcggcctcttaagatgtccatctataaaaataaccttattttttcgtgcggctgcttaatagaatcatctataaagatatgagtcgatttttgcaaacacggatacttagtccacctgctatctattcaggtggtcatccatgaaaatcatttttaagtagtgattatttatgttggtagctacattactctccatacagataggttttgctattttactcgtgacagatttttgggcttctgtttttttatattttgtttataggattttgcatcaagattcgtgtttatgtaattctaacttccaattacactcatttatttagtacgtttcatgtagtattaaagtaccacgacgtattttttctttgggcctgaaactgacgaaaagaaaacgggtatatttttctcattgtttgcagaaaggagccatataggcgctatgtcggctaaaattgggaacaataccaccgaggaactttgtttgcacttattttgaaagttggaagatgcattgtggatgtgtttagttgaaagttggaagttggcctgtctctggttttttatcgagggatgattttctaattcggtgataaaatgagggatctccgctgtactttttccacatcaaaattacaaattttctatgggcctcagacatctggcccaacaagggtccgactcattcttcaattttcgaaaatacgtaacctctggtatcggactaagcaaattacgtacgtactcaaaattaaaatttaaggtatagttaaatttagcaaggttttccaaatagcaagtgatttttaatttgtcctatatattacgatgcttgtaacaacaaagcctaattatagaaaattacattcaaatctcagttcaacggtattatttttatcaaataaaatttaatttatattagatttattggtcgtgagatataccagggttgaattaatatttatgcataccttgtatttttttggaaagagggtacaaatggttgactgaaaaccacaacaagttttcttaatcgaaaattacatcaactttgatttgcagcaaactaatataatcataaaaaaaattacaacacaatcacacaagggcaacagcaattaaaaaatagaaacacagaagaaccatgtatccaccgtccaattagaactccatgcctcccaaattgatgaagcttcataggaagcctagtgcttaggcgggcagatcgccggccggaaagcgagcgggccggtggcgtacatgacgttatagtagtcatggtcggcccaccgcttgccctcgtcacggagcggcgcaccctcaatgctagagtagttgatgtttgtggggttgttacattcgaagtcctgcgaggcccgaagccgcacatagcacgccttgcgcggatcgcccatgtagaagtcggagactttggtctcatcgagctccgcgagaaagtagccgttatcgttggcgactgcccgatgacacctcaccatgacacgattcttggcgtcgtggcagatgacagacacatccgccttaggcagtggcttcgcgccttcgaggctgtgtgtgtttctttgagcgcagctctggcagtacaccataccctccaccttcaccagcagctttttgctgtgggccggcggggtgtactgctgcggcggcggtggtgatggtgtggtgtagccatagtttgcggtggcgccggcggccaggagggacacaaacacgataaccgcgagaggatggaaggcagccattgctgtgagctagcttgctgtgttccgtactcgactgagatgttctgttttgtagctttggctgtgtccaaacgtagaaatgcgtgtggattatatactgtatgccatggactaaacgtgggtacatgtagatggaaattaactgtcttgattttggatgaagatcacattttatttttttttgttatcgattctaagaaatatataatgattagcccgcgtagaaatgctaacatgtaatcattgatctgtaaggcactttgaatagaagaaatcgtatgctcatgatctgccaggtgattagttaaaaagtcgtaggcgataaagaatattcaggaggaagatatgcagatttgtcggaacgtgcagcccttaacggcactgaaataccaggttctccacccaggcagatgatttttgccgatagagctacagtatttatgtcagtactctgaaaaggagtatggcatgtcatttcctactcccaccgtcccatctagaacgggacgtgacatattatagacaatgaatgtggatatatgcatgtccagattcgtagtacatactaggatatgtcatatctaatactaagttggttttttatgggatggagggactatgtaaaatataggcaaattttgctacaggacattgcgactttatggttttagctgtaggacaccgcgcaaagtaacttttgagagaagacactatgtaaatgtagttatttgccaccaaacaccacatccattaaattagtatttttgtgctgacgagcctagaaggggcctactttgttaaacatcgtgaccgaattgcccctcttcctcttcctcctcctcctctcctctttcttccttacctctcttcatctctctccctactttctctcttctctcttctccggcgaagcatacgacccacaagcggcggcgtgaccaccagagccgcagcggcacagggaaccactcctcacggcgccacccaagcgtgaactgcaggtacgccgcgagcagcagccatgccattgcgcgcaccaccctgacgacggcctccaacggtatgttcccggcggcgaggaacaccgcgatgtcgctgagctcaacgtggaggtatgagaatgagccaccggcagaggggatctccgtggcgagcagaggactgggggcaccagatccagcgcccccgctgagctcggaccaaggagagagggggcatgcaacgacggtgggggagggggagcagcggagagggggcaacggaggacgagcggtgccgccagtcgtgagagtggatgggagggggaggaggagctcgtggtggggggtgggagaggaaagtgtgattagggttagggttttaggcaccaacggttttgatggatttagaatcgatccgagccgtccatcaaaatgagtggcttagatcgatcctgtgtcgggccggcctccatctcgggccatagcactgttgggccacacgctctttatgggccggacgcgcaatagcaggccgatagggtccaatggggcctttttttctttttttagaacctttttatttgtaagcaacatattttttttatgggctcatatcacgaaaaactaaaccctaatcatctaatatttttatatttgctataattttagtttacccgttggccgttgcaacgcacgggcatcttttctaataaaatttaatttatattagatttatggttcatcagatattactagggttgaattaatatgtatgcacaccttgtttttttttggaaagagggtacaaatgattgactgaaaaccacaacaagttttcttaatcgaaaattatatcaaatttgatttgcagcaagctaataaaaacataaaaaatttacaacacaatcacacaagagcaacagcaattaaaacagaaacacaaaagaaccacgtatccaccgtccaattataattccatgcctcctgaattgatgaaatgcgcaactgtgcaagtgtaagtgttacaaatgcaggcatttttatagggtgcctagtgcttaggagggcagattgccggccggaaagcgagcaggccggcagcgtacatgacgttatagtagtcatggtcggcccaccgcttgccctcgtcacgtagcggtgctccctggatgctagagttgttgatgtttgtggggttattgcattcgaagtccagtgaggtccgaagccgcacatagcacgccttgcgtgatcgcccatgtagaagtcggagactttggtctcatcgagctccgcgcggaagtagccgttttcgtcggtgactgtccgacggcacctcaccatgacgcgattcttggcatcgtggcagatgacggacacctccgccttaggcagcggcttcgcgccttcgaagctgtgtgttcctttgcacgcagctctagtagtacaccatactctccaccctcaccagcagcttgtcgctgtgggccggcggggtatacctgtggcggcagcgggggcggcgatggcgatggtgtggtgtaaccatagtttgcggtggcgccggcggccaggagggacacgaacacgaggatcgcgagaggatggaaggcagccattgctctgagctagcttgctgtgctccgtactcgactgagatgttctgttttgaagcttttgctgtgtccaaacgaattaaattttaaaatatactgtttatccaatttttttcaggaatattcgggataaatttttttttttacaaatataccatcaatctcgcgcaatcgttttacgaaaatgacgtggacatgacgtcaccagcggtatcgcgtgacgaaagcgcgagaccgtgcggtatcacgcggcagtggcgcgagaccgcgcggtctcgcggaagcaaagagcgagtccgctcggtatcgcttgttcaagcagcaacaccggcatggcagtcccggccgtcaatggttcatgacctaattaactattaactaataataattagtaatt

SEQ ID NO: 45024 - DNA, 2401 bp, Oryza sativa
tcttaagatgtccatctagaaaaataaccttatttttttttgcggctgcttaacaggatcgtctgtaaaaatgtgagtcgatttttacagacacagatacttggtccacctgcaatctattgatgtggtcgtccaggaaaattatttttaagtagtgattatttatgttggtagctatattattctccatacagataggttttgctattttacttgtgacaggttttggggcttctttttttatattttgtttataggattttgcattaagattcgtgtttatgtaattctaacttgcaattacactcatttatttaatacgtttcatgtagtattaaagtaccatgacgtcttttttctttgggcctgaaactgaacgaaagaaaatggatgtatttttctcattctttgtagaaaggagccatataaacgctatgtcagctaaaattgggaagctgaggaattttgtttgcacttgttttgaatgttggaagatgcattgtggctgtgcttagttcccttcaaacttccaaatattccgtcacatcaaatatttggacacatggataaaaaaaataccaattgtacagtttccatgtaaattgtgagacgaatcttttgagcctaattacgccatgatttgataatatggtgctacaataaacatttgataatgacggattaattagatttaataaattcgtttcgtagcttacaggcggaatctgtaatttgttttgttattagtctacgtttaatacttcaaatatatgtgtccgtatactttaaaaaagttttggctgtggaactaaacatggcctgtctctggttttcgatcgagggatgattttctaattcggtgataagatgagggatcttcgcagtactttttccacatcaaaattacagattttgtatgggcctcagacatctggcccaacaagggtccgactcattcttcaattttcgaaaatacgtaacctctggtatctgactaagcaaattatgtacgtactcaaaattctaaacttacagtatagttaaatttagcacggttttccaaatagtaagtgatttttaatttgtcctatatatttcgatgtttgtaacaacaaagactaattatagaaaattacattcaaatctcagttcaacggtattaattttatcaaataaaatttaatttatattagatttattggtcgtgagatattaccagggttgaattaatatttatgcataccttgtattttttttggaaaagagggtacaaatggttgactgaaaaccacaacaagttttcttaatcgaaaattacatcaagtttgatttgcagcaaactaataaaatcataaaaaaattacaacacaagcacacaagggcaacaacaattaaaaaatagaaacacaaaagaaccacgtatccaccgtccaattagaactccatgccttccaaattgatgaaactgtaagtgtcgcaaatgcaggcacattcatagggagcctagcccttaggagggcagatcgccggccggaaagcgagtgggccggtggcgtacatgacgttatagtagtcatggtcagcccaccgcttgccctcgtcatggagcggcgcaccctcaatgctagagtagttgatgtttgtggggttgttgcattcgaagtccggcgaggcccgaagccgcacatagcacgccttgcgcggatcgcccatgtagaagtcggtgactttggtctcatcgagctccgcgcggaagtagccgttatcgttggagacggcctgacgacacctcaccatggcacgattcttggcgtcgtggcagatgatagacacttccgccttaggcagcggcttcgcgccttcgaggctgtgtgtgttcctttgcgcgcagctctggcagtacaccataccctccaccttcaccagcagcttgtcgctgtgggccggcggggtgtactgctgtggcggaggtggtggcggcgatggtgatggtgtggtgtagccatagtttgctgtggcgccggcggccatgagggacgcgaacaggatcgcgagaggaaggaagtcagccattgctctgagcacagctccgtactcgactgatgagatgttttgttttgaagctttggctgtgtcgaaacgtagagaagcgtgtgggttatatactgcatgccatagactaaatgtgcggacatgtagatggaaattaaacttgattttggattaagatcacagtttattttttgttattcgattctgacaatatatgatgatttgcccggcgaaagaaatgataacatgtaacgattgatctgtaaggcactttaagagaagaaatgacatgctcatgatctgcttggtgattagttttgaatttgtagactataattctataaagaat

SEQ ID NO: 45025 - DNA, 12083 bp, Oryza sativa
  unsure (1)..(12083): unsure at all n locations
aaaaagatatgatcactgaatctgactaactaaatttagtctatcgattcggtaagtaggctcagttaaccaaaattccaaaaacagcccaataacaaccatcaagaaaaaaacaaaccatactcacttttctctctattccctaactacccttctccgccccaacatcccaatcatcactcgtcacgataccacatcgacggcatcaacaacacctacatcgtcttgccacttcgttgtgtcgttccccacgtagtcccgctgcgctgtaccaccattctttcgtccatggccgagctaggaattttagaaagggaaaagtccaaattacccccctgaactattgagtgagtacgaattatcctctggacccgaaaatcagacatcattcacccttgactattaataacagacaaagatcaccctgagcactattttggagcggttttgacctaaaattgtacatgtgcatcaacgtgacaatccagtcagtaaaaaaatagaaaaaaaatccttggacccacatgtcatctctctccctcccctgccctctctctctccacagcacccaacatcacttgttacaaaaaccacttcactcctccattaatcagaagcagaagacaacgacgaaggatcgtgcgttgcaggcatcgggagagggagaggaaggcaaggtggacggggatgtgcctcgcatatatgtgtttcacaccgtcgcatggctagtgttgctcacgctcgcgtcgtgccccacttttgcctctgtccccacccccgcccgccgctaccgtgcttggctccccatccgccagctgagagagacggaggtgaggggagggacaagagagaggattggggaaagagggagatagagaggtgaggggaaagaaatacagaggatgagactgacaggtggggcccatccatttaaaaaagaagaattgctgactggactgccatgtaggaccaaaaccactccggttcgagttagtggtaattcgtctgatattaataattgagggtgaaacatgtatggttttcgagtctgagggggtaattcatacttaggggtgtaattcggacttttccctttagaaaatttaggtgatggacaaagcctaactaaaaccactacatatttcgctcaaattgttcttagattagaaaaaatacctgtgcgttgcaacgggtaaaggcgtttttcagtgatacaacggctattaagagccaaggaataaattgaaacattagtatcgctatacattataattgaaaaggcgttgcctcctacctccttttaaattccagaaaacaagttccccatcaaatcaaactgaatctttctcgatctcccaaaattgattaaggattttttatccacttgatctcttcttttagttttttccaaaatcggaacgaatccacgaaactcgggataaaaacagttgggggaagatcactggcagaccatcattcacaaccgttaaacaaatattaaatctagttaattaaatccgaattgaaaggggaaattatggggaaaggatgagggacgagtagagaatcgatttttgcaattaattagagaagaaaacgcacaggaaggtatagatcgatgtggcggcggcgttagggttcggcctgggcagcgcggcggcggtggctggaggcacgtggcaacggatcggacttatacggacgacgtacaaaatcaaatacacgggatgcttgcttattttttttattacatgtacagatagatttgcgataaagagaaatattagtaaaccaactccaacacggatgacatactaaaattttggcagaaacatctttaatttttataatagtagagatttaaatcagagtaattttgttataaaattgcgatctaacacttatataaatgtggaagaatttctcttaataaaatataattggtcccttgttatgtctttcctggactatggtgtagtatacatgagttgatagtcagcaatatcaacatgattaagtatttaagcatacacaattaggcaaggtgattagcctggcattggttcaggtttcaagttgctcagtggaaattgcatgggcagccctaatgggcgattgatcgcccgccaatgggggtagcgatcanattcnctacccccctcccctctccctccctccacctggtttcctttttggcaccgtattactttcttattttagtaaatttatacacctaaagtttacacatctaaagtttagagacccaaagtttataagtcaaaagtttatatatccgattcaaatttgaatttgaattcaaatattttttatatatagtatttctatacatctaaagtttatacacctaaagttagtttatagacctaaagtttatacacctcaagtttacacatctaaagtttagatacatgtttcaaatttatatttgaattatatctgattcaaatttacttgtttcatatttgaatttgaattatatccgattcaaatttgaatttgaattcaaatattttctatatatagtatttctatgcatctaaagtttatacacctaaagtttatagaaccaaagtttataaacccaaagtttataagtcaaaagtttacatacccgattcaaatttgaatttgaattatatctgattcaaatttgaatttgaattcaaattttttctatatatagtatttctatacatctaaagtttatacacctaaaatttatagacccaaagtttataagtcaaaaagtttacatacccgattcaaatttgaatttaaatttaaattttttatatatatagtatttctatacataaatttttctaactttttgttttttaaaaaaaatttgtgtggtgtactgtagtaggggaggagggaggagtgtatctagtagtatagggagggggcgggcgggtgatcgctgggcgggcgggggagcgatcacccgcccattagcatttccgagattgcatgcattagcaaacattgatgtgtgggtcctgttgacagaaaacacgaggcctgggagatctgcttaacttcagtgcaggtccaaaactcgccttcgggtgtatgagcgtggtcgttaacaggtctgtacccataaatcagccactgctactgaatcagcagtactgtagaggatctgcattcaggctggtgccttcatgcagtaggacacaaccgcacacatttgttgccatgcgcccgcaactaacttgcatggtaatacatcgattggagtcaacccttacatggcgtgaagcccgagcagccgcccgatctgcccgataggtgaatcggctactgcttccgtgctccatattgtgccgccttcttctccatagcggcaccccctcagtggagatctagtggcacccgcaagatgaaggtctagcggcagcagtcttaatagagaagggcatggccgcgggcaaaaggcagaggagagaaacacgcggacgccggcgataggtagatgatatttttttctgatttctttgattattgtgatcttcttgtctgaaatatttcgtgatttttgtgactcttttgtatatctaaaaatattgattactttcagtcatgatagagaccaaggccgcattgcttagcgttggccatttttcgattgcatgttggttttcatttttagattgtaggaatattagcaaaccaccaatattttcatcacaaaatataaatcaacttcttgattttacatagatgaccaaaatttcttaaaagaccggaaatcgagaccgaccttactgccacccccgcgtaaggtagccaatatattagggaagttggtgttcggcagcagggttatccaaatgtgatcactctaatctcacttattcacgtagagatttacccaggtttgggcctcctgaaaaatagctacgacatcttggcctaataaggaggaaagtgcaagtgaggtgatttgtgtaagtgggcatgcctgttggatggattggactgcacggttttggagcgcgggtttttacaatagcagacctacacctgctttgatgtgttttgcaagtatgacaatggtgctacaatggagcggtagagggtgagtgtgtgaatggtcggtggtccagagatcccttctctacagagatatcaaagttttcttgatcaaaaatcacatcaagtttgatttatagcaaattaataaaatcataatagatttacaacaaatgtcacacaagagcaccaataattaagatagaaacacaaaagaaatacatatccaccatccaaattgaattccacacatcccaaatttatgaaaagcacgcgcatgtaaacgtcgcaaatatagacaccacatttacatggggtgcctagttttagtgcttgggagggcatatcgccggccggaaggcgagaggaccggcggcataaacaacgttatcgtagccctgaccagtccatcgcttaccctcgtcacggagtggcgcacccttgatgtcagagtagttgatgtttgtggggttgttgcacttgaaatccggcgacgcctgaagtcgtacgtggcacgccttgctcggatcacccatgaagaagtcagagactttggtcacgccgagctctgtctggaagtagccgctctcatcggcgatggcccgcttgcactccatgacacgattcttggtgtcgtggcaggtaacggacacctccgccttgggcagcggcatcgcgccattgaggctatgcgtgttccggtacgcgcagctctggcagtacaccatgccctccaccctcaccagcaacttgtcactgtgggccggcggcggcggcggcgatggtgtggtgtagccgttgttggcagtggcgccggcggccaggagggacacgaggatcgcgagaggaaggaaggcaaccattgctcggagtcggagctagcttggtgctcaacttaagatggtttatcttaacctgaagttttggtgtgagaaaatggagagaagcatggggtttatatactgccatggactaattaaacgtgcagacatgtaggaaatcactaactgtcttgattttggattaagattgcattttatttttgtgaagataacatgtcatgattgatttgcaaggcacttctaagagaagagatcgcgtgttcatgatctgctgtgattagttaagatcagtctgtagacgataaagaatgttcggtgtgaagatatgcagatttgtcagagaacgtgctgcccgtgtgtgttcccatctgcactgaaataccacaggttctcggcacaggcaaatgatttttggcgatatagagctacattatttccgttagtactctgaaaattaaggaacagcatatcatcttctgtgtaaaatatacggttcatgtagtatctatttcctttgggtctgaaactaactgaaagaaaacggggtgcagttttctgattgattgtacgcagagcaagtctgtttttttttacatgcggcagatcaatcgtgcgaagttttgtcatggtaaggctgcaacatctgttcgcgaggaggcccgggccaccggatctgacaacctcgacctccccgcacaacacggaaccgggtagcttaaggacacaagccactcccgccgccacctttttctatcactcttcgtctcgccatgcactactcctatcaacgttaagttaggagtgggcaaaatagaccagaatcgaaccaaactaaccaaaacaataatgaaaaaaattatggtcattagatctgactagccaaatttaattgatcaattcgataagtaggctcggtaaaccgaaataccctaaaaacaaaaatttaagaaaaagcacaacataagccgatcaaaccaacaaaagcaaaaccctatccacttttttctttgttccgtaactaccctttcccacccccaccaccctcggcatcgacaacaccacaacgcatcatcctaccgcatcaccgtgccgctccccacgctatcctgtcgcgcatcctaccactcttctgtactgctacgttgtgtcgtgccgccctgcttctccgcaacgatgcctcctcaagtggagatctagcggcactcatgatatggagatctagcggcaataatcgtgatagaggaaagcgcaggtgtaggaaaaaggtgaaggagagaaacatgcggacgccggcgaaaagcaaatgttttttttgttttacagtactgcgattttttggtttgaaattattgatgactattgttattcttttgcttctcaaaatttgttgattatcttcagtcatgacagatacggaggccgcattgctcggtgttggccactttttgaatgcatgtagaccaaggaaactttgatgtggttttcttgatctactcatttgacaatggctagaaagtatgtgattttcattgtacttgtgtaactcagtaaattatttattatataaacacatacaatgtaggagactctccttaaaaaagttttctagatcgaaaatcacaccaagtttattttgcagcaaactaataaaatcagaacaaatttaccacaaatatcacacaagagcaacaataattaaaacagaaacacaaaagaaacattatccacaatccaaattgagaattcagtgcctcccatattaacgaaaagcgcacgtgtaaacgccacagacgtaggcacatgcacggggcgcctcttaatgcttgggagggcagatcgctggccggaaggcgagcgggccagcggcatacatgacgttatcgtagccctcgccagtccaccgtttgccctcatcacggagcgacgcgccctcgatgctggagtaattgatgtttgtggggttgttgcacttgaactccggcgacgcctgaagtcgcacgtggcatgccttgctcggatcgcccatgaagaagtcagagactttggtcacgccgagctccgtctggaagtagccgctctcgtcggcgatggcccgcttgcactccatgacatgattcttgacgtcgtggcaggtaacggacacctccgccttgggcagcggcatcgcgccgttgaggctatgcgtgttccggtacgcgcagctctggcagtacaccatgccctccaccctcaccagcaacttgtcactgtgggccggcggcggcggggtgtactgctgctgcggcggcggcggtgatggtgttgtgtagccgttgttggcagtggcgccgacggccaggagggacacgaggatcgcgagaggaagctggaaggcagccattgcttggagctagcttggtgctcgattacctgaagttttggtgtgagaaaatggagagaagcgtggggtttatatactgccatggactaattaaacatgcagacatgtagatggaaatcactaactgtcttgattttttattaagattgcgttttattgtgtgggctatttaattctgacaaaatataatgattggcctggaggagaaaaaaaagaagataacatgtaatgattgatctgcaaggcagttttaagagaagaaaacacatgttcatgatctgcttggtgattagttaagatcagtctgtagacgataaagaacgttcggtatatgaagatatgcagatttgtcagagaacgtgctgcccgtgtgtgtcctcaactccactgcaataccaggttctccagagagacaaatgatttttgccgatagcgctacattatttccgttagtactctgaatagtactctgaaaaggaacaagcatctcatcttctgtgtaaaatatacagttcatgcagtattgtcgtaccatgctgttccttttcttttggtctgaaactacctgaaagaaaacggagtgcagtttcctgattgtttatacaaacaagagatgtaaagccaaattactggacgcaaagcaactatgtttttttacatgcggcggatcgatcaagagctaacactgcatgattcatggcgctatcgccattgccagtttgtcacggtgaggttgccagatctgctggcaaggaggcctaagccaatacaaccccgacctccctgcacaacggatccgggtagctagaagtaagaacacaagccactcccaccgccaacctcttctaccactctccattttaccatgcaccgtccctatcgacgttcggtttgggtggtagtggtacaaatagaccgaaatcgaaccgaactaagcaagacacaaacaaaaaaaaaaaggtcacttgaatctgtctagccaaatttaatcgattaattcggtaagtaggctcaataaactgaaataacttaaaaaccaaaattcagaaaaaaaacccaagaacagaaaaccaaactaacaaaaacaagccctacgtactcacttttctctctattacatttccctaaacccaacagcagtccaccaaatcaacaaaagcaagccctactcacttttctctcttttccatttccctaactaatctttcccaccccacgctagttggaaaccgccacactagcatcacggcattgagaacaacacaacgcatcgtcctgccgtgtcaccatgccattccccatgctatcccgtcacgtatcccaccacccttttgtgctaccactccgtgtcgtgccaccctgcttctccgcggcgataccttctcaagtggagatctagcggcggtagtcctgacagaggagggcacgggcataggtaaagggtagaggatagtaacatgcggacatcggtgatagaaagttgatttctttgtgattactatgatattattttgtatgaaattgttgatgactatattgtgattcttttgcatctcaaaaattgttgattcttttcggaccgaggccacattgttcggtgttggccaaatggccacttttcggatgcatgtagattaagaaaactttgatgatctacttatttcacagtggctaaaaaatttgtaattttcattgtacatacataactcaataaattatttattacataaatatatacacggtaggagactctccttaaaaagcgttttcttgatggaaaatcacatcaagtttgatgtgtatagtaaattaataaaatcataatagatttacaacaaatatcacacaagagcaacagtatttaagatagaaacaaataaaatgcatatccaacatccaaattgaattccacgcctcccaaatttatgaaaagcgtgcgtgtaaacgtcacaaatatagacaccgcacttgtgtggggtacctagttttagtgcttgagagggcagattgccggccggaaggcgagagggccggcggcgtaaacaacgttatcgtagccctgatcagtccatcgcttgtcctcgtcacggagcggcgcgccctcaatatcggaggagttgatgtttgtggggttgttgcacttgaagtccggcgacgcctgaagtcgcacgtggcatgccttgcgtggatcacccataaagaagtcagagactttggtcacgccgagctccgtcaggaagtagccgctctcatcggcgatggcccgcttgcactccatgacgcgattcttggtgtcgtggcaggtaatggacacctccgccttgggcagcggcaccgcgccgtcgaggctatgcgtgttccggtacgcgcagctctggcagtacaccatgccctccaccctcaccagcaacttgtcactgtgggccggcggggtgtactgctgcggcggcggcggcgacggtgttggtgtggtgtagccattgttggcggtggcgccaactgccaggagggacacgaggatcgcaataggaaggaaggtagccattgctgggagcttgcttgctgtgcttgaccgagatgttcttttctaaaactttggctgtgtcgaaacgtagagaggtgtgtggcttatatacttgcaatgcatggaccaaacgtgcggacatgtagatggaaattaactgtcttgattgattttggagtaagatcacattttattatgtgttattcgattctgacaatatatgtaatgatcgattcatctgtgatatgcagttttaagataagaaatcgcatgttcatgatctgcttggtgattagtcaagagtctgtagaccataaagaatgttcagtatcaagatattcagatttgttagaacgtgctgcccgtatctgtcgttaactggactgcagtttcaggttctccagacagaccgaaatagactgaaaccgagagaccgaaccaaactactggagtagtaaccaatactggccgaaaaaaaaaacatttctgtatctgacgaaccaaaatttaactctgtcagtaggcgcggttatctgcaatttcaaaaatgaccaacaacaacctgccaacccaacaagagcaaatcccactcccttccccagtacccccaccacctctctcatcacccgttagtccgtcacacttgcatcggcggcatcgatcccattcctcgcgttgtcctactgcgctgtgccatcctgcttctctgcggtggcacctccgcgtctcctccactagagattgagaatttggtggagcggtctctcctatgttttttttaaaaattttgagattgtttattgttttggtatgaccgaaactaaatcagtatcgactatttttatatacatgtcggtcccaaaatttctctaaagatcgaaggttgagatcgaattgtttgtttttacataatggccacccctacatccggtaaccaatgtggggaacccgatgtacggtagcaagtttttacagttaaaatcactctaatcttaggggcggacacccattagataagatgggtcaaccagctccgctatggtacactccacccctcacccccagacctccctcctagtcgtggatctaacacattagccactattccaccatcaacccatcaaataaatcaagtatttcaaaaagggatgaaaatgatatggaaattcccgaccaactaagtattgttttctataagtggttctattttttatcatatccgattggccatatataaatcatttcctaaatagttaaattggtaaaataaaaatttgcaacagaccataaatcatttctgaataaatgatcgttttcagtcatttttatccctagctaactctaggcattaggcatccattgtcgtgtcattttcatgactatgctcaccgtctcaattctaatatctatctgaccatgttcatcttcgttgttaactgttcatcttcgttgttaacttgtgtaatgtttgtgtggtgtgtcgccataccggtgcgttgagccggtgactataatttatgtgcacagtaccacacgcccctagccagcagctagctaggactagctccttgttagaggccgctctatcctaccactgatctcactaattcacataagggtttacggtttaccatccttaagaaattattgggagtttttcttgtgtaaattaagcttggtatctccatgtatcttgactcttgaggtaccaaaatatatttttatttaggtacttgaggtactttttcatggatcataaaatttcacttcacgtagagagttactcagctcgtgtgggccgtcaaaatcacgacctagtgccccgcagcattatccacaaggcccattagcctgatatctgaagcaaattatcggcatcattttttcgcttatgcttatacttatcagtcaaattttaaattttaaaccttaaatttataattgattttaggatattttttttcgtcgaagtttattttccagcctttgcttttagatcgctaagaacacatatgtaaaaattttattcatattcttttttgttgtaaatatgacctttcgcttataagcgaaacgatggagccgaaaattatatactcgcggggttatctttttttcccaacaaaaatgacatcaagtttgattaatttgccgtaaaactggtagaaccacaacaatatcaacttacaaaagaatcacataataacaccaccaattcaattagaacagaatcacaaaataaaccaggatatattctccgtcccaaattaaattt

SEQ ID NO: 45026 - DNA, 2180 bp, Oryza sativa
tcccctccaccctcactagcaccttgtcgctgctttggtgcgccgctggcgccggtggcggtggcgatggcggcggcgtgtgctgcggtggtggcggtggcgatggtgtggtgtagccgttgttggcggtggcgccggcggccaggagggagacgaggatggcgaggtggaggaaggcagccattgatgcggagcttggtgtaagctcgactgagatggtttgtgtgaagcttttttttggctgtgtcgagatggagagaggcttggggttttatatactgccatggatcaaacgtgcggacatgtagatggccgaagcccgaagtggtggccatgtttgtcctggaaaatgtcttggttttgattaagattacgttttattatacattattgtaaaattgtgacaatattatacgtacaatgattgacctgtcgaaatgaaaagaaagacaatatgtaatgattggtcaccatgggcatttttaagagaagaaatcgcatgcttgtaatctgtttggcgattggtcagtctgacatagataacgaatgttcagaaggatgatatgcagatttgtcagagaacgtgctgcccgcgtgtgtcctcaagacttcaactgcaatatctggttctccgtgtaggcagagagatgttccccaacgcaatgccgcgcaaaataatcaattttgccggcagagcgacaacttgttttataatctgaaaacgaactgacatcttattttatctgtaaaatgtgcagttcatgtaggagcatgatgtgcgtccatgttttgtctgaaaccgactgaaagataaacagagagcactggagtaagagaattttctgattgtttctacataggagtaggagagtttaaggcgaaagttactggatggaaaggaagtctgactaatcgagcttacccaaaaattcacaaaacgtagcatctccatcccatcaagagcaatatgtgctctagttcttgtttttcatcttgagggagaaattatccgattaagtttacatgtctgaagagcctaatcatttttgtatatcacttatatgtgctgtcctaaagatttgatttatggaagagtagaagacaattctcacttcacattccaaacaggtcataaatcgacaatatcgcttgttattgtgcggtttccgcggtaaccggacttacctttggatacactaatagtaacttatcccgtcaaattcaaataaatttacataataatatgaacttctaatagcatcgtctagtttttcatggtttaccgtgtgattaccgtgcttacgattgggtgcggtaactcaacccctgatggtaaggttagccctgctctaactaggaaaaaacaataacaaacagatatataagacacaggtttaacatcagtactcttaactattccctccgctcaaaaatatactacctccattctagaatattcgtcgttttgagttttttatttgtaatgtttgaccattcgtcttatttaaaagattatgttattattatttattttgtttgtgacttgttttattatcaaaataccttaagtatgacttatcctttttaggtttgcattattttttaaataagacgaatggtcgaatattgcaagcaaaaagtcaaaacgatatctaatttgggatggaggtagtaataaattttgacactttcatttgtccacaaaaggctagtgaatattattaatgggctgggccaaacacccaccaaagaaaattcccaatgggccttgagtgatccccaatatacagcccattacatgtacaccccagcaatccaggcccacacgcagcgagagaattcgactcccgtttaattccggcccaaatccatctctttcgactgcttacttctgccctaatccacacacgtatcagaaattcggaatactctgttcgcacttgcccttccggaacgctcccaaaccctaggcgcgtgaccatgtcggggtcgtacggatccgacgactaccgcggcggctacggcggccgaggtcgcgtcgggatcctgcgggttgtgtgcgtgcttgcttctggatctgctcctgactggcttgtggttttttttgtaggtggcggcggaggcggccgtgggaggggaggtggcggaagaggagggggaggatatggtggtggtggtgt

SEQ ID NO: 45027 - DNA, 2161 bp, Oryza sativa
tgtttttgaaatgagttcatggtgttattggaagcattacaaaatacagtaaataagcactacaaaatacagtaaatactttcttttatgaatatgtttctttcaatatggcattagttgtcttgctgagttggttatattttgcagaatattcggttgcaatttcattggttctcttccaatattcctaatatatttgtttatcattcttgttccagttgtggcaatgtgaactttgcaaggaggactgaatgcaacaagtgtggagcaccttctcctgctggaggtggaggtggaggtggaggtggagggtataataaatctggtggagggggtggaggctacaatcgtggtggtggcgattttagttctggaggtggcggtggctacaacagaggtggaggagattacaactctggtggccgtggtggtggcactggagggggaggaagaggaggaggttacaatagaggtggtggcgatgatcgtggatttgatgaccaccgtggtggcaggggtggttatgggggaagagaccaagggaacaaccaaaggggagacgaaagtggttatgacgctggtagctatggacaagttcctcctcaaggtcctccttcctatggtgggcctggtggtgactatgcagcacctccaagctcctatggaggcaataatgcatacaattcagattctgcagtgccacctcctagtagctatggtggtggtccaggttcatatccaccaagttatggtgcaccacctccgaacccgccatatagcggtggtgctccaggtggccaaggtagcctacctccttcatatgatggtgggtatggtggtcggcctatgcctgggggtggaggccctggtgcacctccaccctatcatggtggtggtggtggtggtggtggcggcggcggtggcggcggatacactggcagtgctgctccagagccagctgcaaaggttaagcagtgtgatgcaaactgtgatgagacttgtgataatgcaagaatttacatctccaacttacctcctgatgtgactgttgaggaactgcaagaactatttggaggaatcggccaggtatactttgacctcctcttgagctcccacatatttagtgtttatgaactgtgcatttcacgattcgctcactgaaatattttgtgcattttatgtcttttttctaacctcatgtttttcattttatgtgtttcgccataatatctttttccagtgttactgatattacttgttggaatttaagtaaatttacaaatcagtattcagatgatgtttataatctgtagttgggcttgttaacatttttttccccttttgctttcactactgctagcacattgcaagtcatagttttgcacaaaatctgctccatctgttgtatacagcgcagttagagcgagcttattacatattgtttttttccttgctagtggagaagtacacccttgtgtttcaatgtgcataattaaatttggatatttgttttgatgtaacataatcatcttgcagtaatgatgctctttttttttgtagaagtagtagtactgtaattttagttataaccaagccattcaatgattttgtagtaattttgctttactcccatattggtattttatgccaaataattcgtggcatatcaccccatgatgttaatgtaaaatctttgataataaagtaaagttggttttacagattacttagtgttcctagctaaatttattgcaagaaattaatttctttagttttgggggtggtaactgcttgtgtttcatggctgtgttttgagtttttgcaactgcttttttcttaaggttggaaggatcaagcagaaacgtggctacaaagaccagtggccctggaacataaagatctatactgatgactctggaaagaataaaggagatgcctgccttgcctatgaagatccttctgctgctcattcagctggtggattctataacagtaagttcagcatcgagattatattatgtgtgtataaatacagtgttctgcaatttttaatgcatgttttctattgatattccagattatgaaatgagaggctataaaattagtgttgcgatggctgagaaatcagctcctagagctcctgcatatggtcatgggtaag

SEQ ID NO: 45028 - DNA, 1330 bp, Oryza sativa
gggtcctaaccacttgtcttaagtcaatgtgtagtgtatgactgtgtaagggacaatgtgttggttgaaatctttagcatacctcgatttaacacaatatttgtgaacactacttgttattttatgtatgtgcttgggcatatacatcatggtgtaaaacaagtaatatatggcaactgaatgatttttgtttaatttttatcagttgtgccttttaggtatttaatatctgtccacaccacttttagctcatatataacttaagttattactcatgtcgagttgtatatgtataatcaactgcattacatggcatgcagaggtggacgtggtggctatggtggaggtcgcagggataacttcagagatggaggaggccatgggcctaacaggcatcaaggtggtggttcgcgttcaaggccatactgaaagcaactaatatagttactaagattgtcatctgtgagaaaccatttctattcctgttcatcggacttgtactcaaaacaagagcgtaaggtaggttgcctgcttttctcggaattatattccattgtcatactccaatgttggtcggatgtttgtttgtctcatccaaaaagtgattgatccatgttatgtgaatttttccatagaggcagatggataagctccaaatgctggtagttttgagatgttatttcaggtgagtgccgatctgttatgattctgcaatgctttgctatcccgtgattgcttacctttttatttctgcgattgcaaattttgctataacgcttacattccacatggtaactcagccggtggatcactagcttggattttggcgaggagaaacaggtagggcatttttgttcttcgataggtttactagatctagaatccattagttacggatatctctgtggatattagatgtatatgaaccaccttttctggtacacattcattgacttattcatgtggtttgcgtcaaataaagcatggatatgttactatttagatactatttccagacgaaaacatctgcgcatttgttggcttattcatgtggtttgtgactcaaatgtagcatgcttagaaactacaatttccaaaaggaaaaatattctaacatagtagaaaaaatcttgtgggagactcctaaaatcaccccccttagcattagtagtagcactcttgtatgaggtttcctactgttgaggttacgcttgcaggcttgctgctgtacaatgtgtgcagccaacaccgtctgctgcacatcgatgctgcctgctcttctatcactgcagcgtattgtgaaacctcgaagccatccttgtatctgccc

SEQ ID NO: 45029 - DNA, 971 bp, Oryza sativa
accggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactgatgcttccgcctgcacgactggcctattatgccgccgttgttgggcgtctacgtcttcaccgaccggccgcctcgtccgccgccgactggtgcttccgcctgcacggctggcctattatgctgccgttgttgggcgtctacgtcttcaccaaccggccgccgcatccgccactgccgactggtgtttccgcctgcatggctggcctttatgccgccgttgttgggcgtctacgtcttcaccgaccggcttgccttcgccgctgctgactggtgtttccgcctgcacggctggcctttatgccaccgttgttgggcgtcttggcctattatgccgccgctgttgggcgtctacgtcttcaccgaccggccgcctcgtccgccgccgactggtgcttccgcctgcacggctggcctattatgccgtcgttgttgggcgtctacgtcttcaccgaccggcttgccttcgccgctgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggcttgccttcgccgccgccgactggtgtttccgcctgcacggct

SEQ ID NO: 45030 - DNA, 10354 bp, Oryza sativa
aattcctgcagcccaatttgcagcggcattctggtctgcaatcaggattcaaccctcagtcacctccgccctacttatggggcagctacaacctccggcgatcattctggtcgtcgagtatcgagccttcaacctgctttgcttctggcgcctttggaaccatcgtcacgatgtggtcttccgaggggaagcgccgtcaattcaacaactcctacgctgatgcgtagaggatgcaactttgagggcggaaataatgaactatagagaacaccctgtagcgacacagtggaaacactgcttctcttctgctctctccctgatgtaatgctggatcctttttatcaccctttacctcccactttgtccatctaaatgaaaatttaggtggggaaaatcccccccccccccccgggtgaacattaaaaaaaaaaagatccagcgttggttcatttcatcctaccctaccaccgaagcactaaggtgaaggtaagctcttatttctagtgaatttgattatactgacacccaactgacatacaattgatatgcaagtttgggccacagtagatctttacattcatttgatatcattcaggtaagtcagatctttacattcaaccagtttgacagaattgctaccgtttagtacatccatatttcttaagtttgctcaatgacaactgaacagtgttgatcagtaactgctgcgatagacagcacatggatttttccaaatgaatctgcaacccaacttgtgtttatgagatatatttaattcagagacaaatcctgggtatgaatttatgatcatatcaatgcaggcatatattccagaagcgattgaactaaactgctcgcttgcaccttatgaaacttcattaaactaaacttgatgaataaagcgattgattgcataccttccttgcttcaggtgaaatcctctcagtaactgacgaaccaaaaggcagccacccactgaacactgcgccaccacctagagtcttgggataaagcaaaacacttgctaatgtgagagcacctgccaacgaacatgcactccaatacttagttcacagtacaaaatttcttaccacttcagaaacttacaatgcaaagcactagtcctacctccttgactgaatccacaaacaaatatgttctctggagggatgccatcagctacctccttatcaatcatggcgtgcacattttcaacagccttaagaaccccactgtcatcttgtggagaaccctactcgttgaagatttgaacaagatcaatacctactggtacagtaaattatcagcttagataagtggaatcagtgaactcacagagctcatgggtagctcgtggatgtcgaaccatgaaggcatcacagcgccatctgcaaggaggaagaaaatctcgttactgaatcaggagcaaatccgaagcagagaagacgagatggcgcgggggggcaacgaggcgtacggttgcaggagacgggggagttcggggcggaggggaacgcccacttggtgaggcggaactccggcgcggagaagaagttgcggatgggctcgttggccgggccggagtcgccgagtccgtgcagccacagcacgaagctccggttgcgggccgccgccgccgccatgggcgcggggacgaggcgggcggcgaggccggagggcggcgcgcggcggcggagggcggcggcgaggagggaggctgcggcgatggcggcggcgagggagaagaggaagcggaggcggctactcattgggtcatgggccgaagtcaactgggccgtgacgcgtcactcagcttggtcggtgcgacaggctatgagccggtatggtagttgaccaaactgcaattggtgggattaaaaaggtttgaactgtttttgggggtttgattttgtaagttttgccaaattgtatgtgttgattgaaggatcgaatgaatcgcaatgcaaattctaagatggaatggcagaaattgcaaggatcataaacctttatcagatcataattccacaacataaaaaggcatttcgcagtacatcaaatgtagcaccaatgtaccaacaatgaatggtagccataaattggactagaatatccacatcaagaacaagaaggagctataaaaattggggcctaggattcctgccctttggttctaaaaaaacaagcagctactggagatccatcttgtcagataaggatggcactggaactccagttccttgagataaacgatccttgatccattgtcgaaaatactggagctcttcatccaccaatgtatgcccaagtgcaggataagcctggtcatttttattagtgaaagaaaaacagaacattgtagtcagcaaacagacagattcttcagaaaaactgttattttgtcaaatatgcttcattaccaccttgaattcgcagtgcatgccaatttcttgtaaaaatgcacacccagcatgcccagcttcaaacagtaccaccccgtcagccatgccatgaaaccacaaaactggtgtctgcaaattttgaagattcagtatgaagacaaacaaatcaacccatttgcaggaggatgtgatcaccaaatgctcgttgcaaatatatctgcagctctgttacctttctagcttcagatggtatactctcagcaaatgttttgcttagaggaagtgatccactgaacacaacacagccacctaaagtcattgggtagagtagaacacttgctatggctagagcacctgtgaaaaggcaattaaaatcatagtcttgtgagtcctaactaatgccattaccagaagcatgcagattactacctccttggcttaacccacaaacgaatatatttgaaggactcgtcccagcagctacttctccgtctaacatttcgtgcacacgctccacagctttgagcacttccttttcatctctggcagttctctaagaaggacaaaagaatgttgttacttttgaaccaataaacgatgccatgctagcaagagaagtcagtattcaccaagcacaagtattttctttttgaatgaagttgaacagcattttggaattttaatagttaggagtacgaattacagcagtaataggaacttccgggatggcgaaccaagccgtgatcacctcgccacctacagcaatggtggaaacagacattcagatatgttcctgtttctctctgaaattttttatgcgccttggatttggaacagattttgtgtatatataaaagtttggttttgggtaccgtagcaagggatggaggaggtgggcgcggtggggaaggagaagcggacggaggcgagctccggcgcggcgaagtatggggcgacctgggcgcggctctcctcgcccgtctggccggagccgtgcagccacagcacgcgcccgtacccgcccgccgccgccatgcccatgcggccggcggggttcagcgtcagcgatcgatcggggcagcgaaggagctaggccgcggggggaatcgcctcgtgggcaacggagacgcgaaacggaggccggtcaggtcggatcacaccttgggcgtgcgctttgcgccgtccgcctccatcctcatcctgccgtgcccgtgccgtgtagcgtccgaactgtcgcctccgtcctaggcgagctgcgctgctgccgatgcgacgagagagcgcgcggcgtgggtggccccgtccccgcctgtcgccgtccgcccaggcctaggcctagcgcttcgtccgctcgtgcgggccttctacgaattcaccagttttgggcctgggccccttttgcacgcaagcgggatgtcctagaccgaaagtattactccctccgtcccaaaatatggcagtctcatatccagattcgtatttctaaatgggtctcatcctactacattttgaaacgtaggtagtaatagtgtgaaagtttttagattttaaattggaagttttaaagctacagttaaaaattccacatgatttgaactgaaagtctcgtatagaagttttattagaaggaaaatagtgtgatcaaacaacgcacgtgtacccatctcctgagaaagaatacatttaggacttttttgtaagcttaggtttttaagttagtttttttttctttatataatttataagccagtaaatttaaagttctaaatttaaatttaaattcactagcttataaatcacacatgccctaaaaaaacttcttttaacctagtttttaacttaacggtgtaagagtgtcttatagctttagaaaagtcaaacgaagaaacttatttgtttaggtttagatttttcgacgcttataagtctaaacaaacggagccgtagaaacaaacgggttgctcgaggccttgagttgtgttttgaagctgcaattcgtacttcagtactttgatgtacttgtgtcttgtggtttctcttcttaggaactgttgaagaggttactgcacaagaagatgttccttgagactctacggatcaggccttctcttccactcctgtgcaaaattttctcaacccaccgctgacagtaatccaattcgtagtattccaaagaatgcccaagcctgtcgtatacctacgcacatacacggcaacaagtgagagaaacgtttatatcgaattctgaaatgttaaatcagcaagctactagtagcggagcacataacgaacagttgcaaatgtgtatgattaccttgaactcgcaactcatgccaagtcctcgcagaaatttaattccatctctgccttccttgattgggattagagagcctgcttgcccatggatccacaaaacgggtgtctgcaagccacattgtagctgtagcatgattatttaccattgcagtcatgcatgagctggtcattagctctagctcttcttttccgttaaaatactacgagcattattggttgccctaataaatcaaaattaaagccaaatttaaatttttgaactttattttaaaattattttttaacgtagtttttttttcagcattagcttttaaaccgctaagaaacacatacatatataagctttatctataaattagttttttattctttaataagtcattttggcttattaagcaatatgagcaacgatgtgatcctaccattaccttctttgcttgtgcagtaactctgacagcaaaagaggaattgaagggaaggaagccactgaagaccgcacatccgcctaatgttttcgggtgaagcagcacgcttgctatgcccaatgcacctaaaatgtgcagatgtttagttatcaaactttcttcagatgaacatatattaatcgtcgtatgacaatgttagttctacctccttggctaagtccaaaaacgaatacgtcttgtggattcgtcccggctgcgatctctctgtcgatcatcgcgtgcacgctttggacagctctcagtacatcctcctcgtcccttacagatacctgcacacatccagactcaagtgaacatcacaattgttccttttctggcttctgcaagcatggcataaacaggggaattttcgttgtggcagagatatctaacggaagtgatgggcgcgtcgtggatgtcgaaccacgagggcatgagcatgccgcctgagaagaaacggagatggagagagtgcatcagtccagcgacgaacacataacaaaaattaccaagatccgatatatataattatctaattattaactaatatacttattaatatgtttattagttagaatcgaataatcgaacgtagaatcgccaatgaatcaagaggaccaattgattggtggaggggttgcgattcacgtacggttgcaagtgaccggagcggtgggcgcggtggggaaggcccagcgggcgtcggcgaaggcggccgtggtggggaagctgtcggcgaggaactcgttggcgcggccggtgtcgccgaggccgtgcagccacaccacgaagcggctgcgcggcgcccggctcgtcgcgggctccatccgaccatccgagattccggaggaggagaagagcgcgaggcgatcggtcgattattgtggctgatgagttgacatccattcttccatcggtttctgacttcccgtggctgttgactgatgatgagacatgagagcggcttgactttgatggcctgtacaatttcatatatcaagcttccccatccaactcgcaaattgtgccaacaaaacaactcctgcggtcctgcctggtttatgttaagatggaaaagaagagtgaaaaggtacagctgaaattactgaacctccaaccataacttgtacaagctgtaagtaatcaggtctaagggtgtgtttgagaaggaggggattgaagagatacgtaaaacgaggtgagccattaacacatgattaattgagtattaattattttaaacttcaaaaatggattaatatgattatttaaagcaactttcatatagaaattttttgcaaaaaaacacatcgtttagtagttcgggaagcatgcacgcggaaaacaaaactatctttctctctttctcctgcgcttgaacgcagcctaagtgatgaaaaggaacaaaagggggactacatctctttgaaataaaacaacaacaatctatttgccgaaaactatcaactttatttgtaataacacactcgtccatatccatggacaaacgtttgtgctgaacttccattattcagctcataaactaagaagcccggaagctggtggaaggcttagccaagtggtgaaaaaaaacatcgatcttgcagagtgcacacacttttcatgatccaaagtactaaaagcacaaataactggccaattctgctttgtaataggcacagataatcgcttatggtaaacagatgaaaacttttgtctcctcaatcagaaaggtcgtgtagatggttggcattatcagtcccgatcaaacgattgtacatgcacaatcacttgcccgatgctttcaaactggcgtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcttgaggatcatgcacaaggcatcggaatacagataaaaaatttgaaaatggtgtttaaatgtgattttaagttctttacacttagcttctcacaacataatatcctgaattgcctcaattcaaccatttatgacggttttcagtcatactttatgcttgtcaaaggtggtcttctggaacatctcttttaggacaccacatactgacatacatttatgaaaaagaagtgctgcatcaaaattgacatcggaaacctctacttttggcctaaattagcgtgcctttgagttccttacagttaaaaagggcaggtctagtatatcttcatagtctagacgtaaataagattcaacaaattaacttagtagtatagactatataattgtactgtttaatattagagtatatggtagttagagtcatattaggatatgattgatttatgtggattttttccatatctgtaatccttccttatctcatgtatctatatactggcccctgaggctctaataccatgttaaatataatacttccttatctctaccctatttatttcctatatatgcgggctcctaaggctcaatagaatgtgtccaatattcgcagtaatctcctcttcctatactattcaacatttatttacctgatcatttttgctgaaccaaatccaagactgtcatgaaataggcttgtcatgtacttcttctgtgcaaggcacaaaagctctgagctgttgtatatagggggcaggtatgcttccccattcccatctttgtgtttattccataattcgacaaacttcttgtggaacaaattccatgaatcttcaattgtcttcaagatccatttcttgtaagcctgaaaaatatgtacagtcatataacttattttatgccccgtgatacatcatgaaaataccttctaaaatctagatgctgccattgcactttgccatataacttgtcatttctgcagttcccattactcagggacattcaagtgatgagtaaggcaagttattcaacttattgtctgccgagcaccctcctccctctgttacatacggcatatctcaacaatatcaattgctaattattctataggatacaagtacacaggaagacatgtggttgccattatcttagcaaacgcaaaacaacttaaccacccaaaaagaaaaactatctttttgtcacataaaaaaaaaagaggacatttgtggaccaggtaaaagtacacactttcatttactattattagccaataaatccatacataccttacgatcatttgcttgatcagcgtgtccatcttgtgaaaaatatgccaaaatcaagttccccaggaaggccccaatgtcgtaacccattgggccatagaaagcaaattctggatcaatcacttgagtagaatctggtgtcaccatgatggaaccagtgtggagatctccatgaagaagagcctgtgctctctcaataaacctgcatatgcaaatcatgtccatcatctccaatatgaaaagaaaagaaaagcgctggtttaatctggaaagatagttacattgatttcaattcagcaatctccaatttaagctcagcatcctctcgaaccgctgcagcatcattatctaggaagggtgatgtgcaacgattgtatttggcgagcatgtatgggtctgagaacacgacttgctctgtgagcctacacatctccacattatcgcagtactgagcaactgcagttcacagaacacaaacattccatcaatttggttatcatttttctcccttttcatagtcacagaacacaacattctatcaatttggttctcatttttctcccttttcacaggcaaaccaaacctgtataataaatcaaccaacctcctttcttgtgatcagtggtggagttgtagagaagggaggtgaagaagagcgtcttggccatgtaatccgccatgtgctcggcgagcagcgggtactcgacgccagcgatgaggcccttgcggaggatgatgtgcggcggctcgatgtagcgcatcccgatcagcgacatggcccggtcgaagtggtagacctcggggacatggtccgggcagaggccgcggtgcttctgcagcgcggaggcctcgaagtaggcgcgctccctcgtcatcggccacgaatcccccacgcagcggatgtacggcagcgcctggattgcagcgtcgtcagcggaggaacggagagagaagatgcgtacatgtgtggcggcggcggcgcgtggaggagatagggacctgcttgatgacgacggagccggcgtcggagaggacgatgtagacgaagttgaggttgccgtcgccgacctccttgatggtgagggcgtcgaggctgccgccgaggcgcgcggcgagggcgggcgtggccttgatgtaggccaccagggacgcctcgtcgagcgggcggaagccctgctgctgctgctgctgctgctgctccgccgccgcggccatggccggtgcgtgtgtggccgtggcgtcgagttgaccgatgcgagcgccggcggcgaagtggccgcgacccgcgagaggagtggggaatcgagtgcgcgtgtgtgggaggctgcgctgcgcggaggtgtgtgggttttgtaacagctgctgctttcgcggaagggggcggttctctgaacctggacttgttattggtacaaggcggattcttcagttgagtcgtgtcatcagtgtgagctaatcttgaggagttcatgctatctttgagttttcaatccaggccgtgtttagattcaaaattttttaaattttttttaactttttcatcacatcaaatatttagacacatatatagaggattaaatatgatgaaaaaaaacaattgcacagtttgtatgtaaatcgcgagacgaatcttttgagcctaattacaccatgatttgacaatgggatgctacagtaaatatttgctaataacggattaattaggcttaataaatttgtctcgcagtttacaggcggaatctgtaatttgttttgttattagtctacgtttaatacttcaaatatgtgtctgtatccttaaaaaaattggcacacaaactaaacacatcctagtatactgctaattttgaactgaatgtggcttctggtcattggatttggtgaattttcctctctgttccaaaatataccatcatttatgt

SEQ ID NO: 45031 - DNA, 2065 bp, Oryza sativa
gtattaaagttgagtcatcctccgttcatctccttctcccaccgctcgtgcagtctatttgtccgctccttctcaaatcatgtacacaacctccgtatgatacggtactttatcctcaattaccttcctagccctttcttactcgtctcaattgtatgttcgatctgttataatgcatgaatatatgttgctaataaatctgaataagtgtttgttcacttatagcagtattttaggacggatgaaataaataaaattgttttctcgaaaaaataaaaaaaaactaatgaatctttcactcatgcttcaggctaccaatggtggtgtgccttcggttgaagttggaattttctagcaaatcaaccataatcgaaatgttctcatatagatatatagaaacatgccatgcctacataatttttctgaaaaaaacagctctaagataaggaccatatattcatttgatagaatgaaacggttactatgttcgtttgtgtgtttattagaaaaagaaatttattgtgatattttagaggattacaattcacaattattgtgtcccttcaatgaactctgcgagttgataaggtagcatccgaacgattaatcagttggtacgcatgttccacgctgttcttttcaacaaacagggagaatatatcgactgtgtttggccccatacttcggcttgatgtcgccgtcaatgctagcatcatgtatcttcaaaatgacatcatatccaaataaaagcagcatgaaagtgccagtcctccatattaaacggcatgaaactagctcacaagacaaaaatcattatagtattctcatgaccaagcgaaccatagtgagaaagttgacaaactctattatattcaccggatgaactagaatgttcaaagtatagataggtcttttggagaacttctagcatgtacagtttcttccaaaatctccaattccctaaataatcatattatgagattttatagctatagaatccagaaaaaaatgtgtaaagtacacgggcggtccttaaacttatagcggtgtgtcatctaggtcattaaactctcaaaatgcatatccaagtcacagaacttgtcatagtgtgtcatctaggtcccagatcaccacaaatccttcaggatcctacgtggtgcggatgtggcatgtcacacgaacatgatgtggcataattttgactgacaaataggacccatttaaaaattttatttctttcttttttttcttctcttgcattttcctttcttctcctttgtctgtgacccgagcaaaagagaggggaaaaaaacaagaataagaagaaaacagaaaagaaaaagaaaagaagaaaaaaaaggacatgtcacgtccatgtggcaggtcacatcagcgccacgtaggatccagaggggatgtgtcgatttgggacctagatgatacactttgataagttctagggcctggatatgcattttgagagtttgggggatctagatgacataccgctacaagtttaagtaccgctcgtacactttactcgaaaaaaaatctacgaggaagctaaggaaaacctactttgtagattaaattctgagaaatggaaatctagttgtgagagcataaaaaagcagggaaaaccagttttttagcttttattaagattcttttgaatctagataaaaagttaaattgtttggggaagcttttgccattcaaccgactgattcttacaaacttagccaagtggtgaaaaaaaaacatcaatcttgcagagcgtccacacttgagcatgcataatgtatagtagaactagtccataaagaatacaatatttcattcagccacctaacaacattgtagaactagtccatatcaagcaaatagcaaaagtcacccataaacatatgagttgcctatatagaataaaatatattatttatctctgctttctctctccttctaatactactaactacctatatatattacatccttcgtttcacaatgtaagtcattctagcatttcccacattcatattgatgtccatgaatctagatagat

SEQ ID NO: 45032 - DNA, 7864 bp, Oryza sativa
  unsure (1)..(7864): unsure at all n locations
gtcttcccttcaggattgcctttgcacaattaagggcacgtcgctcacacgaagctctcttgctggcatcctcaatcgactcaaaatcctcaacatgagcaattccaacaattctcctacatatgtatggtccaatttagtaaacagaagtcgcgtgaggatcatgcacaaggcatcggaacacagataaaaaatttgaaaatggcgtttaaatgtgattttaagttctttacacttagcttctcacaacataatatcctgaatagcctccaatttaaccatttatgacggttttcagtcatacttataatcgtcaaaggtggtcttctggaacatctcttttaggatagcacatactgatatacatttatgaaaaagaagtgctgcatcaaaattggcatcggaaacctctactttggactaacttactgtgcctttgagcttcttacatttaaaaagggcaggtctagtatatcttcatagtctagacgtaaataagattcagcaaattgacttagtagtacagactctacataattgtactgtttaattacctgatcatttttgctgaaccaaatccaagactgtcatgaaataggcttgtcatgtacttcttctgtacaaggctcaaaagctctgagctgttgtatatagggggcaggtatgcttccccattcccatctttgtgtttattccataattcgacaaacttcttgtggaaaaaattccatgaatcttcaattgtcttcaagatccatttcttgtaagcctgcaaaatatgtacagacatagaacttattttatgcctggcgaaacatcatgaaaataccttctagaatctagatgttgcaattgcactttgccatatcataacttgtcatttctgcagttcccattaagtactccctccatttcatattataagtcgtttgacttttttcttagtcaaagttctttaggtttgaccagatttatagaaaaaaattagcaacatttacaacagcaaattagtttaattaaatttaacatagaatatattttgataatatgtttgttttgtattgaaaatgttattctatttttctacagatttggttaaacttaaaaaaaattgactaagaaaaaaatcaaacaacttataatatgaaacggagggagtaatactcagggacattcatcgtctgctgagcaccctcctccctctgttacatacggcatatatcaacaatatcaattgctagttattctataggatacaagtatcatgttccaaacttctatcctatcgaaattagtacacaggaagacatgtggttgccattatcttagcaaacgcaaaacaacttaaccacccaggtaagattacgcactttcatttactattattagccaataaatccatacacaccttacgatcatttgcttgatcagcatgtccatcttgtgaaaaatatgccaaaatcaagttccccaggaaggccccaatatcgtaacccattgggccatagaaagcaaattctggatcaatcacttgagtagaatctggtgtcaccatgatggaactagtgtggagatctccatgaagaaaagcttgtgctctctcaataaacctgcatatgcaaatcatgtccatcatctccaatgaaaaggaaagagaaacgctggtttaatcaggagagctagttacattgattttaattcagcaatctccaacttaagctcagcatcctctcgaaccgctgcagcatcattatcaaggaagggtgatgtgcagcgattgtatttggcgaccctgtatggatctgagaatacaacttgttctgtgagcctgctcatctccacattatcgcaatactgagcaactgcaattcacataacacaacatgccatcaattcggttctcatttttctcccttctcaattttcacaggcaaaccaaacctgtaataaatcaaccaacctcctttcttgtgatcagtggtggagttgtagagaagtgaagtgaagaagagcgtcttggccatgtaatccgccatgtgctcggcgagcagcgggtactcgacgccggcgacgaggcccttgcggaggatgatgtgcggcggctcgatgtagcgcatcccgatgagcgacatggcacggtcgaagtggtagacctcggggacatggtccgggcagagggcgcggtgcttctgcagcgcggaggcctcgaaataggcgcgctccctcgacatcggccatgaatcccccactaagcggatgtacggcagcgcctggattgcagcgtcgtcagcgaaagaacggagacagaagatgcgtactacatgtgtggcagcggcgacggtggcggcgcgtggaggagatagggacctgcttgatgacgagggagccggcgtcggagaggacgatgtagacgaagttgaggttgccgtcgccgacctccttgatggtgagggcgtcnagccggccgccaaggcgcgcggcgagggcgggcgtggccttgatgtaggccaccagggacgcctcgtcgagcggccggaagccctgctgctgctgctccgccgccgccgcgaccatggccggtgcgtgtgtgggcgtcgagttgacttgaccgatgcgagcgccggcggcgaagcggggaatcgggtgagcgtgtgtgttggaagtggctgctgctcgggtgggatttgtaacagctgccgtttccgcggaagggggcggttctctgaacctggacttgtttttggtacaaggccaggattcttcagttgagtcatgtcatcatcgtgtgagctaatcttgaggagttcaggctatttttgagttttgaatatattgcttcaaatcttgaactgaatgcggcttctagctattggatttggtgcttttcgtgccataccttctccattttaaaatgtaatagcatttctgatataattttggataagtgtttgttcacttaaagtatgatgagataagagttaaaaagatcagaaaaattaaaaattaaaaattggatcacttcaggctagctgccaatggcggtgtactggcgtaccgtcagttggagttggaattttctaggatatccaccagactcaatatggtgtactgaacaaaatgttcttctatagataaaagacgatatttggattccaaacacatttttaaaaaaaattgtaagcgcgttagatattgaacacggggtctcaaaattgaaatcacacattccattctataagtgcatcttgttcttctatatatagatacatgccatgactatatagttttgctgaaaaaacaggtctcaggtaaggaccgtatattcatttaatatgaaacggttactgttcaggttcgtttgtgtgtttattataaaaatagaaatttactgtgatattttagaggatcacaattattgtctcccttccacgaactatgtgagttggtatgggctgtgtttggatccaaacttcaatcattttccatcacatccacctccacctgttatacacacgtaacttttcagtcacatcatcttcaatttcagccaaaatccaaactttgcgctgaactaaacacagccaaggtagcatcggaccgattactcggttggcgttggaacgggtactcatgttccacgctgttgttttcaacaaataggaagaatatgtccatgtttggacccataattcggcttgatttaaacatgtcgtcgtcaaatgctagcatccactaatctgttggtttggatacttgttttcttcgaaatgacatcgtatctaaacaaagcagcatgaaagtgccagtcctccaaattgaacggcatgaaactagtagcttgcatgaccaaacgtatttatggccatgatatatttaagagaaaaaaatcattctaaacagtatatatttactgaatgtactagaaggtccaagcacataattactccatcaattttaaaatataaggattgttacaataaataatttatttttttcacttcagttgttagcatttgaatttcgaattacttgtatttcttttgggaaattttgtaaaaatacactcgttatgatcaaaattacacaaaactacaaggattttgacacatagcacatgacccataggtactatggatataaagttccacaaaaccacattgtaaccaatttgacatactcatatatcaaatttttaaaaggccatggatgtaacatttatatgatggataaataactcataaattcgagatgcgattgtataacttaaaattatggtaattcaaagttagaatgataaatattgtgttttttgaaatgaccataatacatatgtttatgtgctaaaaaatcgtatgtttttttaatttactcaatttgttctaaaatttagtactagataggacacatcatagtactataaatctcgacagaaattcgttgggtattatatgctctatgttcaaattcgtagtactataatgtatcccatctagttataggttattattatttgtgattaagaggtagatcataatacgggtggttaaatgaaatttacttattctctctttccaagcatttgattagctttaaaattattgaaatgatgggaatcacaaaaatcagtgaaaaataagaatattatggtgtaaaatttaaatcttaaaagtatagaaatggaaggagttattccaacaccatcgggcatcacttgcccgcaaaattgcaataactcaccataatatttcaaaataattcgacggaattcattcgctcgcgccgtctccgaaaccgaatccatttcctgatccagcaaaggacacagagagagatcccatctcgtcctcgtcgcctccgcctcgtgagctccactcacctaccccacttcctctcctcgcttcggccgcggccccaaaccctaaccctccccgcggcgatcccgatggccaccacctcccgccgatccctccacgccctcctcggcggcggcgcaggtacgcacgcgcattcccggcgctctccgatccgggtcgagaatttgggttcggttttctcctcactcgtgttctctcgtctcgcagtcgccgacttggtgctgtggcggcggaggaacgtgtccgcggcggccgtggcgggcgccacggcggtgtggttcctcttcgagcgcgcggggtacagcttcccgtcagtcatggccaacgccctgctcctcctcgtcgccatcctcttcttctgggccaagtccgcctcgctgctcaacaggtgggtttttgccctggctctacagcaccgcgtgtttctgatctcatgtagagtcgcgccgcgccctgcggccctgattcgctgtagttgtaactgcggtgttcactgtaatgtgtatgaggttttgctgaataatgtggactttcttttccccaaccgtttggttgttgcatctttttggcttcaagaagctcactgccaaactgtttcatacactaacttgcttagcatttttgaattacgggttgcagtaagaaactaaacttcaggccagagcagtttgtaattggaagtgatccgatgatctcctaagattagagattgttcaaaggtttgaactctgcatatgtcggggtttcctaattatcccttttcctgaaacctgcatatttcgtttttattacattaccaataatgcatctatccgatcccttatctacaaagtaaagaggctgctttactttaaagctaagccgcgatagcagttcgataagttaattctgctagcatgtgtcattttctctagagcttgtaactgtgctatatggtctcttctgcaagcaatccacaaggtttttttcctagatttacattacatggtcaatcaccgcgcttgccattccttatcggctcatttatgagtttgtgttccccatctgacttgattgttgcctagaattgatatgcatttatgcagtgtctctgcgattgtatcgctaaaccgaaaaagaaagagctgtttttggcactttggttgttttatgttgttctctgtgactggcattgtacttccattgcccatatcatctatccaagtttgacacaaagttgtgatttttgcaggcctcttccaccactccctaaactagaggtctcagatgtggttgttgagaaagctgcagatcgggctcttgtatggatcaacaaggtgttggctgttggccatgatattgccatcaagagagataggagtgtttttataaaggtctctctcttatacacacacatccatgcccactagtacacacacaactgtacgtctatatggctgtacctgcctttgtatgctttcttcttatgccccttattttgtttggtcatataggttatattgattttatgggtggtttcatacattggaatgctcttcaacttccttacgctcatttacattggtgagtactactgaatttgtttctctttaacttcctggacctattcatgtatggatcaatcgttcttttatgatagctcatatgtaataattgtatcattctggcttttctctaggtgtaatgttttctctgttagttccaccattgtatgagaagtaccaggaccaagtcgatgaaaagattggtatggcgcacagtgtactatcaaggcacttagataccatcattagcaagactggagaatcaaccaagcaaaagaagactgagtaaccggtgtttttgctacattgggtgagcttctaagacggtttgaatcttttttactagttcatggtatactctaaatccaacaaaccactaatagcttttgtgtttcacatatttagtatgctacacatttcgttaacatgatagcatggacaacatttttgtttaactcttgcaatctcaagtttacataatgttgcaatagttcaaaaaacctttaagatgctataacggcaatgccagtggatctttgttactcgaaaagtcccacaaaaacctaagggctaagggcagcaaagatgagataaattctcgttgaacaaatggatagagttacttctcaccgtattctgtatttctgttgtatttttctaaggcaaaaatggtctttcttagaaaggcgaggcagtgatgtcctccctttgttaataaaaagagaaaccaccagcccaggaatggcattcaaggcactctaaatacaaccaagtaatcactttcagaagtttgtttttctggagttgaactgttaccacacatgaaatttacaaatgttctgagaccatcttctgttgttcctgagaaatgatacttctctataatgatcatcttttgtcttatcaggaacctcttttgtcatatgtggttggtcatgaacctcgtcagttactctccatacctgtgaaccaccactggaaatattcttggatatcgaagatgtcatgtttgactgctgatgtagtttacatgcactctgttcaatttgagaaatggaatgctttgtatattttttcaagtaacatgacacatgctgaggtttatcatgggcacatatcttgtggataatgatatatacttttcccctgaaatcattttctgtagccggcatatacaaatatgttggttgctggtgcactaaaccgtttttttagtgttcttgattctcattgttaaatagttccctaataaactttagtgagctcattcgatgccaaactgcacacatgcatacctgaatctttggtaatcgtctagggccagccatttttctctactacttatgaaccgttgtgttcagtttttactattctggtgtattaatttgctgcaaaacttatgtatcatgtaagtattttgtgttggtgtaaaatcgctatgctaga

SEQ ID NO: 45033 - DNA, 18844 bp, Oryza sativa
ttttttctggtttgctattatgaatcagacggcaaatattgcttccggccgagtcatgtcatgctgacttcatgtttagcaaacgctaatatgctatatgaacatatctttgctcctggcccagaagatgatgatgttccacttgctacatacacacattgtgccttttgtcatgccccagtgccccaatcatatactaccggtatgtacagactacagagcactgagcccggtcgtgaggcagcctctgccctcctgccgaggaaagccgacgctattgccttccccgcactgacccatcatcaacaactcaactcaaaatcacaaaacgccttgaccgcacactgccatactattatgtgtgtattcacttcgcgagctaggcacgtagccacttcgccctggaatcaagtgcacgccccgctcggctcggccagtggtcgcgagctgcacgccgccgctgcctgcacgcacgagcgctgcttcatttcttcttcttcttcactcctaccgtcgatgacgactaattaaccgccaaccccactaccgcctctctctttgctggctgccattgcctcctctcttccccggcaaaacaacttctctcctattcccacctcttttcacccataaagcggaagtggatttttgtcgggacatcctctcgttttgtgcgtatcgtttaaaaagttatcaaaatttttttaaaaaaaattatcaagatatatattgtgatcaatatatgatatatcttttcgcaaacatgcaagttaaaattcgacatatgtaatttgaaacaaaaataacaaacaaatttaaccgtaaattacgtgttcttttcacagttaaatttgctatttttgtttttacttgtataagttgaatttgaatatgcatgtttgaagtgacatatcacatatagggtgtgtttagttccacgctaaagttgaaagtttgattgaaattgaaatgatgtaacggaaaagttgaaagtttgtgtgtgtagaaaagttcgatgtgacgtttttgggattcaaagtttggaactaaaccgagccataatctgctacactaaattttttaccacctccgtcccaaaataagtgcaaccatagatatccgtgtccagcgttttgactgtccgtcttatttgaaaaaattataaaaaaaataaaaatattagtcacgcataaagtactattcatgtattatcatctaataacaataaaaatactagtcataattgtttttcaaataagacgaacggtcaaacgttgagcatgaacggtgttaaaactgcacttattttgggagtgacatgtaaaaacgagatgatatccccttaaaaaatgaatatagtttttcccataaagcacgctccacttgtgctgatccattccatgtcaatggagttcatggagccatggacccatctcctcctcctcctccttaaaactcgtcttcccccccacgtctcaccaccatctaacgtgcgtccatggcggcggcttcaggccataatgcgcgcctgcttgcgctcgcgctcgcgctcctgctcgccgcgctgcacctgcacggcgtggtgtgtgaccccagccatactcacttcgccatggtgtcgcgcaatgcgccgtcgtggaggcccgatcgcggtggacaagggaaggtatcggcgccgtcgccggaggacttcctgaacgagaacctgcaggcgctgtacccggtgatccaggcgttcaaggcgaccatcaccagcgacccgcgcggcgtgacggcgtcgtgggtcggccccaacctctgcgacagctacttcggcggcgacatgtacaagggcttctactgcgagcacccgccggcgccgccgggtgcaacgacgccgaaggacaacaccacgctcaccatcgcgtccatcgacttcaacggctacggcctcggcgcgcccagcctctccggcttcgtcgacgcgttcccggacctagcgctcttccacgccaactccaacaacttctccggcgaggtccccgacctcaccggcctcccgtacttctacgagctcgacctctccaacaacaacttctccggcgcgttcccggccaccgtcgtcccgctcggccgcctcctcttcctcgacctccgcttcaaccgcttagtcggcacggtgccgccgccggtgttcgacctcaccgtcgtcgcgctcttcctcaacaacaacggtttctacggcaacatcccggacaacttcgggagcaccacggcggagtacctggtggtggccaacaaccagttcaccggcccgatcccgcgctccatctacaacacgtcggcgaacctctccgaggtgctcttcctcaacaaccacctctcgggatgcctcccctacgagatcggattggtggaggggctcaccgtgttcgacgccggcggcaacgacatcaccggacccatcccgctctccctcggctgcctggggctcgtcgaggagctcaacctcgccgggaaccagctgtacggccacatccccgacgtgctctgcgcgctggccaagaccgggaagctgcagaacctctccctctccgacaactacttccactccgtcggccgccgccattgcctcgagctcgtccggagcaaggtgctcgacgtgcgcctcaactgcatccccaacttcccccaccagcggccggcgctcgagtgcgcccgcttctacgccgacccgccgcagcactgccccttcgtgccgcacatcccctgcgacctgccgggcttcaggccgccggcggcggcgttgccttcggctgtggcagctgaagaaggcggcggcggcggaggtggtggcaactgaactgatcagcgatcaccaactttgtcagcgttttgtcgttcagatcgcatgattccaaactttgtaactgttggtcaataaacggaaaacggcctaccaatttgtgccgcaaatctcagcctgacgcattgctgacaacaatctgatatcacatcgcaataagagggaaggatgcaaacacgaacattcttgcatccttccattgtatccttacaagtaatcagtgttctgaaattcactgatcagatgtactagttgtagctatatttcgacagaagtgaataatgagaatttggaacggtaaaacaggatcttcgttaatgtattcttgagatgataaattatatagagtacaaattggagaagataaataagagtacaaattggatcgagctatgtacacagatcactgtaagataaaaggcaggcagtagagtaaataagctgtcccctcaaaatgcgacaacgatatatggaggcacggaagcagaaatttcagaaaggctccacgctgcctcatcccctctcctcgccgattacatgttatcgatgagctcatgcggtgttcagcttagcgagcgtgcgcttcaaagccttcacgctcaatgggctgttcttgctctgcacaattccaacaaaaggaaggtcagttcgtacgttcaaatatcttgcacaattccaacagaagaaaggtcagttagtgcattacagttatctgaactatctttggagccaaagcaaccttaatgtctagttttttcagaaaaagcatgatgacaaatatttgctgagttcagatcatgaaagcctcgtgccttttcaaaaccgtatagcttgtcggagcagaatactatgatgaaaacaatctttggaatagaatgtaggcagtataaagttgcagtaagaacgaacaagaaagcgaggagattaccgctgagcaggttccagcccgggtgttgcagacagggtagtcaggcgggcagcagctggcatgatccttgcagcaggttgcaccttcaactgggcaacagccccaaaccaagcagagattcctgaagccgaatgcgcagcagcaggtgctgcccgctgggcaagagaagttatcatcgcagacatggtcaggggcggatgggggaggtggtgttggaggagttggaggagtcggagatggcttgggtgggtttgctccgctcttggtagggtatgatgccatcatggcaatgccacacttccccgtggtcacattgatattgcgctccatgcgaacgtatccagactcaccccacttcgggccccaagagttgcggacaatccagtagtctttgccattgtcagtgccataaccgacggcaaccacaccatggtcaaggcttgtgccacacctaccgctgaagacgccctgtaatgtaaaaatcaatagttgttacgaccaaaacctcctatatgcatggggtgatatctgcaagttcatttaccgaatgatagagctggaactcgcggccaccagcctcaatagcaacactgactggttggtgagcaaccgccttctgaagtgatttctcatcattttgaggtacatcctcaaagccatcgatgctcacaaccttagcattttcctaaaacaatgcacccgttgaaacattagcgatttgcataatgtgggaactgaaagatgaatgtatgaagttattcatcagaaaataagttaataccctgttgatgtcacacttgccatctacagctttgtaaggatagtcatcttcagtatcaatgcctccattcttaatgatgaagtcaaaggcatcatccatgagcccaccgttgcagccactgttctgtccattggttgagcattctacaagttcttgttccgacaatgtgatcatctcaccagtaacaagttggttgatgctttctactgtgcttactgcggagaaggcccagcagcttcctgcatcccaccattcaagaccaaagatgtcagtaaccatcaaaataactagtgtcatccaagagagcaacaactgcaatcataccgcaagcaaccaattgtaatatgaggcaagaaccctaaactgtttaattgtatcaatattatcaagatcaagatggatagtaagatatttgcagacatttgtttcacccctgtttttacccacaaaagcagtttgaagacacctgtaggctaatatcagcaaacagctcccagcacaggataaaaagtttgctcgactgaacacgaaaggttgataaggtgtgatatcccttaaaagtcttaaaggcccaaaatagttgcaatgcaaagcaacatcatcaaatcggtttaatgtcttagtagttggttacagggtcaccttgtccaaagtatttgactgatagatgcaccgaaaaagacctttaaaaatataaagacaaaagcagcacaaccacagaaacggcagtcctaaaatcaggaaaaaacaagctaagctaaactacaatcctggaaacaaggaaaccacactgagcaagtcagccccaaccaacggcgggctttgaatctgttcaagtccacaccgctgtcactgcacgattcacaagtcacagccgttgccaactccagaagcaaagaacgaagagaacaaataccttacacagttaacccaatgagaggattttccaagaatacatcctgcatccactacgtaataaatccttaccatagaattccaaacaattattcggtccagtaaattatcatcgtattaaaagaacaataactctgtcattaaatcagatatgctcattcaggggggaaagtcagctttagctagaaaaatgacccatcttttctagagactagacggtgtgtgactatataatcataatctactattatattatgtatatatcagaaggaaatctgcactgttttgcaagtaggggcaaaagattactagctgtgaacctgaattaactgttgtgaaattgccctacttagatccgagattagcgtgacaaatagataatcgcatctaagctttcaatggtaaataatcgcacaagggagatgagatgaggaaagagaagaaattccttaccgcattggccctggttcttgacgggggcgacggcgcccttctccctccagtcgacggactccggcagctcctccaccccgtcgtggcggtacctctccccggcggcgcggctcctctcggcgaccttggcgccgaggaaggtcgcgcggaactcctcgttggtgagatcggcgaagcggttcatcccgaggcggaacccgccgcgctcgtcggcgcgggcgttgtgggcgtcgacgaacttgaggttgtcccagaacacgaggaaccggcgctcgtgctcgccgccgagcgcgttgggcgagccgccgccgttctcggcgagccagaggtcgtacgcggcgcgcgcctcggcctccgtgggcccctcctccagcccccgcgccccgtgctccgcgttgtaggagatgatcgacatgtccggcgccgcggtggccgcgccgacgatgagcagcagcaggaacgcggcggcggcggcgcgggcggccatggcggcgacgtggagacgagcgtctctctccaacctcttcgctttcctcctcttttcttttcctcctttttttttccttcttcgttgggtttgtggttttttgggcttgataggctcgatgcgggtgggatttataggcggcggatgcgtgtttgggtcggcgactggaagaggagtttgggtttgggaattgggatgggatgaggtgagggatccaacgccgctaactaacaattctgatctgaattaggttgctaatcgtaacaattcctatcttaattaggagcgaaacagggtggatattctcccccgaataaaaaattttccatggcgaagtcgatcgggtaaaaaattaggaaccgaatcctcaagtaattagtactataatctagctcgtggtaactggtaagacacctcatcggtgtcgaccaaatccgttggatcgtaaataaacaaggcagattttcccccccccctccctttctcatcgggtaatttagaactgacggagcgtggggctcctcaccgggagaccgcgcaggcccccctttgccagttcggccgggggccctgggtgaggttctaagctcccaatctgtggaaggttcgcaagagcggaaacacacaagacacgggcgatgtatacaggttcgggccgctgagaagcgtaataccctactcctgtgttttggtggattcgcgtatgaagaagctacaaagtgccagtcagcccccgattcttctgggattgctttctcctctcctttctaagtgggcaaggtcctccttttatatcccaaggggatcccacatgcaccatctctccctccctttctttcaacttgacttctcttcattaatggacggagatttgtatcgctgccatccgaatcaccttctgacgggacggcccatacctacctccactttcaccggaagcaggcgcgacgtgggagatggctgtctgctgacgacatgaccattgtcagaccggtcaccaatcggtcattcttgtccatcacgtgtcagtttaacaatctgcatgttcgcccttcttcatacaacatcttgcctgtaatggttaggatgaagcctggtatatatctgaccggaaccaacgtgtcatctccaggaggtaacacgccggctccggctagggacgagtgcttggaggctctcgtcctgactggacggggcgaggcgtgcgtcagaccgcctgtcgccacctaacccacgatctgaccggtctgtgactggtcacagaccggataaacgagcgcgctgcaccgtattacacgcggcgtgacgcgttcgtccaaaccgcaataaatgcggttaggtgagcgccgctgtgctcacctaacccatacacgcggcgcaaaatccacaaggggtcggggcgccccagccctcggggccaaggcgggagcggtccgaccccctcggggagacaaagaggagggcgaacacaccaccctcgggcccgacccccccccccccggtgggtgccaggccacgtgggcgattgtgtctgcctcaagcctctagtcacgatactcccggtcccatgtcatcgacagtagcccccggcgttatgccggggcgattaccctcctcgagggaagcggtcgggcgtgacgccacttcctaaggcctggtgacaggtgggaccggtctccacagttgggcagaaacccatcagtcgcaaatcacgcacatcggcaacggttactcggctgtcaataatgaacggtctcttcaagactgccacattactcgagtaacgtgtgaatcgggacgtgccggttcgttttgcctggagatatggtgatggcgcttcggtcggcgagcgtaattaacgcgcgcacgagatgttccatctcgactgccacagccgcatatccacctcatgcaccgtaaacgggcgaatgggattagtggaagagtgggcgcgagaaacgagggggcaagatagtgggcgcgagaaacgaggagccgggcacagcgttggcaagggtataaagttgccgaggaagagatttgcttcctttctttcgccattattccccttgtcttcgccgcttgcgccctaactccttgtttcctgtgccctacctccgccacacgcgctcgctctcaaacatctcttcttccggcgtcatggcacggggctccgctccgcttgacggtagcgtgctgccgccttcccgcatcgtgagcgagagacaggccgggctgctgcgccgcttcatgccggaatctgcgaccggccgggagatagtctcgctgggcgaaggatgcccggcgccacgctacccggggcggtccgtcttcttcctcccttttgctatggcagggctggttccgccattttcttctttcttcgtggatgttctggagttttacgatctccagatggcgcacctcacccccaacgcggtaatgacattggccatcttcgcgcacttgtgcgagatgttcatcggggtgcgcccatcccttcggctgttccggtggttcttcaccgtacagccggtttcgccgccgtcggtggttggtggttgctacttccagccgcgggggccggtgctgaaccgctacattccctgcgtcctccgcaagaagtgggatgactggaagagcgactggttctacacccccctcgccgacgaatcgcgcctccgactcccaagccagcctccagcgcaggcctccaactggcgggcgccggtagatctgggagatggctacgacgccgtcctcgaccgcctggcgggcctgcgatctcaggggctcacaggggccatggtgttcggcgactatcttcgtcgccggatcgcgccactccagcggcgcgcccggggcgcctgggagtacaccgggtccgaggactgtatgaggacccaccagggggtccgatgggactgggctcctgaggacttcaagatagtggtccaacgggtgctgaatctcagctccgtggaggcatccctcgttcctcaaggagtcctccccctctgcagtgatccagaccgtgcctccatcttgaccatcatgcaggcggtcggggcatcggaggagcgggctcctcgaggccacgatggcgcggtcgggagccgcaggggggaacgatctaccccgggagggggtcgtgcttctgggcctcgcgacgggggcccggggagcggccaccctgccgacgcccgggggaagaggaagcaggaaggaacccctccctcatctcctccccgagggggcggggcggcgcgtgccagcagcaggcgcccggagggggccacgccgacgtcgcagcccgagggggagcggaagaagaaacggccccgcaagatgagggggacagaaccatcccggggaaaccttatttcccctccaaggtggtcgtttaaccgaccccctcgcaggttcgtcccacgcccatcatggccgtattcattcctttaacgcgagttttcactcatccatcttgttttgtcttctggtctttcttctgtttcagcgagatcccgtcgcgtccctcccgccattccaagtccggccagtctgagtccgaggacccggcgtccacagaggcccggaggcgggaatctgaccggcgagaagccgcagaccgccttcgggaagccgaggaggccgctcgggaggccgccctggctcgccagaccgaggaagccgttcgggaggaggccggactccgccaggccgaagcgacgacatcctctgaggcgacccgtgaaactgaccggcaagaggccgcggatcgccttcgagaagccgaggaagctgttcaggtggccgtccaagctcgcctagctgaagaagccgctcgggaagaggtcagacttcaccaggccgaggcggcgacgacttccgaggcagcttgcgacgaggccgcgggcgcatcgcttgggcccaattcctcgggcgacgcccaggataagctaggtccgggggatatccctgagtccggcacgtccattggcgggccgagccgcgcggcatcctcaccgagacggctcttccccacgccttctgctgctccactgagcgcagaaccccttctgcgggccttggccgtcgcaaacacgacggtgttggacgggttaagtgcccaagtggaggccctgcaagcagagcgggcggagctcgacgccgcatgggtgcgtgtcgaagaggggcgacgctcggtggaggccatggtggaagtgggtcgcaaggcacaccgtcggcacgtctcagagctcgaagcccgtcggaaggtgctggaggagatcgccaaggaggtggaggaggagcggggggctgccctcatcgccaccactgtgatgaacgaggcgcaggactccctccgccttcaatacgggagctgggaggcggagctagagaaaaaactcgatgccgcccagggggtccttgacgctgccgctgcccgagaacggcgggcggcggagaccgaggtggcatcccggcggcgcgacgaagcccttgaggcccgtgccatggcgctggaagagcgtgcctgcgccgtggagagggacctggcggatcgcgaggccgccgttgctattcgggaggtcacactagcggtgcacgaagccgcctgtgccgaagaagagtccgcactccgcctccgcgaggacgcgctcaccgagcgggagcgagctctcgaggaggccgaggccgcggcgcaacggctggcggacagcctgtccctccgcgaggcttcgcaagaggaacaggcgcgccgtaatctggaagatgcccgcgccgagaggaccgcgctgaaccagcgggccgctgagctcgaggcgcgggagaaggagctggacgcgagggcacggatcggcggggcggccgcgggcgaaagcgacttaaccgctcgcctcgcaactgccgaacacaccatcgccgatctgcagggcgcgctagactcgtccgccggggaggtcgaggccctccgcttggcaggcgaggtagggcccggcatgcttcgggatgccgtctcccgtctagaccgcgccggccggcaggtgggcctctggggcgggcagactgcgaagtacgccgccacccaagggggcctcgcccagcgcctctcggagatagccgggactctccaacggctccccgaggagctcgagaggacgattaagtcatcctcgagggacctcgcccgaggagcggtggagctcgtactggcgagttaccaagccagggatcccgacttctccccatggacggcgctggacgagttccctcccggaaccgaggacggcgcacgcgcgcaagtccgggacgccgccgaccatatcgtccacagcttcgagggttcggcccctcggctcgcgttcgccctcaactccgacggggaggatgatacggcggagtgggcaatagtggcgacgaggccggcgatccgggtgcgtcggagtgagcccccaggcccccgccaatctttaaatagtatcttcttttttttttaaggccttcgggccccctgcttgtatagactaatttaatctgcaatcaaataaagaggaaattttttgtgttaattctatttgttgtgtgtatgagacaaggatgtctgtgccgcggttctcttgtgtcttggcttgaacaagggctcgtgcccaggtcctagtcctcaaatggctcgggtcggggctagtgcctggagagatccacatgtcgagactggccaggccgggagcgtggtgaccgagggttatgggtgacccgattgtgggtttttgccgattctcccccggagttcaccacgccccggggcacggctcggttctgggccccgtttggcgattttagccgacccgagcccccgagggcaggattgaacacgagtgacctatttcaagtcaagattcttcaaaaggaaacaacagcacagatacagcctttaggaaatcgaaaatacttttattgaggtacagatataagagaaataagaatatgcatatgtggcagcccccggccaaccctgcacgcccgaggggggtgcggggttggcccaagcctaaatcctgatacccgatcccccttaggggtagaagcgacgaaggtgttctatgttccacgggttaggcagttctgcgccgtcgctcgtggccagccgaacggagcccggccgggggacaccaatcactcgatacggaccctcccacatcggtgagagcttgctcaatccagcacgcgtttggacgcggcgtaggacgaggtcgtcgacgcagagtgatcgggcccggacgtggcgctgatggtagcgccgcaggctctgctggtagcgcgcggctcggagggccgcgcgccgccttcgctcctctaggtagtcgaggtcatctctacgaagctgatcttgatcagcttcgcagtacatggtggcccgaggggacctcagggtgagctcggatgggagaaccgcttccgcgccgtagacgaggaagaaaggcgtttccccggttgctcggcttggcgtggttcggctcgcccagagcaccgctggcaactcctcgatccacgaatcgccgtgcttcttgaggatgttgaaggtcttggttttaaggcctctgaggatttccgcattggctcgctccacttggccgttgcttctggggtgggcaggtgaggcgaagcagagcttgatgcccatatcttcgcagtaatcgccgaaaagttcactagtgaattgggtgccgttatccgtaataatacggttaggcactccaaaccgagctgtgatgcccttaatgaatttaagtgcggagtgcttatcgatcttgacaaccggataagcctcgggccacttagtgaacttgtcgatcgcgacatacagatactcaaacccgcccggggcccgcctaaacggtcccaagatatcgagcccccagacagcaaatggccatgaaagcggtatgatctgcagggcctgggccggctgatggatttgcttggcgtggaattgacacgctctgcatcgccggactaggtcgaccgcatcattgagagctgtcggccaatagaaaccttgtcgaaaagctttgccaaccaaggtacgcgaggcggagtgggctccgcattcgccttcatggatatcggcgagaagctcgacgccttgttcccgaggaatgcacttcaggaggattccgttagccgcgcgccgatagagggtcccttctaccagcacatagcgtttggaaatgcgccggacgcgttcactcccttcgcggtcctcgggtagagtcttatctgtgaggtatgcttggatctcagcgatccaagcaatcaatctaagggagctaggagcgctcccctcgggtcccgaggcctggactccgacgggcatcgggggcctgtcaggcgcgtccgtctcccctaaggggtcgggtcgcgccaacggctaggcaagcctttcttcaaaagcgcccggtggggtctgggctcgcgaggaagcgagtcgtgagagttcgtcggcaaccgtgttatcccgtctgggcacgtgccgaagctctatcccgtcaaaatggtgctccatacgccgtacttggcgcacgtaagcgtccatctgcgggtcagagcaccggtactccttacagacctggttaacgaccagctgggagtcgcctaacaccaggaggcggcagatccccagtccagctgccaccctgagtcccgcaaggagtccttcgtactctgccatattattggtcgcccgaaagtcaaggcgaaccaaatatctgaggacgtctccgctcggcgaggtcaacgtgacccccgcactagcgccctgaagagacagggagccgtcgaactgcatcacccagtgggcggtgtgaggcagctgtgaggggcccgagctggcctcggggactgagacgggctcgggagctggggtccactctgccacaaaatcggcgagggcctggctcttgatagcgtggcgtggttcaaagtgcaaatcgaactcagaaagttcgattgcccatttcaccacccgtctagtaccctctcgattatgcaagatttggccgagggggtaagacgtaaccaccatgacccgatgcgcctggaaataatggcgcagtttcctcgaggccatcagaatagcgtaaagcatcttctgggcctgagggtatcgggtcttggcgtcccggagggcctcactaacaaagtagacaggccgctgcacctttcggtggggccgatccccttcgctaggggccacatccctggggcgctcttcgtccaagcggcctcgcgaggcgcgctcgtcttctgtgccgacgacctcggggtcagaggacgacaggggcggccttcccacagtggccccggggccgtcctgggggtcggaggctcctggcgtcgtcggacaagcgggcaaagggccaactccggtcgtcaggggccttaggccaccgttcggctcgggggtctcttctccctgctctctcccgagtcgagcgggcacaggattagcctcggggtcagagggtgataggtgcggccttcccgcagtggccctcaggccatcctggggttcgggggcacctggcaccatctgacaagcgggcagagggccaactccggtcgtcgggggccttgggccgccgttcggctcgggggcctctcctccctgctctctcccgggccaagccagcacagggtggggatgcgcgaatgaggattatcctcatcgcgctccacaaccaacgctgcactaaccacttgcggggtcgccgctaagtaaagtagcaagggttcatctggctccggggcgaccagaaccgggggagagctgagatacgccttcaactgggcgagggcatgttcagcttcctccgtccaggtaaacggtccggagcgtttgaggagcttaaataagggtagcgccttctctcccagccttgatataaaccgacttagggcggccatgcaaccggtgacgcattgcacatccctaagcttgctggggggcgcatgcgctctatagctcgtatcttctcgggattggcctcgatgcctcgggcagagactaaaaacccgagaagcttgcccgcaggtacaccgaacacgcacttatcggggttcagttttatgcgggcggagcggagactctcaaaagtttccgctagatctgagagtaaggtctcttggttgcgcgtctttacaaccaagtcatcgacataagcctcaacattacgtcctatttggctacccaaagaaattcgagtagtacgttgaaaagtaggacctgcattctttaacccgaagggcattgtcgtataacaataagttcctatgggggtaatgaacgcagttttttcctcatcctccctagccatgcgaatctgttggtaaccagagtatgcatctagaaaacacaaaaggtcgcaccccgctgtggagtcgacaatctgatctatgcgaggcagggggtaaggatccttaggacatgccttgttaaggtcggtgtagtcgatgcacatccgaagcttgccgttcgccttgggaacgaccaccgggttcgccagccactccggatggatgacctcgcggatgaatccggcctccagaagtcgcgccacctcctcgcggatgaaggcttgacgttccggggcctggcgccgcactttctgccggaccggccttacgcccggccgcacggcgagacggtgctcaatcacctccctggggaccccgggcatatccgccggcctccatgcgaagacgtcagcgtttgcccgcaggaaagagacgagcgcgtcttcctatttgccgtccagaagaccaccgatccgtgtggtcttggacgggccgtcgcccagggcaatctccttgaccgggacctcgtcgcatgtgactatccgctgcctcggggcggcgggggcggatgtgccaagcctctcgtcgccaccctcgggcttggacgcgacggcgaggcggtccgcgcgctgctccatacaagcaagcgcgactttgaggtcgccatggacagagatggggccatcggggcccggcatcttcatctggaggtaggcgtagtggaccgccgccatgaactttaccaacgcgggcctccccaagaccgcgttgtagggcagactgaggtccgccacatcaaagttcacctgctccgtgcggaagttggcgggtccaccgaaggtgaccgggaggtcgatatgacctagcggccaagtgtgccccggcgtcacaccgataatcggctgggacggccggagcaccatccccggggccttgatggcgtcaaaggctgcgggggaaaggatgttgagggctgctcctccatcaatgaggacacgccccagcttcacgttgcaaacagtgggggaaaccaccattgcgatctgtcctccccgggcaacgcacggtgggtggtcggtctggtcgaaggtgagggcaacctccgaccaccgcgcccggcgcgtcgcctcatgagtaggggccgcggccagaagctctcgcttcatggccttgaggctccggcgagaaacgtgagcacactctcccccatcgacagtggcaatggtggccccaggctcttggaaacctaggtcatcatcgccgtcatcgatgtcctcggcgggggccttctgcttggcctcacttcgccgattgctggaaggaaccgccggggacttgccctctcggcgctcctgcctcctctcctcctcccacttcctcgtccgctcagccaaacttttgactgcacggcagtccgcgaggtcgtgaagggaagtgttgtggacgatgcaccacttgtcggttgggcgctccctactaggagcgccggcctccttctttttgtcgcccgcaggcctcccctttcgagtggcccgcgaagcgtcctcgacagcgaggacatgaccctcgtcgtcggtgtgggctgacctcttcttcctcctcctgtcacgccgccctgtctgagcggcggatccgggggcggccgaagctgccacaccggaaccggaggggttccaggtccatgcctcctccttacgagccactcggtccgcgagctgaaaaagctccgcggtagtctggggctctttggaggcgatcttttcgagcatgcgattgtgccgcacaccccccctgaacgcgtaaatcaccgtgtgtgcagggatgcatggtatggtgttgcggacttgacagaaccgctgaatgtacgagtgaagtgactcatcatcccttcgctgtactgcgtgcaagtccgcttcctcacctgggcgcggatatgtgccttgaaagttcatggtgaactgttggcacaaatcctcccaagagtggacagacgcgggtggcaagttcattagccaaccccgcgcctgtcctttcagggccatgggaaagaaattcgccatgaccctgtcgtcacccccggcggcctcgatcccggtcgtgtagacctggagaaactcggcggggttgacgctcccgtcatatttttcggcgatggtgggccggaaccttgggggccaacggacgttccgaaggctcgccacaaaggctctacagccgacaccaccaaccgggggcacggagggctgatccccgcgtctgtggtgaggtgacactccggacgaggaggcgccctccgttgcgtggggagcacgtcggccattacgccggcgctcgatactgatgcgggcatccggtcccccacgcagatcttcccgggtcagaggcgttgacgaaggagtggcggccgaatggcgaacagcggctgccgctcgccgcgccctccgtcttgacgacgcggagccggtggtagcagcaccagaggccttggtggcggaggaccgcccaccagcatccaggcgctgccgtgcagtcatgaccaatttggccacatcgtccagccaacgttgggctggagactccgggtcatgggcgacgggcgggtgacgtaggagcgcgcccgcagcttggagcgcgccctggggcgtgctgccgtcgccgtagacgaggaggcgacgctccccatctcgccgcccttctccacctcctgtggatgtcgaagtcgcggatccttcggccctctcgagcgccttctcccgcctaggactttggcgtggagggggcggtggagtacgagctcgacggcgtgggtttagctccccgtcgtcaccgctcatactcggggagaggtcgtgcgcctttgcttgctcggccattgggctgaacaggaaaagcttggcgaacacgaaagagtgcgagagctcagaagatcactcacagagccccctacctggcgcgccagatgacggagcgtggggctcctcaccgggagaccgcgcaggcccccctttgccagttcggccgggggccctgggtgaggttctaagctcccaatctgtggaaggttcgcgagagcggaaa

SEQ ID NO: 45034 - DNA, 2362 bp, Oryza sativa
ccccccccccccccccccccgtgggtgccaggccacgtgggcgattgtgtctgcctcaagcctctagtcacgatactcccggtcccatgtcatcgacaagaaccatgccattataattttacaaagtttaagatatgtcatcggtatctcaatgacataaagaactcacatgagtcaatgacatgtgggtcaaaatggcatatcttaaattttatataatggcatggttccaattttcactttctctctctttctcatcacttagtagtatatagtatcctaatttaacatgtacttcatcggataagactctgactacttgctgagagggtaatctttgctttgaaacgctttacacctcctagaaaaccactaaataatactcgcgcgctgtaatgcgccggaagctaatcgcatgccataatattgtcaattgtcactaataatagggcaatactatcttcatttgcatcatgccgttaaagtgatcccgtcactgatggatggctgcggtcgctgtactgcagctacccatcgtagactggccggtgacgcacacgcggccatcgccgccgtgtacgtggtgtcgaaacatgaattcggcaataataaaagggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatataggatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacagtagcccctgagaccttcgcagtcgaaaagataatcttctctcgaaccagattactccaaagccgagtgcttcaatcatctttgtcatggtctcccgagtacttttaccaaatctgaagactgtggagggctggaaaataaagtcaggtgcaccgactagatgcacctaataggtgcagcccccgacaatgtggttaattgaacaaaccaagcatatagtcaaggaataaataatccaaccaaccgagtggttttgataatcgtaatcaaccaagtgacttgatatcaatatatagcatatgcggtgtgaatcctccaaataacatgatccgagtgatataccaactgctttgtaaaatatgatgagtgatatagcaaaatagctataaagaagcttgtatattgtgaataaagaaatttccaaagtattgggcatacgccatgcgcacactgctttaacagatgtgcttaagtccctagaagacacatggtttcaccacacctggaaatatatggcatatgtggtgtaaaatccgagtaaataaactcataaaggatttaccaaccgcctagaaaatggccacaacatataatcagcctaagccataatattggtcaataaaaatgcacacttacgtggcgaaaagcaatgatattgtatccaatcaaatgcttaaaaacccaaacagcaccttgacttatatataaaaaagtcagcgggacagctatataaagctttactatttgacaccttttaagatgcattgtaccaactcctaaaaagttaagtaactgcggtataaaaggattttaaggtattgggcacttgatcacgcgcactttggcctaagcaaaaagtgcctaagtccctaaaagaacgtgacaggccacacctgaaaatatgggctgcagacatattaggcctaggccaaaacatatgccttcgacgccctttaaaggatgacgcatataacatgctcccgagtaataaatcttccgggtaatatagaccaagcgtagctcatatgaatagcttctgatctgagtggttatcccttatgggatactctaaaatagatgtaacaattgaatcccgactggcgcaagtattcaattgataacccttacggggaataataaatagtccagtctttgagcatataaaatagacccatgatcatgaattcatgttgcatgtatccggagcaagtccaaattgaagatataatacttgtatttaagctagtaagcccctgagcacgtagtcacaattgttcattgatggtagctgacgcagttggcatagagacaagacaaccaatatagagagaatattgcccaccagagg

SEQ ID NO: 45035 - DNA, 1676 bp, Oryza sativa
taggtcaaccgtgaaggtgaaataataagtcggcgaaaacataatcatccattagcaacagcggagatgtcagggtcgatgaagcagaggtgctggtgatgatgtcagtgataataatccatcaaattaatgttatagctgttgtagatgctttacttggaggagagttgatgttgttgcccaactcgtctaaaccgaaatatttgaagttgttgaagtagaatgtctgctccgaagcaaagatgaagataatgactcctggagttgactcgttggctgattaattgatttcttcagcttgacataaaatttgtcaaattttgagccttgtagttgtgtagtccccgactctttgattagttgggaaacaactgaacatagagtcgagaactgtagcctcttgtcgtcgaatagttattgcttgattgaagatatgtgttgaagatgtccaagtagaaatcatgaatgttggagagcctcttgttgtagtaaaataacatggcatcgcatgccgagatgtcgaggctcataaagacgtcgtggttggtgaagtagcaaaacttgcgaagtagcagcaatagagtttgccagtgccgaagataataaagatgaagttgctctaccatgatgacaaagttgcattgccgtgatgaagtgaacacgagtcgtcggcaacagaagcaaactggtagtgaagacgcgcagttgtgaaaataaaagcactagtcggcgacaacataaccagtcggcgacggaagacgatgatgttcatcagtagtgatagctgtataaaccagatgtagaaacgagggtactagtcagcagcagacgagacgaccggcgatgaagatggtaaggccaatcaacactggcagaatcatgcagccatggaagtgaagaaaacagtcggtagccatggcaaacgtaggcagcttgtgttgaagatactgatgcctattagtagcgacagcgatgtagccagccgtgaagaagatagcatcagttggcgttataacaggccagccgtgcaagcggtgacaccagtcagcggcggatgcggcggccggtcggtgaagacgtagacgcccaacaacggcagcataataggccagccgtgcaggcggaaacaccagtcagcggcggtcgaggtggccggtcggtgaagacgtagacgcccaacaacggcggcataaaggccagccgtgcaggcggaaacaccagtcggcagcggcgaaggcaagccggtcggtgaagacgtagacgcccaacaacggcggcataaaggccagccgtgcaggcggaaacaccagtcggcggcggcgaaggcaagccggtcggtgaagacgtagacacccaacaacggcggcataataagtcagccgtgcaggcggaagcaccagtcggcggcggacgaggcggccggtcggtgaagacgtagacgcccaacaacggcggcataaaggccagccgtgcaggcggaaacaccagtcggcagcggcgaaggcaagccggtcggtgaagacgtatacgcccaacaacggcggcatataggccagccgtgcaggcggaaacaccagtcggcggtggcaaaggcaagccggtcggtgaagacgtatacacccaacaacggcggcataataagtcaaccgtgcaggcggaagcaccaatcggcggcg

SEQ ID NO: 45036 - DNA, 8887 bp, Oryza sativa
  unsure (1)..(8887): unsure at all n locations
tcggcagcggcgaaggcaagccggtcggtgaagacgtagacgcccaacaacggcggcataaaggccagccgtgcaggcggaaacaccagtgggcagcggacgaggcggccggtcggtgaagacgtagacgcccaacaacggcagcataaaggccagccgtgcaggcggaaacaccagtcggcagcggacgaggcggccggtcggtgaagacgtagacgcccaacaacggcagcataaaggccagccgtgcaggcggaaacaccagtcggcggcggtcgaggcggccggtcggtgaagacgtagacgcccaacaacggcggcataaaggccagccgtgcaggcggaaacaccagtcggcagtggacgaggcggccggtcggtgaagacgtagacgcccaacaacggcagcataataggccagccgtgcaggcggaaacaccagtcggcggcggtcgaggcgagccggtggtgacgttctgactgatccattcctggagcgtaagagataagcttaaagccatgaatcccttttatgcatatctggatctggatcctttgtaatattccccttggtgatggcagaagtggccaatgtgggaacaaagtcgtccatcaataacaatgaagacaccagtcggcggcgacgaaggcggtcgacggtgaaagcgaagatgcccactaatggcggcataataggtcagccgtgtaagcggaaacaccagtcgacggcaacgaaggtgagccaacggtgaggacgtagacgtccaacaacggcggcataataggtcagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgtcggcataataggccagccgtgtaggcggaggcaccaatcggcggcgacggaggcaggccggcggtgaagtcgtagacgcccaacagcggcggcataataggcatgccgtgtaggcggaggcaccaatcggcggcgacggaggcaggccggcggtgaagatgacgatgcccatcaacggtggtgtgaccaaccgaccgtataggcggggacaccagtcggcggcgacggaggcaggccggcggtgaagtcgtagacgcccaacagcggcggcataataggctagccgtgtaggcagaaacaccagtcggcggcggcgaaggccagccggtcggcgaagacgtggacgcccatgaacggtggtatgaccaaccaaccgtataggcgaggacaccactcggcggcgacggaggcaggccggtggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcgacggcataataggccagccgtgtaggcggaggcaccactcggcggcgacggaggcaggccggcggtgaagtcgtagacgcccaacagcggcggcataatagaccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccaatcggcggcgacggaggctggccggcggtgaagatgacgatgcccatcaacggtggtgtgaccaaccgaccgtataggcggggacaccagtcggcggcgacggaggcaggccggnnnnnnnnnnnnnnnnnnnnnnngcaacggcagcggcgcacaccaaccgtggaggcgatgaaaccaatcggcagcgacgaaggcggccggcggtacatgtataaaataatagatcaaataataattagtgatctgtgaattaattctaatttatataagaaaatttagaacgataaacctggtttgtgatccaactttgattcgaggcctgtcaatggatgaaccgtagcatgcagccgtgtcatgcagccgtgtagacatgtaatcgtcggtagcacatgcacggattagtttggagaccactttgtgcatgtaatagctgatttgtgtatggattaatttccttgaccacagatttgaccaggtatatttaatttgtatcctggactttgtgtcttgccgtacgtatccgagtagtattgacttggtgatgtacaggctcaaccaacggtgatcttcgcatgattttggcggcggctgcttgctgattgcttcaaatcatgccctggtgacgaaaccgacggaccaacagatatggcagcattgtagcgacggatttgatctcactgacggaggtaaaattgacggtaacaagctggttgtagatcgattcgatcggtgattaatctcctggttgattgaccagatccagatagaatttttggcgacgaagaccctgcccttttgttgagaggatcacggccaaagacaagagtagcaccgatgatgccagcacaaagttccatcgcacttctcgacggaaaactcgacgcagcccctacctggcgcgccaactgtcgaaacatgaattcggcaataataaaaggggtagcgcacgagacctaaaagtggatggatgcggagacaaaggatttagacaggttcaggccctctcaatgagaggtaataccctactcctgtttggggatttgaatccgccgagtgtgtattaatctgacgatcaggttgtctcatgccccctagagggcttcctgcccaccttatgatggggggcaggattacaagatagaaaccttaaccaacacggtatcggtctactttacaatcttatcaaaccaggactttaggctgttccgtaatatataaggaaacgtaatacccgagtcatgatctattacatattccatagatataagttatcccctatgactagtcggataaccatgccgtatgggtatggggtacccataatatccacacgtggcgagacaccatttccgggcgcccgagcgaggcgtcaacgatggccaactgccggcgagcgcgaggcggcggtcggacgaatctcgtgttcctttcgctccgtggtggcgcgtcctaccgcggtactcgctacctcccaaaatataatgattttaaactataataaggtctctaaaatataaaatattagtttgactaccaatatctgtaaaactagtattgtaaaactagtattttaaggtaaaaaaattacatattataatagtttgtttaatgataaatctaataccatcaattttacatgattgatcttttttaaatttttttactattaataattaaagtttaaattttttgactttttttgcggtggttaaattttttgacttgctactctgctacaaaataattagtatattttaagacggaggtgtacttgatacgtaccacgacaccggggcagttggtcccccaatcacggccgtttgcttacccgataaggaaaaagagttgggaggagacacaactcgcccatgcactgcacagagagcggctggttggtcaccacggtagcgtacacgaacacggtcgatcgggagacgacagacgagacgccatgcatgttcgcggccgctcgccggccggtgttagcggtggccggtgaccgggtgtctgaaatcctatccgatctccttgggaaccggagccccatgcgcgaacatgagcatcacaacgtctgaacatgacgggaacgtggctggggtccgtcccttcccttcgcagcccgaaatgcgcaacgtgctgcagatcagtggttgattactccatgcttgtttatgtgcaccaccggggaccagtgagtagatcacgtgttaatcggccgcacacactgacgggatagtgccgtactagaatcatcggcactggtgtacgaagcgctactgtagtagttgccgcttttcaccgatggataccagggaaatccaacgtgcaatctgccgcgaggtttaccgggcggcgggcggcgaggtcggcaaattttgcccgagacgcgggcagtcggcagtgtggccaactccgcgtgaatttcttttgcccactcgggggaggtttgcttccgcgatttcgcctccgatcctgcagttgcttggcttgagcggccacttctccgctccgcttgctgctgtggcctgtggcatgtccgcgctgtatgtgcagcgtcagcgcggctcgcgcaacacgcgtctgttgcgtactatctccccaccttgttggttgatggccacatctcacgccttccagtctcgccggtgtcctggtgtgccctgctgacccaatgaacgcacagtagcatcgttttgctcatcgaagagccgaagatatgtccaggcagctacagattgtctatttgtctactttttcttttgaaagagaattactaaatgtcaattaaaaaaaatctatctttgcctgtgagcattgctagtggccggtgtctactagctagccaagagccaaaaatgggtgatccaatagctgtaggacactgcgccgaccggagcccatctcccacagattccagtcgattcctcttatcgtctcctattatttttttcccacgagaattcagatggtatcgacaatatcctagagtaggctccgtcctcgtgcaccaattattcatgcacgcaataataatttgaatagtgcaactatgattaattggaaggattagcttgttgccctacgcaacgcacaaccccaaacccaactgacggggttaatatctatcaccagcacgactaatgacatgtcaattaaactttgattatccgagtcatcatcgaatggctttcttatctcgcaactcgcacattgctttttcagtgacccaaagggagctctcacaaagtcccaaaaggaaagcatttgactctgagttagtgcgagccacgttttgccatttttctgattgcaagatgctttcccttcctgactgacccaggagagcttcaccgattgctaagcaacaaccctgtagcttcgtcttatggattttctttttctgtaatcacatgggggtatggacttgtagctggtgaagtagataagctgcttaccagataagatacttcacgagaaaacagtattatattaaaacagatactttcacgagaacatgaaggcaattgtgactgactggctatatatactccaggatgaacccattatactatccctccatctcaaacaatagagcgtatttttgttttgttaggacagggaatactctattatgatataattctcacaaaattaatatgctttgcacgactgatcattgttttacatggcattgatccacaggtaaagtatgtatgaagaaaagaagctatgtatcaacagctcattcatgtttctgtgcccactgagatcaccacctcaccgtcagtcccatgatcccatcctgaaacttggacaggcttaacaacagtcagtcagcagaaggcagtgacgtgaagccgtcaactgggcaagagaaaaatcaccatctagatcatggcgtccaagcaaggtagaccgcagacatctctcttcaaaactgatgccccgcacattcctggcggctacacactgaggagaacatcaccctcgtcgaccatgttcatatgcaaagagctcctagatctggtgcaactttagaatcgtgatcccggatggctggtgtttcatcttgttctttcttcttttgcttcttccccttctggcctttcccttggccacctttggtcctgatagtaaagcacattaagcagatagtattagtacataacacttccagcattgtgttaaacatgcaatgcaactaacctccctagtgaaaaaggaaatagtaatcaggtcggtgactttaaggcatatgggataagtgcatattttgcagcaatactgttaaggtttcataggccagatacaacagcagcaatgcactatgcaaatacgctggaaatattgatttcaccccccaaaaattccatttgaaagaatgcttacaatgcgaacagcaggacataagttcagttgtagaatagaatatggtaaaagacaaacaaaaggacagaaacattataaaggggattagctatatttaagacaccacattttccaccaaaaaacaaaaaaaaattaaaaccaaatctcaatacttacaccatattttttgcagcacacactatataagagaattaggatgaaaacaattaattacctacttgaaagaggagatagtagagcgaaacatacttacataggagtataaaagaatggtagcaatccgaatgggaaaaaaatgactgaaatcaagtcaaaaatgtggcgccatatttttagcaaaaccattataaagccatactttggaggttctctcgatggtgcagttgtttttggaggttctctcgatgctacagttgtggctaaattacaagaaggcttgtgcttcctagcagatccacaagagcattccttggtttttgactttccctgtgcaaaagaataaagggataattcctatttattccttccaacatagtattttaacaaggcaattcaatgtttggaaactattaagagtcgtccacatgatagttacctttttagaatgtgaactgttgtgtttctgagctgtttcgcctttgctagaacagtccttttcttctttcttgtgttcatccagttgactctcatcctgcttcatgctaagctcatcctctatggtctgtacatactctgctgatccaggtaatatacacaataaaggaaatgagttcagtgcatggccaatgtaaaacaaatattacttgaacaggtatgagaaattggatattaattgaaacagttaatgccctcagtttacaaaatgaactacttgtgcttctaaaatagtggtctccaacaataaccagccaaacaaaaatgttacctcctacagggtggttagatagcacactaactcttagtacagatatacctcctacagggtatgatattgacctttggcaattgcagaggaactgaacatggaaaacacccagcacagcaactggtatgggctgtttggtgggagcttaaaattctgagaaacagctagttggtaaccggcatctagttcattttctggattctatagctaagaatctggattgtttgagagagctgaaaattctgggagaagctgcagtagctagaagctctccaacaaggccgtagtcttacttgagctttctataacaccgttcatgcttcttggtactgttatcatattttgatgatcttaaaaataaccagtaaatggtaaatatcatattagtgaggcataaacccaaaatgccatgagcacaacacccagtataggttttacctactagatttatgctactgaattgaggggtgtgcatgaaacgcttgctcaggtgaggcagctcatgtttggcaagaatatgaataggattaaacaatgaaaactcaatctatggaatcccagaagtactccaaatttcaccataaatttcattaattgtcataagctgaagtcctcaagaaagataaggatgagattcattcatagggacagccactttagacttcagaataatcaaatgtttaccatcacatgcatagtccagataaggatctccatccgcatcatcagaacccagtattagttgctcagctaacatgtactctatagcagcatcaatgtcaccatccatgtctttcaaaacctatgtgatgtggcattgaccattaatatataatgactgattggctgctacggtcagcctaggctcgcagttgcaatacaagaaagtcgatttgttgtataattcatacctgttcaactgcagcgatattagaacatccagttccagccatcaccaatttaaccgatatatgatcatactttgatctgtctgaagatttcttcaggtcctttgcttttgtttgagcattattgcttgtgctagctacattggcatctgcctgtaatttcataacggataaaattaagattagtaacagagcaagttgagctacaacaggatctcactgtccttccagggacacaaaacaaccaacagtttacaatttggacagtgagaaaccttgataataactggcattgcaggaccttgacatggatcttccctcagtctgacactattgtagtgctcaccctgatgatacgatctatattggaatcaaaacaaaggaacatgagaatgtatgtccttttactgccagtattagcatattagtttaaaacagcagaacacacattaacttacaaatgaatcatactggtagcttcacgatcagaaaagtttcttatgtaccatcgtggtgagttaagctgcaaatcattcagtaatggtacaggcatcaatcaaatgttacagtacgttctcttctatagaagaaaggctataatatgaaaatgagtacgaaaaataacagagaaccatcaggggatatataagcagcacattgatctatatcacccatgtgtttcaaaatacagact

SEQ ID NO: 45037 - DNA, 13574 bp, Oryza sativa
ccaatgcttgcttgcagcatgtcttttagataaaagaacaacccagcctggcagcctgtactctacgcccagatcagatgtacacagccaaagtttgcagcatgtgcaataccttattgattcaatggcaccctaattacagttcttaagtcacagtgttacaagatgtttcttggtcatagccaaagcttgcagtatttctaataccttattgattcaatggcaccctaactacagttattaagtcacagtgttacaagatgtttgttttggtcatctcatctgatgcataccttaatgtattgcacaatcattgcacggtacttcatgtgctcttcctcgttgccttcgagctggtcgcccattgccctgcagactacgatgagtaaccatataacacaagactgcataatgcatatactattcctcctttcataaactaacagtactctaacatatcgtacaacatcgattagcctcttcttgtaaaaagtggcaagaatttgagtaatggaatcgaaaagaagacctaaagaagcagttgccatccgcactaacttcgataatcttcaaccccagcgagtccagctgcgcccggaactccgtcatgtcggccttcttcgcgaacttcttctcctcctaacaaatcaatcaccaaaaggaaaaaaaaacgagaaaatatattagctaaagctcaattccccttccaccaaaaacgatccaatctccagctgactgaggcgcggggtattactgcatcacgcttcggcttccgggctttgggcgccgccacggctaccttcttcttgttccgagccattacgacacgtgcggtagtagtggagtctcgcctagatttccccgcggcggcggcggcggcgagggggaggggaggcggaatcgcagatagtatcaaatcgtactctaccagaagcccggagaagaaatcggatgggaaaaggaagaggagaagagaagagaagtcgtcaggtgatatttcgtgggccaaatgggccgggccgtaacacctcaatccccaatctgctacggcccgtgtgtgaacgtgacacgtcatcctatttagaatcgaataccgaacctgaacgtgacacgtcagatttaggagtagaaacgagtacactctacacgatacagatccaatacgagaccgacacgtcgtcagcgaccaagtaaaattcggtcacgaaccgtacgccaccaacctgtataaattcatcgaccgccaagcctctccagaacatagcacaagccaaccaaacaccgcacgatttcgtatccacacatacttctacgtgatttcgtttcgacgatctcgaggcgccgcggcgtgacgtgacgtcgacgacaaccatggcaggcggtggcggcaagtccgtagcggcggcgctggccatggcctgcttcctcctcatcctcgccgccttcgctcccccggcggcggcggcgccgccggacatcatgtcgatcatcaggtacaacgcggagcacggggtgcgggggctggagcggacggaggccgaggcgcgcgccgcgtacgacctgtggttggcgcggcaccggcgcggcggcggcggcggctcgcgcaacgggttcatcggcgagcacgagcgccggttccgcgtgttctgggacaacctcaagttcgtcgacgcccacaacgcccgcgccgacgagcgcggcgggttccgcctcgggatgaaccgcttcgccgacctcaccaacggcgagttccgcgccacctacctcggcaccacgcccgccggcagggggcgccgcgtcggggaggcgtaccgccacgacggcgtcgaggcgctgccggactccgtggactggagggacaagggcgccgtcgtcgcccccgtcaagaaccagggccagtgcggtagctgctgggcgttctcggcggtcgccgccgtggagggcatcaacaagatcgtcaccggcgagctggtgtcgctgtcggagcaggagctggtggagtgcgcgaggaacgggcagaacagcggctgcaacggtgggatcatggacgacgcgttcgccttcatcgcccggaacggcggcctcgacacggaggaggactacccgtacacggccatggacggcaagtgcaacctcgccaagaggagccgcaaggtggtgtccatcgacggcttcgaggacgtgcccgagaacgacgagctgtcgctccagaaggccgtggcgcaccagcccgtcagcgtcgccatcgacgccggcggccgcgagttccagctctacgactccggcgtgttcaccggccggtgcggcaccaacctggaccacggcgtggtggcggtggggtacggcacggacgccgccaccggcgccgcctactggacggtgcgcaactcgtgggggcccgactggggcgagaacggctacatccgcatggagcgcaacgtcaccgcgcgcaccggcaagtgcggcatcgccatgatggcgtcctacccgatcaagaaggggcccaacccgaagccgtcgccgccgtctccggcgccatcgccgccgcagcaatgcgaccggtacagcaagtgcccggcggggaccacctgctgctgcaactacgggatcaggaaccactgcatcgtgtggggatgctgccccgtcgagggcgccacctgctgcaaggatcactccacctgctgccccaaggagtatcccgtctgcaacgccaaggctcgcacttgctccaaggttttaaatttaaattttatgtttacttttaatttttagagttgattttagcgtttttataagtaatttctttttcatcattgacttttttttaagttgttaagaacatatgtaaaagttacattggccgctaatacgtgttatgtctgtgtgtgttatgtgctcacacgttgccatgttttttccttgacagagcaagaacagcccgtacaatatcaggactccggcggcgatggcacgaagtgttccggaacaacctgattcaatctcttttgtagttttgaatagggaagatctagtatagaagccttatctttgttactgttaccgagtcctttattattatcgctctttttttttcgcaagatgtataaagtcctaaacagttactgttactattactgaagttattatctatctttggatatgagttctcccaagtacagcatcacgtgttgttacagctctatcgtttgttttttagggtgtgtttagtttacgaaaaaaaaattggtatcacatcgaacgtttgatcgacgttgaaaggggttttcggatacgaatgaaaaaactaatttcataactcgcttggaaaccgcgagacgaatttattaagtctaattaatccgtcattagcacatgttggttactgtagcatttatgactaatcatggactaattaggctcaaaagattcgtctcacgatttccatgtaaactgtgcaattagttttttaatctatatttaacgcccgatgcatgtgtccaaagattcgatgtaatatttttagagaaaaaaattgggaactaaattattaataaacgttacagctgacaaatgggattgtagcttttgactgagttgacaggaacagcttcctccatatggagaaccctgtcctgaaatatcaggagaaccatctcgtatttggctcatcccaataatccttctttctataaaactaatacctattaaacacctaaaacttaacatcaaaatatactacctctgtttcaatttataagactttctagcattccccacattcatataataaatctatatatatatatatatatatatatatatagattctactcattaaacacgcaaaacttataacatataaacatatagtaattatatttacaattatttcattataaaactaaatatatacatgctaaaccatcatccttcaatcattttcataatatttcagttcaaatcatttcatcgtttcttcaatatctaacgtatatattctgcagcaaagcgcgagagatcatccagtgcatgttatgcttgtgctttgaacgatagtttcagcgcaactaattgcattggtactctgtttcatggtgtggaataaaactgccatgtttagtttccttcctattcccaattttccatcacatcatatcacatcaaaaaaaaacttttctacacatataaacttcaaactttttttctaaactctcaactttctttgaacttttattttttttcaggaactaaacacacccctgctagcatgagtttccaaaatataaatatcaggagaatcctatttccaacaaagatattacgtacactctaggagggttggacgagccctcctattttcggaaaaagatacagtagtacacagtaccgtggataggtgggacgaatcgcttccacaaaactacaaaagtgccccgtctcaacgagaaacccgcgcgcgccccgacaaaaattcgcggtggcctaccagcgatttcgcttcactgcagtccgtctaccgaatggccgcggcggcgcggcccgtcgacgtcgtccgccacttcccgtgctcctcctcggtcgccgcctcctcctccttgctgctgtcgcgctccaagtccaggctcgcgtctcctgcggcggcggcggcgagctccatgcggcgaaggcttgtgctcggcgtgggcgccgccgccgccccggccgtggcggcgctcgcggcctcggcgacgcccgcggcgctgcgggactgcgccgccacgctgctcatcaccgcgggcgcgtactccctggtgcgcgccttcgacgggctcacggcgcggcggctcatcgaacaggtgtcggatctcgtttttcctttttttttgtatttcttttttttttgaggtggagctgaagctttgatctccgccattcttcaaaaaatatcaattctttagctctgttgactgttatccggagagtaaaatatggtatatacaattcagtggatgtgatctgtatcttgaatttattttcaattgctgggaagatctgactggttcagatggactgctactgttcaaaaaatacagtagttaggatagataaaagagaagtctttctttattgatcaatcaaaggaaaatagattattcaagcataaaatttatacctttcttaattatatcttgttaacttctgattcttttcataattaatctcagaacctgagcagaaaaattgtgcatgtgctctccggagtcctgttcatgtcttcctggccactattcaggtctcccttgccactgcttcttccagcatcgaaatgttttctacaaccaaatcagactagagatcttaagaaaatcatgcccctttcgcagtaattcgacagaagcacggttcttcgcggcaattgtcccgttgctgaactgcataaggcttctgacctacgggctccgcctttccactgatgaagctctagtaaaatcggtgacccgtgaaggaaaaccagagttcgtgctatgatccttatttctgatactccttcattcaaaaatcaaaatagtattccttgacatgatctttggttgcttacagggaattgctgagaggtcctctgtactatgtcattgtgctgctggtcagtgttttggtcttctggcgccagtctcctattgggattgtttcgttgtcgatgatgagtggtggtgatggtaagatgttggatctcctgggaatttaggaaaatctgcagtttttttttgtaataccccagttcacttgatgaaatgaatgcttctgctaagtatatccaccttcttggttcttattttttcaggctttgctgacattgttgggagaaggtatggctccgcgaagctgccattcaatgagaacaagagctggataggaagcatctcaatgttcatttctggcttccttctatctgcactgtaggtttttgcttcagaatgcattgctggttcttttgcattgttactccttgttattgttaactcatggatcttttgcatcacaggatgctgttctacttctcttgccttggttacttcactgtctgctgggatctggcacttggtaaactggctcttgttgcattagcagctactgtagtggagtgtattcctgtcaatgatgttgtggatgacaatatctccgttcctttggccaccatgttggcagcctatctgttatttggctacagttcatgttgttgagactataaaatttctcccttttgcttttcatgtcctgaatttggtactgccaaacatcatagattggatctctttctgttgaatcaaaaggtattttgctcatgatcatgcatgcattttgggtgaacgctagccaaatcatttagaagcaacaaatataagggactacgtactgtctcaagcttctctctgagtaatatggaaaattgtctgccgaatgggcagattcatatatgaattctcatggcagtgaaccaacaaacctcacacatggagcaatgcggggaatcactccagacgaaatacaattgacaacaagagcataaacctactgttgaaatttctctcatatttgcactacaaacaatccataaattggcagggaatgctaactaactcctcccatgggggattgattgctaatactaacaatcatgtctcgcgagtcatgtacaatggcaccgaagagggatcgatgttccatcaggttttcgcttctctcgggtaaccgcttcttgaatcatcggcaacttctggtgaatctttttccagatgtggttcacagcaccatcttgtgcagcagaggccatcctacctgggtaaatactatcatactcaaatataggctggacgtgagccatgtttcttcggaattcatctttctgctgcctggggacatttcttaagtagtttgtgagccattttggtctcatagaattattgactgagacaaaaatggcgaattctgtgtaatctatcatcccttcaaagggcagctcaatctcatcgctgacaatgacaggtatgcacagactagcaacagcatcaaagagacgacatgaagttggggtgtcaccagctgggtgcaagcaaaactctgatgtccgcatcccttttattgattgttcacgtcctgtggcattaggataaccttcttccatgacaacatcaggctcattaaccatcaagtcccatagtttctcccgtaccaaaccaccctgaaagaaaatttcagaagttatagtaagataaagctgtatagagatgcacagtagtacagaacaacaatctcataagtcataaacaaagctggtttgtaaataaaagttctgttgagagcataatgcttcaaatggcaatagtttccttgtagatacataaataatagagtaaagtccatcaccagtccctaaacttgtaccgctgtgtcatcccggtccctaaactcgcaaatcgaccgttcaggtccttaaacttgttcgactgtatcatcccggtccctaaacttgcagatcactcgtttaggtcctccaacttgttcagttgtgtcacgccggtctctaaacaggacggtctaaaaactttatatcaaaaaataattcataactttttcatgtgaactctaataaagacaaactttatatcaaaattgtagcgctcgacgcgacctacaactttgtagttgaaaattttttgaattaaaactgtttagggtcccaaaatattgttgcatgtttatagattttgtaattttaaaattaaaattacattctgggacaaaaaatgacttaaaataaaaaaaaatatcaactacaaagttgtagatcgcgtcgagggctacaagtttgatataaagtttgtcttcattagagttcacatgaaaaagttatgaattatttttaaatataaagtctttaaaccgtcctatttgacccagatgatattcaaatccaagtttagggactgaggtgacacaactgaacaagttggaggacctatacgagtgatctacaagtttagggaccgggatgacacagtcgaacaagtttgagaacctgaacggtcgatttgcgagtttagggaccgggatgacacaacgatacaagtttagggaccggtgatggactttactctaaataatatcaaagagctgtggattcagactcaacaggttctaaaataaaattttaagatagcccatatcatactaacatgttcttttattccattttcatttccaattgcttagattcagatactacaaagaagataaatattgccatgcatacattaaatgcttattagtatgataaatggtacgaacccgatgcctgtgtttggctcccttgaagtacagaagagtggggcggtccttattctctgataagtgcattgtagggagcaaatgagtgtaaggtacaatgacatctttgagcaatgacacttgcgtatgctgtatcatatgagaaacattgctgcttgcagagtttgaatcaagtttgtaccatccgccaaaatcaaccaccaaaagaattgcaggagcaatctctttacggacatgccacatcgccacagggtctgtcaaagaatgcctcaatatttaacaaaacctgagcatacaaaagaataataagctactatgcagatcaattacaacgaaaacataaacagtatatcttgtattcctacattgcttgcaaaacagttgtgtcttttgctccgaaacactgaggattaccaatatccccttgatgacaaatgtacagaaagtcacatggttcaaaattgtttttctttaatgatggcatttcaagggtatgccactcccttacacaagaaaacatgtaaagcgtgcctaagaaaccaaaaccagctaccttgacccccctattccaagtatgcacataactaatttcaaatttatgagtgcattgtgaggttcctatcatggttaaatctacatgtcaatgtgctcactgttctgggcacactccctctgtttggaaaagggaacttggtaagtcttacactgaggcgccgagcaacaaatcacatgtatagccggtaactaacagaacacacaaaatgatttcaagcctaaatcagctcacagtttttagagttgagtagctaaaccctgtagatatcagtcagaaagtgggattgagtatggaggagaaaaaactagtttccaatcatatactagttgagagttgggattgagtatataatagacggacaacaagcataacttaacctatcgaatgcttaacatataacccacaccaattgggagcaatggagggttaatatgatcaacagcccgttccattatgccattttgatcacttaagttcactcaggaaaaaataaaaagcacatttccaatttccaactgaatcacagtacctgtcaagacgaagacgtggtcacggccaccggagcgccgccacgctgggtgggcggtgacgcggtcgacgacctcccgctggcggcggtagtcctcgttcccctccttcctgcggaacgcgcccttggcgccccacccgagctccatctccgcggacagcgtcgcgaagaaggggacgaacaccacatccgcgtccctccagtccgcgaccaccctgacggcgggcgcggacgacgagcccggctggagggaggcgaggagccagtactcggcgctgtactgcttaatcagtgggctatccgggtacggcgagtgcgcgcgcggaggccgcggcggcgggtggtcggggtcggaggaggccgggatgcgggagtcggcggcggggagcgaccagtagaggtcgaggaggccgtggttgagcgcgcgggggagctccgcaacgtagaccctgaggaggcggcggcggtcggggccggacgccgcttgctgccgcgagaaggggagcggcggggaggcggggcgcaggaggaggaaggagagggagaggaggagcgcgacggggacggcgaggagcgcgaggcgcgccatggccgccttccagatctcgctctgcttgcttcggatgggaggaggaggaggagccgccatggccgcactgctgcttgtgcgatgcgttcgtgggcctgaaactagtatacttaactgggccgggcttttcactgtgtccgtggtccatttgccgcgaaaaaacaaaaaaaaatcctcgtcttctctctcgccggaaaccgcttaagccagcgccaccgtgtcccatgcgctgcaccggccaccgaatcaatttttgtttatctttttaaccttttttattttaaaatttatttatatataagatctaaacattttaacaacgttatttgggttagcgtggcaagacaatactactacgtcgatctggctaatagtacgtctattatcttgacattgcagcagtgagaagggcacgagagaaatagaagtcgtcatcgacgtcgcctactcccttctgctgctcccgcttctcacctccgcagccatcctcctagtcctctccatcgtgaagccgcctgtggacaagagtggctgcggcggctggtctgccactttctctaacgacgcccaccttgcattcatgtccaccgccatgctccggctcaacttctttcctacctcaccccgctggtctcctccccctcctcctcgatctgccggcctgctcagacgaggagaagaggacagggtaatgacttggtcaccatgacatgcggagcctacgtgggtcctgtgctgactcagctgctttgttgaacaaaaccagggtcaatatcacctaaagaccaagaataattcggttctgtaagttgacaattttgtaattcgctgagggacctcagttgtactgtttactggaatctgaccaactggacaaacgacccattttatacttcctaggcccatatactacgtggcatggtccacgaactgatcgaatcacgaggcccacggcatgagcatttctgggctcgggatgggccctttcttcccttccaagccgtactccccccaacacttataccatctccaatcctatacttccccatcgcatcgcatcgcacattcgcactcgtctcgtcttactcaccccgcacgtttccacttcccctctcccccacctcaccaacactcctcgccgtcccaccaaaccctactaaccgccgcgcgcgagagggtcccatccccgacttcgccgccatggccggcgctcccccgacggaggcggagaaggagtccctcgtcacctccttcctcgagatcgccgccggccagacgcccgagacggccacccagttcctccaggtccgtcgtctcgttcctcccccctctagagtctagcttctgatcgattcgaagggtttgatgcgatcccgtctctcccagatgacgagctggcatctggaggaggcgttgcagctgttctacatcgacggcgaggccgcccttgcggcgcatccggccccatcgccggctgctgcggcggaagcggcggcggcggcggtggcagcagctgctgaggtggaggacgcgatgaggtaggtcataggtggatcggcgcgagatttctcgggtttgggctttggtttttgggtccttgagttttctgttggtttgtgtacgcttaccgtgtgctgtgatgggcaggttcgctccgcccccagctgctgcactgggtgatggaatgctgcagggacttggggaggaagaggatgtgcgggcaccgctgcccacaaagcgggagactctctacggcgatgcccccatggtcgtgtaagtctagtgcttggttagcaaactctttatgatagttgggttcctgggattgagttcctcagtataagtgttaagactttgtgtgagacaacttctagttcaatgcaatatctgtgctgcccctgtggtgattgtggtttatgtgatgtactgatacatgtaaatagccaaatagggtgtatcggtggcacaaaatcggtactagtaatgcctagaatcattggtttggttcaaagagaaattgggataggttacatggggcatgtgattgtctaaaaaaactcttatccgacaatgttaaggccatgctgtttaggggagctttaagtttttgatggcttcaaatcgaagcttaagtcctcataaaaggcatgtgtgtgtttggttggtgatgaatagatgtcactaacctatagtaattttgttctcgtccaatggaattagcatgtgttgttggtaatcattgttggcttgctgatgggatataaaccttttggcctaaattgcacctttggctatgttaatagctagcaccattttctagtaccactaatttgcagtcaagcctcctgccctctcttcccctgccaagtggactaacatctctttcatatagtttgcaaccaatgagattattggtatttggttggtcaccaacaaatttcgttcatggctacaagttagatatctttacttgtcaccaacagatatgatgacaatcactagctcgaactcaaccagaatttactgatcagaagaaacatctagtcatttcatttgctgccaattattttcaaaacaggagagattgttgcctcctgaaaaagataaagttaggaatgtttttattcggggtgttatccttctacccattaggacaacacaatgaccattaacatatcagtcacagctcttattttatcccttattctctatgataccgatggcatatctgggactgccccaatggcactgcaaattaagggggtatacttagatatatatacttaaatgcgctgtgccaagtatttattataattggggttgattttgctgatgtttagccatttctttggtagatgcaacatctcttgaatacatatgacattattactatggttctttgttatagtccacttttgttaaatctggaaggaatagcgctgagccacacctaatgacctaaagtgtgggaagtgatgcaatttttgttctactctttcttttggagatgataaggcccaaattttgttgtactcttttcttttgggccgacatgctttgttaggcttctatgtcttgctttgctaaaaccaaaattctaaaacaacagccttttactctaaagaaaattagaataggctagagatgaaactcaagttgagccacagtaaccaaagagaagtatagcactaatagaaccaaactttttgcatgattttcctggaacgtggactactaatttaaaatctatcattttctaaatttgaaacggttttatgacttcttttcagcgttcggcctaattcaacagttgcatttcgtaactttgaagaggagtcaaggcaatctgctgtttgggattctgagcagaatgctgcatctagttctcgtgataatctggcggcattgtatcgtccaccatttgctttgatgttcaatggacccttcgacaaggtcagctatcctttttttcttatttaacgtctggtgttacctttttatctctaacatgaccatgtgctgcctttgcctgcaaacttcaataacctgctttgtctgtgggcatttggtatgca

SEQ ID NO: 45038 - DNA, 7595 bp, Oryza sativa
cccactctttatcattctcaacaaataaacccaacttgctcgcgtacagtacatacagtacataggagtactgtagtgcaggccggagcaccagtacactgaactgctgcacccaattcatactagtactccttgtcaagctcatttaagttgatacgcacggtcaaaagctcatttgtacggatggctccggagcctctcgtttggcagctgagatgatcttttctcttttaatttttgggttaacataacacaaaagattaacctgaatatgccataaactttaccagtttggacccaggtaagtaggatataaagcatgagcctcacttgtcatcaacttttcaggtcacatttcctttggaaggttaatttacactttacacccccccattaccaccataattaacatgactcatcttttttgcagacgttggaagctatagctagcacaacaacatcaagaaattaagactcccatccatatatattgacgtcaatctacagatatagggatgtcgacagtcttggcaatgaagactatgatcacgtcgaagcaatttcagtgttactatcggtacagcgatcgaacaggcttgtacagctatggagaaagcgagagatcatcaagagggccaatccgaaattcttagaaagtacttatgcactaatccgatgcacagcacgagtacgaaactacgggcaaaatattcactcgatcagtagataggggcaaatgcatgcaacgtacactggtcgactagtaccattcttctttttttttttaaaaaaaaggtttttacccaacacatagaatgttttaacatatgcattgagtattaaacgtgaaaaaaaatcaattacatattttacgtgtaaattgcaagacaaatcttttaaacataattgcgctatgatttgataatgtggtgttacattaaacattttctaaatatggattcattaggcttaataaatttgtctcacagttttctggcaaaatctttaatttattttgttattagataatatatatttaatactttaaatgtgtttctgtattccacttgtgttttttcttacgacgagttaaaagattttttttcccctcctgcgacgtaacgtcaagtcatccatgtagtacgagtcaaacgtgttttccatgtctatgtcgcgtcttctttttttaatcggcgaaagaggacgaggacgccatggacatggcatgcagtggtcgacaagagcaaaaaaataaaaaaattaaaaaatctcgagttctttttttttctttttctttcacggttggattggtcacgtcacggtacgaccggcatgtcgcgcacactagggttgggttgatgtgacaagattgctccgtacgtacacacccccatccctttcctccttttttaaaaaatgaccccctgtttgtgcgctgtcacgtaggggacgttacgttgctgttgttggggatggtaaaaaccggccggactcgtggaatcaaaggctctaggacaggttgcccgtttggggtgtggatgatgatgatgatgatgacgacgacgacatgggttaaggaggcaaggttagctgtaatcaaacatatgtgtacgtaggaggacaagcatacaaggactgattatataagcatcacaagtggctcccagttaattaagtactactagtcgctaatccgcaggcagctctttaagtggaaaaaaaaagatagtacttgattagtcttgtcatgattatggtatttttgactaattgtgatttccaactcataaaatagaagcatcaagtacataattttttatacctataatatatgtctcttattaacatagaaagtaatgtctcgagatatttatgtactaactcgatggacccgttcctacttttaccatggcttttattagacagactgtaagcactatagtcagcgcatcgagaaagtatgtcccaagatacctaatgctcccctctctgttcaccggagctctacgtatataaaatattgcctacacctggttgaatatattctgttgagcgattaacattctatgtagtaggagtactccctccgtcccacataaaacccattcctatcatgctaaggtgagactagtgaagagtaaaaatgactaaaatacccttttattattgaaaaaaatagtaatgttgaaaggtaggtaaagggtttttaagggagaaaacttttcgttttatgtgccaaggttaggtaggatggtagaagttgattttttatgggacaaaatttaaactatagaagttgattttatttaggacgaagggaacatataacaaaattagcaccataagaccatattgttaacccaaataatgaaatcaatacttcatgataccggtagaatctggaggacgggactggacaaacacgtaggaggagcagtactagctgtaacacagacggggaggagttcacaaaccaacacgggctacaggttacaaggaacggtagtagtactccagtgatacaacagtggtgccccacgggaacaccagtctgcgctgcgtgcgatggagagctgcatatgccgggatggtggatggatctctctcatcaccattagagcatatataatagcagactattagccagatataaacatattttaataagataagtgatcgcgggctatagatatgtagccagctgcagcacgaacttcaagacacaatatatgtaatatgtgagaccatatattaataatatattaaataattattgtacgaattagctattaaattggttatagatgaattaaagctagtagtgaactatactattatactattaaacttgctcttacggccgtggttacaccgacccgacagccgcttacatgagcccataaaatacggctttttcaaaaccccctcgcttcccaactttttaaaaactcttcagacactgtgcgggagctcacgctactgtacggccccctgcgctgcgccccccctcgtcgcgcacacgcacacacgcactcgcactactcgaaccacgcgaacccctctctttctctctctctctctctctcgcttaaatgccacaaacctaatcatttccacccctcttgcgctctctctctctctctccaaccccaccctttctccccaccatggtggcgatctccgagctcgggtgagcggaagagaaaggttggttggtcccttgccggcggggtgggggttggattgattttgctttgctttgctctgtggtttgttgatgcttgttgttggtgttggtgttggtggtggtggtgcagaatgcggccgatttgaggagggggatggggttttcgggtggatttgtgaggggatagattaagagtttgtgcttctctggtttggtcggaggaggaggagatgagctcgtcgtcggcggccagcatcgggccgccgcagccgccgccgccccccgcgccgcccgaggaaggtgggtggctaggtttgtttccgccgcttcgcttcgcggttcgctttacttcccttctcgtttggttgatgactcgatctgctgctgctgctgctgctgcagagaagaagtgcctcaactcggagctatggcacgcctgcgccggcccgctcgtctgcctccccaccgtcggcacgcgcgtcgtctacttcccgcaaggccacagcgagcaggtgaggctgagctcacctcctcagccgtctcgtgggcgcgcttgctttgcttctctctctctatctctgctggtttctcttgtttctgacgcgggtgagctttgcatacgtgaaggtggcggcgtcgacgaacaaggaggtggagggtcacatcccgaactaccccaacctgccggcgcagctgatctgccagctccacgatgtcacaatgcatgtacgtggttccttgccctaatttctcggggcatttctcagatcgatgcggcgtcacctccactccactcctccggtttatctccatggctgtcggtgctgacttgggctggcaatttttttgcaggcggatgtggagactgacgaggtgtacgcgcagatgacgctccagccactgaacccagtaaggcgcctggggtttttgcatgatgtttgcagtgctgaggttttgatggtttgaaggcgtgaaatattctaagcggttaatttgatggtttttttggatgtgttcattcgtgcagcaggagcagaacgatgcgtaccttcccgcggagatggggataatgagcaagcagccgacgaattacttctgcaagacattgacggcgagcgacaccagcacgcacggggggttctccgtgccccgccgtgctgctgagcgcgtcttccctcctttggtgtgatgagtggtgtaatttggggctgtgctcctttcttgtacttcttgggtggttgggttttgctgttgccaataacaggtggtatagtgtggtttgtaggatttcacacagcagcctccagcccaggagctaattgcacgggatattcatgacatcgagtggaagttcaggcacatctttcgaggtaacttcttaaaaatctgtagagcttatggcagtcttgaattcttcataacggtgaattatgatattcttaaagggaatttcctaataatcatctctgccccttttccattcgataagttcaccctttgtaatcatggcttaaaaccttcctaataaaaacgttttcaagtgttctgagaaaaacttcaaccattctcacacaatgtgatgtaagcgtctttttcacttaaaaatcagttggtgtgaatggagcaagagatacttgattgaattagggttatgcatagaaatgaagttacgagatcattaattggataagcacataaaaaatatcaaattttaatatgttaggatagttagcagtggatcaagttacaattgacatatgaatacatgatactttcagaggcgtactgaaatatttactagagttcgcaggtcttacaaaattgcacaatgagcaatcactgtactggacagtataattctcggtgtaggcttctttttgtatgccttgaattcccatctttctgcagggttgaacttattgttagtgtgttttctgacacagaatgtactttgtattgatcacaataactaaaaaaatgttgtcttaacataaatgttgatagtacatatgcttgaggtacttgtgctgtattgattatgaaatgggatctgctcaacactaatgatgttgttagtaattgtgtttagtagttttatatttttgaacatgccatgttactatcttttgtagtaatatgctgtttttgacaggccaacccaaacgacacctgctaaccactggctggagcgtttttgtcagtgctaagagacttgttgctggagattctgtgcttttcatatggtttgttttccatctctcttgcatttgtgattttcttttttacctgtgctaatgagtagggcgcattgttgattctctgactcaggaacgagaaaaaccagcttttacttggaataagacgtgccagtcggccacagactgtgatgccttcctctgttctttcaagcgatagcatgcacataggtctccttgcagcagcagctcatgctgctgctacaaacagccgtttcactattttctacaacccccggtaagttggacttttaaattagtatatatgcattgttgtttttcctccccatgtacaccgttaatagaaagagtgtttgtagggcaagtccatcagaatttgtcataccactgtcaaaatacatcaaggctgtttttcacacccggatatcggttgggatgcggttcaggatgttgtttgagactgaggaatcaagcgttcgcaggtgacctagcaaatgtcaatgctcagtccttattctataatctaggccaaatatataaatgatggtactttttttagataatacttggttacctagcaccaggagatcctatacatgtttgtaggatgtatgtgactatgccagtggctgaaattgccattatctgtactttttatgctttcacgcgttgatgttcttgaaaaatctgcgcatctgtcaggacatcaccccattatttatgggaattttataattgggcctctataaaaatccataatatactaatgcgcccaatgcacactttaatgaaacacaggtatatggggactataactgaagttagtgatgcagacccagtccgttggcctagttcctattggagatctgtgaaggtaatttttatattacttgaggttgttctaaagagctgtgggggtttaaacgtgatttgtgttgtctttcctgattatcttcatcttctttagttgcattttcttatgatctgtacctctggttttcattataacaatcatggaactgccttcagatgttattgcactagtgcttgcttccacagttccactaactagtgtgatattttcaggttggttgggatgaatcaactgcaggggaaagaccaccaagagtttctttatgggaaattgaaccattgacaacctttccaatgtatccatctctgttcccactgagagttaagcatccttggtattcaggagttgcttccctgcatggtacgcttaagattcttgttactgtgtgtcaggcataaactagttttgaagctattttgctgtatgcttgctatgtgtgtgcgcctatcatgtggaagtttatttggtgcatttacatagtgttttagccatcacactcaaattactgaagccacagccttaataaatttctgaacctgccacatcaaccagctgatgattctaactaaaataacctgaagttgagattgtggtgcaagagcaagaggctatagttcaagtcagtgttctctactgtgaacaatatgcctcaaatgatggttctggatacagagattgatcagggaactttataaaatgctcatataggctaaaagtaaaacaagttatggtgtaagtgaaaagttgatctcttccttccatttcttaagcacccaaggtggatcaatgttatttgataaggctcttcctagcaaatgtaacgttctataatatgcattctttttattcattgtctttctgtgcattcttgttatggagaatgcattgatctgcctgacataattccattttctagtatctctcattcatatttctgttcttttattaactgctgtatcacacttaagatgacagcaatgctttaatgtggctgagaggagttgctggtgagggaggttttcagtctctgaactttcagtcacctggtattggctcctggggacaacagaggctccatccatccttactgagcagcgatcacgatcagtaccaagcagtagttgctgctgctgctgcttcccaatctggtggttacttaaaacagcaattcttgcaccttcagcaacctatgcagtcccctcaagaacactgcaacctcaacccattattgcagcaacaaattctgcagcaagcaagccagcaacagataattaatcctgatgcccaaaatatccaaacgatgttgagcccaagtgct

SEQ ID NO: 45039 - DNA, 6107 bp, Oryza sativa
gttcggtgcctaattgtgatctcaaacagaattcatgtgcattcagtcatacatctttaatgtgtattaatatgttaaatttttttactagactgttcttccttcaataatatgtgttggtcagtcactatatgttgatgctcagttacccaagacccttcgtgagagtaaacatcagacatgattcttcttgaaactgaccttcctcatatgatgtaggtcctttgtgaatagtgtatggtacatcaagatactttcacctgaggatgtgcataagatgggaaagcaaggaaatgatccacggtatctgtcctgaagtgagagaacatggtgccatttctggtaagatgtcataattatatttattgtaacgattaccaaatcccacactaatccttaaaaacctatgactggatagagatgttcttttctgagtaaatctgttatcatgttgtgtacttcgatagttgttgacatattggcatcatgtgttttttgtcccttattgaatgtaaaatggtctcattgtgcgggttgaagaatgtctgtttgctctaatttttattgctcggaataactcacatcttaattgacgactcaaatttaatttagagtctttttatgcatattcatctctgcatactaacatgtcctggtatactatcacagggcttccaggaggattctgcagtgcatggtggcactcttgctctcgacaatgcacgtcgtcagaagtcccaaatttgtatcttgcatgtacgccgtacatgtttccagaactctctgttacctattcggtgcaggccaccggaaccacgaaacctgatattttgtaggttccacttaggaatcagtatcggtttaactcttatcctagatgatttgtaactcgcacggcagtccactgttttcatgtttcatcgagtcttcctagacattaaacttagttgatattgtatcaggatttatgtgtattgagattcctctacatgctttcaaccaaaaaaaactgcgataatcgaagcgcacgaggattgtttcaattcgtgttgtaggatctggattttcaccgattgtccggttatgtcagtttcgagaggagctgtcaatctgaagttttttctgtagtgcctaatattttgcttttattattaatgctaatcatatactgttgtgatattttctgttgttgaatatccaaatctaaagaacagaattcccgatggttcactctacagaatacatagatcgacgaactggcaagagagtaagatttgaggcagagtgagcaaataccgttttgcgtgggctcgtttgtgtttgcctttctccttgcgccgcctgccaccgtcgtgtgcgccgagtttcttatccgggacgacggcgagggaatcaactggtggtggaggaagctgtaatttgtgggagctttcgcgtggagtgagatgggatccatgatccaacacaggctccatggcggcgtatgccgttataaaggattggaatgtacgatctgtcgcagttgttttcgcacctcctttctgacgaggaaacctggattgcccccgattgggattatgtgatattcccccgtgacacgagaatgtcatggggaatgtcaccgaatcccaatccgattgcccccccctccttatttttcctgaccacatagtactaaactgttcccgatcaaaaaaggagaaaaaaaagagggagcaatttctttttcaccaaagccgtttaaaaaactttttgatcccgacaaaatctgattaatttttatataaaaaaataaaaatctactttgaactttttttgaatttgattgttaaactaagcggtttatgtcctcgaaccagcccgagaaatcgagtttttgtcaccatccggttttcactagttttgtaaatcctagttctttggggcaattctatcagaagagtgatgtggctcgagcctctactattgatgcgaggattatggacaactcacataatctctacaattttttttttgccatacatagatggaaatggagctgctgttcctttgtctaatttcttagacatcctgctatttttttctggatacgtcattgctggccctgttatagttggagacaataacatcacattaggcaagggctaccataaaagatgtttgagaagtgtagataataaattcttttacaagggtgttgtgatgagttaacggatttgttcggtagacttttgctacagcgttttaagctgtgttgcacagcttagccgttcggctgcacaaacacatggcgcaggaagctgctgcttgctgctagatgcctggttgtagtgcaaccacagctaggccgtatgaacaaatccaataattgaacaagtgaattcaaatgtaaaacgtattccctagagagaaaaaaaggaaaatgtaaaatagagttgttctactagtagtggtgtactactcccctcttctcaaaataaatttatatttcactcattatgcacgtacgaacaaaaataaaaatagtataatatcccactttattaaatcctaatataattattgttgtttttatctattttcaatgtatttatgtcttactatacaaactttgatatgatgaataaataattaaataaaaaattattttgagttaaatagatggaaaaagtcactaacatcaccgagcagtgagtcaaagacatcacagaggtactcaaaccggagtagcactgtgctattcaacggtcaacctattgcatagacagagaggcgcaagcgcaacccaaatcggatttacagaaaaaccctcccgttgccgttgcctataataccgaccttttcccaattattttatctatttatttatttttttaaaaaaaacctgcggcgtccaccaacccaaccctttttccccaagtcgacacgcgcagccaagagaggcgaagggcgcaacgcaacgcgaacccctccttcccccgtcgcgcccaaccctaacccgcctcccctccacgtagatccaatcccgccgccaccgccgaaccctagcccgccccacctccctccccgccgccgccggaggcgcgcgcgcgcgcgatcggcgtcctcccgccgccgcgttcgtgcggggtggggttgggaggaggaggaggaggaggagggcccgacggcggctcctctcgagacgggggccatggaggcggacggtgccgcggctgcggcggcggcgggggaggcgagcacggaggccggcgcgaggcccctggcgccagaggaggaggcgctgcggcgcaacaccgactgcgtctacttcctcgcctcgcccctcacatgcaagaaggtgtgtgctcgttctctctcgacgattcgtcgtctcttttccctcgtatataagctggtttggtttttggggcggggtggtaattcgtcttttctcgattggagcttagaatttgaattccgcacctcgtttcgggaatcttgatttctgagctaagtaaacacgaatttctttggttcaagatggaatcttttcatatggctattccccctcatccaagatgtgatgcttaatgtagataacgtaataatataagttcgtagtgccttcaggttcggggtatttgttgcctcttggtgttagcccctgaatttttcagggtttctatgctaggtcaaattctgaatcggctctataatttaaaatttgaatggtatggttgtcctgaattgatgctccttcgggtgaaaagtgaaaacaatgtaatttactatcgcatttgttcccaatatatcgctattgcagtggctacatggcttttagtagtacggtaaggtaggaattgtaatgcttcccttgtcaccaggagcactataacaatatgttagtatccttattagtctagttattcaagatcattgcttcacaatttttttgtttctctttgggaatccttgctcggctcagaattccatttgcttttagcccctctattattttggaatacgtatgatgctgtactgatttagttctggagctgttctgatgaactatggttaaattagagagaggcaaaacgcttgccataaatcaaatctgtcacacaatctgatgtgttgtaactttgtaatcttgtttgataatactatcaaaattatgctacattaatgcaaatatgtgcaattctctatatataaacattaatgtaacactaaaaaaatgctacattaatccttatgggcttttgtgtcttatttaccatgaatattttgtccatcatggatttgttactaacttctagcttgaatattttaattgataatgattctttttgttccttacatcaggggaacgaatgtgattttcgtcacagtgataatgctcgtatgaaccctagagactgctggtactggttaaatagcaattgcttgaatccaaaatgtccgtttcgccatccggtatgtccctttccttcctttttccccttatgcactggtattatgtttttttatcaatacttgccagcaagcagcattgtctaagactagtaaatttgctgttatgtttctgttcatcagaaactaacagggtgtttgctcctagttattaagcttaatattatttggtcattttgtccagtgaagttatttggagtctaattctgtcttctacttttacccagccaattgatggtatgtttggtgctccaactactggaatgcctgcagtttcttcacactacgctccatttaactctggaaagcagttggttccatgctattactttaaaaagggaaactgcttgaaaggtgacagatgcgcattttatcatggaccacaatcagtgggaaataatccatcagaacaggtggtaaaagtttcttccttacctttggagcagcttcagactcaaaagaatgatttgttgggcattaaagattctgtgcagtctactaattccattcagcatggtgctccaataactaatgagaggggcaaaacagccgttgatcggtcaacggttaattctgccaggacagctacagttgcaataccggttgcttccaatgcaatgtcttgtcctaagtcagagaaggtaaaaagtagtacgccagcagcacttaaggaaagcttcactacttcttcaggtggggatcatcctgagtgctaccagaaccattttccaatggatagtgatcctgtgcgagattggaaccaaagttatgaaatgccccctgcagatgatctgccccagaacagtagggaggctgatgaacttttgggtgaatcttcaccaggttttgatgttctcgtggacaatgatgcagatggtgctgcttatttacatgatgaagattttggaggagatatgtatccagtggaagattatgaatatgctccagctgattttgatgttcgtgcacatcatgaaagagagcggttcaatggtatggatgagcaagaccagatgggacatatgtatgatggctacgagagaaaacggcgtagatcatctgagaggagcatggaacggcctttccactcagaaagaaggtttctgcaaagagatagagaccgtgtcgagatggatggatcggatttacgtcatcggctccgtaggagaagaataaatgagtcttcattggcaattagtccagaacgcaatggagagcaacggcggagggatgagcgctacagggaaagggcacatggtcaccgttcacacagggatcatcaccagagctctcgaggaagcactcttagctctcgtctgcaaggcagaataaagcttcctggaagatctcctgacagagttgatactcgctccgagaaagagcgagatagaagaagactccgggacaggctgtctccagttaggcgcacggaatttcagggtaccaggcatagggaggcaggacaacatgaagagcagacccagcggagatcaagtgaacttgctttaggttccaggaatgcagatggccagcatttgacaaaggatgtgcctgactcacacaacttccctcatcgcaaaaactcgagggactccagtaaggccaatggaagtgttgagcctgaagcatcgcttgattttgagggcccaaag

SEQ ID NO: 45040 - DNA, 11776 bp, Oryza sativa
tcgttgtgttgagcatatatctgatctatcctgaaacgttgtattgtattagtttcctaactaacagacaagatatttctttgataaattttttgcctgatatgggtaatataatcagccccattttggaggggttcttttcttcacgaaagagtaatgtgtgattgtacatatgtggttcctcagttttcctaagattcttaagatggcatcagcctctgaacgagggaaggaactattttatcaggtcaactaatttggccgtctgggactctgtaaaattttgctgcttcattcaaatataatcatcttataatcataacgaactattttatcaggttaacggagtgtgattctcaactcacgatcatctctatctctactaattgaaaatgtttttgctagtactttaatatatcatccgtgtatgagtcggtttttaagtttgtttgattttggaaatacacatccgttcagtcgggttttaaattcgtttgcttttaaaaatatcgaaggagtcatataagatatctctttaaaaatctcacatgctaacttgagatgatcaaactcctaattgcaactcatgattttctagaaaaatatatatccaagccgcgaattcctagagtgaatatcatcttaactaataaatcgtataacaacaataaattaaagagtaacgtgtacgaacattccttaaacttgtaggggtgtgtcatctaggtccctgaactctcaaaatacatatccaaatcctagaacttgtcataatgtgttatctaggtctcaaatcgtcataaccccttcaaaaatctacgaggcattgatgtgacatgccacacagacatgacatggcattattttttctttttctttttttcttctcttttttcccatttattctcttttctctatgacccgtgtagaaaaaaagaaaaaaaagaatgggaagaaaccgaaaaagaaaaataaaagaagaaaaaaaaagagaaaaagacatgtcacgtccatgtggcattgccacatcagcgtcacgtaggattctagaggggatgtatcaatttgggacatagatgatacactttgacaagttatgggacctggatatgtattttgagattttagagacctttataacataaccttacgagtttaaggactgccaatgcactttactctaaattaaaataaccttcacccgttgtaacgcgcgagcttatttttttctctagtcttaattagtatcttttaaatatactcgtgatcgtgccgcgcctactggatctctgcttctgaccaaaatgttccgcattgaatcatcacaggactgaaaatcaatcctcgcaaaccacgagattatcagtatattaagtctcctgggaagctcacatgtatacccttgcaaactgtactgctatatgctaaattatctgcctgcatgatcattgaacgcaatcgtgagattctatggccttcttaagagcaacaaatgcacacctttctggacggggaaaccaacaaccaaatgcatatattgttgcacatcatcaaatgcccttcaaaattgtattagggcgcatgtgtatttcttccgttagatcaaaaattacaattcaaattaaaattcaaaaagagagagagagagagagagagaggattgagagagtaatcctgaaatgcaatgttttctgtaaaatacaatcggcttgtggtttttccccaaagaaacaacattggatgttactcctaattaagaatttcggcatttagcaagtactaaaaaataccagtaacaatttcattataaaaaaagataggataaatcacgatcgcaaaaactgaaaaagaaattctcaaaagaatgaaacagtttgcatcatgagaagaagaagacaagaagaggatgagccctcagtggcatatataaaaactggattactactgtactactctcagtctctcggcttctagactagggaagctcaccaacccaagaacaagaagtgatcggagatggctcccaagaaggtgctcctgctctgcggagactacatggaggactacgaggtgaggcaaatcttcctcttgttccgtgtcttgtgtgttcgattcgtgtcctcgcgattccaatggggttttcttggaatcttgtggatcaggccatggttccgttccaagcgctgcaagcgtacggggtgtccgtggatgctgcctgccccggcaagaaggccggcgactcgtgccgcaccgccgtccatcaggggattggccaccaggtacttggaatgattcgattccgctcgatttggatagggtttagtataactagttagggcttggtctgatgaattgaacatggcggattcccattctagagtggtcaggaatatcttcgctttcttgcctttgagtaattttaggatgtaatttctaggattaatacacatctgctcatcgcaattggcagaagggggaaagaaaaggagagtacacacagtcacacaacgggacagggaaaacatatgtgcaactaggtttatttttgagagctcataatgaaatgacagatttcttggtatgattgatccattagctttatctgttattctttctattctccaaatatctggtttagcattgcgagataagtttgacggaataatcagtcatgagcagaaatattccttaactgtctacaaaatgggatagctcttctgcatgattgaatggaaaaatcatttgaacattttggatactgaatatacttagacagccattcttatttctttcgtcacttaagtgaactgttgattggttcatgatttgggggttaactgttgctgtagagatttcttataaattcatatccttgtctgtttcccatattattgcattagttcctgcttctctttagatggtgttgcttctttcaaaactaatttgggggtcctctttgtctactggactactactccctttagtaatggaatctttgttttctctgaagcactcgattataaggatcgtctgtattgttggttcttttaggtgtgatagtatggtggtacttttcgtctttctaacataagtttgctttgacaaattaaattagattcattttgattcatcatgcagacatatgctgagtcaaggggccacaatttcgcacttaatgcttcgtttgatgaggttaatatcaatgaatatgatggcttggtaattcctggaggccgtgcaccagagtatctcgccatggatgaaaaggttcttgatttagtaaggaaattctctgatgcgaagaaacctattgcatcagtttgccatggacagttgattttggcagcagctggagtagtccagaaccgtaaatgcaccgcatatcctgctgttaaaccagttttggttgctgctggtgctaagtgggaagaagctgatactatggacaaatgcacagttgatggaaatcttgtcactgcagtggcttacgatgcacatcctgaattcatcagcctttttgtgaaagcgcttggaggctctgtaactggctcaaacaaacggatattgttcctttgtggggtatgtttagggaaatttcattcaattgaattcgtatgactactttcttattttcttcatttttcataagtcataccatctctgctgaacctctttgcttaactacatgcttataacaggattacatggaagattatgaggttatggtaccatttcagtctcttcaagcccttggttgccatgttgatgcagtttgccctgacaagggtgctggggagaaatgcccaactgccatacatgactttgaaggtgaccaaacatacagcgagaagcctggtcacgattttgctttgacagcatcatttgacaatgtggatgcatcaagctatgatgcacttgtaattcctggtggacgggctcctgagtaccttgcactgaacgataaagtcattagccttgtgaagggcttcatggataaagcaaagccagtcgcctcaatttgccatggccaacagattttatctgctgctggagtccttcaggtacatgataatgattaattttctaccattgctctacattaatcgtacttacttgattacttctatacctagtgttggaatataaagtgaattgtccgtctttcctcatcagcttaagcttttggattgaactggtcggtgcatgcaactcaatacctagcgataggaaaatttaccttgaacaaaacaaaaataatgcaacaatatctattcttgattaatggataattaaatgattaaatcattcctgcaaagtaaaagcattttcatagtgtggtaaggtaggcaacaagacgtactattacagtatcagtatgtcactatccttcttagcgtagttattcaggatcactgaattgcttccgaaaatctcacacaaatggacacaaacctgtttgatgcacgcagcgatgctccccagtctccctaattgtggatgataatatgatatgcagggaaggaaatgcacggcgtatcctgcggtgaagctgaacgtggtgcttggcggggcgacatggctggagcccaatcccattgaccgctgcttcaccgacggcaaccttgtgaccggcgcggcatggcctggccacccggagttcatctcccagctcatggcattgcttggcatcaaggtctccttctgaagcaacgagaggtcaggtcccagcgtttttgcacgcgatatagcaagacacagctttgggctttcgtctaagatatatacagtcttaccgatactgtaccagtctgctgtcgttttttgtgcttgaaataataagataattactaaaagggtttgcgtgtttatagtattatgtctgtacgagcagaaggagctgcacctggggattgcctgtgtatgatatgaactgcagttgaatttcatgagctctcgcctctcgccgacctgggcagtacttcttgggccgtgcttcaccgtgcggcccactaaagtcagcccatcaccgcgagagcgatcggagaaggaaaaagtccaacgctactccctaagactgagtttgaggagaagaggattgagaagattggaaagatacgtaaaacggggtgagccattagcgcatgattaattgagtataaattattataaatttcaaaaatagattaatatgatttttttaaagcaacttttctatattttttttaaaaaacacaccgtttagtagtttgggacgtgtgcgcgaggaaaacgatgtgatttctcactcaatgtcacttgaacgaacgcagccatataggttgaatttaatttgtatcccttgaacgcagctatgacgacttcttaaaccggtataaaataacttcaaagtagtattgaaggtggtattcactgacggcatattgcccttggtcaaaccacctgagttggctgttctcctctcctctgatctccatctctcagggcctattcatttttttttaaaaaataacacataagaataggagaagtgaaggaataggaatgcatgcgaacttcaatccataggaattttccaattggtcagagcggatgaatttttttatgttttctttttataacttgtaggaaagaatttttttgttttcctatatctagatttcttcgaaccaaatggatttcatagaaattaatccttagaaatccaagtcctttgaaattccccttagaggctatggcgccgggtccttctccctcttgctttttgtaccttccttctcgacagacgtccaccaccctttcccatccctcctctttctgcaggctacagagcttgcagagcttcttcgatcgatttgctctttataccatttcctccgtttcgtaacgtaagactttctaaaattatccacatttatatagatgttaatgaatctatacacatatatgtgtcttacattgtaaaacggatggagtagtcattctagcatttcccatattaatattgatgttaataaatctagactgtgagaaatgctagaatgacttatattgtgaaacgaatgaagtaaaagattttgggtggatgtgatacattctagtccaaattagtacaaatgaatttggattatttttagcagggagggagtaacagagtaataatagtcacacctatgtataaattaatcgtctgaaactctgaatcttcctttcatttcatctccaatattgcaaaaattaggtacggcgctgttaaggtttgggtaaagcgcatggcaccagcgccacctgccgatcgatggaaccaaaagcggcaggaaatgagataagcagagaaaggtcaccacgcaagcacgcactacatcacgtatgtgtgcctgctccaagctaagctactctttctagctaagctttgggcttaatttgccggcttttcgctttttcgtgaacgcgcaaaaagattgcacctcaatatattatgccggcttttcgctcatgcgcggcaacgaaataaacactgaattgatgatgatgatgatgatgatctgaggctgctaatcttgccacctaattttgcctcaagaaaagctcgccacttacgctaaagatggcgacgaaacggcagctccgagccctttaatcctagcgtgcccttggcctttctgcgctaccgcttcttctaccttatccttctcacacgccattcttccagaaaacataatgctattcttaggtcgtgatgttcagttatgtttttgaaaaaaaaaacaaaaaacataagtgatcttcagttacgttattacgtcccctgtaactgtaagctgatgaagcctgaagaacctctcgccaaaagatcgaatatggtgtgtaaccgcttattgtactttctgaagttttggagcattcaccgacgaatctgtttcactgctcctaactgttactgacattgatgttacactgagactggactgaagacgtggaggctaattacctaaaaacgcaaatattagaaaatgacctaatatcaaataaatataagatgtgagatttcgaacccaagccgactagccctccttatgaagttagccggaagactgatgggcgtttctccgatctggaggcttactaaagctacacataagacatagctctagctggctctgaggctggccctaaagatggatgatctaatcccacacacgcaaacagctttcatcagagggagaaaccttcatgaaaacttcatttttgtcaaaggtttggcgcagcaatttcacagaaggaagaaagacatgatcttgctcaagctggatatatctaaggcattcgacaccgtttcctggagtttccttttggagatgttagaattcaggggatttggtgctggttggagaagatgcctgtctgctctgcttctaacggctgagacaagtattctgatcaatgggatcacttctgatccggtgaagctggcgagggggttgaggcaaggtgacccgctgtcaccccttctttttgtgttggttatggatacgcctgaggctatcatgacccaagccaggacgacgggattgctctctcctctcaatgctgcgagatttttgcccagcacttcagtgtcttcttccgcccggtgactcaggaagcgttggttattcaggctgtgctggatctgtttggggaggccactggattgaaaacaaatctcgcaaagagtgccatcacgccaattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaagatggtgaatggctcggctcggcaggcctgcatcgtccaagcagcgacggcccaagacggcggcccatggcgcatgggctcaggaggtgcaggcagcttgcatgcgcaaggacgcgcgcggaaaaaccgtacgcggcaacccccgtttcgcgtgactcgatcggaggcgggtgcaggagcgcgggacccacacgcgattttgcaagcgcgcgcgggagcggctcagcgggacgcgtggcggcttcgggctggttgggcgctggcgagcgcgcgctgaggaaaaggagacggaacgcgcacgacgcggctgggcaacgtggcaagtttggattcgtcaagacggagagcacgcggattcatcagcaagaagaccatgtgagggttcggatcgatgaggtggcaatcatctggagcttttcctttgagtagaaggaacaatggatggaccagatctgttctgagttagggtttcgccctaggggtatttgagaaaatgtcttaggggtcttaggctataaatagagagatggatgcaagggtggaggttgctccttttggtaatcattttgagatgctcggtgagagagtttccgtgtgagtttggagtgtgtttgcccgagaggcttttgtattaggattagtttggagtgtgtttgtccgagagattttaagtttgtgttaatgttcctctgaaggtgtatgtttgctcctagttgagcggttattttgcatcacctataaatgaaatgatttgaaggatttcatttttgccttgtccatttaaattccgcaatttaaattccgcttgcaatttgaactttgcgatgatgagttttgctctctctttctcacctcacttctagtttcgggaattccttttctcttcctcctctagtttcgggaattccttttctcttctttttctctcttcttttctagatccggcttctctaatagccgcgattctagtaaggattttgagaaatccggcttgatgagtattttcgggggcaagatttgaattgctatattcaccccccccccccctctatagctgttcttggtctttcaattggtatcagagcccggttaagttcgttgtaacctaaccgtggcaacgaacgcagctatggaggaaaaatactctgcgaaaccatttgttttcgatggacacaattttgtcatttggaaggcacgaatggaggcctacctccagtcgcaagggcataatgtgtggaataaggttaaatctccttatactgtgcccgatgatgctgacatcacgcctgcaaatatggctcaggttgattttaattatcgtgcaagaaatgcaatcattggtggaatttcttctggtgaatttaatcgtgttcaacaccacaagtccgctcatgacatgtggactgctctgtgcaatttccatgagggaaacaatgatattcaattggttcgtcagaatcaatttcataaagaatatcaaagatttgagatgcacccaggagagtccattgattcttatttcaaacgttttggagaaattatttcgaagttgagatctgttggaaaagaattttctgataatgatatgctcgccatcttttgaattgtcttgactatggtgtttgggaaatgaaagttacttccatcacagagagtgcacctctgagtgaccttaccatggacaagctttactcaaagctaaaaacccatgagatggatgttttccatcggaaaggcctcaaacactcgatggctttggtagctgatccctctggtagtacttcttctaatgactcagcctttgtgtatggtggcttctctcttgccgctttacactcagtcactgaggagcaattagagaagatccctgaagatgatcttgctctttttgctagaaaattctcaagagcttacaaaaatgtgagagatagaaaaagaggaaaaaccaatgaaccatttgtgtgttttgagtgtggagagcctaaccacaaaagagtgaattgtcccaagttgaagaagaagagtgacaagacgaccaagaagcccgagggacaagggcgaaaggggaagaaggatttgatgaagaaggcgatccacaaggtcttggcggctcttgaggaggtgcagcttagcgacatcgactccgacgacgatgatcaagaaaagggggacaaggacttctccgggatgtgctgtctcgccaacaacgaggacttcatcaacctgtgtctcatggcgcttgaggataaggatgactcatcggagcatcctgaggtatgtcttgatgatatcccttccttggatggttctctttgtgatgattcttgctcagataatgactctgttgatgatgaactaagcaaagaaagaatggcacacttgatgattgaaattagtgataagtataggtcttctaagtataaaattgagaaactaaaatctgaaaatgatggaatggcgctagaaattgctaggcttcgatccatgattcctgaggaggatacctgttctacttgtgcttcatatctttctgaaattaatctcctcaaggataagttgaaatcatgtgctttaggagctgggaatccttctagtgctagtgctgcttgctctacttgctatgaaatgaaagttgatatgggtttgcttgagatggaattgaaagaactaaaagaaaaatttgttcatgataggattggtaggtgtgaaaattgtcccattctcactagtgacaatgatgaattaagacaacaagttgccatgcttaggaccaagaatgatttgttagaatcttttgctactaaggaacctattcattcttcatgtgctaattgtgctatcctggaaactgaactaaaagatgctaaaactgtcattgattctatcaaatctattgattcttgttcttcatgcatttctctgaaagttgatcttgagtctgctaagaaagagaactcatacctacaacaatctttagagaggtttgctcaaggaaagaaaaagttgaacatgatcctagaccaatccaaagtgtccataaacaatcaaggtataggctatgattttgctgagtctttgaggataggtacccatgagattttaggtgtcacagatgggatgatagaactagctcaaaaacctataaccttcaagtctgcaggtttcattggaaacactagttctagtacacccaaaacctcagaaccaaagatggtacctatgactagcaagtctaagcctgtagagttacctagacccaaaaatccaaaacaagttgagcacaagcaaaaccagagacaaaccaagcctgtagagaaaaccaagtatgagtgcacctattgtgggaaagctggtcatttggtaggtttctgctttagaaaggctagaaaagagcgacaagaacgtcttaggactagaagagctactagagtccctgagaggttcgagtgtgcgtatcattgtcgttcaagtggtgtatctcgctttcctcgccgagat

SEQ ID NO: 45041 - DNA, 4298 bp, Oryza sativa
tttcttgaatcaaaggaggaaacatttggcttctttcaggctcttgctcgtagtttggctttggaggttcctggtgctcttcgagccattcgcagtgataatggctctgaattcaaaaattctgcatttgaatctttctgtgattcttctggagtcgaacaccagttttcttcgccatatgtcccacaacagaatggggtggttgagaggaagaaccgcacccttgtggagatggcacgaactatgcttgatgagtttacgactccaagaaaattctggactgaagctatttctgctgcttgttttatctccaatcgtgtgtttttgagaactatcttgcacaagacgccatatgagctcagatttggtcgtcgaccaaaagtttcacatctcagggtcttcggttgcaaatgctttgttcttaaatctggaaatttggacaagtttgaatctcgatcattggatggcattttccttggctatgctactcattctcgggcttatcgagtttatgttctttcaaccaacaaaattgtggagacttgtgaagtcacttttgatgaggctagcccaggagctagaccagaaatttcaggtgttccagatgaaagcatctttgtggatgaggattcagatgatgatgacgatgattctattcctccacctctagacagtacaccaccagtgcaagaaaccggttctccttcgactacatcaccttcaggagatgcaccaactacatcatcttcagcagctgaggagattgatggtggcacatcaggaccgacagctccccgacacatccagaaccgacatccgcctgactcgatgatcggaggcctgggtgaaagggtaactagaaatcggtcttatgaacttgtcaattcagcttttgttgcctcttttgagcccaaaaatgtttgtcatgctttatctgatgagaattgggttaatgccatgcatgaagagttagaaaattttgaaagaaacaaagtttggtctttggtagaacctcccttgggttttaatgtgattggaacaaaatgggttttcaaaaacaaactaggtgaagatggttcaattgttcgaaacaaagccagactggttgcacagggtttcacccaagttgagggcttggactttgaagaaacttttgcaccagttgctagattagaagctattcgaattcttttggcttttgctgcttcaaaaggtttcaagctttttcaaatggatgtgaaaagtgcttttctgaatggagttattgaggaagaggtctatgtcaaacaacctcctggttttgaaaatccaaaatttccaaatcatgtgttcaaacttgaaaaagctctttatggtttaaaacaagctcccagagcctggtatgaaagattgaaaacctttttgcttcaaaatggttttgaaatgggggctgttgataaaactctttttactcttcatagtggtattgattttcttcttgtccagatatatgttgatgacatcatatttggtggctcctctcatgcacttgttgcccagttttctgatgtgatgagcagggaatttgaaatgagcatgatgggagagctgactttcttccttggacttcaaatcaagcaaaccaaggaaggaatctttgtacatcagaccaagtactccaaagagctcctgaagaagttcgacatggccgactgcaagccaatcgccactcccatggcaactacttcatcgcttggtcctgatgaggacggtgaagaagttgaccagcgcgagtacagaagcatgatcggctccctcctctacctgactgcgtcaaggccggacatccacttctccgtgtgcctgtgcgcgaggtttcaggcttctccaagaacatcacatcgccaagcagtcaagcgcatgttccgctacatcaagtctacacttgagtacggtatttggtactcctgctcttctgccctttcagttcgagctttttcagatgctgattttgctgggtgtaagattgatcgcaaaagtacttctggcacttgtcattttcttggcacttctttggtctcttggtcctctcgtaagcagtcttctgttgctcaatcaacagctgaggctgagtacgtagctgctgctagtgcatgtagtcaagttctttggatgatttcaactctgaaagattatggtctgtctttctctggtgttcctctgctttgtgataatacaagtgcaatcaatattgcaaaaaatccagttcaacactccaggaccaagcacattgagatacggtaccactttctccgagacaatgttgagaaaggtaccattgtgctagaatttgttgaatctgaaaaacaattggcagacatttttacaaaaccacttgatcgctctcgttttgagttcttgcggagtgagttaggggtgatccacccctatggcttgatttgagggggagttgtttttcttttgcatgcatttgtaacatattgcatcatgtttactttatgcattgtattatacactcttcaattgagctttgcttgttatctcttggtcatcactatgctatggatgtatcactcttatgctagtttgatctcttgtctagctttcatttgcttaagtagcttgtgtgatcatgttatgctgttcaagcgtgttgaaacctgcttaaattaactattcatttgaactcaatcaatgtgcaatgcttgctctagaagtttgtttaaattgaagtatccttctcatactcatgccatgtttacattcttttcgcaataactgtcagtacatgcttatgaatgctcatgcttatgcgtccatactttgtatcaatcatgctttacaagttttatctctgtttttgtccgggctactgagtgcgtttacgcatgagtagtgccgaagatagcactgagacagcctgtaatgggaactctagctggaaaacttgattgaggtcagacggcagtgtttggcacaaccatcacttgctgactgataagatcaggtggaccgtcgtgattgtgctattgtctttaaagaaattaaaaaaaaaatcataaaaataaaagtcatgagaaaagattaaaagctcatgttctatgctttgttatcatgttgatactctttatgaactgggcattagcacattagcatgggttcattgctttgtttatgtaaatcttgcatgattatgagctggtttgcttccttttaagcttcttctagaaatagctttgcacactaaatcactaattcacttgaaagctttttgcttgctggcgatactaacttgatattcatgacttgtttcatacttcttatgcacatgcttagctaggcttgagcacatgcttgtatctgtgtgatccatgtctaccttttgatgcctttagataactctcaaagctctcaaaacctaaaatttgcaagtttcatctcatttttatcttgcatttttgtctcttttgatcttgatggcatcattgacaaagggggagagaaatttgcacttattgaaaattaaaacttgctttaaatcttggtgaaagggggagtttggcacatagggggagcattcttgcatttgcatttgcatcccttttttcttcttgtcacttggtcttgatttttcgcgatttcaaaatgaccaaagttcgcttttgcaaaatggtttgctttgtgaatcaaaaatcaaattttcaaaattttgcttgagattgtcaatgttcccatcaagggggagattgtgaaaccatgtgtggttatagttcttttgtgatgggaaattgacaagtaccggatgtgcaagaagtgtgtgtgtggactaacgttggtcaggttgcgacatctgtgccaagacaacggttgtttggttcatgtgtgtgcaggtgatcggggtcgatcttggtcaacggcggatcgggactagactcagggaggagttgaggtccaaagcgatcaaggatgccgggtgacaagattggacacaaggttgcacacggtggacgaacaccgtgtgaaaaggtctttgcaacaggcttcacaaggccaagtgtgcaagcatcggattcgcgaagaaatcagaagggactgtgcaagtgcattgctgctacagtacttgctgtaggtagcatacatgcatgtacacgtactgtacttgtgcaaggaggagcttgcactgtactggttgctactagcatggctcggtggaaaagtcaagctagctagctgtgcatgtgcgctgtgattggttggcagggaggccaagccaatccagccgttccacgtggcccaag

SEQ ID NO: 45042 - DNA, 2291 bp, Oryza sativa
agtgcaacccgtcgcagatacaagctgtggaggctattttgcattgtcaggttcagcattttccaattacctacctaggcctccctctttcaaccagaaagccgactaaggcggagattcaaccgattcttgatagattggctaaaaaggttgctggctggaaacctaaactcctctccattgatggacgcctctgtctcgtgaactctgttcttcaggctttgccggtgcacttcatgacagttcttcaattgcctaagtgggcggtgaaagacatagagcgtaagtgtcgcggtttcctttggaaaggccaagaaaaagtcaatggtggtcactgtctggtctcctggcgcaagctctgtatgcccattgagaaaggcggcctcggggtgatggacctagatctgttcgggcaagcgttgaggttgaaatggcatgccaagagccttgagcagaaaggaaggccgtggactctggtttcctaccatctgggtagcgacgtcaatgctatcttcaattgagtggcggatttcgtcatcggcaatggaactgacactaacttctggacgtcgaattggacgggaaagggaggtttcgcttggagatggcccatcctgttttcttatgttgggagatcacgtctgacggtggctcaggcgatgatcaatcacaggtgggttcgttgtctgctgcggccctatgcgagttctttcagctctgggacgaggtcagaaacaccacgctgcagaatggtgatgactctatccgatggaaggtctctcccgacgggcaattctcagcatcggcaacttacaacttctttttcacgaccaaagaggactgtcctgtgggcgacctcttgtggcactcaagagcaccttccagggttcgattcttcatgtggctagctctcaaaggaaaatgcttaacggccgacaatcttgctaaaagaaattggccccacgaggatcactgcgttctttgccaaagagaagaggaagattgccagcacctgtttgctgactgcagctttacctctgcggtctggggattgatcaggagcagagtgaatttcaacttcccgattcccaccgaggaaaactgcccactaatgtgctggtggcttcagccgagagcccgttgccgggtaagctacaggacagattttgacagtctagtccttcttacttgctgatcaatttggaaggaaagaaacgctaggatctttgagcatcgttttgaacggcgaaccatctagtggaagacataaaagaagaagcgttgatgtggaaggaagccgggattttttcccaagagtgcgagtagtcagtgtcccgtttgtttgttcccctaggctgaactctgtttcggctttcttccccctcgacatcctcatgtcgatgtaaatcttgtaatttgtaacttattttttctcctatcttaatgaaattggccggccatcctttggccgtcccggcaaaaaaaaagacacagctctagcttgaaattaatattcagggattctgaaggtacgcacaacacatgcaggatcacagatcgaattgcaagtgggttattggtgccggacatggtccaagatggacctctggctagctagccaaattatatgccatcaatcagaccatgcattcacgggcatattaagcaccaaaatatcctactcctatcatcatccattttatgcagatccaatccaccggcctacggaatattgcattattggtaataaagatgcagtcaacatctagctgctgattgatcattgctgatgagacatccagcctctagaaaactgcaggtttatcaatcaatgaatatacattttgattgcttagaatctatgataatatactgtacaattgacaaatccaacacataactaccctacggttcaagatcccagcgacaattgactgaggacatataagtttcgatacatttatcgtacacatcaacttaaaaaactgacacaagaaattctaaaaaaaacatatatgtacttctaatagtattgcacatatatgtataaagtctaaacttcatattacaaatgacagcagctagccaacagaacggtttacacttcagctgcacaaattacagttattcgaagtaagtgttacatagaggtaaattgagcagaagagttgcacacatagtaaatcattcagagtaactgcgataattggtagttgcaggaggatctatcacctatggcatctgtcaacagagttacctgggcgtcgtcatgctggatgctacccgtgcag

SEQ ID NO: 45043 - DNA, 6546 bp, Oryza sativa
atcccaaaacaaaacagaagctgccaagttgatcagatacacactacataccctgttgtcggttttaacagataaaactctgaattcagtggaaatttccgctgttagacacagaaaaataggaaacagggtcgaaggaatatcgtccgtcacataaacgtagggatattttcgtctacaccttataaaaactcttgtaagtagtgtaccaggttcctccacccaatacattgatcccattcttgaactttaagatttactaaaacataaatttgtggcacagaatttcgcataagcaattgaatccgtgtgatgatcatgcgaggaagttaatgggtccaaacctgaaaacctgcatctctccggtgaaaccggccgcgggattgtcagctcaagaactcgttaacagcaaatgctctctgtcccgggacctgaactgagctaagcttgctgctgaattgtgacaaccaaaacaggtgtatacagttcgtggtgggcccactttgcagtgatatttttgcagcttgattgacgtggagagaatccggggaaggacgtgggccctacacagaaccaacggacaaccgaaaccagcttccctttgccttccttcctactagctttgtctgaattttctgatgctgctctttcgtctctcacgctgcaagcctgcaactgcagtatggagttgcacaatttgcatttgcacaccctccatcttggaatttggaaaactattgctgataacatgaatcatttcgtcttcatgtgagcgacgctgatgcattctatcttctactgcagtgactgcctcactgcaggtacagtcaccgagagaatcatctcgcaacagctaagctaatctctgaacgtgccgagaaaacacttagagactattcttaccttacgtggcattcatttttctatccagtttctttccctgctaaaactacatcaccatctaaattgaaagcagctgtgttgattcatgaatcagctaaaaaatatcatcgatctcgcgcgtgggccatgacaatcaatccaataattttgatggtggtggggtccggaggcctgcactttgcgcctcctcctcgacaaaacagctcgatcgatccatcaagagccagatgcgatcaatcatacctgcaattaacgtacaacctaattcccctttatatatggctataatcagctgcatcaactgccctggcatggcaatcgctgtagccgatcgccgttgctactgcgattgcctttcttgtttcctctactcttctgaagctcatcgcattttttttttcagtcggatgtgtacagatcacctaatgctaagttaaagatcacagtaaaatcactttttggaaactagctaactaattacttcatccgttctcgaataattgacactagcagtactattcaagctcaaatttgttttttcctgaaatttataaacacctaagggtgttatattagtcaaagtaagatgatcgtagtcatcagtggcagtaattcgagaaacgagggagtaaacaattggctcatatgattggagaatcattgtcatacatgtagcaatgaacgcatggattatacaagaactgaaagaggcagtaacatgctgcatggcacactaactgaaagtctgaaactctccaagagaatacactaccacatcgagtccagaaagcctggctgtccttttctctcccctagaatataccagctaatagatagcacaatttatcaaggaaaagcaggggaatataccctaaatatggagatccccatggaccatgcatgtctggtctacttgccgaatgtggagttgtccgtgtacgtctcggccaaccaccgggtctctcggctactctggagggccattttcttctgcagcttatggtgtctttgaaaccctctattaaacagcgcgttagccacgtggaacgggatgattcattaacatgtaattaattaagtatatattattataaacttaaaaatagatttatttaattttttaagaaaacttatatattaaaaaaaacatatcatttattagttcagaaaacgtgctaatgaaaaataataaagctgtagtttggagttgaagtttagaattcagctgacacaaataaggcggtatgtgaaaattactccagaaacccttgtgattaacaggcagtataatctagatttgacaggccttacattgctcgtggttgatgttaaatacagtactgaagaagtgttctctgtttgtagtgcattcgtttcatactggaccatcagattggctattctgtcactggtgtttgtctgctctgcagcttgattcttcttctcgtccggagaaaaaaaaactgtcacaatacaatactgtgctcttcaattttttttaaaaggaaatgctgtgctcttcatggtacagtatcagactatctacgctgttgctgacagtaacaaaggagcacatgcaccatgcattgagcccagaaaccaaagcacacgtgtcatggtcagttagaagctttcagaaaaagctgtgcgcagccttcgtaaaaaaaatgcgatgtgaagtctttcattctgacatggtcctacacaacactgatgataatgcacgcgtaaatttcataaaattaaaattatgagaaaactatatatttaaatcaatgtatcataaagtatataattagaactaaatttatcaccaaacaacaaatttagcaataaaattatcataaaaattttatgtcttccaccaagtacaaaactacaacttttataattaactttatcataacggtactgctagatatttaaacaatgtgataacttcaatattaaatttgtagttttgaaatacttgatcttaaatatataggtttacgataaattttgaaatacttgatcttaaatatataggtttacaataaattttgtataaagcatacctataattttataatacaacatattaaatatatacttttacgataacttaatcaacttccacacagttttgtaaagtttacccgtaaatcacaatgcatgcaacattgcaacactccaacacacaggattttcagcatcacattttttttaacaatgccgttgtattttggtttggttgtgagaattcacaagagccaagaactctgcatcgttctaaaaataattacaaaaaaactctgcatcgacggagagagtgagagtggatggaccacatggacaggtgcccatccagctcggctgttcaagccggctcgatctacgagccggccgtgtttcgaaataacccaaaaaaaagaggggtcaaaacgcaaaaggggcatcgctataaaaccgcggctccgcgggcgccaatccaccgcatcatcggcttccctccggctcgagccaatctctcgctgtgtctctctcgcgctctccactagcaccggctcggctcggctcgcgcggcggcggcggcggggcggcgtggcgccgagggaggggaacgccggtgtggggagggcggcggcgaggggactcgccggcgacgagctggtttgggtatgagaggggttacccatgcggcgccgaccacgagcgtcccccgccgcggctccatggacggcctcctcatcttcgtcttctacctctcgcttcctatacgtggtggccgcgaccactcgttaatctcctcctctaattgttagccgatctcgcctctcccccacactctctgatcccgctctctctctctgcttcgattcgattcgattcgatcttctccacctcgtcgccgtcgaacgcaactcggatcgggaggataatggaccagccttctaatggcttcgccgccggaggtgcgtctccgatcagaatactcccctgttcttttttttccatttttaggtagagaagtcattttttattttattatttttttgcaaattgatatgttcatcagtgctattcaatttcaaccatgcatacaaatcccacacgcaactttagattactatccaagtataaaatccaagttgattgtgttacggcaaatattgctgtcgacctgtcgtggactggcgtcccaatcgcaatcgattgtgtgagtatgacagtgcagtgctttagtgtcacaaatcgtaggggtcagaatgtttcgattcagtaaatgctgatatggagccatccttttttttctttttttttttggttccggtgaatacgcaaaaggggttgcgtagccatggattaaggtggtgaaagcaaagctaaaatcctatcgaatatgaaatgtgtacatatctttaactttataccttttttgttctatgtaataattatataaatacataaagtaggacccttcattactgttttcttttttaaaaaacgaaatgttgtaaaacgatcctttaattgattggggaccatcccccattgttttaaatcttgcaatatcagatgagtcacagtagtgtagataccatcaatcagcaagaatctagaggaaaggaagggattgtgatggcaatttgctagcaaaactgtgaaagagatgtggaacaaggttccaaaaattgaggtctctaaaagagtaaaaggtcaataggaaaaaaatggtatcccttgtccagaagaagtagcatccgaggccgaattgtttccttgttcttgattgcattttttgcagaatatgctgctgcatcgattaatccagactgctctgcgtcaaataactctatggatcattctgctcaatctaattcgaacatgacactttattgccaaaaaccaactgtaatgaataaatcactaacaaagattattcagttggccacttgtgggctcgaaagcacaactattttcagtcataaatttaacaaatgacacatggttgcactgaatgaaactttaaatgtgcttattcatgtacatgtttgagaaatatgtgatattagttgagctacaattccaaattgatttcaatatttaacccagaaatttactgtgcggtgcattcaggtctttttcttcgtcacattgatgggcaaaatgcctctcccccttctgtcattgtgattggtggagggatttcaggcattgcagctgctcgtgcgctgtctaatgcttcgtttaaggtaaatgctgtcattgaaagatgaaataactatatctctgtcttctatattctattagcttattgtccaaaaataagttaatgttttgatgcttcccgggccctttttcttagatacttttacataactacaggtcacactattagagtcacgggaccgacttggtggccgtgtgcatactgactattcttttggctgcccaattgacatgggagcatcttggttagttgcatcccagaagtagctattttcgccgccttgcaacgtgtttggttttcatctcatggttttatcatgtggttcaggttgcatggtgtatgcaatgagaattcattggcaccactgattaggttgcttggccttagattatatcgcaccagtggtgataactctgtgctatatgaccatgatctggagaggttaggagttattcctaacccataagtttatcctcaacttgatgggctttcattctcttacaattgttgtttttgttcatttagctatgctctctttgataaggatggtcgtcaagttccccaggagatagtgacaaaagtcggggaaacatttgagaaaattcttaaggaggtattgtcatcgtttgcatttcatttgttatccatcaaatgcttttatgcaactcttgtgagcttactttgttaatattgcagacggtgaaagtaagagctgaacatgaagatgacatgcctcttattcaagccatctcaattgtgcttgacaggaatccacacctaaagtaagtggaatttagcattcacctatatctggaatggtggtgctttagcgacggggtgaaatgttctaatgatatgcattcactcttacaggcttgatggtttgcaatatgaagtactgcagtggtgcatatgtaggctggaggcatggtttgccacagatgtggataatatatctctgaaaaattgggatcaggtatgcaatagggggcacttttgtatttacatgcgcacatgaagaattgttgtattcacgtagagcagtggactgacctttcaaatttacaggaacatgttcttactggtggccatgggcttatggtgcatggttatgatcctgttatcaaagctctcgcgcaagatcttgatatccacctgaaccacaggtatgcagttacatatcctcatggccaagtaattcacataagttctgtttcataggtttcatagttataatcccaaatctatagtatcttatctcttaactttcctccagggttaccaaaatcatccagaggtacaacaaaactatagtatgtgttgaagatgggacaagctttgttgcagatgctgctataataactgtccctcttggtgtacttaaagcaaatatcatcaagtttgaacctgagctcccagattggaagctt

SEQ ID NO: 45044 - DNA, 11821 bp, Oryza sativa
atgctaccaggagctactgaaccggtaaatcctcaaaattcattttcagaccatgtacagttgagtactgtcaatttcagactatgaacagtagctctaacacttgtgctacacaactgcaggtccagtatttggtttcaaggtggggaaccgacccgaattcgcttggttcttattcctgcgaccttgttgggaagccagctgacttgtatgaaagattctgtgctccggtgggcaacctgtttttcgctggggaggccgcctgcatcgatcactctgggtccggcatggagcttattcttcaggcattgttgctgcagaggattgccgaaggcatctgtcgacgcagctaggcatctccgaccttttccaggttgggaagattatcatgagggaggagatgactgaagtcatggtccccttccagatatccaggctgtgaaagaagaacaaagcctgcctatttagcaccgtgtttatcctgcagctgctatggttaatattgtagctgctgctctgtagtttcctaattatctcagatcctgtaccgtttcacagtttgatcgtttatgtgtattcaaataaaaacagaataattatatatcaacagaccttgttctctgaatccatggatattgcttttcatttacacattcccagtcagtactgctgaatttattttagttttcagtgtttgccttgagactggagggctgtagtaaactagtaatcgtctgatcgaacttggcttgcgcccccatttgcttcattttgcatgtatatagggttgtagatgcaggctagttgcagttcaatggtcataaacagtggaggtttttctttctttactttcatacgtagatctccactaataataaaccatacagcatcctgcatattcggaaacgattccaccatcgtgtgaaccatatcaaacgcattcattccactgtaacatctgctgccacaatttgcaatgtccatcccatcctgtagcatcagacttgtaaattgtaatagccacaaacagagaatacattaattccctcccccaccacctaaaaatcattttttttctttcaaaaatacatatttcattaaaaaatctattatttattttcattgtattttgttttatcataaaatgcattttaccatgatttgtattttacatatttacacaaaatatttaagacgaatattcaaacatatatgtctaaaagtcaacaaccacatattaaaaaacggactcaatactacctcctttttaaatagatgacgtcgttgagttttgaatacacgtttgactaatcgtattattaaaaaatacgtaattatcatttaccatattttttagttgttttatcattaaaattacttaaagcattatttatatgttacgtatttgcacaattttttaacaagacgatactcaaacgtaacgttatctattaaaatacaaagggagtatatatattatctgtgttctagtagttcctcttgtaaaaggaagaaaagataaaaacaaactggtgccgacgccaactatttccaccgcatttgggcccacatgtccgggagccaaacgcggctacgcgacccaaacgcaaacgcaaaggcggaagctgggatcccgtgtcgtcgccgactccgactcctcctcctccgctccatataagactcgccccaaccccctcatcaacttcataccaaaccgaaccgaaggaccccacccaaaatcacacgcgccaaccagatcaaacccacctcgcaggagaagagaagcgatctacctctcctcgaggtggtggtgaggatttggagttgaattgtggggagggggacctcgcgggtgttgccggtttggagcccaagatagggttatgagctgcttcgcggaccgccgctgctacgccgccagccgccgccaggacggcctcctcgtgttcatgttcttcatctcgattcccatacgtactagtagcagtagtagtaataattgtaattccagtagtagtattagtagtaatctcctgtaagcggagttcctcctcgcggctgcgtgtacggggacgggaggaccttcttcctcttcgtgttcatcttcttcttcttcttcctctcttccttcggcttcggcgctggcggctatggatcccaatagcctcaaaactggaggtatgaattattcccacttttttgtaatttttttttctgaaattttatctggtaggagtacttggtagtggtgcgtcgtgaaaggtgggaatatttcccattgatcatagtatttttagaaatctatctattgtactttagaattaaattttccacatagggaaggtgatcatcacactttagattttacaagattattagaatttataattctagttgggtacaaattggttagttagttggtaacttgggtatctacagtattatgtagattagtgagcttgatgttcaacgtgatttctctctcttatgattcacatacctgacagtaaaaaacattttttgttcaggcctcttgcttccgaccattgagaggcaatgtgcttcgcctccatccgtcatcgtgatcggtgggggaatttcaggggttgcagcagcccgtgctctctccaatgcttcgtttgaggtgactgttttggagtccagagatcgcgtaggcggtcgtgtccataccgattactctttcggatgcccaattgatatgggagcctcatggtcagtctcaccctgaattgttagtgtgagaaattcactttagattctgttcatacaagcttacttactgttcattccaaaaattcaggctccacggcgtttgtaatgagaactccttggcaccattgattggctatcttgggctgaaattatatcgcactagtggcgacaactctgttctgtatgatcatgatttagaaaggtaatcttttagctcttgatcttacgcttttctttaccgatccgcacaatccttgttgattcttacatcaactctgtcaattgattctgttacagttatgcactctttgataaggctggccatcaggtctcaaaggagacagttgctaaagttgaagaaacatttgaaagaattcttgatgaggtacataatgaactcatttatacttggtacttctggtgccgtttgaagagcatgttcagttcactatctaatttctgttgcattaatgttccaaaaaaaattttctgttgcattgcagacagttaaagtgcgtgatgagcaggaacatgacatgccccttctacaggcgatttcacttgttcttgagaggcacccccatctgaagtatgcacattcttgtaccatgctatcaatttactcacaacatacttaataaattcctaggatgcatcatgagaggttgactgatatggttaccattatttgtaggttacaagggatagatgatcaagtcttgcaatggtgtgtctgtcggcttgaggcatggtttgctgcagatgctgatgaaatatctctgaaaaactgggatcaggttagctgaaatcagtctatattagcacactgcacattcttatagtgacattagtttgcttagtgaaggatattggtaaattacatcgaattgtttgccatcttgcatagttagttacttatgtttgtattcctcttaactatgcaggagcatgttcttaccggtggccatggtctgatggtgaacggatactatcctataattcaggctcttgcacaaggtctagatatccggcttaatcaaaggtgtgttcttttacctcccgagcatacaaacacaacaattaatttcagcatactgaagtccctttttcagtgtattttggctccacaaaattacttgtcgtttcacttgtcaatattgctaaacagttttgcttactcgcttttgctactgctaaatcttcagggtaaccaaaattgcccgccaattcaatggagtgacagttaccactgaagatggaacaagttactctgccgatgcttgcatcattacagtaccgctcggtgtgctcaaggcaaacataatcaagttcgagcctgagttgccctcatggaagagctctgcaatcgcagaccttggtgtcggtatcgagaacaagatcgccatgcacttcgatacagtcttctggcctaatgttgaggtgctgggaatggttggcccaacgcctaaagcatgtgggtacttcctgaacctccacaaggccaccggcaatccggtcctcgtctacatggccgccggtagatttgctcaagaagtggaaaaactgtcagacaaggaggccgttgatctggtcatgtctcacctgaagaaaatgctacctgacgccactgaacctgtgagtttgccatctcagatcatggccacagttagttccattttcgagttcgcattatctgaatgaattcgttgttcttgcgactgacaatttgcacttgttgatttgtgttattgcagacgaagtatttggtttcacgctggggttctgacccgaactcgctgggttcctactcgtgcgacctggtcgggaagccggccgacgtgtcggcgcggttcgccgcaccggtggagaacctctacttcgccggcgaggcggccagcgccgaccactcggggtccgtccacggcgcctactcgtcggggatcgccgccgccgatgagtgccggaagcgcatcctgatgcagaagggcatccctgacctcgtccaggtcaaggcctacgaggagatggccggagtcattgctccccttcagatttgcaggacctgaaaaaactgaacctgctccaccctgccattgtcatggaatctggattgattcaattgccatgcctatgccctggaatcttgatgattcaatcactcatacaagttcaagttcatgtaggggattaactgcatgaatcaaaattattaattaataattatgtaattgtcatgttattattgaataaataaatcgagatcatgcttgagatctttgtactgggacacagtttcaattaattaatgctagtaacaaccttggagtgaatgaatgtgagtagttgggctggagttgcttgttcgtcttttgctgctgtgattgcaacctgcgagggagaagtgcacggctgtctcgtctcatgcctttgcttgctttgagcctttgaccgtcgccggcggtggatggcagctgacctcgacgtcgacgtggtggaacacaaatttggcgccacgcatagttctgaagatgacaggtcatcttgtgactacaataaaacgctacttccttaaaaaaaattcagtttttaatacaacatttaactctccgttttatttaaaaatcttctaattagtatttttattttcgttagatgataaaatgtaaatagtattttatacgtaactatatttttaaatttttataaatactagaaaaaatgttcgtgctgaagtatattttaattgggtgaagtatattttaattttattattgttatatggattagttaagatgaaatttattgtgggagttcgcttggatatatatttttttagaaaatcatgagctgtggttaggagttcgagatcgtctcaaggtagtatgcgagttttttaaacagacttcttatatgattccttctgtattacaaaaataaataattttaaaaaccgactcaaatatatatatatatgtatttactccatcgtcacttagagatttgggagggagaccggttgagctgacatgtccacgatggcagaatctcccaagattccacgtggaaccctaaccttccctttccaaaaagaaaacgagagcccttttcctattgacgcacgtgagcgcaccgcttaagccacgctacccacgctacgcctctctatacctaacgctttccccgaactccaagagatcaaaaaaaaaaaatctcaaacggcaaagtcaaaaaaatactactactccgacacgaaaaacaaacagaaaatcgggggaaaaaaatctctgtccattcgttcgcttctcccatggcggcgatctcgcgcgcgatccgggcgtgcgccgccgcggggtcccggcggagcatggcgtcgtcggcgaaggaggtggcggcggccggggcgcgggcggcggcggcggtggcgcggcgcgggcgggagcgggagcgggaggaggacgggaggcgcgtgcagtgggtgttcctgggctgccccggggtggggaagggcacctacgccagccgcctctcgcagatgctccgcgtgccccacatcgccaccggcgatctcgtccgcgacgccctcgcctccccgggccccttctccgagcaggtgaaacgccgcctccgtttctctcttcctctctcttggccttcgcccttcgaggtctcacaatgatggtgatggggatggatgataatgaacaagagagcatgcgtttttcagattccaatttcttgctgtcaattgcttttgttaagttgatggatcccctgcatcgagtacggaaaaggctttaagtactaaattgttcttactaaagtcttattatgctataagtaaatctagatttcctctaacccccatctagttaaatcaagcggttaagatcattgtttgtaagagttatgtaagatttttttgtagtacgtgtggttataacaacgaacaggaaaagaatgatccttagggtgcctaaagagatggcttgatgtgagaatagtaatgtattacttctatgtttttcattgttctgtgtctgatccgatttcagcttgcggagattgtgaataatggaaagctagtgtcggatgagatcataataaatcttctgtcaaagcggcttgaagagggagcagaaaagggtgagctgggcttcatccttgatggttttccaagaaccataagacaagcggtgagctagttatttgacctgactgtaagtatgcaaaacacatacttgcaacttctcagtatacaattatgatttgccttcaaatttgcattttcatatttaagaggtgaaatcatatacatagcatgcaatttgatacacataatgtgtaacttgattgctgaggtagtattaatctttggcagttcaacattaagacgctgtgcctttataatcagcttgatctggttactagcagcattttggcgactagacaaatcaatttgttaacctttgcataagttggtagctatgcattagtttacttaggtgtgccataattccataaacggatcagttaagatgctatttttgtgcctatattgcatatatcgttgaggccaacaatcatcaactacttgttaaatcttatccactggaactattttgtgctttggtaggagatacttgaaggagtcacggatattgatttggtcatcaacctcaaactccgagaagaggctctgcttgcaaaatgccttggtagaaggatgtgcagccagtgtggtggaaattttaatgtagcgtccattgatatggagggcgaaaatggtggtcctcgaatgtacatgcctccactactgcctcctccacagtgtgaatcaaagttgataactaggcctgatgatactgaagaggtggtaaaggagcgattgcgtgtttatcatgatttggtatgttctagcttgtgttatttttatttattgaattcctcacttgtaatttgctagtaaaagactaaggctttgtttgtttgggcattcggcagttgcaaattccttgttttccgttagcatgcttcccaaactgataaacaatgtgtttcttttttaaaaaaaaactttttatatagaaatttctttaaaaaacaaataaactcattttttaattttatttatactcaatttatcatgcactaatggcttgtcttattttatgtgcaaatgaaaagctgaataagggaaagtttacatttagtttactttggcatcgtgccgtcctctctaagctgtcatttttgcagtgtgagccagtggaggacttctacagagcacgtggtaaactattggagttcaatctaccaggaggaattccagaatcatggccgaagttactgcaagcattgaatttagaccctggcaatgaaagatctgcagcagcatgatttttgctttaggaatgttcgttatgtatttgtagccctacgccagaagtagttaagtaatgagtattccttgtacctctagaagtagttcaatcgggttaccaaaattatattgatatagcactcaattgtataggtgattcatcatcgatcttgcatgatgccatgatcgatgagtgtgctggttgttattcttaaatgagaaagcttccaataaaccaatacacatttatttgtagccaactatgcttgttgaaagcaacacaaggcaagccttgtgatgacagtaatattttccttgcaactatgcctgtttgaaagcaatacagagcaaccattgtaatgaaattctggtgctattgacacattgagagtgtttgcacatggttctgaaatttcccttgccccaggttgggtcttatctgaatatgcaagtagcctgctgaatactacctccgtcccataataagtcccataataagtgtagccatgagtttctgtgcccaactttaatcgttcgttttatttgaaatttttttataattagtatttttgttgttatgagatgataaaacatgaatagtgctttactcgtgacttatgtttttaatttttttaaaaaaaaatttcaaataagacgaacggtcaaagttggacgcggaaagccatggctgcacttattttgggacggaggaagtacagcagaggtcacagactcagttcaagtagcaaatctgtcttttcgaatgcaatctcctcacggtaagaaatgtgtctacccttttagcaggaaccaaatagtatctggattagaagaaggtatcacggttaaaggcgttaggaattgttatactacagcattggtagcaactcaccgtcacaacgggggtgtagctcatatggtagagcgctcgcttcgcatgcgagaggcacggtgttcgattccccgcacctccaatcttttgatctttttttgatttccattttatcataacttaaaacctgttttttgtttttcattccaccacagcttcatcactcagaacttccatttcatcataacttaaaatctgttttttgttcttttttttcattccaccacagtttcatcacttagaactttattttcttgtgatgaaatgaaatgaaaaacaaagaacttcgtatttaggtagtacaaaattggaataggccgtagaaggtgcctatgattctgggctctggctgtccgctgatccgctggccgtagaagtcaagcccatctcacagtctgcagatcgcttctttttacaacccaacgggccattttcagaggcgtcacccgtaaatccttgggccaatgtgacccaatcaatttcgtgaaaagtactccgtagcaaacaacgcgcgcgcgttccctgcaaaaaacgccggaaaacgcattgccgagcgagccgtttcagcaaataagggatcgttagactttatcagtgactgtatgaaacttttatatatgtgtgtgttcttacgacttaaaagataatgctgaaaaatttatttcaaaatttaaattttggttttgacttattatatatttttggggcaaccgatggggctatgaggctatgagctatccatccatccatagcgcaacgtgtgacagcgtgaggtgacaagatggaaaaccgtgagccgcgccaccggtgtaaaccccctcccttcacgcgcgtttactttgcaagcaaaggacaaggaaaaaagccgtaattggcgaagaatgttcttggatttgattagcagcggtacggtaacacctctagcttgcatttgcatggtagggtgatttggctaggagagcaggatcatccgtgcattcaattttcctcatttctttttgcaggctcaatagaggagaggaggggcctagctagcaccaagataatgcagcaaaaaggagagaagagaacatgtcatccagtccaaagtgcaaacgtctctatacaaatggaacatatggagtggacctaagcctagttgcttctgtgtcccaagctcccaagtgtcaaagccttaatgtgcaaaaccacatctgtggggactcctgaaagcaaactaaatgattgcaaaagagttcgtttattcacctatttatttatttattttattttctttccatgtgtctgttgtttgatactttgattgatcatgtgctaaactgcagaaaaaaccaacaggcccagagtaccggcgaaaaggctcctcgatgaaaagtgcagggattctgggggagttgccagtgcgccaccgttggatttttgcacacatataaacaggggactctgctgcacctctcacacagtaacatatatagggacggttccaccaagcacgtttgggaaatggttttttgagcaacatctcatgcgaacaatttaggcactatttacttgtaccttcaccttgtacgtgtgctccatcccatagctgcattatttgcatcaatcattttaattgcatatatacatactccctctcgtatttattttttttaataaatgacatctttcactttttatcacacgtcttttaataagacgaaatatcaaacgtatgataaaaaaaatcaataacgccatctattaaaagacagattgagtatatgcgagacatttaattatttgccacctctcaacaatttaacactcgtgtgacataggagtagacgcatagggtaacaaattgctaaacgtcaagtaatctatgagtagcaactagcaaatacttaaatatctcctaatatgttagcattgcaccaaagtctataactatattgagctttgtcctgtccatggtaaagtgtggggttaaagtgttaaaaagctattggtagcagtatctagtatggcgtggcaggccggtgcagataaaaggggccccgggttttgcccggaaatgaggagaggacgccccggcagctagcggacgctttgcatttgcatgcatggtgctctctacttctccctccgttcccacggcaaattgcaaaacgcatgctagtatttggcaccattagcctaaggtagtagtatcagcgtgttacagaaagaaaatagttaagtagcagtaattaattaaagcctgtgattaaggtaaagcagcagtgcagttacaaaccgaaacaaacaagagtcagcgaactgaaaagaagaccgggaagaagaagaagaaaaaaaaagacccgaacagagttttgatgagcagtgtcaggtctgtcacatgagaagagagcgaagtagctcagctcagcccccactcgctcacatggaacgcctctgctcgcctcgactacttaaccagctaaacgctcggttgattaggagaggaaaaaaaacgagggaaaaaacgggtggaaacacacgcaaaaacacaacgccgtgcggccttgtaaatacgggcgacgccgacgcgcatcgctccccgaacaccaaacgcctcagcttgccttggctctcgccagtcgctacgcccgcgacgacacgaccgcgccgcgcgcgcgcgagcgagcgagcatgtcgggctcctctgccgacccctcgccatccgcctcgaccgcgggggcggcggtctcgccgctcgcgctgctccgcgcgcacggccacggccacgggcacctgactgctacgccgccgtcgggggcgacggggccggcgcc

SEQ ID NO: 45045 - DNA, 7687 bp, Oryza sativa
cgccgccaccggcggcgcggccgccgccaactccgcccccctcccgtcgtactggacgatggagcggcacgagcgcaaggactgcaacctccccaccaacctggcgccggaggtctacgacgcgctctccgaggtgctctcccgccgcgcggcgcgacgcggcggcgccacgatcgcgcccaccccgccgccaccaccgctcgcgctgccgctgccgccgccgccgccgccctcgccgccgaagcctctcgtcgcgcagcagcagcaccaccatcacggccatcaccaccacccacctcctcctcagccgccgccgtcgtcgctgcagctccctccggcggtcgtggctccgccgccggcgtccgtttccggtaatggtcggtgcgcgcaccgtacacttaatactcatagtagctgttacatcccctcccctccaaaccatttactactgttctctcacactgatatgtgggcccacctcgcagcgagctgagctccgccactatacgttattaaaagcccgcgttatgattgggctagttacgttgttgagttgagctggtcgtaattatttactaccgctacattttttttacctttttaccgtggggttcgggagagggtggtcgcggtaataataatgtcctcaactcaggggttgggagaataaagctgcgtgcagtgtggtgcagttcatgcatgggaaaggtgatgcgaatccggatattttatgggggtttaattgaaagatttactccacgacgatactaccctctactcctgccatgctgcaagcatgcgtaatgcgttacattgcgaaatcactcgctttgaatgaaaaaaaagcctgaaactttggagaaaaaaaaagcaccttttgttttctcctcgtgcatgcatgccgcgctgcgtatcttgaactactttggacttttgtatcgatcaacaaaactatacctatattagcagtaattaatactacatttgtagatatcctttgaccgttctatcttatttttgataattaaaaaaattagttacatttaaaaatgctatttatattttattatctaataacaataagtgtattagttaaatattaaacgttggatatgaatagtttaaaacgttggatatgaatagtttaaaactgtattgttttggggcggagtgagtaattgattgatcgattaattaagtggttgactaatgtgtgtgtgatttatttgtgtagcggaggaggagatgtcggggtcgtcggagtcgggggaggaggaggaggggtcgggcggggagccggaggcgaagcggcggcggctgagccggctggggtcgagcgtggtgaggagcgcgacggtggtggcgaggacgctggtggcgtgcgaggagaagcgggagcgccggcaccgggagctgctgcagctggaggagcggcggctgcgcctcgaggaggagcgcaccgaggtccgccgccagggcttcgccggcctcatcgccgccgtcaacagcctctcctccgccatccacgccctcgtctccgaccaccgcagcggcgactcctccggccgatgatcgccattgcaatcatatgcaatgcagcaaggacgatcgatgtaaataacccatggagatgcatggatcgaggcatcggattattgtttggaatggctgcaagaagaggagtagctatatatttttttttttgagtgtgcatcgccatcgcgtcgtctgcgagtattgggagtacggtgcattgcatgcacaacgcctccgtttcttgatttctttctttctctcctgtgtcctgtgatttttttgttgtttattcttttcgtgcaattagtggagagactggcaggtgtgtggtgtgaatgatcgaaatggttagtgtggctgctgctgctggtgctgttgctgttgctgcgttttttcttctcgggtgttgggtttgtcgtggacggcgatcattagcggcacagtggatgagagagctgagctctagctgcaggtcgcttggtctcgctgcgctgtcatgtgatcactactgcgcatgggggccacggttaccgctatagctgctgcaactgcgtgcgagaacgagctcgtgctgagctatacaagctttgctgctacttctgcttgcttttgtgctatggtggtgttggccgaatcagatcagagtttgtgctaccactttacattcgagattccgcttttgcccccgtggtgtacttgcaatatactccgttcataattaaactaattaacattgaattgaattgtacataacctaatataataaattaaatctgatcatgcatatccaaatttattgtattagattgtgtcacattcaatcttaggttgatttattatgagagtacaaaaatatactccctccgtcctatttttaagtgtaattatgagattttgtgtctaacattagaccgtctgtcttatataaaaaatatgattttttttttaaaaaaagtcacgcataaagtatgttttatctataataaaaataaaagtattaatcaaaaaaaaattaaataagatagatggttaaacttcgttggacaaagaaacacactactgcttttttttttttgacaaaaggagtactagtacagtactacgttcgtgtggtgtaataattgttgagcacaagatagcatgagatcgagcacagcggagtacgtactcatgcaaatcacctgatacgacgacgcccgtccatgtccatcgagtacatggaattgacgtgcattgtaccgatccatgcatgcactggctacactcttctgtcaattaattaatggtatcactagtacggtactctagctagcacaatgttgtgatttgcagatggtaatctgagcaaatgacaattaattgtagggacgtgtgtctctctgcattgccgggtaagccaagtacgctgctcccatttcaagtccggattaatgcaacgcacgcatgcacgcacgcacgcacgcggccaagtgatcaagaccgcgattaccccacagtcccacacgtatctacgctcgccgacacacgcgctaaaccctcactcacctcacctgcttttgctcgcgtgcatgcatgtgtctcgtctcacagcattgaactcctggtcactgcaaacttaactgtggtttaagaaaaaaaaaagtgataagttccatcccttgagggatacaaccttactgtttactatatgttatctaaatagttattaaaaaattaaaaaataataatatagattaatacaaaatatatcacatgcaaaaccaaatttaatttctataagctgcaataaaaagaacaaactaaactgaaaatagttaccgtacattcacgtctacattggttatttttttttacaatttataggagttgaattttaatttgcatatttgtaaagtgatacatttcatattaatctatcttgctaaattttttaattttttttaactatttatatgatatgcacaaaatggaaggatacttcctcgagcggataagttgttctccacatgcataggtcggcggccggatcgaacagccgagctgagcagcagcgaacacacaaccacctctctagtatagctagccctgcatgcacgacacatatattactactagctcgttagtttagagacgatatcgtagacagattaatcatgtggtagtacgtagtacgtgctgattctccaggttaacaaccagctagctctcgtagatgctttgcttacgttacagacagtagtacgtagctcctcgatccctagctagcctgcatgattcctcacgatttgtttcttcttgtgaaaagaatttaattacttatacgaagtacgtagcttgtgttccaccgagaaattaacgcgagaaggaactagtaggggagagattctcttctctggtcgattccactagctactctgctgtgctgcctgtgtggtgggtagcgtagctttgccaaaagctcgcgatcgatggatcatcgcatgggacgcgcgcggtcaaaaaaggctcaaaacgcacacacgattctgcgattctgcgcgggcggcgtggtggtgaggagaaggccgtcgcgcgaggtaggcggccggcgaatcgcggggttggtgcgacggctgcgctttgctgggggatcaaccggcaccgccctgtgctgtactacctgggctattatgctaatctattctagcgagagagggaaggtagagactagagagagagagagagtgggtgtgggtggaccgctgtcttgtcgctttgctcccatcatctcacctcacctcacctcaccgtccccaaaggcagcgcagataggggcatttcggtcttttcattttgggcataaaaacaacctctaattttccattgtcttgcctggttattcaacggcgagaaaccaagttagggagaactgtaaaagaaagtctcagttataaaaagagttaacttctgataataaatctgaccaatatttatcttaattagattcattgttaaaaattagttttttgggacgtaaggtgtacttgtactccttggagatagatttgttttctttctcacatgatgttccctgtttcatgtatgttgtgtaaaaagttaaatttttcaaagaattgaataatacagatcaaaagatagcacatgatatgccactacacaaacatataaattaaaattcaacctataaatttagaaaaagaacccataaactatttattatatattcgtagtcaaatttattaatatttttgcttagcttgtattagttgaatctaatcttataaatatgtttgtgaagtggtatattatatgttgatttatcttattaattttttaactttttaagatgatatattacgacaacacaagttatggtaatctacatcgttcatcaacgctaagcaagcaaacagatcaggttaagatatcaggggtaaagtaaggtgctctcaataaaacatatacatctcagcaatagactagattaataataaaccatctcaatagtatgtctatatgggtatttatacctctttaatccattgcctcgtttttctctatagactatctccaggttagtagatagttttgctttctctcttcatttaatcttttccatataggaaaatatgctgacatggatcttttatatatagtctataagagcacccgcaatgttaaagtaaggtactatttataaaacatatacatctcagcaatagattagattaatagtataccacctcaatagtatatctacacatgagtatctatagctttctaatctattgcctcgtttttctctatagactatctctaggttagtagatagctttgctctctctctcttcatttaatctctttcaagtaagaaaatatgctgatatggatctcttatagagagcctatagataaccattgtgggtgccctaaataactattacggttgacctcatatactgagatggcggcacagcgtataggatagtactcgtacgtttggtggcgatcaggctttaattgattttggtggcgatggcgatgattttggtgtgggagagtgagaggagaggagagtggacaggacactggacactggacacaggcggtggtggtgaggttggcttggagtgctagtactacacgtactactactactactgggagtatatggattcctctccccgctttgtggtgtcagaaaaggccctgacaatctcccctagctgtcatccccgctcagagccgtagtcaaacccccttgaccggacagagtagataccatgccactcaactcactcatatccccgaaatgcccctcccttccaatcacaaaggtatacgtaaccctagttaaggacctgtttcgagaagtttaaaattatgagaaacagaaattaaatggtactctcctcgtttcacaatgtaaattaatttactatttctcacattcatatcgatattaatgaaactaaacatatatatttatctagattcattaacatcaatattaatatagaaaatggtataataacttacgttatgaaatggaggaaatagttagctttaaagaatttaaaaatatttaggtttctcggattctaactcctactttattttctggttctataactatatatatttttagcatctgaattataaactgaagcttcccgaatagggccgagtttagttttaaactttttattcaaactttcaacttttccatcacatcaaaattttcctacacataaacttttaactttttcgtcatatcgttccaatttcaaccaaactttcaattttagcgtgaactaaacacaccctagcatcacgtttagttccaaaatttttcttcaaacttccaacttttccatcacatcaaggtcctgttcactttggtaaagttgccaaaattttggtaatttgctaaaattttagcagaatttcttatatagttaccaaaatttgatagcaaactaaatgtagcaacttttttggtaactttactaaaatttggtaagattgtaaatggcatcaaagtgaacaggtcccaaaacttttctacacacaaacttctaatttttctattacatcgttccaatttcaaccaaatttttagttttgatgtgaattaaacacagtataggtcttaaagctaattccacatgtctctagctagaagtagccactactagtacgagttcaactttgctcctttcaattcacctcaccgatcatatcgatcacccttataattcaccgcccatgcaatgcatagccgcctacgagtagtttttttgacgttacgcttcgttgtcatcttgctgctacagtacagacagggcagtgtgctactaccccctaatctctattgtactacacaatgcattatgcatgtctctaattaagctcaaaaaatcgtaaaatttgtacttctactccttggactacaaatttctcaagagaaaatggtgtggcaacgctggagcaggggggcctacaggtgcgtacttgcaaagagcaaaagcattggagcattggatgctagtagctccactgaaatgggctctagagagagagagagccgcgctctgtaaaaaggcatgcagatgcagtgcgtgggcaggggatccggagctgagcgagctagcggtgcatgcaagctgtaaaaaaaaaaaaggcacagcctgcacgattctccacgcacacacgcacgcacgcacgcacgcacgcacaaggacccccgttcccgttccgtccaacaagtacggtgtacttatatttgccagaaaagagctttgtatgactcagaataaaaaccttaattcgtaagggaatgtttggtggtattttgcctgaattatgtgccacatatacagccccatcgttgggcttatatctggaataagccaaacaacatatttataaacgaaaaataatttataaataaaacttttatatatgtgtccttagtgatctaaaagcacagactgaaaaataaacttctataaaaaaactcaaaatcagctttaaatttaagattaaaaattcaaattttagctgataagtataagcgtaagcgaaaagatgagcccggtagaatggaatgatacatactgtttaactattcattaagaggaagtggaac

SEQ ID NO: 45046 - DNA, 1660 bp, Oryza sativa
ttgaagtgagctgcagaggcaagccgaactgataagtgatatacagtgttcttgcatctaaaaatattagtattttgtattattagtataagactttgactgataaattgctctacttatatactattcatgtgatgaaaagcataatcataaaaagtacttctgaatataaaactattaacaccaatttgatgtcgaaaaattatatgctaatggagtaattatcggtctaaatcatgtcttaacgtaacaaaatatgtcttaattttttgaacaaaaggagcccttaatcttgtgttattagtcgagagatcctggattgattgaccagaatatatagggtcctctagtacgacagtagcatagctagctagtcatacaagaatagaattacgatgctatcttaaacgaccacacacaggagtaattgaaatggagtttactggcagcgagacggtggtactggtacgtcgacggatgcgccggagatggcagcttgtataaatgcaatcccggcccatgggcaggggccaaaccgccaccaatcacccctcctctcctatccgggagggacacgggggccagtgaaaacgaagaagccaagccaaagccaacccacagctgcaataataacgcgtagccacagccactgccgatgccgctgctgcgagagggtgacaccggccaatgcaacagcggcagcagcagcagaagaggcaggcaaatcataaggcttgcccccacgcagctgcgtgccagtcaaacggagccagtcaaaactccaccgttctcttccccacactgtgtttcagccccacacaaacccatccatccagcaccgtacgtgtacttgtccagcaagggtagcggcggtgacagtatatgacattattgtaccatggggagagagataattggctgtgtttagtacacgctgaagtttgaaagtttggttaaaattggtacgatgtgatagaaaagttgtgtgtgtatgaaagatttgatgtgatggaaagttgaaaggttagaaaaaaaaaaacttggttaaaagtttggaaaaaaaactttgaaactaaacagggtagtaatatataggttaggccactgggatgcatcatgggttaaaaaccttgaatgctgcgctggaacgagaattccgtggtagtactgaactttaattttagtcggtagattgtctgtgagagcatggaacatattgtgaattatggatgatagaaaaaactgaattttgtaaccattataggagaaaacaatcaaacgagttaagtattagtagaaagttaataacttggtttagaaaggaataacttatgacaagaaaattttatggacaaattagcatgagatctaacgtcatggaaaatctctgcaatttttcttgcaatctatccaaactgtcgttcgtgtaaaaacataaaatgcttgaaaatccatgttttacatttctatttttcttttaaaattttacatttttcatattaatgtgttttctcattcttgcatttttcttgtgttttatatatatggtcatttctcaaatgtttgaaaatcctcttttatatctgtcctaaatcgtgcgctccttttactacattttcttaatcctacattaaaaaggtggtcttataattaaggaaat

SEQ ID NO: 45047 - DNA, 734 bp, Oryza sativa
atgttaatgaatctagacacacatatatttctagattcattaacatctatatgaatgtgggcaatgctagaaagtcttacattatgaaacggaggaagtataagacagccacttttgcacttgctagtcaagccaaattttgttgatcttaggcacgtttaatatctttaaattatttagatatacaatgaagttacaatgcctgatgtagatttgaaatttttacttagcatgttaacttggccgttttgaggccaacatcaattaagagattcagtttgtagtgtgcacacatggacagggtatgccaagtgtagtactaaaatttaagcagatttttttgcaaccaaatcatagaacggtaagatgaaacttaaatttatattgcttactaaaacttgaatttgtagtgcgcatgcatggatattgattactaaaactaataaataaatcagaattctgagaatatttcttactcccaagggtcgtctccaaggagaagcacatcattctccctgtcgacgaatacaagctgccagcctgatctatcagggtcgtccaattgacccttaatgccgaacatctgacccagttcttctcgaagttcagcataattagagaaccgggttatgtccaacgacctcccaaccgaacctgacttgtaaacctgcaattttacaatggttccatgaaaagaagaatatatattttttggaggaaaaagaggagctcat

SEQ ID NO: 45048 - DNA, 990 bp, Oryza sativa
atatccaataccaccaagctaggaattaattatgagtcatgtaactaatgatgccgagattagtggtagtggccggcaatatgcatccatgaaaccgcttttgtttgtgtggtgtgcaactgtgcatgtatagaagctactagagagacgtgcagttgcgtgctataatgctgcctactacactacgaattagtgtgtgctcacgatcgatctccctagctatatgacgaccagggaccatgcgactgcgagcacacgaacatttgctacgcgtgttgtgtggttgccgatgaacaggcaggcaggccaaagctacaggctactgaaaaacacagagactaatcagatatccctcacctaattcttgaccggccagggcacacgaccagttcaacaaaactgccgtgtaattaggccaaagcgcagtgtgcacaccagcagatatataatactactatcggcagcacatagtactacaagtcgatttgccgtatgccgtcgccggagccgcattacgtgtggcggcgtgtgtcgacgtgcggccgtaccagctgcgggacgtggtcgtgtacacgtgcacgctgcaccctgcaggcctgcaccctgctgtgcgtgcccttcacatgcatgctcgtctctcggtctcgttcccgtacacgtcgcgatgtgaaagagagggggaaaaatgcgtatcgatacgtgaccgtgttgccgtttcttctttcttttttttttccgtgtgtgtcgtttcgttcttgtttgttcgggtcgcggcgcgggagacgagctaacccaacggtgatgatgtcagctgacgtggcgccccggagcggtccagctcagcaccagacaaaagccggagcggcggcgtcccgaggccggcctacgtggcaggaggacgtgggggcccaccgtcgccgcgcggttcgcatccaacggttctttttttgaccgtttgagctttgcgacgccgcatgatgccccccccct

SEQ ID NO: 45049 - DNA, 736 bp, Oryza sativa
tttttagggcatatttggaatgttaccgtacaaatattttgttaatgccaaaatataagcaagttttggcactaccaaatatttggtaaggtaaaattgcatttgatcatatttggtttgctgccaaaatgtaaaattgtagtgaagaatgttgtacataatctcaattgtagattacgtattaccaattaataggcttccattttcatgtgtgctgttgtggactgtgcgcgctactggatatggcactaccgtgaagcgccgaaagtgtgttgttgtgagcataagttgttcgagcacaatacgaatgaaaagaactacgtagacgagacaaacacaagtagtactgcagtagtaatagcaaaagtagtactgctttacaagtttgtaagccaaaagaaacggtcacataaggactgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcctggtggtctgcaccgtgcaagtcgtcgtcgtagaactggctagtaggaccagtcctaccgcgtgagacgaagaggccccagtaccgaagatcccggctgcaaatcctgctggacaaggac

SEQ ID NO: 45050 - DNA, 1116 bp, Oryza sativa
ggccgccaccgtactcgtatattcctctccacccgtgtgtcgcgtcgatcgccgtcggcggcgggcggcggcaacttctggtttatggagaggaacaactagggtgggccggtgattggtccagtttcgactaaacggcccaattggttcatggcccaggcgcatcttaggggttcggagatttcttctccgtaccccgtcgaaacatacgcattcgccgttgtggtgccctcgtatcgtattaccggacacctacgaggaatcatcttcgctgtgtgatgcttggcaactcgccggtgttctttccctcgagggtcggcgcgactacgatgttgtctaccgttcatatcgacgtcgatcatagctccacaatagattagggcactatgtgaaaaaagaaaagcaaaattatgccaaaattaagattaggccaaggattttgagtaagaggtgtgtacaattctcgagtcatgaattcgtgatcatgggcacttcacctcgtagaagttgagattacacactaggctgcgtttggatcctcggcaataaacatactagcctcgcttagtaaggtgagctgtttggcactgcagctaaaatgttgctaccgtgggcaagattacctcattttagctaaaatgtttattgggctttagctgcaatgggctagcccatgcttatcaggctaggaaagccgatcaagggatctgcgcgcgcatggcacgagtagacaccgacctgctcccatcaattccattgacccacggcccaggcaagcccactggcttagctagttagcttctccccaatcctgcagatcttctcgtcttcttcgacggctcaatccaacgcctggtggtctctcttcgtaggggttcgggacttgggaggtctgcgtcgtcgccgttgctggtcgacgaatcgcgtcacccatggcgcataaaggggtaagcctactgtttccatgtatctaaaaattaattgagaagttgtgtcagtattgggacgacctcaaggtgttcgatagaatgcccagaagactcaacatgccgctgcttcgtcctatgcgccaacacaagcttaccacgaacaccaaacacacgaattcaccactct

SEQ ID NO: 45051 - DNA, 2681 bp, Oryza sativa
  unsure (1)..(2681): unsure at all n locations
ccaacggcttgtttgatgggccggttgacgggcccccggccccgctccacngacgctttctgaggccgggtcgccgagaggtgagccggcggcgggcgagtggagatgagcagaggcggagatggggaatcggttgcgacttgcgagctggctaggccgaggcgatacggcgtcgtggtcacgagctgagctcgcgccttcgcgcatgggtgcgtcacggaacaggcaagaagggaacgtacaccttaagatagtttcatactctgtgctgatagaaaataacgaacaccttaaaggcaaggtaacccgcacacaactatactctatgctcatccaaaggtggctttcgtaaaaaaaaaaagagatcatatgtgtacccttatgtgcataccctctaaaatatgctcccctaccataccacactgcatagtaagccaaagcacctgctaatatgtttgaactcacaacaatctatttatcattaataatctacctatttaatatcgaagaaacaagaatacttaaatattgtgtgcaaagataaatcaatagattattagtacttgtttggtgattaaatattgcaacacacagcacagcagtggaaggcagccaacctctagttgctctggtaataaggagctatcgtctcgagagattataacccactcccctctactgggcattctatcgaacactttaaggtcgtcccaatcctgacacaagttctctaagagtttttacattcatgcgaaaagacagtagtaggcttacctctttatgcgccatgggtgatgctcgacagacagggaaacaccgcccaggtgatgctccgaccaacaacggcgacgacgcagacctccgagagaccaccagacgttggattgggaagaagctaaagccaatgggcgtgtctgggccgagggtggtgagctggaggaacaggttctacgtggcggtcaactgggccaccacgctcgtgtgcggcagggacaacatcaggatcggctgatgatgatggtttttggtcgggatttggctggacgtgtgttcagttctctgaataatccacacattctggaagagagggattggaagattctctctcttactacttgtttttctgaactaaatttcatctatgtaagtgatgatttattaatggattaattagatctatatcattaaaattttattggttttgaaatatactgttactttttgcgtatttcaaacgatgccactgctatttgtttgtaatttcattggtgctactaagatacgtattttgtatgtattggacgaaaataccatcatctccttctctctttcccgttgcttctttacatggacatggtcatacgagaagtaggtgtcaaagtacaggcccatctttttctcccccaattcgtaacttcaattttacgatgatgaacagataagagattatctctgcgggctcatcaatcaattcatgtcgggtgaggcgatctctacggctcccgttattacatgcgtgtccctagcagcggtgcgggcagacacccccgtgcgcccgttattacactaaaaactactatgtaaggttgtactctatgagtagtaggtaatggagaaaattatcttaaactagactacggacaccatggggatacttttctgatgattatctgactgacatgtaaataacatttcttcaatgatgaaaacaattttccatactggttattcattccacgcttctagaagtacgatatttttcgtattggttaatggttattcgttccacacttctagaaagtacaataactctaaaaactccctgcatcagtatccgtatcagtctgtttgattggagggagttgttgatggaaaatgggagtattattttcgagagtataagtctgtagtttggttggaatacttgaaaattcgagagtgtttgggagaattaagggtccaattcccaccaatctcttacctagggaggtctgttaattcgtgagatttgaagggaattcaatgtgaaaccaaacaaaggatggagactatgccaaacatgccctacgagttttttttttctctctctcaatcatccagtttaatttgcccttaatcaaagcagggttttatgagctaatcacaccttaatcgacattgagcaattgtacaacggtgccacaaaaaaattcagtgacagaagaaccaaaccttaggttggttggtcggtcagtcagtcactgcagcggcttgaagacctgagagtgcggcgagacgacggcctcctgcaccatcctcctggggtcgccggggtcgcgcacccacttcacctcgctcatgttgggcgtctcgacgaacagcatcgtgaactcgcccaccttctcggcgcggccgcgccgcccggcccgcagcacgaggctgttgctcctgtggtaggagaagatgccgccggtcagccgcacgatgtcgcccggctcgaacgcgtcgcgctcggcgccccacaggaggaagtgcgccgccgccgtctcgtcggccacgagcgccaggcacgtctcctccctcgcgtcggcgcggccgtgcggcggcggcggcggcgccctgccgccttgtcgagcacgatgaacgtcgtgttcacgtgttggtggccgccggggcgaggtctttgagcttcaccgtgctgc

SEQ ID NO: 45052 - DNA, 1164 bp, Oryza sativa
ttttgaaagatgatccatcagcccgtaccagctgggttgtcttctaatttttcatcagcaaatggcccaaaagaccatatcagaattggaccaactcagcagcagcagcaaatggcttcctcctcatgcagaaacaattctattcccatagtgtgattgataacgattttcaagcgcaattgcgcaatggaaggcctagaatggatgcaaaggcgagatctcagttgcttccacgctattggcctagaataacagatcaagagctacagcacctatctggagagtatccaaaaaattctatgtatcttcatcagcaatttcctctagataatatagatttactagtaaatactgtcatttttttcacgtgtttttttttgtttaaactcttgcctgttcttaagtgtttccttaaccctccaacagctcaaattctgttattacccctttgtttgagaaaatgttaagtgctagtgatgctggacggattggtcgtttggtgttgccaaagaaatgtgctgaggtgagttattcagttatcgttttaaactgtcttttcttttattagattgtattactgaactgtttattatgctaggcttgccatgcatgggatctgccctcattagtgtttactaataacccatgtatgatgtatggttatataatctgtccttttacttttactaggttttgcaacttatcccgagtcatgcacagatatttgacataatctcgtgatttggttatatatatgtgaataagcttgtgatttaaaactaatctgatgtatgggaacttctatagaaatgtgggttatttagaattaccagcaactattgccttcattttagttgttttaaccaaaagtgggttgaaatcagttgatgctacattataattggatgtgcagtcattttacatactttgctgatcacctccaattttgtttattttattgcataaatactcttctaacaaaaaaaaaagtttcgaataggcgtacttccctgccatctctcaggcagaagggcttcccttaaaagttcaggatgctactggtaagaatgggtgttccagttccgcttttggcccaataataacagcaggatgtatgtattggagggtgtcacaccttgcattcaatcgatgcagttacaagca

SEQ ID NO: 45053 - DNA, 1124 bp, Oryza sativa
  unsure (1)..(1124): unsure at all n locations
ttaagaaatctttctttttggaagaaaactataactctaaatttcttcaacaaaactaattggttgtgcctaacaacagaggctagagatgtaagccattcccgttatctttaagaaaattattctaaacttcttttttgaaggaaattaccaatttaaccacagagcaactgtcagaaatagggagcattaagtgccatatttgaagtagcaatcagtgataaattgataatgatgttaagatatattgattgcaaaattaagatggtagtactttcggcatgatttttactgtactcacaaatagtccagttgaggtatggcactcagatcaggaatagcaccctgcaaactgcagtttcgaagactcctgatgtgacaagaaatattatcctcagcataacaacacagtatttagacatatatagtagagagagaacatatagtgctcacagtttaaatagtccggacatgttgtaatacagagtagggatggaactcccgctgaagttattattgtcagcctgactagaaacagaaaaaaaatacgaatataagaaacaggtgtatgctatcatagcaagctattttcaattgagtttgacaattgacaatggatacatacagtattttcaagctttttgccgcagctagttctggaggaagaggcccagacaaattgttgttatcaacaaggctgcaaagttttagttagagtatataataagattaattccatgttacctgatacaacatgcattagaaaaaaatgcaaccaataggcttccacttacaggtgcaaaagtgtattcagtctggacaattcggacgggatttgcccacttaatgaattattattcatgtgactgaaatgaaaggggaaattgagtctagcactgaattcagattgaagaacaaagcaggaacaaaatggaaatgaacaatccttacagatgcttcacacttcttaagttggcaaatgatttaggtattgcgccggatagatggttttggtcaacctgtaaccttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45054 - DNA, 790 bp, Oryza sativa
aaagaggagaagattctccggaatcagtggaagtagtgcagtagctattgactgggatttttgtaagcccggtcaataggttcccctgtacccttggagagaccctgcaagtgcacacagatcacgtatatatccacatgcctatatgtgcatagatcacataggcacgcatcaaaagctttttaatcctagctagcttactttaatctttgattattttcaatagaaatttaatgacgtttaacttgattcatcattcggcgacgtctcttgaacatgttaaaggctgggccgaggcccaccaaaaacggaggcccatgagcaaatttcaaattctgactcgcgcgcggtggcggcaaaattttgcaggcgagacgtacctgtactggctgcggcggcggccggcgctgtacgtgacggacccggagctcatcggcgagatcgggcggtgcgtgtcgctcgacatgggcaagcccaagtacctccagaaaggccaggagccactcttcggcggcggcgtcctcaaggccaacggcgcgtgctgggcgcgccagcgcaaggtcatcgcgccggagttctacatggcccgtgtcagggccatggtccagctcatggtcgacgccgcgcagccgctgatcgcctcctgggaatccaggatcgacgccgctggaggcgcggcggcggcggaggtcgtcgtcgacggcgacctccggagcttctccttcgatgtgatatcgcgggcttgctttgggagtgatttactcgagggggagggagatcttcctccgcc

SEQ ID NO: 45055 - DNA, 10292 bp, Oryza sativa
  unsure (1)..(10292): unsure at all n locations
aaattgaaggtcacaactgcatcaccatctactataggcccaacagccttgtcactatcgtcaacaatcacaaatgggggaagatactgatcattagccttggtctctgaccggagtgttttcacagcttcaacagcgttttggaacttgtgaggtgcttctccaagcacctgagcatcccatccacgtttaacaacatcccagtcattctgcaaaattgagatattaaacaaatagttcaatacttccattagtacatattatcccaagtcagaaagagttgcaataaaaacagaatgcagctgagagataagatatgagcaatccaaactgacagagaggaaggagggtattcatacctcatatcggtccatggtaacatacatccttccaccacctgatgcaatgcacgcatcaatgcccttggcacgcagttgagaaagatcattctctagcgtttcaacaaaaccaacgcttgtgccatccaaaacatcacgtccatcagtaagaatgtgaacacggatttttttcgctccattcgcacttgcaccattcaggagcaactataaacaggaatgacaaaagacaaaaagaattagatactggacagatcaacatgttgtaaagaaacattagtgcctcatactatacaagatgatagcaaactatagaaaagagtacttttatacctgcaactggtcaagccgtgagtggacacctccgtcgctcaacaacccaataagatgaagagtgccttggtcaaaactctccttaatgtacttaaacccttctccttcaaaaatttttccagaggccaaagcagtatccacaagtttagccctacaaaagaaaatggagaacatggtatatttagaggcttaagtctgaggcttctaacttctttcttaaaagaatgatttcatatacggcataatggcaatgtctaaaaggcaccacatggatttagtaatttaaagagaaaatttggaataacttgaagtacacagcaccacgagtagttggcatgccttcaaaaagtcgctgcatgtcaagtataacatacaactcaaacagttgttcataaaagaactacccttcatctctaaagtttgtaaatcagtacacgggatatctttttagttagtactagtagctgctaaaggaagtgcatgatttgtataataacatgagatagtaatgatgatatctctttcatgctcatgtggtaatccacatcatttggagagatctgtgtaaatctaacacttaagatgccaaaaggaaccaatggttgccatttgattttactaaatctggcacacaaataagccaagcaacagaaacctgatgtaataagacctttagaaacaaacgcaatactttttggccatccacagattataactgacagtgtgctaataaaaaagagaaccaggagaaacatgtacccttgagcaaaaatccgaccagcaccaagtgcgttatgcccaacctcactgttacccatgtcatcatcagaagggagaccaacagctgttccatgagcctttacaagcttccacttctctggagcacccttgaaacatagaaaacaagataaaccatgaagttaagtaaaagggtaagaacaatcatcataaagcgtttcaacaatatcatactaaacttgttctaatatatgtcgcaaacaaggtcagaatccattgcctacaactcataatggaatgttagtatgcacggaacatgcaaagacagtgatccaggtaccatacttaacgagtacagtatttcttcactgtgacaatttgtctaaaaataccaaccataccacccacaaaatgtactagagtcaatttactaagacaactacatgaaggagaagcccctagcaaaggtagggcgaagataattggttggaggaaacaaagaatttgtgcttcaggtttcacctgtcacctaaccaccacagattcttcaaaaacaatacacagcaaattacatctatggtggctaacctccaaggccttaactacatactaaaagctaagaaaatataccttcttgagcgaatccattgttggtgtctcagcaacatggatgcagttatactggtccgcatcagcctcaccccatccatccagtacaaccacggccaccggcttccccttagggagctttgggtgatcaggcaatgtccacgagaaatctgagcttcccatcaccaactaaacctaccaaaatcacagatataaagaaatcaaagttagaacatgaaattaaccatctcagaacacatacctgccacacacacacacacaaaaaaaaaaagaacaacaatgtcgcagcaatcccgttctaaccatcacatctcaacaaggtggctatcaagagcgaaccctaggtactcttcttatgggctcttcatgggctattcatgggccattatactaccgttaatcacagccgttggatttctttctcttcccaaaccctaattccccccccccccccaatcctctcgtctactcgacgccgcaacgcgtgcggcgcgcagccgcgcgcctccgccgcctcgtccgtgccttctcacctctctcctcgcgagctcatctcactaagtaacagtgtattgtattgctagtaacaattacagaagtagttggttaatctgcagctgatctcctatcctactcgaagcgatctatagagatcaaaaggggtattcccaaatagggcttagcatcacacattctccagaatcgttcgactcgaacaaaatcaaaccattctccaatcttaatctccatctctaaaccgcacaaaaatgcatctgcattggaatcagactatcgcgcacgcataggcaccgatttggttaaacaagccaaaaaataaaaaaggcaaaatagagcgcaaaaatgtgagggaaacaaatttaccagatctacactacaacagatttctgggggtagggaacaatccaagttaaccagattggagaaatcatagaaaaaaaatcgagcggagagttcaaagcgaggtgagatcgagaagattaccggaagagagactgttttttttttctccttttttttcgttgctatatttttctctggatgccggatgatatgaagccgcttggcttggagaggaggaaggtcgatataaatagagcgagtgcgattctcttctggtatttttgcagattagcccacaagattagctcgatggcaaatacgcccttccgagaaaaaaaaagcccttaattaccatgtttaactgctgctccgtacgaaattgactagagaatgagaaaacagctttgaactctgtgccttaattttacttttgaaattagaaatgtggtacgagttgtataaagagttcgtggaaatattattatgcgatgcgcaaagacgacttgatctcttgctatgcatgatcgacatatttagttaattaatgcttataattactaaattcaatgtttgacgcaattataaaaccagcttatctggcctcatgctttagatcggagatgatgtatttaccggttcataaaatataaggtgcattaggtttttacacgttattttaatgttgagttttgaatctctcattgacaactatgaaattaacatagcaagaattactttcaatgcaatattagcttaaatttttagaaaatacttctaaatattgacttatcctgttatccttaaattcgtgtctcgtacgcattgcctccttggcggcagcaccgctacagacctacagttaccgagtcccctgtgtcagttgaacccgacgaaattcctaaatacgctacgtaaaatgaaataatggataagcacatgattaattaagattatatttgacatagcttcgaatcgaaaatactttagagctggatatttttaactccatgaatctatggatctgaatttacgattacattgataatacatgtatgaatctattttttattttaaataaaatatgagaatttatatcactacagtttaatatacaaacttcaaatccatcgtgaaatgtcaaatagtatctaagtattagctttaaaaatttaaaaatgaattaatactttttaagataatttttctatagatttcttggtaatcgtgtacgaacgaactaagcaaatttggtttaccgtgcgtccgtgccatgcaatgaagcatcatccgtccaaggcgtgcaaatcacaggccaggattagggtccattcggccattcccccaaaccaaattaggcctactccatcctgatgaaattggtcgcctcaattccgccttacaacattttggcccacagatatttttccctcacgcgaggcgctcaacggagagaacttgtggcccaagacaaatggcccaatataaaaggcctaatctcatcgcttggtggcccaagccacccacctctgctatcttccaaaccaaactttcctccttccgcttccaaatcaatccccacagcgcagcagcgcacctccgcctcctcgccaccggcaagccgcacctccgcctccgcctccggcctctccaatggacgcgctatggtgcgacctcaacgccgacgtcctccgcctcgtccacaagcgcctcccgtgcctcgtcgaccggcgcaacatgcgccgagcctgcaagtcctggcgagctgccgtcgcggcgccggcgccgccgcagcagcgcccggtcccgtggatcctcgtgccgagcgccggcggccctaccttctcgtgcgccgtcggcggctgccgcagacacgacttcggcgtcccggactacgcgcgcgaggcgcgctacttcggcacgtacagcggcggctggctcttcctcaacttcggcaacacccgcggccacggccggcacgtcctcctcagcctccgcaccaagtaccgcatcggcctccccggaattgtctacctccacctgaatcctgaattcatcagggacatggtcatgatagccgcgaccctctcctcgccgccggaggacgagcactgcatcggcgccgccatcagctcgtactggccgcccgggatgaatggtgcacgcgtgcacgcgttctggcgcatgcggcgtcaggtcgctgtgatgccgactgctatcgagggcgtcatcggaccaattctggaggatgtcatacaccacaaggaagccttctatttcctcaccgcgcaagagcacctccatgttttcgcgctaccggagttccgagtaaaccgtcgcggccatctgcatatagcacccatggagattcgcagcttcccgcatgatggtcgtgattacgacggacgcgccgttgctcgctacctggtggagtcccgcgagaatctcctgatggtggtcaggttcgtctctgatcctccccaaatgccaccgaggacgtcggcattcaaggtgttcgagatggtggagctgcccatcaacaacggcgaggcccggtacgcgtggaacgagctggaatcgctgggtgggaggatgctgttcgtcgcgcgaggctgctcaaaatcctacgaggtggccgattacccggggttggggttcagcgccggcgtctacttcctggacgacgggagaatctacgacgagttcacggtcctcgatgacaccgcacggcgctacccctgcagagacagcggcaagtggctgctgggggcggcggaggcggacaacttcttgccggagcaagccctgtcgagctactcaccgccggcttggcttctcccctgagcgtgtgctcatgttagtttgatcgtcgtggcacaggtaatgtttgctgccgatcttgttgaaatctgcttacagcgagttgtaacagttgatattttcattcgtgatctgattttgcggctgttgatttgtccagttagtataatccatgatgtttcattctatttcgagccttcgaggcccattcgttcttgcaattgcccggccatcttttctgtaccttctgctaattttcgatgcttcgtgatttcagaatggagaaatggttgacttggattgcattagtgcatcattgtattacagtcgattctgcagtgtgagaatgcgtttagttaacaccagcacttgcctttttcttttctttttttttgaagaaaaggcaagctgccaattttcattgaatagaggagtaaaactgtacaaaggcgaaaacgagctcaggacctttggtccgagctaactaaaagaaagccaattatgaagatttttcgcgcccgctaaggcccaagttttggcctcttccttgattttagctagaagggaggtggtcgatagctctttttgctgaaaggttctgcggtttctcttagtccagatctcccatgcgaccagcaggatcagtgtgcgaagagccttcttgggtgcctcctggatgtttaaggtagcctcccaccattctaacaccgtggaggtttgctgccaccgacatggtttcaacccctcacacgccgtccattccgcaattgcctcccagattctctttgtgtatctacaacccgcgaggaggtgtagggcagtttcttgagatcgacgacataagggacatatggaaccgtttggccatcctctggttgctagtctgtcggaggtccatactctgtttggatgattagccatgcgaaggttttgtgttttcgtggcgcccaggtcttccaaattaggttattaaagttggtggctgtggtgccgaggagttgcacattgtaggccgacgttgccgtgtattcaccatggctggtaagcttccatgttattttgtcatcctcttgctcttctagttgtagtgtctgagtggcggtccagattgtgacaagttggtcaattaagtctgtcgtccatcctgcatttgacggcaggtccaaatcatgaatccattggtcggattgcaaggcttgctggatcgtcttgttctttttcttggatgctgcatagactagaggagctacatctttcattctccttccttcccaccaggccgaatcccagaagcttgtcttctcaccgtttccaattgttatgaaggtggccgccgcaaaacggagtttgtcggtgtcgtcacatggtgtgccggttcccacccaggctttttccgatgatttccattcatgccaaagccaatgcagacgcaaagctctcgcgaacttttctaagtttaggatgcccagacctccggaggcagtgggaaggcaggttcgtgtccaattgactttacattttccccccgtcaaagcttcctcgcccgcccagaggaacttccttctttgcttgtctagaacctcgagggactccttggacgcttttagtcctgtcagaaggaagacaggctgcgaagtgagcaccacctttaccagggtagaacgtcccgtgagcccgacgtgcttccctcgccagccagcaatacgactcatcaatttgtcatagagaggttggagatcgactttgcgcagtcggcctgttgtcaagggaagtccaagatacttcaatggcaggtttgctctggttgttggcgtgtcatggaggatgtcgtctaaatccaggttttcgcacctgatcggagccacatgtgatttttgaaggttcgtgcataagccagttgcttgaccaaagcgaccaaggagatcggtgaaggcttgtacattttctttgttcgggtttatgaagactgctgcgtcatctgcgtacatagaagtacggaagcgtactgctctcccccgcagtttgcttatcacccctagttcagtggccatgtccaataaacgttggagggggtcaatcgctaggatgaagagtagaggtgatagagggtctccctaccgtaatcctttgccatgctgattgcctctcctggtgtgccattcaggacgatctttgaggcggaagctgaaagtaggcccgttatccattcacgccattttggtgggaaacctatgttttgcaagagtgcgaggaggtagtcccacctgaccgaatcgaaggctttggatatgtctagcttgaagaggaggatcggtcgtttggtcctgtgatgcttcctgaccatgtttcttacatacataaagttgtcatgtatgcttctccctcgaatgaaggcgctttgattcatcgaaatcagcgagtgcattaggggccgtaagcggattgctagcaccttgtaaaagagcttcccgaagccatgaacaaggcttataggtctataatcttctattccttccactccttcttttttggggattaggaccacattggcagaattcaggaggctgaaatgcttgttccttgcatcatgcagtgcattaaaagcggccaccacatcgttttttatgatgccccaacacgacttgaagaacttccccgtgaagccatctgggcctggagctttgtcggcaggcatttcttttatcgctttgtgaatctctgcctcagtgaaaggatcatcaagcccggagaggtcaagcggtgtgtaccctaattccggccagttgaggtcgcaggaccttggctccggttgccccatcacatgttggaagtgttcggcgatgacaagttctttttctgcgtgcgtgacagcccaaccattttgcttctttaggcggtggatgtgatttttccttttccttgcattaatcttgcgatgaaaaaactttgtgttggcatctccttctttgatgttagtgatgcgcgcggcttgcttcttccttgctctctcaataactgcaaagccgaggagcctcctcttgaggcccatacgcagcctgtactctgcttgtgtcagctcacggtgctcctgtgctacatcaagacggtacttggctttttcttaatctaaccatgctttgcatcaactgaatttcaacgaagatgaattgcatctcttcagaggatccaagcagaatccttccaacgggtgctacaaatttcatactactacgcagtccttttcacctgttcataacttccaatgggttctgaatttactgataattaacaatgagatgacactatatacaaggagtactaatattgttcttaagacttgctattacaggtattctttcagcagtactctatagtccatagcagaaaacgcttctgaatcagatttacatgaatgcaattttatatctgatctgatgaattccatgaagtcataaaattgctattcatgacatgaattgcattagcgcaacattgtattgctgtcagttataatgcaatttgaaaatgtgctcaattagcagtgcttaatttccaagatagaagcatgttttgcatgaaatgtatttgcattgaaggtgaattattgcttctacagcctgctttcagttgcttgttaactgcccaagatgggactgaggctggctacagcctctcttttgaaggacatggattgcatatatttcataactcaactgctagtcttcttcacttgttcataattgtgattccaagcttctcaaaatatccgaactgagatattttcagcatcagtttgagaagcttggcatcaccgtcgaactactactcactgccggcttggtttcccaagtaagatgagctttctgccgatcgatctggatgagatgtgcttgcctcacatcgaggcgtccgtgtgatgttgttgtcgtgctgatcagtgaactgtttttgttgtttccgttccagctctgaaccttttctgtttttctttgagccaacttctgaagttcacatatttgcagttgttgattgtccagtaatccagttagtacaatgtacttgcaatgctggacctatcataacatcttcaagtattttagtttctggtatgggttggattgcattagtgcaccatgctgcatatataaagtggattttcaatgaggaggaattgtttctgcagctttctttcagttgcttcaattctcttctgaggagatctagtcagaaattcagaatccttggtggatgctacaagttagtttcaacactcagcttcttaatttgttatactgagataacatcgtcatcatgcaccggtttgagctacctgtgcaagaagtannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45056 - DNA, 42367 bp, Oryza sativa
cagaataaagaggagaatgctttcccccgggcactcgacgggccagggaaatatcggtcgctccaaatggtggaccagggttgtgttgaccacaagattttttctcaagatgagcaattacctttttctctcttctcttgctctatcccagttccatgcatgcatgcataaacgcatgcgggctaacaaaatgcatgttgttttgctaacaaaatgcgtgcatgcattaaatctattagcatgttctaaatattttctctaaaattatttattcgatcaacgatccgatcactgctatatttggtgcaattaaatctttacaacaagatgtcatatgattatattacaattaaaaaagaaggtttagaccattgtttttttatgtttcacgtgtcagatgccaacgtttcaattggaatttaaatttgttccacattttaagttttttgtgttggaaagagttgttctttatgttgcgtacgatgctatttgggtgtttcaataagtattttctagtatttcactagttcatttgcaaatgttgcacttcagtgtggtgtttttgggtgttccagtaagtagtttgggatgtttcaaaaattacaaatcaatgtttcatgcgtgatataaaaaatgtttcaattagaaatattataatatattttttgtcataaaaatataatcatgtgagatctcattataaatatttaattataacaaatataacggtgcaaatagattatgaatcagataagtaatgtaaaagaaaaggtgatttaaagatccactaaataaatcaattttagatggaggtaaagggtttggctactcagttttagatggaggtaaagggtttggctgctacaacatgtattaatgcagcatgtatgttctatgatacgctttaattaattggcatgatacatgcaacctttgctgggagccaaccagccagaggcatggggtgtccgatttttttgggtaaaaatcgcacgcccgacgcgtagtggctctagaataaaaaattccctattactcttaagtttcagaataaaaaatgacagaattattgtcatggacattgggctagaggcccgtggggccagcttctggcaagtggatagttcaatgggtactgtagcagcaggttaggagtagataatattagattgggttagttaattaagggtaagtctcaccagctacataactgttccggtaagcaatgttcttctttctaacctaagtcctcatcccctcatcgcagtgattatcctgtcatggcctcaggtcatgacatttatcaacatgatatccacactagtttataaacatcaaggctggcatttactgacagactacagataagggcaatggggcatcttatcctgtcatggcctcaggtcatgacatttatcaacatgatatccacactagtttataaacatcaaggctggcatttactgacagactacagataagggcaatggggcatctatcttacttgtcatgtttgtgttgatgcattagcactcttgtgttaaatgatcccttctaggatacctttgcaagaaactatcaaggatcaaaaatcggctaaacagaaaacatcaaaatactgaacgtggaaattgaatttggccaattactgcctagtttgtctggttttcagccagttaccacccagaatcgctgcctttgtctggttctcagtataacactgattttgtttgaatccacttgtctttctaacaccaaatactaacacatatcaatgggtactaatcaaatcaattatcaatacaaactagccaaaaagaaatcaataatatggttagtgtttgcatgcttaaatttttcatgctaggaaatttgtgaggtccaaattaccatgaaacatgtcattgaatccaatataaagtatagtaccttaaatctgtctggttcagccaattcaaagaccaatgaatcaccatcttccaagttgtggtgcatcgcaaaacctctccatccaccacttaggcctgtacggttcccaatgtagacagaatcaaattcaccaccctcttcatcctccaagaccatcttatactctttgggaggcagatgcaatttgcagaatctagttggaagacccttgtaggatggaaaagaaacatagctatgagtactcattgatcataatatttttaacaaaattagttaatgaattccatacaacgaaaccttacaagccaaaagcagctggacacatgtgatcgaaccatggtcttaacaaacgacgggttctcagggtctagactattttgaagtctctcagcttttttgaaagcacgttgttgctgttcataagaggcaactcttccggtgtaatccctcccctgctctgtgctcctaatcctactgcccctgttcaacacaagcaagtagccaattatattgcctggccacagccacaactatcacaaatctgtaaaccatatggaagtattaccttctacggcatagaaaactgttgagttcatcaaactggcacaataaaaagagcacaacttagtaccaacatttgcatgaaaataatctttcatcacttcacgaacaaaacaaagcttccttgcgctttaactctaagtaattattccctccgtttcatattataagtcgttttgactttttttcctagtcaaacttctttaagtttgaccaaatttataggaaaaatttagcaatattttgtacataaaatgaacatattaacaaaatatatggaatgttagtttaaatgaaactaggatcatgtcattaaggattcatttgggattgtaacccatataaaaaactggactcacaaacttgttctagaacatgactacagtatctgaatagacatcgcaaaatttcttcctaaatccccaacaaaagcaacactaccaatcaaatagcactagctttgaagtggaccaactcacattctctttgtacgaaaccgagttgcgcgccctcgatgaacgcctcacttcagtggccccaacctcaaacttcttccgcggcttggggctggcacgagtgctctgcaagaagacccagagtaaatcaatccacgataccagcaacccaaatcccccgcgtgtagcataggttgccgtaatcaccttctgcaatctcgccgcctccagcaagctcttggacatcttctttatgcccagatcctgcgcagaatcaagcaccgaaatttcaaccaaaaagaaaaaaagaaagataaattgatgctgcgacagtgcatccaatccacacggaatcggcaaaggggaatgcgtggaatcccgcacgaacatccatcctctaaacgaatcaggttctaccggtggaaaaaaagcacctcaaatctatccacgatccacaacgaggaacggagaaagagatgagagccaaaaaaaaaaaaaatctgaaacgcttgtgtgcacgggcgggcgggctcacctcgaggtgcttgaggttctcgaggacccgcttccggcgctcctcctcgtaggcggcgccggcggccgcgctgccggcctccgccgccatggctcctcctccctccgccgaaacccttcttctcccctgcacgcgactacgcgaggaggaaatgggtctctctcttctcctctccgagagaaaaaaaaatactaagagaaaggaaagagacagtggagtcgcttgttgccttttggagacgggcaccctctgggctgaatttgaaatttcgaattccaacttttgatgcctcggggttcgtgcgggggaatccgacgggccgtacggatggtgggcccgctggcagccttcagctgacacgtggcggtgccattctggggtgcgcggcacgtggggccataaaacagcctcgtgcttttgcgggtctcctcgcctcctcctcgtcctagcgaggagcttagggtgcgcatccatctgccactcacgcgaaaagcccagctggcaccatgtagcaccggtccagctaagagcactgtgagaggcctaacagaaccaaccgatacgctaatatgaatcccagcatttcgacctcacatgatcaatactccttctgtcccataatataagagattttgagtttttcttacaacgtttaaccactcgtcttattcaaaattttttgaaattattatttattttatttgtaacttactttattatttacagtactttaagcacaccttttcgttttctatatttaaaaaaaattaaataagacgagtggtcaaacgttgcaagcaaaaactgaaaataacttatattgtagaatggagggagcagaaggtagtatagtcttccaatatctattactacataaatgtcaagtagcaccaaagtacagtggccttgatctctctactaagacataaattaaagtagttcatgtagtatctgcaacaataaaagctactacctccatcccataataattacatttctagaaaattagagacaaattaacaacaaacacaatttaccacaataaccctatttaataactatgctgcatacgtatattccatatgtatacttgattaataggaaggttgaggaacacattccatatgtaaacttaattaaaagaaaggtttgggtacacattccatttgttgcgtcccatcttatcagaaatacaatatttttaggacaaaatttaaatggtagaaatgtaattataataggatggaggtagtaaatcacacgtagcattgatatgtgtctcaatggatcaaagcggtactgatatgaaagccaagtaacatgtatccctgtcatggatcgaagcactactcaatggagtagtattcctgacatctatcccaatagacaagtaaccctcacactatacgctatgtcatatcacaactacttcatctataagtaaacacatggcatctacaagtaactccctcacatggatgtgtctgacacctatccatgtgaccaaaaaaacattgtgactccaaaaaggtggcttgcactgcccaaaaaattgactcctttaccgacctgcatcaaacaaataaattttcagtgctagctgagtttttctacaagtgtcctcagttaacgaggacactctagaagtgtcttacattgtggatgccttaaggggattagcagtgcgccacctatttttctcagcctggggctgtcacataggacgaagacacaagaagaataatacttgccacaagtctcacagtgctacatagcctcaaagagtagccacacaaataaaaaaaatcatttctttctcccttatcctcagtccgctccccacctacgcgcgcttctccatctccgcccacgcgcctcgccccttctcctctcgccgcacttccccttcctcctccggcgcggcggcggcgccgaaccacccagttgcggcgtcgagcggcgcggcggacgggcggcagcgtggagcagcgcagtggaagggtggcggcacgaacggcccgagcggcaacgccagaactggtcaacggggtggctcaagcgcctcccctcctcctcctcttctggcgccgcggatcgaggggcagcggcggcggccggcgggacggcccgagcggcggcggggtggtcgagcggcggctcacatgatcaatactccctccggccacctccctcggctccctcccctccccgtcccctccggcggcgctgggcacaggcctcaccctctcctcttcccggcggacgacggtggcggcgccgccgagctcgccagatccgtcctcggatggcggcggcgccgagctcgctagatctgccttcggtcggcagcaatgacgacgatggtagtggtccatctttccttcctcccttctctccggcgagctcgggtggtggcctcgccggcgacgcccgtcgcccccttgcatggggccatgccctcttcggcgatgctctcctctccccggcagcgtcgggcggtggaagcgagcggggtttggggcggtaggacgacacggcccacgagtgtgggccccacctgtgaaacaaaggaggaacggggagccaaagttggctccacggtcttgggcaagccgcgtggattgccgacgtggggacgaatattccgtttctaggggtgaggctgaatgccacatgggagcattgtgaatggcctaagagcaagtttaatagtataatcaactactaactccaaatcatctatatccaatgtaatagccaatttatacaatagttgcttgctacactattaatatctggtcccacctatcatacacatattacgtcttggagtccgtgctgcagctggctacagatatgtagcccgcttctcttctctctctttttttatctctttaaaatatgtttatagctggcttatagtctgctattgtacctggcttataactactggcgatcaaacactaaagcaatcactataaacaaatagactatagtgaataatgatcatgtatgctaattagaaactaaccaagaagtaattctcactaagcaaatcttaattactcataatgatatttctattaaagcagagtaattaacaagatacaaaagtaggaggagattaccgacaactccgggatttctccgatttcttctaccttactctctccctattctaatatacaataaagtacactagagcctcttgtaattcagctcatgctttggtggttcgtcacccgcatccaaatatacaccaacacttgtgtaaatggttagaaataaatcctaccactacgttggatgctttacttttatggttttatgcaggtattgacggcgttaatttggtatttaacagccgtcaacaacgggatctctcctagatattcgttcgacagcatctacctctcctacgacggcgtaatttggcgtaagtaagtatatgtggtattttcactcaaagcagtttggaatatagggtttccccaaaaaagggagcttttttactatcagtttttataaatttgtacagtttaatatcacaatatttatggtttttatattctccacgcgaagtattttaatagtatataatccacatgttattaaactatataaatttctaaaattgctagtcaaaagatagaaatttcgacttataacaaagaatgacgatcgatttaaaacgcaagtactaattgttgagaaaaaaatactgcggtaaacacacagacacgctatttctactagcacatttgacaatatgggccaacatatcccatgatcaaccacgtgtcaacgagtactctacttataactaaagaattagttagccgtaaatataaacacccacgtaaatctgaggagaactgaggaacttatcatcccttattgatagagatactaaggagtaaggacttccgttattgataaagaaaaaaatggtgagaaaatatacgctcaaagggattcgaactaaataggcgtgctgctcctagcagctccctgctagtcaagctaggccccgctctcaaatctatgagttaaaacttaaatagactgacttcaccataaaaaaactaacagagttatgctctgttcgctgcattgttaactcatcttggttggaagacatttttagctaatgacaaataacatacaagttaacgtccgtgtaactttcaaaagataatttgaggataatcttttatacttctaagtaacaaacttagtatttcatattggcacatcctaatactacgaatttggactatcgtactaggttaattatattatgggacggagggagtaagccgcagctgagttgcttcagtgcaggcgaccagaatgatccacaagtctacagtatcatatcaaatctgaattgttgaggactcatttggatcacataaattttacagcattcttttataggatttagcccaatacctccaaaattactttgaaattcctccctttttgcaggcgtttcgtcttctcgctttgaaagccttgttcagcttagctaaaagaaagtttagaagagcattgtgaatctaaacgggggaataagcctcatatcatctactccctccgtcccataatataaagaattttgagtttttgcttgtattgtttgaccactcgtcttattcaaaaatttttgaaattattatttatttttttatgacttactttattatccaaaatactttaagcataatttttctttttttttgtatttgtacaaattttttaataagacaagtgatcaaacagtgcaagcaaaaactcaaaatccattatagtaggggacggagggagtatttggtagcttatcagccacgactgaaatttaaattttaaaattgattttaggttttcttaatcatattccattttttacattagcttttaaaccactaactaataacggagacatacagaaaaaaatatccataaattatttctactgcttattagccatagctcaaagcctcaaacgatcaacatcttgctttctaatgtgtatcactgtatcctaacatcagcagcaactcagcaatgaaagaccttttggcaaaatttgctacaggacaccgaaagattgtggcctttgttgtgagacacccgaagatcgtgtatttgctcgtggacactgtaaaaagtggtaattagctactagacactcctattattttattattttcggttgaaatggagagagaaagagttgtgtaaataccaaaataaccctttgacactgttcttcctctctctctcttcttttcttttccccttcttcctcgcagtggagcagaggcgcgacggcggccacagcggggcggcggcggcggcgcatcgccggggttcaccgccgacagtgacgacgcacggcggcatcccggtgcatggcttcctctctctctctctcttcttttcttttccccttcttcttcctcgcagcggagcagaggcgcgacgacggtgggacggcggcggcggcgcatcgccagagcgcgtcgagtacagcaccgtcaagccctagctcttcgagtggaaggccggcgccggtgccactgccgctggccatggcgagtgcgcgcgggtggacggcaatatactgacctagattggcaaggatctggcgccgcctggacccttttggccggccacgacgccgcccggagctcaacccagcatgctcgccatggccactcacctgcatgccgttgtcccctgcagccaaactccgtgcggctggcgttgcagtggcggcgatggtggtggcctcctccgctcttcctccgcctccatggacagctgccaccagtggaggtgacagagtgggggacatcgatgacggcgagaagggagaagatcggtaccctttcgctgctgctgcgacttcttgttgtgcttcagccatggaacaatctgctgttctgatgaacaggccatagcctgctgctgctaatgctgcttcatggccacggcggagctcggcggcggtgcaatgagagagatgaacagagaaagagaggaagaagagagagagatattgacaagtggacctatgggcaaacttgtttttaaccaaagtttctctccgtttccaccagaaataataaaataatacggtcagtgtccgccaactaattaccacttttttacggtgtccacaagcaaatacacgatcttcgggtgtttcacaacaaagggcacaatctttcggtatcctatagcaaattttgcacatagaggacatagttatcaatctaagtataactgtaaggctcaagaatattccatcttgacaaatgcttcgatagcagcttgcaaacatgttgctcagacaagtcacccaaggcagacaaatccctggtactctagctcacagtaactaagaattcttcacactatcagtatctcagcactaccagtaataaataaatcaaatgttctaattatacaaccataggggaggatttcgcctcgctactcatccatcatctgtcagttatgagttaaaatgtcacatggagatcaaaattctagcagtaacagattgccgcgcgaatgccaacaccatcatgaaagctttgctcatgaaaaatttaagttgtgaaggcatggattgattgatttctcttggagggtcaaggaggaggaggaacaagcatccagtcattgtttcatccgtttcatgccaccattactgaatggagaagcactaccaggatgtgggctttcctctctaagtggtgagttcaacaaagcaagttctcggagttgctgtctcttgtagtaatcttgcgattcatcctatatagcacagcgtgaaagaattagcattcgaaaagaggcacgaaaagtacgtacgaattatgatttcgaaagacaagtatatgaagtagaaatgtgttagtactaagtagtgcactacaaaacacattaagataaaacagctgccgtaggaagatggaagttgtgaaaatgatagtgggagaaaagagcaagctatgttcagtttattacttattaattgcaaatgtactaacacaaagctcttttttttgttgcgatgtttggatgttaatgaatggaaagaaagataactgactcaagacaatatgcataccactggtttcaacaactcttctaggatttcttgtgcttttgcgagtctagcgtcaatgacattggcaggtaactcggcttcaatcaagatatgcaggggatcatccaagtgttcatacccagcccttcccttaagttgctcctccttttaagaaatgaaaggaaccacatgtgagcatcgttagcttgccaaacaatagaaacagacaatgaaatagccatttaaacacacaaaccgtatccactgcatagttccacattgatattccacaaaaggtgggttttgtttaccttgttagggtctttaattgagccctttcctcttatgaaaacacgacaacctgtagaggcctcaatcctcttcaacgaatttccccttggtccaagaaggcgaccaataaaattgaactaagggaagcacaacacagtgagtaaatattaactccaaatacacaaatatgaaaatgaagagcatacattagggtaagcatctgtcggtatttccaaccgcaagatcttcttgacaatgtaagaagagggactttgtggtgctccttgccaacctggtccttgagagaaacttactctctgctcaatgtgagaataacaaggttaggtgccacaggagttagggtatggagaatacaataaatgtagcactgaacaagaaggccaaacatagctgaagatccacaggaaatggaaccatagaagtaaggaaatcagcctgatgttcttataactagctatgctattcatccctagttcataaaatctactcaagaatatgctatgaaatttcttgttaagaggcatatctatttattcccgtgcgactacgtaatacagaattgagttgcaaaaaaaaattaagatcttgataataagtatggcaatacatccttcggtaaaagaatagttacacttcctaataattactccttaaggtcaatattacttgtcatttccgacaagcaaattgtcctaaaagcgggtcagttcaattgtctgaaacgacatatatttccctccagagagagaattcgttaagcattttaagagttaatcatatgatttgctaaatgttattgaagttcaccaatccagttgcataatataatttgaaaggcacatggaaaaacaaggaacgaaaaacaacattctctgttggaatgtattggtagtagtgccacatagaatggaaagtcaaggtttctcaaccaacttaacttagagctctgaacactctcttcattgcatttgcacaatgcagagactatatgatttggacaagagaagtaacagtttagggcaggttattcgtttggttgcctatgtaaggaagatatctaagtattttgaccacactggcacactgtccaagaaatggccagccaaaattggtaaactttaattttttttgccaggatgagaaaaataatacgacatccattgctctgttgctgtaaagcagtggaagtgttgtaagatagagggacttacatcagagtctctggactgatgattgtctgctattaggagcatgataggtctaacaactaacaccagaagtgacagtgctgaacaaaaaaaatgtgcgccctatggtaaagcacaatgttgaggtgactgagattatgtgttcaagtcacaataaagtcttctcttccttttcttctgaaggaaactaatcctctgaatcaaatatgggtagttccacatacatagcatcatttgttttttcagagcgggcagtgctaatgatacaaaatagttgtatataacaaaatttcttcattctaaaaggattttaacgactcaagcaccagagcttctggactttgaagtttcaatgttgcactcgtttctcttatatcctgaatgaaatagacatggaaagttgcagttcttgatagctctttatataaagaaaatgtatgcatactttagaattcgtgtatgggatgaaatattaaagagaaaggagagtataaactctaaacaacaatccgcgtcttacattgatataacgtttacaggtattgtggcgataacttattcagaagtccaaaggttaagaggcggcaggggagaagtggatcttgcatgacaaaagtcaagatgagctgatcaaaatgttacccattccaaataaaaatcactgacctcttctataaaccacacgaggttcgatgtagaaaagctatatgatggccataggctacctgttgtgacatgtatagtaatcattcttttaagggtatacataatactctttaaaagccagttttacttcaagaggaccttgatggattaaattgatggcaccctataaattgaggaccttgcgcattcatttgtttccatccttgcatatcgcaattctaataagtataacgcaacttatcagtgatattttacatagcagtccttttgtagaaatgtttaacagctcctgcagattagtgatcaaatacgatacatgactgcatatagcgtgttcgtgtacttggataactaatgctcacctctggacgcatcccattccatggaccaaaagcattaccacagaaattgggcacgatgtgcgacggatgcatctgatttgggcttgcaggttgcgacctctcgaagtcccctacgccgggttgccgaaacatcccagacactcgcattatctctgtcagcagcaaaacattagcacatggcatcagcatggacacacatgaaaacacttgattgccactgaagaaaagatacactgatacagtctcttgtcaagaatcaagctacaacctttcaagccctacgaaacacactaggattgcgcatagaccccgatcgagctaagtttcgcatcatcgagcagggacgagcaagagcaaattagccaaggccgtggaatcggagaagacgaacactccaatccgatccaagaatgctatccactcagtaagcagggcgagcagagctcctcaccttgattcaacagcctgctgcagattgggagcacctgcatgaacggccccagcttctgatgctcctgcaacaactccgccaagtactgcctgcttcaccaccaccaccaccaccaccaccgcaatccaatccaatccatccatccatcccgagcagagccaacaccacaagaaacacaaggaacaagccgcaattcagagaaagaaataattccttctgttgtgttctccgcgcaagaagaagaacaaagaaagaaaaaaaaaacacaaaatcaaaacccaatcgtggcgtccggtccttacccgccgctggcagcgtcgggcgggacggggggcctgacctgcggcgacatggcccgcccgggagagaagcagccgtccgtaccgtgcagcccgtccatggcgatggcggcggcggcggcggcggccccagccacccctcggattggggaggaggaaaccaaagaagggacgggacgagggggaggacgggggtggagtcgagtcgagtcgagtcggggagggggagagacgagagagaggtgttggttttcgcctcgtattctttttcttttctcggtacggtggcgaggtcccctttttaggaaaatctcggcaaaaccccccctctgcgctgcgcagtgcgcacgacgtcgtcgtcgtctcgcgcgcgcgcgcccgcgccgccgccgtcacctgcttcgccggtagggtttactataaaacgagagccccgtcgtgagtcggcgagaccgcgcgagagcgatgagatatgctcgtacgacgcggcggcggcgtatctggcctgcgagtactttgccagttgccattttcaggttacctatcttcggtttcgtaattcctaggtctgtttagattttaacttttttcattaaatttttaacttttatgtcacatcgaactttcatacacacacaacctttcaacttttccattatgtcgtttcaattttttcaaactttcaattttgacgtggaactaaacacaaccttagaagtattatttttagacaacggcatgggttttattatattttttttgattttatatattatagtatgcaaaactaaataagtaaacatttaattttattaaagtatttttttgctaatctatatatcgtattgtaggatttaaattaaatattttagaattattgataatcaaagttaaaatagtttgatcttaaaagttaagaattacgtaactaaaaggaaaaatatgtggagtgtttttgtaaagatggagtgtgtattctttttcttttacaaaatagaggggcttttatctttttccagaaaaaatgtgtgtattatagattgaggttagtatgtttttttccttgaaatgacatatttgtgccatgctagatatagtcgatatttattgtatagtactattcgccattatttggatatatatatataaataaaagagcgctacgtaaattctcattgcacaaaagaaaattggtatacatttgatgttatgaatgcggacaataaccatatgtgtcacgctcgatagctgtgatgtgacgatctcaagtgcataagagttgatgatagctagctagcaatatatgacaatgcatatgtgttgtcttcagttgtacgtttggagatatacgctgatcccttgtcactagtgttagcatcgcgctatagtcgagaagtggcggtgttgttttactaacttatactaattccttgtcactagagttagcattacgctatagtcgagacgtggcggtgttgttttactaacttattacttagaaaacatataggggttgtttagattattatcaaaataaaccttaccaaaattttggcaagttgacaatattaccaaaattttggcaggatttcttatgtatttaccaaagtttgacaacaaactaaatgtagtcattttttttacaactttatccaaaaaaataatatggttaaaaatagcatcaatttgaacatgcccataaatattagtgtcatgttatgtgtcaatatatgacatatactattatatatggacatgtctattttgttcttttaaatattgttttgataaaaattcgttttttcaagttaacttttaaggtttctttttttgtccgataaaattaaataatgaagtattttatgtgcacaagagagttccaacattaccttttcaataaaataatgagataataacactggtggagaaaccgtttgtagtcccggttgataacccccctttagtcccggttttccaaccgggactacgaatccgggactaaagatcgctatctttagtcccggttcaaataaccgggactaaagatcgatctttagtcccggttggtaacaccaaccgggagtaaagagggggaatccgggactaaagaggggaagcgacagttcctcgagattttttattattattattattttgttgttgatttgctaatggctagtgttaatctatgtattttctcccgaatcgaatgagatgcacatcccaaatcaacatcacaaatcaaatacatcacaaatcctaaaaactacacacaaattaaatacatcacagattatacaaattatacatcttagatccatgcgatgcaatgaatcacaaaattatacatccagtgaaacacaacttacaaaaaaaaaagaaaaaaaaagaaatcgagccagcgcccggccaccgcctgcgcacagccgcctgcccgccggccgcctccacgcgcgcggccacgccgccgcccgccgccgcctcccccttcgcggccgcgccgccgccgcccgccgccggccggctgatggaagacggagtagaggggaggaggaggaaggagaggggaggagaagaggaaggggaggaggggaggaagagaggggaggggaggaggaagaggattggatatgagaagagcaagagaggggatgttccaatcttatctaaatatctgtctgggacttaaccgatcggatgtgggagagaaatatttactcccggttgataacttcaactgggactaaagatcgatattaccaaccgggagtaaagatcactcgatctgataccaaccgggactaaagtggtaatttttagtcccggttggtagtatgaaccgggactaaagatcctcgaccccctgacatacatctgataggggatgaaccgggactacaaatcatctttagtcccggttggtgttaccaaccgggactaaagatcaaaattttttaaactgggactaaaaatcgtttttagtcccggtttttaatggaatcgggactattgtgaaatttggtcgaccaaccaaagatggtttctccaccagtgtaattacaagctcggacaaatttgaaatttggcacggcctaaaaaatgcttcttcaaaccgatggagagtgaccactgtatgatggcaatgggcagcatcattttcaaacatggagtagcaatcgaccaattcaatacagagtaccattatcttaaaaaaaacagagtaccattttggagtttatcgttcgcgtaacgaaaaccacaggcaaaacataaaccggtggagcatgcaaggctgtataaccagccaaaattattgaactgaattataaggctgtcagctggctcgtgtcaggaaatgatatcacatatttattctgatttttttctctcctctttttcagttccaacctttgatttggttagcgatccaactggcttctgctaattctaccagtaaaccagacgttgtctcgaacaagatgcatctgaattgtctcgatcgagatgacgttggccggagcaaaagacagtccgtcgattaagcctgagctgatgttaactaagcacaccatctcatgatttttaataaggtgtcaatggccaattaggaatctgcaacctaacacgatatatacatggttggtgatcgacagagaattagatttaatgccaaattatcatgcatgtgtgtgtgtaattgtggtaccacttctttgtcacgtgttcctcacagagactgacccagctggtttgagagcgttgcagctgacccaccgtcgatcgatctgcgacacatcgaggccctaaaagtcaacaatcaattctagagtagatcatttactgtggaattcgtcgcatggatcacgatgatgtcttgtgtagtacttttatgatatgtctatcaaacgtgtgtagacgcctgttaagtgacacattacttatatttacggctaattattctttcagtgatatatggcgtatctgtcgatatcgatgcgctcatggtgagtccggggactttattaatttcaagatatgtcggtctaatattaagcgtgtgcgtgttgtgagcgcctacgattatactacagcgaccccatacgtacattgctacaagacatacgtagagtgttgttataaattgtacaacggagtaatatagatcgagtattcgtagaactgactgagatatgattatccaactctaagagaaaaagacttatgcatgttaagaaaaaatatgtaataatctcaatctttggaagcacaactcacgaatatgaattataatcaataataatattcttttttttcctatagcgttaactttcaacaacttctatctccgtatttactagacaaggaaccaaggttatatccaagatatagcttaaaaataactattaaaattattttaagatagaggtaataagttacaattgtattgaacaagtagatagattagggccaaagaaagcatgcccaaaaaatcactctctccttctacagatttcccatttctagatcccaatattttggttgttggccatgtaggcagttagtgggaccgtcgcatccgtggttctacgtcactatttgttggctgaccgctgccttctgcgttattgtctattagttgccatacgtcgcttctattgttgtcgctcaacttacactatcaatatgtacactatacgtcttaaccaatctgattattattcattcagttctgtatttttattattaacatgtgaaaattgtcctgaaaactattgtaatgtcaagcattaccaggtgagattgcatcaaacacaagacaatcaattgacttgtactaccaagtttggcctcatactggctggcgttatgtagagttggggccacactgacaaaggaggtgaagacggttcctgcggtggagagataggtgtgccctgcagtggagagggcgaaaacagccaacgaaaggagcggcaacgtcttgcagcggagcggtggaagcagtatagctggagaaggaagcagtgacgaccaacaacggagaggatgactgacgactgcccttaccttgaacggatagcgaggttgggcaatagcgggcacaatgaacgaggataagccgatgacaacctgacgagaaatttcacgcgacagttaaaaaaaatcacgtgggagttggattgggagcatcgatcgagttgcttcaattctggctcgctttgcaactggtttttggcatgaggtacatttgagaacgattttgggtatctgttggagcccagattttctaaccatcaaaatttagttttagggatatgtttttagcttttcacggagatgctgtaacgacgctgtcacatactaagggtctgtatggatctagggactaaaataggactaaattttagtccctgtcacatatgatgtttagattctaattagaagtattaaatgtagactaccctggactaatttgcgagacgaatctattaagcctaattaattcttgattaatctatgtgatgctatagtaaacatgtgctaattatgaattaattaggcttaaaaaattatctcgtgaattagttcttatttatgcaattagttttattattagtctacgtttaatatttctaattagtgttaaacatatgatatttagtccatgtattccaaacaccacccaactcctacacactaaacatcatcattgcatcaacgtcttctctagtcctaaagcctcacttgcaggagagttcatagcacaggggcactggggatcataatatcatcggatcatgcgagtccaagagcgaatcgcaaatcgcaccccggccagtcgacacgcgcgcgccgtgcatggcgacccaccgacccaccgacccaccgaccgagcgccacgacaaaaacccccccaccatcatccctgattctaaaacccggcttccgtacatcggaaaccggggacgcccacatgcgcaaacccacggatcaccggagctcgcaaatattttttttccttttcggactgggtttctcgcgcacgttcgcgcgtggacgcgtcgtcacctgcacgtgccgctgccgctgccgcacgagtactcctacgtgcaccggcattggatgccctgcgttttttagcggcagcaagtgttgggggagccatgagtatgtacgtggaattaaatttggaaatatattgtttatttaatttttttttctcaaaaatattcgagatgcaaaacttttttcagaaatatatcgtcggtctcgcataaccgttgcacgaaaatgatatgggaataacgttatgggtagtatcacgcggtgaaagcgcgagaccgcgtggcgcgagaccgttcggtctcgctgaagcaataagcgataccgatgccatgccgatttaattagtgattaattatcctaattagtgattaattactaattattatattaattgttaattgagtaattaatcactaatcaaatggagatgctggatagtgccgctgtttgatttggtgaaactgttcggtctcgctcttctattccgcgagaccacgcggtctcgcactttcaccacgtgataccgcccgcgacgtcacgtctacgttatttctgtggaatggttgtgtgagatcaacggtatatttccgtaaaaaaatttacatcccaaatatttctgaaaaaagaaattgaatgaacggtatattttcaaatttaattctatatacgtgtacgggtgtacatgtgggcgtagcagttgggaaaagcggggggtgttgctgatgcaatcactctcccgctagcggctagctgccccagcctcgtactaccaggctaggaaaaagagaaacagtgacgctgtagaggagttgtgaaaaaagcagtggagatggagatcctcgataggttttgtttggttgcttttttgcctgcgacgcccacgcagcttgttgtagcagaggcgaagcagactgactcccaagacaaaagcgtcatctccgccgtccccaccgtgtctgccgctgcttcggcttttcgagctcggctctcgcttcggcggcgtcatggtggcctggcgggtggtgacttttcggcacaaatccagccgaccttgtcatccacccggccgaatccccaacctaccacctccgcatcagtccagtccctgctcccacttgggcgttgataacctaaatgtaaatgctattcctacattagaggaaggtatttctctttgagcagatacaataaactattttagctagtgatagtgtatccacgctgacgttattgatgatcaggatagggaacagggtgtgagccggcgactaattagttgccaactacacacgagctccaaggcgaaagaaacaatacaaaagagcaagatgaagcgatgacggcgggagcaggctgtgacgcgagatgccaaattaaaaaaaatgatatattaatccattgaagtttgtgcatatagccggctgctgtactatcgatgagtgatactcgtggatcagatgagttgagtattggggtacgttggaacgagggtctacgtagtacgacatcaagcagataaaagacaatgattatactggtttaggccccctatcgggtaatagccctagtccaatttatatgggatttatgatgatgagaacagattacaaatagagtagtcgaatcagacgatactgacgagattgtagtcgagggttttgacgagatctcccggcgacttggttccacgtactccggcttcgtaaactatggtgggtgtgttggcgattgaattgtatgcctttcatcccccctgggggtcccttttatacagtgaatcatcttgacccccaagaaatacctgaggatatttgatctggtacgataaaatataaattctatcccttccgaataggactttggaaatcgcttgactcgtagggatattttccataatttggaacatattctttatgacattcatagggatgatccgtgtacgcgaaggtataccctgtcggtatattccataagttgtaggatatgaggtatgccttatctgtaaccctgacatgtacgtattagctttttctgtctccgctattgacgtgttcttttttactgccggcagccatcgcccattattgatcttgctcttatacacacaatcttttcatgtatatttattaatacccacaaactaacaaatatcatagaaaattttatatacatactttaaatagtatgcacctatgtgtaaaattttattttcaaatttattatactttaatcataaaaaataaaattctaacatagttttaccctttaaactgtcagaaataaaagacgatgaagagagaggagaggggacgaagaagaccgttcggagagaggagagagaagaggagggagtgagaatgacatacaggctccacgtgggccccatcaattttaatttttttaactgacacgtgggtccatagtttttttattatttttcagattaaattgccacataaacaccacatcattaccacgtgagatgaagaaatagtcgaataagccatgtaggcaccacgccagccgaaataggagataatactaccgagggacctcgtttggactggttttgtaagttgagggatgagttgtatctggttttttctttaaggaccaaaatcaaactggacaataacttgagaaacctaaatcgaacttattccaatgatggcctaaagtgggaatcacggcccatccaaggcccagaagatacggcccattactctacacccacaagtcgagcaccaccccgtcggcctccacgacgcaggtcccaaccgcttctggcggatagcaagctaggctcgggggaatctcgccgtcgcatcaccgccgccgccgccgcccgccggttcgatctgagaagccgccacctcgccgcccggatcccgatggcgcggcttcactggctggaggcgatgctgccgctgggaatcatcggcggcatgctctgcatcatggggaacgcgcagtactacatccacagggccgcgcatggcagggtacgcgcctcctcctcctctcccttccgcctccgcctccgcctccgcctccacctgatccgggaacccctcgcgttctgacgacctttcgcatggtttggtttcgtttggatggatgcagccgaagcacatcgggaacgacaattgggacatggccatggcccgccgggacaaggtgctcctccatcaggcctcctccgagaacaactaggtgcggatctgaacccatgccgctggagcttgtgctgtggtctctctttgggttttctcgcggggcacggcttatgtgatgggattggtgttgggatgcgggattctagggtttgggttcgatttgggaatgtggttaggttacagcgagtgccttatgcgcatcgattagaagatttagggtggtaatcttaggtctgtggctggaaaatctcaattatcgggccgctcctgctggaaatttgcacatttctagtgaggattccactgatggattgttatggttagtacagactctgtgatcatgttagacttgatactgcgatgatgttaaattgatttcatttcagtgggaataactacttcatactgctgatgacactgctcaggttcttccgttgtatgttggtacgaaatttcagaaaaaaaaagacgtttggttgggttgtcagagtggggtgatgatgttttgtggttaggagagccttttaagctgtgttgctcactatccagtcgttgtgatgaaacctgatcaagctttgcttcaccaatctgccttttccaaacttaatgaatattgttataactacagtctaggttgctgcttagttttctccccagtctccaaaaacccttgcaggattctaccaactcactccaataaaggctcagaagtggcgtgttactgtttatttggtcgctgaagtatattcgagagctggtatccccagtgttaacatattaccacttgtcctttaggtgcttttttgttttgtgcagtactggtggttgtcggcctgtgtttctttttctgtttgaactctgtatcactgttatgggcttggttttcatagctgggtaaggaaattacctaatttctacaagaaataaaaaagactcagaagtcagaacatggatcactaacacaacaactagaagaattgcaacatggtctttgttctatattcttcttgtttttcttttttgctatcttgtgactaaatattgttgcccttaatgtgcaacaaaccttctatgcatgaaccatgaataacaccggtgatcatggcaattctttgatttaatgttaccagtaccactccagcttgctgttgtttggtcacaatgctcaaaccactgtttttcaaagctaagacttaatagtatttgctttatggaaccatttttcttgtgtccccttgcattctgatcaattgctgatgctggaatcacactactagccataatatttatgttgccaaattacctttaatgtgattgaatgtattaagtccccattgcgttttgtatctgcagcatatgggtgggtactatatttgaaatcttcctcagaatattgaatatacagtagagctagttactagtattaaataggccgtgccaatatttggctgatcatggtgaaggaaatctcaacttctattagacagatacatctcatctattggcagaattttttggaatatgctctgatctgaaaaaagaatgtgtattatctttttcttaaagaaaatgctccactgaattttgtgatatttgtgtattgcgtcacttatctaacaatggaaaagataacagtttatgtgtgcattggttacatatttttctatttgttgccgtggtaatgctgactatatccttacccttcatgttgtaggatattgatcaacaatatctagcctggatgttgatgaagttatttcaaatgcccagaattactcctgttagtttccgtgtataatgggaagctgggcttatgtttttgtttacaacttttgaatattggatgaataatgtgtatctggaatctgtttaattacacaaagtgggtgtcgcttgtcaattgtgtacccatttctccccaggagctgatcatgacgaaaatatttgttgttgttgttgttgttgtgtttttttttctctactgtacaaattgagctagtcaccgcggtactggagtttgccatccccagtgacattgtgaactctaccgttgatgccttgggtcgtctcctgatagctgttttctgccaagagtgctgaataaatgaacattagcaggacttgtttcaaatgaaggttttctttaagaatttttcgagtattgaagtttgatatgaaaattttattttccatgacccttggattgtagaatggctttcaaaatcctatgcctaatgtttacatttcctttgcgaagtctaatgcaaagtctcactgcctctcctcttctttccacgctaatatatatttcccttgacattcctgagattttctgtaattcctcggccatgacatccaatcccttacatcttctcaatcatacatttttccatgttgcagaacacctaaataacttgaacatttcattctttatttaaactgaactcctatattcaaatcctaggaaaaagtataattactgatgatctcaagggacagcaagattggttatatggagtgagataatggcccaaagcaggaggtgctttattttcacaattaacatatggggtgagataattacgtgtgctaggaattacatgcaacaaaatgacccaaaaaattaataggcacaataaactctctacatgcacacaacagtttcagagcgatcacaagatgcctttcgtcaatgctcgttcttcatctctgtcacgccattatcgtccttgaagctccggcgagttggggtcgtcgtctctgctgcaccaagatcgtcattggagctccggcgtgcaggcgtcgtcgccgtctccggcgaaccaatgtcttgcttggtcgtcggcgtctctggcgcatcatcggcatcttcttttatgctccgtcgagtgggcggcgtatctggctcgtcgacgtcggcttccttcaagctccggcgagtgggtggcgtctctggcggcgcatcaacgtcggctttttccttcaggctccggcgagtgggcggcgtctccggctcatcgacgttttcttccttcaagctccggcgcatggtgggcgactcggcggcgcggctgttcgacctcgacatccccatcctgccggcgtggcccaacggcgactgcggcggcgtgcccaggccgccgccggcccacaagccgtgcgccgcctcgtgcgcccggagatgacacccgtactgctgatggtcgtcgtctccctcctcgccgtcgccgtcgccggccatgtcctcgtcgtcgaggtcgaccacgtcctgcatgttgagctggtggaactcgacgatctcccggaggaaccggttctccctggcgtacaccgtgttctcgttcgccagccgcgccttctccgccagcagcgtctccagctgctgccgtatctgcatgggatcatggggagacggattggacgtatatccgtttactgtatttcaattaaatagttataattttttttaaaaaataataagatagatcaatatgtaatatatctctacaaacatgtaaatttaaattcaacttctataaattatataaaaaaaataaatttaattgcaaatatttttaccaggtcctcgtcggcgtcgtgcttgccgtcccggagcatgcggttctcctcctccagctgcgcgcaccgctccctggagaaggccatgtcggccttcactgtcttcagctcccgctgcagcagcttcaccttggccgccatggcgctcgccacctgatcaccgccgccgccaccaccacaagcacaccatgaaattcagagagcgcagtcgcaaatccacctccggaacggcaacaaaagaggagggcaccttacgtcgcgagaagccttgatctgcggcgactccgtgtccgacatcgtcggcgacatggcctccgggctggacaatcccatgctgctgttgcggaggtccatgctgcaagccttcctcctgatgtgcagcttccggccatggacgccgtcgcccgtcctgctgctaccctccaccttcgtcaggccctcctacaaaaataaaataaaataaaattacaatattgatcatggcattcataaaatctctgaatgctaatcttgaagagaatgcgacctcgagggcggtcttgatcttgcatccaatgtccaagggagggttctcgggcttccggacccggtcgtaggaccaacgagattgcgatgtctgaaatccatattcagaaacaggttagactgatcactgatcagactgaacaagcaaacggaaaatgtcaaagttgtctgaattaagcctgaatttgcaaacaaagaatcgatttaatttgctgctccatcagcttgctaatcgggtgatgttcttgttgttccagagctctttaccacagagtgattatcatccgtgccgccgttttcgtcgagcatcactatggcttgctgtgccaacactccccagaatccgtgcttcgtctcatttcccttcgcgccgcgcgccgatgtgtacagctgagtgacaggatcctgcaattgttgagtagcatactgtttcacaaaatttcacatcgattttttctcaaattgattcacaaattcagaggaattttctcaaatttagttttgtatcggagcagcgcaccggggtggagccgtcgggctggggagacgaggaggcggcggcgagggagcggtcggggcggcggctgtcgtcggcgaaccgggtggcgcgcggcgacgcgatggccggcgaggaggtgtcccccggctgcggcggctgctggcggtggtcctccacgaaggtggccgacctctggatcccatgcttcctccggtacgccatggccggcgggccgggggacgggggaactcgagcgatcgacggggcgctttgcccgctctcggcttcgccgtccttggattggcgtcctcctcctcctcctgccttaggtcaggtggcgcgcgctcctcccatggccgccttccgtctccgcgccaccgcgcgcaagcagtggatggcatggcattcccatggccgttgcttcgcccgcgttttgaggccgcgcgcttcccgttggatcgcagctcgctctctctaggcattttgcacggaagaggctcctccgacgtactgccctcttacgtggctgatatgtgggtccaccagctgtggggcccatatgtcatcctctcaaagttagggagcagtacgttagaggatcacgttcctgatggtatatatgctggtttgggtaaaaaaaaattaagagtaaatttcataaaactacatgttttatggttcaagttgcagaaaactacacatattttaacacttggcacttaagtatatatattttagtagtttagtttcacaaaacccactattgatgaatggattgacccatgagatgacgtggttgttccatctaggatggggacgtggcatcctatcaatttcgtgtgatggctagtaataggatgccatgtcctcgtcctaggtgaaacatccacgtcatctcgcgagtgaatcaattcatcgatagtgtggttttgtgaaactacacaaccaaaatatatatacttaagtgccaagtgtcaaaatgtatgtggtttttctgcaacttggaccacaaaacgtgtagttttgtgaaatttactcaaaaattaaacaacttgaggaaatcattagagcaagtttaatagtataacctactaatagctccgattcatctatagccaattcataaaatagttgcttactatattattaatacatgattccacctgtcataaacacattacgtcttggagtctgtactacagctggctatatatctgtaacccgctactattctctttcatcttttatctcattaaaatatgtttgtagctggctaatagtcggctattgtacctgctcttaggctgtgttctttacttctttcccatgagttctcaactcatattcttcgtttttcgcgtgcacgtttttcaatctgctagtaaacgtacgcatttcatgtgcacgctttaaataaaaaaatcatattaatccattttttaagttttctatagctaattcttcattaatcatgtgttaatctatcgctccgtgggagggattcccaacccctccaaaagaacattcccaactcacctccttcgtgtaccatgtgcacgcttttcaaattacaaaacggtacgttttttttgcaaaaagttttttacgaaagttgcttaaaaaatcatatttgatccatttttgaaaaaagaaaatctaatacttaattaatcacccgctaatggaccgttccgtttttcgcatgttagaaatatattcccaacactagtaaacgaacacaaccataagttgtggatgcatgattatgactccatatatgaggattcacattctgatgcccataaatattatgtactgtaataggtttagtgacatcggatgtatgctgctggtttctgtctctttgagcatatgctacgaggtgcatttgtaggggtgttagtgtggtgttacgtgcgtagtggtgtgtatatatatctgttgcgtaatcgtaaaaaaacaacttaaaaattaaatttgtctttttaatttgaagttagttataaatatttggcgattatttacgcttcaaaattcgtgcatatttcagaggctcacaggtctcctggtccggggcagttcagtttggccatacgtggcgtcatttcggcctttctgcgacggtcctcggcagggctccccgtccccgcgagccgcgaagccgtaaatccccggagaggcatttcctcgaacacctgccgcgcgcgccgtccgcccccaaaaaccctcgccccaaaccccgcgccggccgaagcggcggctccgtgcggatgccctcccgtcccgtcccggcgcgccccggccggcggtagtaggaagtggggggcgccgagcgtaagatgcggcgcttctccccggccgccgcggcgctgctcctccgacgctcgctcgccgccgccgccgccgccgcctcaccagcgctccgctcgggtccggtaatctcttgcctctttttaaagaaatatttgttcggtggattgaacctagctgagcccgactgcccgaggtttatgcatgggtgattccgaggcctcgttgtgaagggagattgcaatttggacgattggaatttgtagagaatggggttactgtgtgattaagttaggaatttgtctcccattagttatccccgagttaacctggagatcttggtgtcttggtggctcgtgagagcttgcatagtggatttgtgaagtttgagccatgtttaagcatttggggattgtcgtatgatttactttgtgttgttttaaggttcattcgcacagtgtaacatgccttgctttgtggcattcaaattgctcatttgaattctattcgtcttgcctacagagacagctggtgcgtgcctcgcttcttgacgaaagtttgtctacacagacgagttcagcggcttcaaccatggctgtgcagtaccaccaatggtctagttcagcagacggggatgatgatgaggttcttgaggctttcaatcgggactgttgtaccgatgcaggtgctggtgttttggatgattcagcatctactgcctatgttgagaagctctgcacatcaggcaacctccctgatgctgttcagattctccgacatttacatgataggaagatccatgtaggattgggtacgtttaatttggtgctggagcaaacaggcgaagtgaacaacttcgttctttttgccaaggtgttcaggtacctgctgctttccaaaatagctcctgacttgacttcttatacaaatgttgcaaaggcccttcagaagttggatgactatgaactaatacttaaatttgtgagacaagttatggaaattacacatgatagagatcctacagtgatgaatcgcattgttttcaccacggctaaatatggacagattgataaatgtttgatcatatttgaagaactgaagaaagatcaaagagggttagatgttgtcacattcaataccattttggacatgcttggaaaggctggtcgggtggatcaaatgcttcaggaggtgaagctaatggatgaacttggccattctcctgacattgttacatacaatactgtaataaactgcttgcggaggcttggaaggttagatcagtgcaaaatcttcgcaagagaaatggttgagagaggcatcgatccagatttaagaacatatactgcactgattgatattttcgggcgggctggccatattactgaagcccttgaaatgtttgaccagatgaaaaggtcacatcaaccttcaatttatgtctaccgggccctaatcagtgacttaaagaaggctggacagtttgaacttgcacaaaagttatctgaagagatgaaaacaagtgcttcagaattactaggccctgaagattttaaacataagttcaagggtagaaagatcaacaagaacaagtaagaaaactgtcaatgatcttccaggtgtgaatatttcgtttgcatgtgccttgtgctcatccactgtttcagccaaagattctgggataagttgaaatttttcagggaatgtatctcattaacaatgagataatcacatgggcttacaaaagagtgatgattactaacagatacaatgatatcaggccgagagaaccagaatataaatcataaacctctttgaaatatcatggttggaggcttttgctgatgtgcatttgaagagacaggaacacacttctctcatttatatcttcacggatgcaagagattatctagagacaggtcctttgcttatgagacctgaactgtttatctgagattgttccaccatagcgcaaacttgagccaatgaagagttaattctcgattgaattatgtgtgatgtgcttctactggattatcatgtgaatgacttgtgatttgttcagcactcactggttcaatttctgcttgttctgcacttctacaagttcaatttcagcattgccattcatgttcagtgccgtgaagaatagttggagccttgagtaagttgtttaggtccttgtcgtggatcactagatataacaaattaaatatagatcacattcttttattgtcctctactttgccatgcagccaagtagaatattttgtactcatgtaaactgttagtccaaaggaagtggctaaatttctgtcgatttttcctcccattttattagttttttggatctttggattgcatatcaagattcgtgcaaagaaactgaggttccacctgttttgtttttttattcgaaccccctttgttactgcgcctcctcctttttgttttcttttcaccagatggagagaggggggaagctacatgagaggagaggtgatgggggcgatttcgtcgccggtagatcctgcagcggtgagcttcctgatccctcctgtcatttttgtgttgattttgtcttccttgtcctctgcaggtttcagcaatctatgactggaggccagtggtgtcgagcttggccaggcttttgtcggtgtagcacttcttctgtctgtaaggcccccctagcttgtcgtcccttctgaatccagtagctaggtttcaccggtgctctagttcttccttctcatgctttgttgtttatatgcattagggtggttatacaggtttttagtacggttcaatcctcttttcgttttgtatgcttatggactctgttaaatttttgtggcttagagattacactttcagttgtgctcctggctatttcactctttcccctgcttcatttttgttttgatgcataatattgtatggttaacatgcaaatgcaaaaaatcaaccaataaatggtctatgtgtttttctgcaatcatatatgcatttgattagagttttctttaccagagatgtggggttgattcatgattcccccctatacacagattaggtactttcccccccttcatcttttccaattcctgttgctcttcctcttccttgtcttcgtcctctctttttttactgttcctcttattcctgctgattttttcctttttttttgttttctagcaccatgttctgaatttttatatcagctgatcttttaatattcaaatagatgtccagcatcagtaccttgcacaaaatttctcaatacatatttttcatttttttgtggttttatatctgcttcagaaataatggttttactatatttcaacaactctagtggcaatcccttcgaattctaccttttatctgaacctgaattttgttcagtcgcaaacatgcttcgacaattttcatgttttcttgagatgatggtatatatttattttacctgcaatattcaatcaaacatctcacccttttacttcctgataacaatgtgaagataaatgcatttctcgagtacattaaaatgggagtggcattagttttcaagcattattctatcagactgcagttcctgaaaaaaaatgcttgatttgtgattgcatcaggtttccacattagagatacctagctttagatgagctcacctctgaagtcagcatgctcaatcttgagcgtgctaggcaaataaagagtcgactggtcgctatatctggcatagttcacaaggtcagcttgagcattatggtatatactacaagtatatgtgaacatttatacaatgatgatatggtttattgtgactttgtgagtaattctgaagtgtccgagtgctatttccatgaatcgtttgacaggtcagggatgaactacagtgctagctagatgacgacatcgacatgacaaagctcgcttaccactcagctggctgccagtcatcaagatttgacatcgagaaagaagcaagcgagctcgaagatagtaataggtatactcctacaagacaaaaaaaaaaaaaaatcttccacaagttgataagttggtgcttcatccaaccatggacatgacgtgtgcctgaatgcagcgccagggaggacgatgttgataagttgcaaacatgcttccacaattttcatgttttcttgggatgatagcatacggagtataagccttcattttatatttttacctacaatattcagtcaagcatctcacccttttacttactgataacaatgtaaagatagatgcattgctcgagtacattaaaattggagtggcattagttttgaagcattattcctgaaaaaaaaatgttgtttttctcgcctgggctgtgtatgttgtgttgttgagttgtgtattcggctttgtgggccaaaaagaacatgcgaatgttttggcaaagaagaatccagccattcttgaccgaggtggccctaaacaacattcgaatgttgggtagacaatccctattccctagtccaaattatcttatcgtctgttgattatttgttttttccacgtgctttcatgctatcctctgtagaaatatgccatggatttcaaattcacagtacgcttctctagaaaaaaaaaatctcctcttacataatgcacttcaatctactggtcctactaaaccaaaagcaagaatttggggatacaaggctctctattagttggagatatcctgtattttacgatcaaatgtacaagaggtgctgacacaattcctttgcctcatctattgttttcagcagctaaccaaacaaaacatacaatagcaggcctctcgcaattgtccacggcccggaaaatgcaacccgcagatccaacagggtcgcacttccaatcaccttgcactttgcagcaacatgtatttcatgaacatatcatattatgtcatagtgcagttagtatctacaaaagaatcagatgaaacattataaactacaataactcgagggacagcggaaaaatgtacaaccagacacagtactgccgacagcagctaacccaggaggagcatcatattcaggcacacacacccagagggggctcaaaatcaaatacctagaacagcatggtaagatataagataatccatcctgccatggagaagacagcaaaaatgtgcacccagaacaagattgcagctgattccttgccacaacctcttaggtttgcaacagcacctgcccataaaaaatagcagattagtattgcaactgtattatactcaaaggttgattaacatgccaaatatgatgtctcagtcatccttatactttttcgtacctgatagtaccgatgtgggcatagagtgctgcagtaacaggacgaacttgaacatcttgtctccttttggaataaatccaagcttgtcagcaaatgagacgatgccaataccagcaattggaaccaatatcaagcgtgcaaatataatcgcgacggtggtccgaaccccaagtctcctacttccttcaccagggcctaaaaccataataaaccacaagtatggacttcagataaacatataaattgcagaagtataaatgtactaaaagcacacttcatattgcagcacggttctaatgagatttgagaatacaagatgagcttaccgtcaacaagattgccaccaacggcaagcaaaatgcacggaatcatagcttccctgaaatatataaaacagcattgttagcaagagatggtttttaaatgcgaatcatatttgttattacaagacactataggcatattgcaagaagaaactacaagtcatgagacaggtcaatacccaagaatgagacagctatctgttaaaaagaatagaggcgcgtcatctgtgaggatcaaattcttcaagaatggcacaacaccgagagtaattgcaagaacctgttacatgacgcaaaggaacattcagataattgagaaaaatgcaagtattgttttacggcagtgataagagacaaaaaccaaatataccgagcacttacagatgcaatgattggtggttggaggagctgcttcttttgtaggaatctaaccatgcccttgataggaatcattatctgcattaagccataaatggagtattattagttattttggtaacaactactgaagtgcctctattttttttttccaatatgctgaactagcattatgttgtgcccacttcttacttttgaacctaaagaatgaacgtcctgcccctcctcctcctcctcctcctctatagatagcaggggctcttcctcatgtgtattgccatgagcacttgatggatatttcgctacacttgacatggtattaggagccttaattggaagtttatctctctcctcatcgcagctgtcaaaggtctgcccggggggtggagcaagcatcttgaacacatatgtgtaaacaataatggcaccaacctgcaccggtaaacaatccaatagatatgataagtatttggagtagcattttaaaaagggatgtgcaactccataaacaaacggatttggacatacccattgaccaaatgataagtatgcatttccatcttgagtacatttgttcgagtcaccaaacggatttaattggtcgcgacataatgccgagataaggacaagtggtatatttccaatgttccctgcattaagtgaaatgttaaaaatataatgcagaatgcgtgatgaatcagaagctagcgatattcataagggcgtgaggaatgtacaaacctattccaatgtgagtgatggtgaacttgaagtatggataaggcggccgtacaatcaatgccactataagtccaaccaaagatgcagagactgcacccagagcaatgtttgctggaatgaaccacctgcaatgcaacatcatgagtaatgttgaaatgctttgacacaagaagaccccaaatatcgccaagggaaagatacaacttgtggctaatcatctaaatgagtactaatatgttctttcttaccactccatgatcttgtcaattgtgattgatctcccgagctgcgcaaatattaggcaaggaaggagcagagagaacacaagctgcaaaaataacaaaaaaaaaaaagacaagataaatcaacatagctagcctgaattctgctgatgttcccatagctagtctgaattccattatattctgaaaattagcgagccaccatgatggttgtgagaactactgaattaggcgccttaccgcattgagaagcttgcggccgctgggcttgagcacgccgacgcgcttggacgccatgaggaaccccatgaagcagacgacgaacaccttggcgatgggcagcacggcgtacctgaacatgcccaacaccgactcccccgccgcgccgccgccgccctgcgccgccgccaccaccatctccagcaccgacctccccatcatcgccgcccccgcctccgacacgaaaccacaagcaaccggcgaaatcgaacaggattcctccccacctaaaaccgcgcgagctgaactgatcgaacagacgcggctgcgtcgcgacggccaagcagctgcccggggcggcgaacttgtagccaaaaatagcaaggaatcagttcccgaaacggccaactcctcctcccgacttgtacaaccactttccccttccgtgtcaggatccaacccaatcactcaatcagcgtaggaatcggataccaactcgccgaaatttagggttaatccagcattattagaaagaaaaaaaaaggatatccgagatttaggcagcttagtacgagcctaccaaccgccggaaatccgagacttgagctagagatcgcgcaatgtgatcccactcatccgtgcccaaaaagggcggaaaacccgcaggggagagagagctcaaaacgccgccgcgggagcacggggaagaagccgacggcggcggaatctccccgggaatgcggcgaggcgatcgtggtagggctcgtcggcggcggcggcggcggcggcggtggcggaggattcacggccgacgccgccgcgagccgagggaagttgagaagacgaggcggcgacgagaggagaagcgtgccacgtcggacgcgtggggcccatggtccagctacatccccggtcacttttttggggcccacgtgacgtggacgagttcttggttgggagacagagagaggaggacgtgacgtgaagtagacgagtgggccgccgaaatccagcggagctggatttgaggcccatacaggaaaggaaagtaggcccaagtttaagaaaagagataggcctagttaatttacttacctttcgcaagtggttagtggatccgttggtctaccagcttgcactcctactttaagatgccctcaaccaagagcagctccaacggcgaactccgagatcaagtcgccgaggagagcgacgaccacggccacgatcgactttaacttggaaaaatgaatgatttttcaacttatagtagatctgttcttttcatctcctgcttcctactgcaaatgatagcgtgattatatttgcagtttgatcatcttcctatcgagattgtgtggtactatttcgctacaagtatatattggtagcgtgattatgtttcatgatgatcgatgagaacggttaggttcgatccacttatctattaatcctattcatagatatactctaacaaatcttcagaatcgctttaaaatataaagataaaagaatcaaacccctaaaacctaggtctaaagggttcaacccaaaaatggttttacatgtatagatggccaaggtttgtacaaagttaccaaatttaattaaatttaacaagtttttatggtgtgaacatgagtttcaaaaatttgggtctgagttttacacacacgtagcgagaatttctcgatctatttgtaatatattgtggacatcacatgtataaatggcataaagttatttctctgtataataaatcattccaacaaaatttaactgaatttgataaatttttttggtgtgaacacgagcttaattttttttaaagttttacatgcatatattaggaatttattggtctattaataatgcaaatgatccatttgggtaaccctaaataacatatcgatatgatgaactcatggtggattgatccggttgaaaaatgtatctacaaactcagtaaaaatgattatgtttgacacatatcctaactattcctatcctgagttatgtttacaacattcctttttttcatggccatttgctaactttaacgtctctttttttcctgagtaatattttgtattcaaatataagattaatactataaagttctggtcaattaaatgttacgtacacaagtgtacaaagtgaaaagagtaaaaatgtgatgtccacaattttactctttttctattcaatgaaaatggcggattgcatatgttcttaagtttccagcctaaaagcatccttggcatccgtccaatttcttgcttgttagaagagaagataaaacaataaagcaggtagttactatcatacatgagacttggtatattgcaaagataccttttaaaaagatgagatttgaagggagaaacttccctcaaaacatttttttaaaaagaaattgtgagtgcgtgggtgattgaacacaggacatgggattgaaactacacactcttacaactgcactatctgcaagtctatctcacagagagaccttttaatctaaaatcctctctgagagctgttgacgaaaaaaatcgaacacgccggcctgggagatctgcttagctcctgtgcaagtccaaagattggtcagatgcgggcgtgccagtcagtttgattctgcaactgacaagatatgcaaatagtagatcaaaacagtcgatcggctgacaagccgatggagtagttccagccgatagccgacaatagccgatgccgataccagccgatagcgatagggtttaagcaatcggctatacgtccaatgtagattctaacactttagtaaataatgatatataggcaatcggctactgataataaaatataacaataatatagtccagtataaaccaatcggctagcattgatatgatagaataagcactgatctgaaggttaaagcatacgtcggctggaggcccgatgtcatgaaatccacaagattagattaaacagtgaaacctttgttgtcatcggctaaatccaacttatatgtatatgcaatccttatgagtcgatgcaacgttcagataactcatcggctgaaaccccgatgaaacccttattggcaatcaagaagcaggctagagattatgtttctaagcacgacttagtagattaaacttaactgatacaacactaagtatgaaaagaaacataatatctagacaatcaagccgttgactgagttttcagggtggtagatgtctaagctaatctaatctagcaacgcgatttagccgataccagcaaaaaccctaaaacgagaagcagccaatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctggaccggcggaacattggacttatcccttcgctggagatcgaagacgatgcagccctgcgtcgggtgccaaattccgtcgggtgccaaagggtggcgatgcgccgaattgtattgatcgtagcgatagattacatagaccccgggtatacatatttatacccatgggttgatacaagttcttgtcggacaagaaagaaactttcctaaagataaaaggaaactaacaaactattcctaattaatagataacttgccatgccgcattctctttgaactcggtctcttctggataagcttcctttagtagatcaatttccttagccgaatatagcaagaatccgacaactgacgacttgacaactctcatcggctaatctcatgacttcgaagccgatgctgactctaagcgatgactactccgggcttaccaaatttcactgttaacaagagcttgagctaggacgatggttttgtttaccggagtatagtgttttcttcctgtccaacaattgattatcaagccatgctttacaagtgttacttgcaagagaacttttatggtacaacaaactgatagtattaaccgctggaataaatgatctaatgctataaattgatttgatctcccacttataaatagatggtagtataaaattttacagggtagattcatctttctttgctattctgcaagggtcattttttgttaaaaaaagggaagtaattaatttagataaaaaaatggtaccgtcgcctggggtgtatgagcaagacttagaacgtgtaagacctttcacacacatctgctatgttacaacttacattatttgatcggtaattggtcacttgtaaccaaagtatgtagatttttaatgatgatcagaatcgaccaggaatcgtgccactgcgatgctcgtcattgtctctcgcgggcgtacaaatgagatccaacaacaatgctagtggcccgacacatgaacgagtcctaattggaccgaattgactctcaacaacgaaattactagaaaattttctccaattttcgataggactccaaattttcctatctatataccggcagtatgttgtactgtaaaagttctaatttttcaactaatcatcggctgctaatgttcaacaccttaaaacatttgctcaaacacattaaaaaatttgctgcaatttttctctattactgcatactcattgttggttgaacgatttacatcacaggttcaccaaaactggtatactttgatgtcctgtctatctggggactatggcaagtagttcatcacctctatgaagaacttggagtattcatgcttgatcctacaatcatcactgcaaaagactacatagcctccccatccctactccacgccgcagcaggcggtcatgcactggtggctatcctccggtagcaccagcatcctactgcgacaccctccaaccttccacattgcttcctggatcacgtcctcagtgatcttccagcaccgttggcactcccggttgatcctcttgactccaacaccggtcgctgccttatcgctgtcaccctcgacttggctgatgcacttcttcctggtagcgtgagcctcattggacttgtagaggaggaggatgagcacgta

SEQ ID NO: 45057 - DNA, 5119 bp, Oryza sativa
  unsure (1)..(5119): unsure at all n locations
gcgatgtggacgatgctatcatagcaaagcgccaactctttcattgttgccgacgctgccgatggcctcttcaacttcttcgcattcgctttcaccgccatgctccaggtggacaccatagcaccttatgcgcaagacacatggtacgtgaactcacttggatgtgttaattaatcactgctaggttgatcccttcttaaactcttgtaacaatagccttatttagctatttataactcgggccatgaatgccagccaaaattagatttgaaacgaacgcgtaaaaagattacacaccttatctcatttaatttcttctctactatatattataaaaattgaataaagatgttcccttctaaatctttggtacatggtcgtatgtctgatagcccgcccgcatgattcccacgcaactaagtactatcgattctgatttcgattccgattccaattctgatttcttcgtccatcgtctctcgttgtccgtctcctcgggtcgaacattgcttggccgctgttgttgctggcggcctgctgctcaggatcctgatcaggagttcaggatgagctcaacgcaccaaagtgtgattcacattaattcatcgatttgctgttttggcacggtgataggaaacaactaattgatcgctaatgtaaaatttacgcttgaaatcaacgcatcacagtagattcatggattcttccattcatatattgacgccaggtggaagtataccaaggattgctaggaaaaccaatgctaccatttagctgaatgaaatgctgaaaatatactggtagaatttactgttagtataaatgatctaacagtatagattgatttgatcttccacttaaatatatggtagtataaaatttacaagggtaaattcatctttctttgctattccacgagagtcatagttgtttaaaaaaggaagtaattaatttagataaaaatatttggaaccatcgtctggggtgtatgaatgtgttaacctagctagcaagattcaaaacatgtaagactactttccacgcacatctgctatgttacaacttacattatttgatcagtcattggtcacttgtgaccaaagtatgcaaaactttaatgataattagaattgaccaggaattgtgtcaccgcgacgcacgtcatcatctctcgcatgcttacaaacgagatccagtagcaactccagcggaccgacacgtgaacaagtcccaattggaccggattaactctcaaccacgaaataactagaatttatttttccaattttctataactcctaatttgtccatctatatacttgcagtatagtatactctaaaagttctaattcttcaactaatcatcgagtgctaatgttcaacacattaaaacatttgctgcaatttttctctgttattgcatactcataaaaaattgttggttcaacgattttcatcacaagttcaccaaaactggtatactatgatgtcttatctacctggggactatggcaagtagtacatcacctctgtgaagaacttgtagtattcatgcttgatcccacattantcactgcaaaagactccgtagcttccccatcctgactccacgccgcagccggtggccatgcagtggtggctatcctccgatagcaccagcatcctactgtgtcgccctttgaccttccacgtcgcttcctggatcatgtcctcggcgatcttccggtactgttggcactcttggttggtcctcttgacaccaacgccggtcgctgcctcttcgccatcaccctcgacttggctgatgtatttttcccggtagcgcgagtctcatcgaacatgtaggaggaggccgagcacgtataccgccgccttgtggcccgtgatggctgccttatcgaggaagaggaggccttgctccatatcctgatgcgcgaagacgagcgtgacaccgacgatgaagcatgcgtctaggttgtcggcggtaacgaggtggttaacgacgatgaagtagcgctcgttctccatccacttcatgttgtctagcctctccagcggcacataactcccaacatcacattccttggccaccgcgtgcatggccttacagctgcagtatgcatacacccagagacttatacaagtcaatatataaatatttttacatgcgtatataaataagcttatattagcgagttagcatacgtggcacataggctgagtaggtcggtaataggctccgatgaggtggcagcgacgaggcaggcgatgtggacgatgttatcatggcgaagcgccaactctttcattgtcgccgaagccatcgatggcctcttcatctgctttgccttcactgccatgctccgggtggacatgatagcaccctatgcgtgagacacacggtacgtgaactcatttggatgtgttaattaatcactgctaggttgatcccttcttaaactcttgtaacaatagccttgtttagctatttacaactcgggctatgattatccacctgttactagtagcaaacatacacggaattgcttaatgtcagccaaaattagatttgaaatgaacatgtaagtagattgcacaccttttctcatttaatttcttctatactgttatagaaattgaataaagatgttcccgtctaaatcttgacacgtgtggtatgtccgattgcctgcccgcccgattcccatgcacctacctacttccaattccgattccgatttcttcatctatcatctcttgttgtccgtcctcgggtcgaacattgcttggccgccgttgttaccgcggctgctggccagcctgctgcttaggatcctgatcggtagttcaggatgagctccaacacgcctaagtgtgattcacattaattgattgatttgctgttaggcaaggtgacaggaaacactaattgatcgctatagtgaaatttacgcttgaaatcaacgcatcaagtagattcatgcattcttccatttgtataatgacgccaggtggaagtataccaatgattgctaggaaaaaccaatactaccatttagctaaatgaaatgctgaaaatatactggtagaatttactattagtataaacgatctaacggcatagattaatttgatcttccacttaaatagatggtagtataaaatttacaagggtaattcatctttctttgctatttcgcaagattcatttctattaaaaaaaggaagtagttaatttagataaaaaaattcggtaccatcgtctggggtgtatgaatatgttgacctagctagcaagattcagaacatgtaagaccttcaacgcacatctgctatgttacaacttacattatttgatcggtcattggtcacttgtgaccaaagtatgtagatctttaatgatgattagaattgaccaggaatcgtgcccccacgacgcatgacatcgtctctcgcaggcatacaaacgagatccagtagcaacgccagcggaccgacacgtgaaaaagtcccaattggaccggattaactctcaaccacgaaataactagattttttttccaattttctataactcctaatttgtccatctatatacttgcagtatagtatactctaaaagttctaattcttcaactaatcatcgagtgctaatgttcaacacattaaaacatttgctgcaatttttctctgttattgcatactcataaaaaaaatgttggttcaacgatttacatcacaagttcaccaaaactggtatactccgatgtcttatctatttggggactatggcaagtagttcatcacctctgtgaagaacttggaatattcatgcttgatcctacaatcatcactgcaaaagactccatagccttcccatcccgactccacgccgcagccggtggctgtgcagtggtggctatcctccggtagcaccagcatcctaccgcgtcgccctccgaccttccatgtcgcttcctggatcacgtccccgacgatctttcggtactgttggcactcccggttggtcctcttgaccccaacgccggtcgctgcctcattgccatcatcctcgacttggctaatgtacttcttcccggtagcgcgagcatcatcgaacttgtagaggaggaggccgagcacgtatgccgccgccttgtggcccgcggtggctgccttattgaggaagaggagtccttgctccatgtcctgatgcgcgaagacgagcgtgacaccggtgatgaagcaggcgtctgggttgccggcgccaacaaggtggttgacgatggcgaggtagcgctcattctccatccacttcatgttgtccagcctctccagcggcacacacttcccgacatcacgttccttggccgccgcgtgcatggccttacacctgcaacatgcatacacccagagacatacacaagtcaataaaaaaaatattgttatatgcatatataaaaaaaacttatattaacaagttaacatacgtggcacgtaggctgagtaggtcggcaataggctccggcgaggtggcagcgacgaggcaggctatgtggacgacattgtcgtggcaaagcgccaactctttcattgttgccgacgttgctgatggcctattcatctgctttgccttcgccctcgctgccatgctccgggtggacaccatggcaccttacgcgcaagacacacggtacgtgagctcacttggatgtgttaattagtcactgcttggttgatcccttcttaaactctcgtaacaatagccttgtttagctatttataacttggaccatgattattcacctgttattagtagcaaacgtacacggaattgcttaatgtcagccaaaattagatttgaaacgaacgcataaaaagattacactccttatctcatttaatttcttctctattattacaaaagttgaattgaataaaaatgttcccattaaatctatggcatgtggtagtatgtccgattgctagcccgcctgattcctgcgcacctacgtactgccgattccgattctgatttcttcatccatcgtctctcgtcgttcatcctcaggtcgaacactgcttggccgctgttgttgctcctgattaggagtacttc

SEQ ID NO: 45058 - DNA, 2108 bp, Oryza sativa
cactcccatccccttctataatattggattatctcgtgagttgatagggaacatatgccaattataatcctaacgacaacaatcggggtccctaaatgagtatggagataagtttatttcatatgtttatcacacaatcaagtgtaaatgtgaatctatttcacataagatggttgaataatattaaatagcaataaatatagaatatgtaatgtaggaaaaaccataagtttaaaacatgttgccatagtaatttgcgcacaaataaatgcatatgaggatataacagggagggggatggaaaaggcaatcttgttccctctgtgcaatagaggattttctagtggtttgacaaggaatgggtccctattgcaatacctatacaacagtttccttctccttttataattgctaacctgtttttttgtcgatggtaggaaccaactctccattggatttgtgagtagatttacgctagtaacatcttcttcttttccaactctgtggtgacaacaacaacactgtgttaaagttcaaataaatagagggcgaggggacgagggatgggagaagaggaactgaggaagagtcttacgtagagggatgccgaccacggtggtagatcgtgatgggcggtggggtggtcgaccgtgtggagaggaggggaatgagcgtggtaagtgatatatagggccaaggaaatccaattagttggtggtgagcggtggtagcatccggaaacgtggaagacactggtgtgagagatctatacgagaaactataatatgttggtggttaaattggaggtgtagggagtaggatgggagaggaatgggtggcaagggaagcatgaattgaagggaaccatgggataaagtataacggctatatcatggcaatgtggggagagtgatagagcgcgaagagagtgggttgctaggattatcttgaaagaatgtgagtgtttggaccgttggatggaggtaggttttctagtgtaataaaatgataccttgtttagatccaatcctggaatccgattagtaggcggtgagtagtggtagcttttggaaacacggaagagactagtgtgagagatctattcaaggaagtgtaagatattggtagtaaaattggagatgtatggagcgggatggctaaggaaggggtggcaagggaagtatgaattgaatgggagtatgagataaggtataacggatgtggcgcggcaacgtgaggagtgtgatagagagcaaagagagtgggctgctaggattgtcttgaaaggatgtgagtgtttgatccgttggatggagtgggtttgctaatgataccttgtttaaatccactcctggaatccgattagtacgtggtgagtagtgataacttctagcactacaacaaaaacgtcatgcaaaggcaatttttaaaatgactttaaaatcaagagttctaaagtgtagagacatcttttagaggcactttaaatattgtctaaaacgcttttaatctaaagacacttttagcacaatttattaaatttatcttgtagaggcacttttttcaacactttaaaatttgccttatgtaaaggcattttttgagacatttcaatctctatagaggcacttataggaaatttaatctaagctaattaactacataaaagtaacacgcggcacatatgtacaagtaataacatgaggttgagatggttagaccattcaagttaaaaataatatatgcaataagtctaaagttaaaggattggcaattgcaagggaagtgattttttttctttattacattggtttgccatggttttggaagattttaatgcctttagaaaatgcctatactctcttataaatattaaaaatgtgcctctatgaaagtgccagaaggcatagagacattttgtaaagtgcatctagagtattctagagacatttaaaaagtgcctcaattcactagaaagcatttatgagacatttttgaaaatgcctctagaatattctagagacatttaaaaagtgcctctatattattagagaaatgtctcttccatgcatttttgttgtagtgtggagacacgaaacacgctggtg

SEQ ID NO: 45059 - DNA, 1649 bp, Oryza sativa
tgctacgctcaacataccatactcttgagattatgacgacacaaattttcacaaactacaaatggagatttagcaaaaggtttgcttttaatttttacctaagcaatgtttggttttcactatgcttggttttagtttttccaccatctttatatatgtggtgctacagcttgaatggtgacctttgtaataagttatggcaggatgcttcgagctaaaggttggattaattttattatcataaaaatatttggattgaaagaacttggtttgctatcatattaaaatattgacaatactaaaatctaggcaaatattgattgatctgccattgcaaccatcctcaccactgccatatcctcccaggtcccgacaaccaccgtgagctcaaatgaagcttctgtgctggcgtctcgctccacgacggcgcacaagagcgacccgtacacaagatcattggaatgtgcttgctagccggcgacctcaagaagcagcatgggtattcatgacgacgaggccaataaggaaacgattgtaaaagttagtgttgacatagggacccaaaggaaaaattgactaatcaccatcggtgattgcgattctaaacttttgtgttccgaaggccgtattttaattatggactggatattgggtcctctacgtaaactttgggcgtaggtgatggcccaacaccctctttctcacttataggccaggcccatattccagtccgcatgcacgtgagagttttgttttggagggcccacctgattgtaatccctttccgaggaaatgggccggatttgagctggcttcagatgttgtgggccgaaaaccattgcttcctcgcttataaatttgtttaatctactaaaaaataccctgcacattgtaatggactttcttatagaaaaaaggtctatcaatccttacgcatattataccaaagcaaataacacttataatttttttatgatttttctattatacaaacatacctcatataatgcaatgggttaaaattgtgtccattatgtcatatcactttagactaagattttatatatatatatatacatatatatatatatatacatatatatacatatatacatatacatatatacatatatatatatacatatatacatatatacatatatacatatacatatatacatatacatatatatacatatacatatgtacatatatatatatatatacatatatacatatatacatatatatacatatatgtacatatatatatacatacatacatatatacatatatatatatatatacatatatatatacatacatacatatatagatatgtacatatatacatatatacatacatatatacatatatatatgtgtgtgtgtgtgtatgtatacatatacatatacatataaacatatacatatacatatacatatacatatacatatacatatacatacatacctacatacatacatatacatatacatatatacatacatacatacatacatatatccaaggaagttaattttttctttgcatatttccattttctttttggataatattaacccattttgttccacctttctaaaaaatatttcaagatgagcaatatgttctttgtaagtcctt

SEQ ID NO: 45060 - DNA, 18872 bp, Oryza sativa
tatatatatatatatatatatatatatatatatatatatatatatatatacatatatatacatacatatacatacatacatatatatatatacatatatacatacatatatacatatatatatatatgtgtgtgtgtgtgtatacatatacatatacatatacatatacatacatacatacatacatacatatacatatacatacatacatacatacatacatacatacatacatacatacatacatacatacatacatacatacatacatacatacatacatacatacatacatacatacatacatacatatacatacatacatacatatacatatatacatacatacatacatatacatatatacatacatacatatacatatatatattgtagagagtgggaactgactaaagaggctcactgttaggttggtggtgctggtggccagtggccaccaccactaactctttttaatctagtatggataatcagtgctgacatggtttctatttcttgaaggggtaaagtgtattcctatgtgtttatatggcgagcgtggtcagtttatatatatacatttgcagttatattttttctattaaaaactctactttttgcatatttttctcttatttgagaagagtcccgtcaaccaattagatcttatatgaatttattattcagagcaatttactggctttagttctggggccaacttcaaaggagtgaaaaagacacggaaatcatatatgttgcatgctagattttaatcaataatcatgtagtttttgctaactttaaatagagatttagtaataaattgaactttgaataagctactatttttctttggttgatatggccgtcaggccatgtcgtcttttcatctatctttatttatttctattaggctttgagccaaaaaatataatttataataaaatattgcagtttcagttggagtaaacaccgagtttaatattcactattaaaataaacaactaaatcctactatttaaatcaggttacttcatgatcaccatggacccacttgttagtgagaccaatgataaaaaaaaaatcaaagtgacttaaaaccagaggatccacatcctcgacgttaaacttctgttgctgaactgcatgcttaccactgttttgctctcacacgcatcaaatgcacgcaaggcgcatgcatgcaaaagagcgttacgtgcgcgctcagcctttgtcgcgcgcgcgcggggatcggtcgtcagatcacatgatcagctagcaaaatctgccgccaattgcatgttggttgtggctaagctacctgttcttaattagacaagaacaaaatggagggacaaaaagggtgtcatgtgttcatctacagctagatcgagccaattatgcaaagcacgcccgatcgatgcatatggatcccagctagcttagctagtacgtgccgtgtgcgaccacactcctcattttctttgttggaattgctaagccatcaaattcgacggaaatatatgagcaaaatctggtaaattttcaaccttcggatctactttttgcgattcatcctccaagaagttttttctaagaaattgaacaggtttcgctaaaattcgaacaagttagtgccaaattcaatagaatatgaaattcaatagactatgggatttcttttgcctgtaaaaatatcctaccggaacccaaaatggtaaacgtggaaatttgtgaatctcgtaaatttagttacaaaattgtaaacccggttcgaaattgaagcgaaagttggagaaacaccagtgatgtggtggtgaagtcgtgagtgtatgactccacacccacccgaatttatattctagttcctaggaatcttacacatatgtagctgggcttctaatagaattttactaagatcagatatgtgccgcaggttttcatctcctagagtgtgtgttaggggagtgtattcgtgacggtgtaagtgtggtgttacgtgtacagtgatcaacagtgaaaacctagaaaaaacttatcgagggtccactacatactaattatgtagttgttggttggtatactaactaaactaatatagtataaaataaactaggattgaataatttacctggtgtcctgtgatccgggtagtagtgatatgtgtgcgtgtgcctttgttgtgtaatcgaaaaaactaaaagaaaaaaaattgaagcgaaagttagctagctaggagatcgatagatagtgcaaattatatatgtagtgaaaacttaaaaactatcgttaaattgaaaaatgatcgctttagactcgcgcattaatttttggatccaacggtattttcccacgttcgagagaggtacgttttcttaccgcgcggtagcgtacgtacagcgtgagagcgcgcggccgttcccctgagttgcgaggccctgactggtccacgtgaacgcattcatgcgctgcgcgggctggctgcgccggcgcgtcggctccagccgcgcgcgcgcgcgcggcggggctttgctgctgtgtttgtcagccaatggggtcgtcgacgtcgcgcgcccacaggtgacgcctccgctggcgctggcgccatatgggcgcgcatggccaatgtcccccatgccatgcatgcgcacctgcgcggcgcgcgcgctcctggcacctagggggatctatcggtcgccacagctagcggcacagatcaggctatgcgtacgctttgcagtgcgatcgatgcatgggccgcgcggccggcgatcgatatcggtcgcctggcttgctttgctttaggctggtcctgcatgcagtgcatgcatgcatccatgcaatgcatatggtggtcggtcgtcggcaccacgtacagctgcatgcaggatggatggatggatgcacggatgatggatccaattacctgtagattctcatcatggagacaagagtacacagtgccagcatggatgagtaaaactaccgtactcataataagcagattctgtaacgggaacttcttcaagacgtcgtcatccttctgagacagacttcacgtaagaggatctcaatctatggatcgatccacattcaccacaagaaatcaatgctgtagatttaacatgttagccttgatagcaagttggtggcgcgcgctgatgagtacttgcaggcataggcaccactgcacgcctctactacgcagggttgggagttgggagtaggcagctagtgataggttggacctggtttttatccggccggccagtttttgcaagcagagccatgacccatgagaggagaggtcctcgtacaccgtacacacgtgggagtgcttctgtgctgcgcggtggaccagcgtgtgcccatgcattgcattgcccgagacaggtcaccgcctatccgactatagctatcccgctttctcgctctctcatcaccgaccttttcgttgctctccatcagtagcggggccaaagaaaaagaaaaactaaaaataaactgccgcaaatgttttactccctccgtcccataatatttagcattttagattatttagtacagggacggagctagaacaaaaccaagcaggttccactcgcttactttactttggtttgaatcaaatttagcttgatatgggtgcctaaatttaaattaacgggatatatatatatggtgaaaatagataaactataggtaaaaattcttttgaaccgggttcctagacacccccctagctatactagctccgtccctgatttagtatagattaaagtttaataaaaaaactataatatctcttattgaataatgtatgatgggaagttgaatgatggatgagggtgaaatataatgtgaaaatttttacatggaaaaaaattgataggacaactagctatttcatagtgtaactattttgtataaaatttgaagagtaaattgcatattgggtcactattttttaccactctttcagcttggactagggatatatctacattttcatattggaccaggtaaatttacaaaagtttcaccttggggctgttctcacacctacagctccctctctcctctttgtgctctctcactctctctattccctcatcggatgctgggtgggctcaagatgcagtgtagcatgaagctgtcggtcgagctcgacttaagtgaggcaccagagctatttggactaaggtcaagcgttgagttgggctcaaggttgagcgcggcactgacgacagcgcgacagtgttcaaggtcatggtcaaacgcgtagtgacgccagtgtggcttggtggacgcttccatccaatgccgatgctgatccattcattcaccgacgaactaaccatccattcatttgtctcggacacattgatctccatgttgttgggtacatgtcaggcttgctggtcaccttcctaatggagaggatcagccgatcaagccgtttgctagccgggcgccaggttcgtcacattcctaatggggcagccagtgcaattcggtgatgattaatttggaatatggagaataggaaggagagctggaggtagaagaaccagcccaaagtgaagcaatgggtaaacataagtggtccaaagtgaaaatatttgtttacccctagtccaacttgcaacaatggtaaaaaaaagaggtccaagatgcaattcacttaaatttgaataataaagagataagtattttggaacaggggtaataagtgaaaaactttcgaataactctagtatattatagttgtaatataattttatcataactatattataacttataatataacttgtatagaaatattaaaaataagtttaattttttatcaagtatacatatcaattatgttgtaattatattatagttataactataatgtagtgtaattatattgaaaaatattttcacgtagatatgaatttatctggagcagagatcagtcgtctcctctagttcgtggaaggctcgaagcccaagttcgttgatcaagcccgaagattttactagaacatgtctttcaacatgccgatcgacccacctcttttctcaacccacctctctcattttccacgcacacgctttttaaaatactaaacggtatgatttatgcaagaactttctatataaaagttgttaaaaaaaaccatattaatctattttaaaaaaaattaatacttaattaatcatgtaataaaacagtgctaggaaggagggtttccaaccccctttcccgaacacagcacagcccggtcttcgaacgagcaaatctttgacatgggagcaagtctacgaccgaggtgtaaatttgtctcacgtatactccatatacgaatggacgcaggctttcgaatctcaagtgctgctcgaccaaagaaagtgagagagcttggcccacttccggacgagaaacctagcatcattttagatcacattatgtgccacttgccctttgaacgcactagctcttccttaattaaggatatatatgtaggtgaagaaatgcatttcttccgctattttgtatgtgacccattctcctaataattgttattgataacatctttattggtattataagataatttctctaccagcagtggcgtgcccacatataacttaccggtgtcacaggacaccgggtaaaattgttaaattctaactaatttatgctattttgattagtatactagtgaataattagataactactatatagtgtacgctgggtaatttttgttctaggttcgccactatccaccagtgaatgtaacttgagctaagatagtttcacgacaccgctcgtatagtagccatcgatagacccaaggctctataacctcgggcaattgcctagccacgatagcacgtggcaaagagaggagacacatcgctcaatggcttagaaagttggttctcgtctgacctttacaaaattttttgccccactactaaaagtatcgtggtgattggatatactaaaagcaatgacattcgcaccattaggaatagtgataggaaccactccaccctcttgtgacgtggtaatatttactctccctccgtttcaaaatcactattaagaaaaccgttttttaagacgactaaaaatcatttttgccgggggggaggggggcggcccgcctgtacacataagcctgcctgcaaaattcgcaggctgcatctccatcttcgcaggcgccataggcacctgcctgcaaaaatattttgcgcgaacaaaaaaaaatcgccaccacccccggccacccccacccacctctggccacgttgccgccgcaacccacccacctccggccggatctatggttagggttttgggatggagaaggagagaaagggaggggaggccattgccgccactgcctggagccaccgtcctcccccctccctccagccggatctgggaggagagaggggagtcgtcgctgccaccgccctcccccctgcccccttcatccggatgaatctgggagggaggggagggcagccgccaccgtagccggggagagaaggaaggagaggtgggaggagaggggaggcgaggggaggggagcgcggatgggagggatgcaaggaggagttaagggagagggacttaggtgactttttactgagtaggtggcgatttttatgatgcttaatctttttggtatttttgcaggcaagagatccgcatgtaaaaatagattttcgtaggtaaatgatgatcttgtccatggttgtcatttttgtaggcgtccatttagcttccagagggttacccacctggaaaataaataccatcctctgaaaaaatggtttttctggtagtgaatatatggtatattttattttgttaggataaggctttgactaataattgcttccctaatacttgtacaaaaagtataatcatacaaaaagaagatgaacctaataacatcaattttacttcacaaaaattttattgtaatagagtaattattggtcaatatattttttaaaacaaaataaaatatatatatatcctatatttcaaaatagatggagtacctgatatactgttttgctcaccgaataaaaacatgtacataatatcactaccacataacacctaaaagttgacagttgggaaacctccttaggtgtcggtctttccaaccggcaccatgtaagcggcactgataagtgcgccgacaccaaagccattttgaaaaccggcacctctgagaggttcgcgagccaaaaaaaattgctcaatgcaccggcttgaatcgagccgatgcatcgagctcatccaccccgcatcaatcaatcccaaattaaacaacatcacaggaaacattgaaaaacattacagaaatctttcactaaaacattacagaagaacatctaaataattacagaagaacatcacaggagggagggcgccgccgggccaccacctcctcctgccgccaggtagccaccgcctcccgccgctgggccgccaccacctcccctcccatcgccggatctggcggagggaaaggcgtcgccgccgcctcccctctcgctgccggatctggcggaggggaaggcgccgcaatcgggccgctgacgcctccgccggatccagcctgcgggagttgtcggcgagggagaagagagggggaggggacagggaggagagggagtgagagggtgcgccgttgctgatgcctcaggaaaggaggacgaggaggaagggaggagatggggacgacggagaggggaggaggagacggacggtggagaggggaggagtcgaggagatggccgagagcaagagagccgagcggggctcggtgggagagagaagcgaaagggaaaggataagatcgatggttgccttatctcttgcagtggaccccaccagctcggctcggctgtttagctggctcggcttgattcataggtgcccgtttttttaaagaaaacgacacctataatatattaaatgtgcagtgtcggttcttatttagaatcggtacctataattgcttaaaggtgccggtttttcgcgatttggctataggtgccagttttagcaccgacacctattttatgttttgtagtagtgtatgcatcttatacattaacttatatctgttttaaattatatatagtactggccggttggtgcgaaacgacctgagcccctgaactatcacagatgcaccctgacccaattgatcataaaacaagccactctcttaaatatataaaaaaggatactaggaaataaacaaagcatttctgctcatcacaatcaactctcgacggcggaactctaaagaaaacaattctctgattgcttgcctcattgactgcactagctcatatatgagcacttaaaaaatgcaacattcattctaaaataagtttatttttatacatcccacgcatatcaatataatatatttttatcaaattccaatacaactatttttactttatttactcttaatgtatttattcttttactttggtaaactctaacataataattacattaaaaataagcttatttgaaataaacatgagaaacctaaaaataaacttatcctagaccagatggagtaccagcgttgatctttctgctttacaaaatactccatgggccccacacgcaccagccgagaaggggaggggggcaacggcatacagcaagaatgtggaatgaatgcgagaaaccgcaatacctaccgatttgacacgccacttaattaaggagagccgcattaactgagacagactttccctttgcatttgccgccgtgtttagttctaaaatatttcttcaaaattctaacttctttatcatatcaaaaacttttctacacacataaactttttaaatttttcatcatatcgttttaattttaaccaaacttacaaatttaacgtgcactaaacacaggcattcgcatccatccatgcatgaaaccagccgctctgttcctgcatgaaaccagccgctctgttctgctctgttctggtactgtgtgctctgggcccacctggctagccaccccctctgctggctgcctaggaacaacgggaaaagctatcccttgtgtctccctgtctgtcgccgggggcaggcatgtgatcacgtacacgcatgcccacctgccggatccatcagtttttagctacccacagccagctatatgctctcccctttccagaataagtttatttttaccttttcacctatatgctaagattaatttatttttaaataaccattgcatatcaaagtttacaaaagtaagatatatataaatttattgaaatttgagaaagtaaagatatcttgatatttttattttatattgatatgtgtgggataagtgaaaaataaatttattttagacggagagagtaggtagcccttctctctcttaggctgccctctctgggtgatcactgttttctccttgcctttccctttgttactgttgcatataaaagatcatcaatgtttaaagaattggagctactgtagtcggttgatccggaaatctagaaattaccatgttacttcaaggacgaagaaaataaagacatgttcgacgatgggtttaaattacaatggtattagattagatcattttacccggaagatactccctttgtccttaaataatttagtcaaaaacatcttatgtatgaaagagtttaaaaaaactattatgtcctttatatatggaaagaaaacgaggaagatgaggttttactattggtgtacaatgactaaaaatgagacggaaaatatatagtagtattttagaggtacactaatatagtacgccaatagtattttagtctaagaatttgctctaaaactaaaaagttttaggtaaaaattcttatactaaaaccacactttttttgtaatgggtggagtattaatttgtttggaatgtgggtggtaagtggatagcatgttatgaaagatattctagattagtgttggtgaacataaagctttccatgtatgggtaaaaatgggaaattgaacattgatttccatgtgttgccaaatatttgtaaattactttttttttgtttaaatcatcacttaaagaaaactgagagtgatgtggcgcatctccggcctttctggccttgtaatatatatataaagatagaaaacaaatttgcctggaacaataagcccttgtgtgaaagcaactatgtttgatgaaaactagaaaaataagcacatagtatctaacctaacctagtggtactactctacgcgaggtgatagagctagtacgtaccagctagctagccaatcacgatatacaattatacatccgtatgtaaatgattcacaattggattggttaaaattttaatgttaatttatataatttcaaagtattaaatattaattttacgtacaaataatgtgattttggactcgtgatgacttttttatattaatgattaattaataatcaagtgtcgaacacgttttgttaaaaactaagcatatgaccaaactacggtttccagtgtgttcttttctcctttattaactctactttttcatcatccacccacccacaaggacgtttttaggaaaaaaaatttacaaaaactgttttaaaaatcatattacttttttaaagttcttttagctaatatttatttaataatgtactaatctatcgctctattttacagtatttagaaaaagatttctcgaccattcaaaaatacagcctaaatgattcatcttgggcatggtgtgaacatgttccacgattagtttgaaacgtgtatggaaagattgctttcctaaatatctattcaacaaaatcagccagattaaactgcacgaattacgtacgcccaattaattacatgccaaatgaagcaactgcacgccggagagatgacatatatagcaccatgtaaacctgccatatgccaccctcttgcagcccaacccaacccaataaggatataaaaccactcgcggttttgcacagctagcgcggcgcagtgtgtaaccgtccagggtgacacaattgacttataaatcacgcttttaattaattaattttcttcctaaacatatccgctaatcccccatcccaggtggaatataaacccccgcaagagggagaagaagaagaagggcgaggtgagcgaggcgagactcgagagagaggagaagatccagaaatcgcaagctgcacgctatagctaggtagctatctccggggaaagagagagtaggctgccatggagagcttcttcgtcttcttcacggcggcggcgttgccggtggtggtggcggcggcggtgatcgccgggctgtgcattacggcggcgtggctggcgaggccgcggcgcgtggcggaggtgttccggaggcaggggatcgacggcccgccgccgtcgtcgttcctggcggggaacctcccggagatgaaggcgagggtggccgccgcggcgtcggcggcggcgccaacggcggacggggaggagaccgcctccgccggcggcggcggcggtggccgggacttcgagaaggacgggttcgacgactactgcaccaggatcttcccttacttccacaagtggaggaaagcctacggtacgtgtacacaagcctctctcctctctactgctcgatttcacatcactagctacatgcatgatgcttgcttgctttgcctgttaattactccgctcatgtgtgcttaattagcttaattaattcacactccggttaatcaagtcatgcaaaacccacaattaatcagctatcaattgagatgagtatataccagaatatatatacttacagtaaatttaataaaaaaataaaaaaaagaaaagaaaagctctctcgatctctctgtgacgatgatacaagaaatttgtggttgccctagtaacaagttgactagagtataaaagctgctaaaatgtcaagagctctccatataaaaaagaacagtgggggagaataattaatactgtcccaaacagcgagaggaagagagggggcaaacgagaaaagagagaataaacaaaattaatgcaggatggaaaccgtggttgggacgaactactcggtttgcttccagtcaaccgtcctgcatcattaagctatggattaataattaattaactgcagtatataaatatatatactcccccacatatattaatcggtcgttggtccaattagacaacagcaaagccatgcctaggtacctgtctaggtaggctatgactgtagtacactcgtactactcacttaatagcacattagtgctcttattttgcgaattaatgaaactttaatcaataataactatatataactataatatatttagtataatttaacaatatatctattcagcgtgctatcgtttcttcagcctatcaatcaacttaaaaaacttagtgttaaattgattttggtgttttcttatcgtaatttttcttcagttttggattgttttttaagttgctaacaattttagttaacaaagctatttggaaggagaggaataatgcatccatgacaaaagtatatgcttcataataattttcatataccagatcttgcccctggtggtgacgtgttaccaaataccgactggaattaatttcttctctctttctttttctctctgccggtgcaatgaggcgacatttttgagttataactgtgcgtatgaatgcatgtattaattgctgtttgctgaggttaataggctagcaataccgttgttttgggggaccccgcagtttgacctagtagagtttatcatggacgcagactgcccctacctgttcttcttcacggacagcatgattaattagctatactagtggtagtactcgatgtcattaataattggtctctccgtacgtgaataattatcgatttttgactttgacaagtactccctccgtacttgttaaggaagtcgttttagacagcaacacggtctccaaaacacaactttaacttcttatttctataaaaatatttattgaaaagtgatatatgtatacttttatgaaatattttttaagacaaatatattcatataatttttacattttaaaacttaatggaaagttacttttccaagatttgactcaaacattgttctaaacgatttcctttatgagtacggaaaaagtatgttttttcactgttcttatgaagtgtacatggaaagtgatcgaatagctctgagcagtactctaggtagggaattacttttagttgcgtacaaatctaacaattaattaatatgccatttttagtgaacataattgtatattttctccgtttcacaatgtaagacattctagcattttccacatgcatattaatgttaatatgtctagattcattaacatcaatataaatataagaaatgctagaatgacttacattataaaacggaggaagtaatttatgctagaatgacttacattataaaacggaggaagtaatttagtacatcaccttcgtcgattattacgaaaacatccatcatatcgatcgatatctgtgtatttgctactccagaaaaatattttctgagaccgacccacagatgcatatatatgcacattattgtggcggttttcctttctttttagatcaatcggtggcctgacggccggcccagcttcgattgaaattaagctgaataattattgtggccgtcatgtgctaatcacccatataattaggcgtggttagaacctgactaagctatttaagccggtcagttaggctttcccaaaacggccatcaggccatgcatgttgccattagctgtccgagcacgccggccaaagctcaaccctcgtgatcacatcaactcgatctccccgatgcttatccctttttgcaagcaaccggtatgtggtgcttagataattaatgcaagaattaacagtgtacctcctatcaatttgccgttagctatgcatgtaatggattagaaattctatatgcatgttttcgtctaacagagtttgatcagcagcagtacttagctaactaattattctgtaatttatataactactataagctagagtttaagcagagtatgtaagtatgatattttaactaatttagttcttgtcatatggcactgtagttgaaaccataaaccgatcaattaataggacaaatattcaacctggttgcctcactgcatgcgttgttttagtttgacaaatgcatgcatgtgtatgatattttatttgcttggcccttaataagtatattatgttgaagtcatgcatcttgacacagaaacttggagcaaaaactatataatatatttcaagaaccaaagggcctgaatactagtacttgcctacatcgatcacatgatgctagtgtcaatcttatttaaggtttttatttcttctttaatgtcaaaatggctattgtttaactatctaaaaacaccaataattagaagactcccactagaccatctcatgatgcattgcacgtaggatcgatatatatggcaacattaattattttacttgaacatctaatcgcgttcgctattattcaacttatgttacatgttctcccctaatttaagcaaaggccggtttgaccaacgggaaacaaataattaaattgatcttccaggcccagtacttatattaattacctagtcattaactacattttctccatatttaatttgaatgcttcgttctgaaatatttaaaggccattaacactaacacggcacacaagaaattaatttaaatatttaatttggctagcatgtatacatatatatgttgatatgcatggatatatatatatatatatatatatatatatatatatatatgtatatatatatatatgtatatatatgtatatatgtatgtatatgtatatgtatatgtatatgtgtgtgtgtgtgtgtgtgtgtgacaatagctaactttagatatgtttttttttcgatgatacatggtcccggcctctgcatcacaaatgcacacatccaacgaatatcgtacaaataataataaaaaaagtgatgggacaaaactcccgactcctacataagacttaggactagtgagctaagggtgtgtttagttcaccaaaattggaaatttgattgaaattagaatgatgtgacggaaaagttgaaagtttgtgtgtgtaggaaagttttgatgtgatggaaaatttggaagtttgaagaaaaagtttagaactaaactcggcctaactgaaaacaaatcaattgatatttgttttcagttatgccgagtttagtttgacaaaattaaacgaaaccatacaatatataattacaaatcaataattaattcctaatgctgcttgatgctactagcttctctcctacacagtgccattgactaggtaattgctcctaaccctagctagctaagcatgcagctcgatcgaatcgatcgagcatgaaagcaacaggtcgatcgatagatggtaagccatgacgatcaatatgatcatatcatgcatgcatgacactgtagagtgtgtactacgtactaccaccactccaccaaccatgcatgcattcctcccccctctctcttgcaccttttaaagctagctaggacgtgtggggacttcaatatatttcttgtgcattgtctctcctacaaggattcacatggagatgtgcatatgcatggggttacaccaattaaaagtgcagcccacactctatggattgaaggtgctagctagatctctgtactctatccgtcccaaaatataagcatttttagttataaatccagatagatagttatccagattcgtagctaaaagttattatattttaggatggaggtaatatagtttagatggtggaaattaagtctagtagctatggggaaaaatggcaaaaataaaattacagtatggggttgtactggaaaattttcatttgaatatatctcttcacaaatatgtaagcctaaatttaatctaaatatatatgggcacaaatgaattaaaaaacatattttctatgaacatatatagcaggaataatatgcattcctcgattttattcccttcaagtgttcatatagtacgttaaaagtttgggttaaaaattttaaataatttctttagttattttgaaatggtatgaatgaaataagagcgtatacccttaagtcataaaagatcatccagattgaataaaaaaacaaagttaagataattaagtagatgaatgtaaatgtgcatatacatatcttgtctttctgttgactagttgtctgttcagaaattatatggcggaaaccctaactgaggtgaaaattcatgtgtaccaagacaaaaaaagaaagttctgaaatcacacaaacaatctcataagtagataagatgatagtgaacaaccatgtaaagatcttttccaaatttaactttcatttgtcagatataaaatgacaaattttgaatcagaaaatattttttttgtttgaaatttaccctcgtttcttgatctgaacagtaccactagatacacctagctacatgtatggtcgattgtgataggctcacacacatgctatagcttgatggttgtcatggtggttgcctagttggcaaaagttcgatgtccagctgtgctactatcatgataattggcagcagcctagctagctagttcaaggggacaatattacactggctttaataatttcctcgtcaccaccttttacctcaaaaacatattcttgaaaaaatgaagaatatgatcatttcaccaaaaatcatggactggccatgattaaccaactcattttggatggttttgttggattcctcaaaccagacacatcattctctgtgtcgagaatggagatgacgtgactagcttttatgactttagaaacatactccctccgtctcaaaaaataaactttaggtttctgtgtccaatgtttgatcgtatatcttatttgaaaaaaatatgaaaaaaattaaaaagacaaatcacgcataaagtattaatcatattttatcatctaacaataattcttttcgtgcttgtgattgtgagtattggaattcttttaatatatgctgaatatactaatgagcataaagtataacagactaatcaagtatgtgagttattcaatccttggcaatttccaatacaaatacagacacactatgtatggaacttttttatatatagtctattaaacaatatatctttgagccgtctgaaaccaaattatatgatatttttttagttaatcataccaagatcattaattgagtaggaatataagacttcaagggggaatcaacaatattaattgtttctgagaacaattattcaaagcaattcataataaaagcatatttattttaggagtgggtacacacactatctagcttgtaccatatataagtcaatgaccacgatatatggctagccacctccctccatcatgaaataaattaacctcatacgaatttagatatagaatatgtccagatttattgattaaatcctagattgatttattttaggacgaagagattacctgcctgcctgcactaaccatctgcgacgccgacgtgtcatccatcggtcgacaaaacgtacgcaggccaacacatgcatacgtacacacaattgcccatttgcaccccgctccccatgtccacgtcagacggcgacacgtacacattaacacatgtacacgtcgttttcacgtacgagctaagcaaatccaacgtacagaaaatagttaatttacccggttgccaactgggacacgtacgccggccacgtcacaggtctacgtggcgcggtgtgggccgggctaggagggttaaaagcccacgcttgtgtgctttggtcaactcgtgcacttattactctgaagagttattagccggttcgatgtgtcgcgattactgttgtaattaagtctgtctctgtggcgatatgtacgttgacgatgattaaggtggtgtttggatctagagacttaactttagtctctgtatttagacactaatttaaagtattaaatatagactaattacaaaactaattacataaataaaaacttatttgcgagataattttttttaagcctaattaatccataattagaaaatatttaatgtagcatcacataggataatcatgggttaattaggctcaatagaatcgtctcgcgaattagtctaagattatggatagtttttattaatagtctacgtttaatatatataattagtgtccaaacatccgataagatagagacttaaaagttttaggtggtgtttagatctagggacttaactttagtccctatatttagacactaatttagagtattaaatatagactacttacaaaactaattacataaataaaagctaattcgcgagataatttttttaagcctaattaatatataattagagaatgtttactgtagcatcacatatgctaatcatggattaattaggctcaatagattcgtctcgcgaattagttcaagattatggatgggttttattaataatctacgtttaatatttataattagtgtccaaacatccgatatgatagggacttaaaagttttaatctcatctaaatatggttttagtctcatctaaacagggtctaatagcagaaagttacgtgagattcgtatactcgtacgtacgtatttgcatcggaattttcaaaatcctagactctttctagtactggtggtacagtttggcaaatctgg

SEQ ID NO: 45061 - DNA, 9210 bp, Oryza sativa
caagaacatctacttcgccgggcacgagacgagcgcggtcaccgcgacgtggtgcctcatgctgctcgccgcgcacccggagtggcaggaccgcgcccgcgccgaggtgctcgaggtctgcggcggcgacggcgccgccgcccccgccgcgccggacttcgacatggtgtcccggatgcggacggtggggatggtggtgcaggaaacgctgcggctgttcccgccgtcgtcgttcgtggtgcgggagacgttccgggacatgcagttgggtaggctgctggcgcccaagggcacctacctgttcgtcccggtgtccaccatgcaccacgacgtcgccgcctggggcccgacggcgaggctgttcgacccgtcccgcttccgcgacggcgtggcggcggcgtgcaagcacccgcaggcgtcgttcatgccgttcggcctcggcgcccgcacctgcctcggccagaacctcgcgctcgtcgaggtcaagacgctcgtcgccgtcgtcctcgcccggttcgagttcacgctctcgccggagtacaggcactcgccggcgttccggctcatcatcgagccggagttcggcctccgcctccgcatccgccgcgccggcggtcaggacgccacgtcacaagttgacacatctactgcacccgtgcatagttctcataattaattggcttctgtaaacagctagtaagtcgtgaactgaaaaaaatacatcacacatacagagacaacagaggattaccattttaccagcatacatccatggcataccaaaacaatttactatacattataattaacatgatgctatacacagtataaaaggacatgcatttttctgcgattaatggattaagccgattaactgtttgtcaagtgattacagtgtttaattcagaatctagtaattaatttgttgaatttagatagtctgtagcctgttcctctctgaaagcaacagagcagagcaaaaggcaaaatcaagtttcagaagcacatggaaaagtatgatttctttggcaaaattgttgtgccattctcttatgctataggcctgtggttgagtgagcggccgtttgattgggacgccgacgaacaggtgtcttttcgtttctgctttctaatttctggcactaataaaaacatgttggttgctgagttaaaatcaccaaagtggagtggagatcgcgatgttatcctgtagacttgttgtatctggtctaatggtctctgtaagcaaaacgatcagaagtactgaattagttcaattttttgatagacctggtatggtcttttaaattcaacttttgaaagtacagtgaaatacaaatctagtgatgccatattgtgggcttgtgtagtataaattgtgaatcaagcctacggaattttttgctgaaatacagtacgtgcctgtcttataagaaaaacctgaaccgagaagccattagcgttgtcacatacgacgccacgctcggtgactcggtgagccagcgtgtgcaccatcagctcgccagcagcgcgcgccaagaaagaccagcagccatgtcggggtccggcgacgccgcgccggcgcggcacaacgcgggtcacggtcggcgacgacggcgcgtcctcgtctgggccagcttcgccgcgctggtcctgctgctcgtcgccgcggcggccgccatcgccgcgctcgccgtgctccggccgcgggacccgaccacggagctcctgtccgtgaacgccacgggcgccaccccgcgcgtcgccgcgctgccggccgtctccgtccagctcaacgtcaccttcctcctcgtcgtccgcgtgcgcaacccgaaccgggcggagttccgccacggcgccgccacgacggcgctcctgtaccgcggcgccgaggtgggcgccgccggcgtgcccgcggggacggtgccgagccgcggcgcggcgacgctgaggctgaacatgacggtgcgggcggacagggtggtggcggcggccggggtgggcggcctcctcgcggacgtgctcgccggcgagatggagttcgaggcgaggacggaggtgcgcgggcgggtgaagctgctcgggctcgtccggcggagcgccgtggcgaggtcgctgtgccgcctcgtgatcggcgtcgccgacgtgaaggtccggcgccaggagtgccacaacgagtccaagctgtgactggctctgatacgtattatacgtatgtacgctgtctttgtatttgtacatgtatacgtgtgctgaagacagtcgatttgtacgtactctgatatatgtgcacgaatttgtcgtggcaataaatgtttaggctattcataagctgtttctttggtagactgtatatgtatattgttaaaagttactgcagcctcattgtcattgttgtgtttccaaaattttggagaaatcaacaatatggttattcaatttacatttgcaacccctaaatatattattcaagtagataaagtggtcgcactgtgtgtttttcttccattttttcaaagagataattaaacttggtctgtggtgcacattgcagaaagctactgtgaaacggatggactattgaactactctcgttgtcattggttggcctaatgttagattacatttttctacctgaatatatgttttgagtaattcatgtgtgttttatttcccgtggcattacatatatgctgtaacattccgagttgtatttttctttttttatttttataatattcctacgtttcaaaggagagtctgtgaaacaaaaaggtagattagaacaacatatagctctcaaactagtgagaaatttttgctcttaatgcaacagaggcacaacaaggagaaaatattcaacaaacacgtctaggttgctcctacggcaacaaatttgagaaccgtaggaagtcaaagattcaaccttttgctgtgacaatgtaagaaccacaaaactatttgttgtcatgtattacaaattaacaaaaatagggtgaaattacacgagcgtgctggaactttgagatgaaaatatgagcacatatagatttaattcattctgtaaataaatcataacatttaacgtataaactagcaaaatcacatcatacaattcaaacatgtaaataatgaatagatcaaataaacgaaacacggtgaacacgtaccaagggttctggttctattgtaaactgggttgacaaggagcggcacgcgccgcaggaacaactctgtggtgtcagatgttgtcgtcggcatgcaacccttgagcatagaggtgcaggacatcgaaggcaaaggttccggagacctgctctccggatcgtcggcgcacgccggtgagtgggacggagtagactacaagcgacggccggtgcacgccgatgagcgaggtgcgtgattttgatttcacgtgtgttgcgaggaggcacctgcattacctccccctagagtaaccgtgcacaatgagtgggcacgtgatattgatttcacatgtattgcgaggaagtgctagcacgatctccactttgtagaatcaaggagttgatttagattttgttatgaaaatattgatggtttgctaatgttaatttggagattttataagatggttgattttgtgaagtgtgcagttttggttgaccttggcggtcagaccggctgagtgccgccggtcagaccgtaggtgttgcggcggtcaaaccggccggcccgacggtatgaccggcaggatcctgatcgatgtcggtttcgggttgttttgttggatttggatatttccttcggggatttggcttctagatagtttctatgcgtatggatactgttgctatactaatgtgagtcaagttgggacaaatttgggctcggaatatggcttcttggttgttgcatgtgcaggtgatagatcggagtcaacttgggagaagttgatgtctagggatcatgagatcatgcgggatactaaaggctagaggacaatgcacgtggtgatgaagaaattcatatggtatacaatagggatttgtgtacgtatggaaagaggagtcgaatttggaagggagtccgaattcgggaagtttgattgagataaggaaagagataagatatttacttacaagagagggtttcatacatggttaggagtcctaagttgtgttagattcatgggctttgcacaacctacttcatgtataaatagagagggagggtgagacatcccggtatcgagtttagagagactagagttgagagaaagttagggtttcgagtttagttcgagattttggtgaggagtgatgttggtgcactttgtaaacactagttgatgcaataaagtcgaaaagtttcaatctacatattcgagtttgtcatctaccggtgtttttgggtcccgacggtctaaccgcaagtgtgcgcgcggtctgaccggtgggatagcggcggtctgaccgcaggtgatcgggcggtctgactggcgaggcttcggcggttcgaccggcgacgacaggacttcatcgtcgtcttcgttcgagggtaatctttaattccgcaaaagatttttgggtttttggttttccctatcattcacccctctttggtaggtttgtttggacttgtgcgatcctacacactttgcagaactgaactggataagtcacacgtaacttaactagactccatgacatatacgcaccgcctgcctagctaggcgagacgagcgtacgcatattcctctagttctctccactacacgtctcgagtggttaggagagtattctccccttaaggaaatccctccctctctcttaaaataggaaagatggtactaaacgtgctcatacatgtcatcccaccatatggtgagcttttgttatttttttaaagaattaatcttcaaatgtgctaagacctatctattaattctaacactttgtaccgatgcacaaatataacacttgtatgctagagcttgttctatgcataagcagaacatcactgctagttataaattaattttttttgaacgaatcgacgagcgccaatttcattgaatagagaagtcgaactttacaaaaacaaggtattattttcttgtttttgtcaatgctgtaccgacgctgtggcaatcattcgtcatacagtagttggccaaatttcgctataccacaacgtgcacaattgatacatttccgcacaaaacacctacggtcagcgcacatgattaaaacatctatgattagttcgtcgattatcgcatcattcgcttcattgcgcatgaattggaccatgagcctcacaaaagtttctcaaattagctttctttttagagctaattaacatggctaggcgtgtggtagtggtacacgatcaggcacgtttctaaaatttcgttacctttttatacggcagcaaagaggagaaaccaggcgctgcatttcaaatttcgaattcccaaacctatccattccaaaaggggcaaacactccgcagtccaaagtccaaaccacagcgctacttccaaattcagctccagctcaccacgctggagaaaaaggtaaaaaagaaaaagaaaaatgcccagcaagtttcccatcgaagccttacccctaacatcccctactttactcactgacacgtgggcccaagaaattctgggcccagacgtcagtgacaactcggagggaggagcctggtcccgcttggttcggacacgaccccgaaaatattcaaaccagcagtagcccaacgtttcgatcccgccccgcgcctcccgccgcctccctcactgacgggtgggccccacatgtcaggggtcgcctccgccgcgcctcatctttaacacctgtctatttcctgcacgaggcaatctcatctccctcctccccccccccctcattttctctctcctctttctctctctctcttcctcccaatctgcgaagcgagagagagagagagagagctcgaggcgagctctccccgcccttctcccaaaccctaatccttccgccgcgcggaggagagccgcgtctcgggcgcgcgcgtggaggcgtgaagcgatctgtattggtggaggggaggggaggggatggaggcgcggcggatctcggcgagcccgcggccgtgcagcgggaggagggtggtggcgaggaagaggccgaggcacgaggcggcggtgaacagcgtgcggaagctgcagcggcgggagatcagctcctgccgcgaccgggccttctccatgagcgccgcgcaggagcgcttccgcaacatacagctccaggttcgcccgcacgcgtccttgcccttgccctaccgtttctagcttcgtttcgatttttttcttttttgttcgcgtgctcctgcggcgaggtagttttttcgttcgccgtgtgtggggaatttgtggctctgggagagcgtgcttggcttcgttttagccgatttgtggtcgggatgggttgccacgattgactaattacttcgcatggggacctgagatctgttcaggttgggccatctgttggtggtaactggaattggagtgggttcatggatgctgtgctgtgctgattttgcaattatctaaaaaaatgctgattttgccagattgtgatgagaaggctgcgtatttcgttaagtaggttagggaccactgctgattcgtggaagtcatgtgcagccgccatctgcatggcaaattcctgtatcgctccgtgcagctgcttgtctggcttaactacaacaaactttataattttagggtttcgttttcgtatggtatcatgttggcatattatttattgcattgtcagaattaacgaagtgtggattaactgtcagattgcaggattggtgtaattgtacatagagaatgactctatctgctgtctttgccctttgcagcaagtatttttttagatgttaaaatttagtacttgcctcgggtatcgttgtcttggttacttgttgttcatgacttctgtcactttgctgctcagataacgatcttagtggctttgatcctccattgaaaaaacaatgtgggaccctgcttggactaattcatgcttataatggcccacagtcaccttatgaaaactgtcaagcttgcacctttggcctgcttccattgtttatgttgtagtggttttacctcacggctgttttagtagtttctcttgactttttatctgtatttttaatcatgcactttactgtcactttcaggaggagtttgacacccatgatcctaaggaaaacagcttgctactaccttacttgaggaaaaggtcaaaaattattgagatagttgcagcacgcgacatagtttttgctttatcacagtccggagtgtgcgctgcttttagtagaggtatgtttgtgtcattgtggtgcacttctgcttcctatgatcatactaagaacagcttcatgtattatcagagacaaataggagaatatgctttctgaatggaagtccagatgaagttatccgcagtttattctacaacaagaataatgagtcactcattacagtatcagtgtatggttctgaaaatttcagtgccttgcgatgcaggacaactcggatagagtaagctttgtgttctatgagtttccgttgttgtgaattccatgctatgccatctgcttaagatactggcaactctttcaaggtatatacgccgagcaaaaccagatgctggtttccctctttttgagagtgagtccttgaaatggcctggattcgtggaatttgatgatgtcaatgggaaggttttaacttattctgctcaagacaggtacacactaacttctgtaatgattataaagtatgtttattctgaaactgtactgatgccattgcattctgcaaacagtacttacaaggtgtttgacttgaaaaactacactctgctgtattctatatcagataagaatgttcaagaaataaagataaggtaccccctctctgacccacctttttttttcttctgttcccatttcttgcagataccctaactaagaagttttttggatgcaccttattactttgaattcaacaggctgttcatcatttgaattcacctcatcttagtagaactaacaataaactcaacaagcatgctttagattgactgaacttgtaagaccagaatgcactatagtgcacatataaatggagagagtgatatcataactgtggtgttgccatgcagtttaacagaactgttcttttttctatagactcttagcttatattatatttttttaattattaatggcaacatgatgtggctttatatgtataatcctgtgttaatttgtggcagtcctggtataatgctattgatttacacaagaacaagcagctctgttcctctgaagattctttccattgaggatggtaccgttttgaagtccttcaaccacctcctccatcggaataagaaggttgatttcattgaacagttcaatgaaaagctcctggtcaagcaggaaggagagaatcttcaaatacttgatgtaatttttcccctaatgccacaattgtcatttacaatcaagagaaacaaattacttttattgtttaggtttttaacactcggtattgtaggtacggaacttccaattaacagaagtgagcaggaccgagttcatgactccatcggcctttatctttctctatgagttgcaactgttcctgactttccggaatcgatctgtagcagtttggaatttccgaggtgaactagttacatcatttgaggaccacctgttgtggcacccagactgcaataccaataacatatacataacaagtgaccaagatctaattatttcttactgcaaagctgattccaacgattcatcttcagaagaaaatggtacgatttttttggtgtttttttttggcatatttgtatatattttactcatcatacaattgaaatcactgcttgctgtattttactatttatcttatgttttcctctcagacatctttgtttgtttatgtgcccatcctcttgccacatcgaactattttaattagacctttgcatgatatcatgctttgctgtgaccaaatatacggaagtctgttgttttgctcactttggtagtgtgcttcttgttggtgctgatatttacgattagatgtactacaacttttgttttgcttcatctcgttttcttgtattt

SEQ ID NO: 45062 - DNA, 887 bp, Oryza sativa
aaaaacaaccccaaggctgtacacatcacttttatccgtcaatttatgagttaggaagtattctggatcaagatacccctgccaaagtaacaaggatatagttagtatagtatagctgtaaaagagaaagaacaaccgtgtgcaactagtacttacaggggtgcccttaacaacggtggagacatgagctggtaaagccccttcaacatctggtactggagcaagcctcgaaagaccgaagtcagctaccttggcgacatatttagaatccaacaaaatattgctggccttaacatcacggtgaaatataggaggatctgcatcggtgtggagatacagaattccctttgaagcacccaatgcaatgtgcagcctcaaaccaaaaccgagaggtggtttggactttcctgcgattgaaaaataaaacgaggagattgaagtagaacaaggatattggcaacagaacaaagtattacacaattcactataagcaggttcaagaaggcacatcaactataagattcagtaaactgacaactgaatggctgatcttgatatcaaagccataggagtcagttcaggattgcagtagatcagtgggataaaagaactagccatgtgcttaccagaaagatgatcacgtaaagtgccattcggcatgaattcataaactagcatctgtaaaaaaaacacaatttttatcttatcaggatgattttgccagaatattatttccacacaaataaataaaatcaaagagatgcacctgttcattttcttcatcacagtaaccaaccaacgcaaccagattgcgatgatgcaatctagacaacagctctatttctgtgcaaaactctgttgaaccttgaagagaatcctcgtgtgcc

SEQ ID NO: 45063 - DNA, 1203 bp, Oryza sativa
tttagccttggaccaacttcccatatgtagttctcaatatatagctggtaaggaaacaactgcaacaaagaagttaggtcaatcttgaaagcattttcgtatggatgaaagtctgtgactcctggactcttcaaccgaagtccaactccaagtggcaccgcacaaaaacattggtccgagaatgaaggattgtactcataatttttttctgtcgggcaagctccacaaaccatggcagtgcttgtttcctgtttagatttttccaggtttattgactggaggcggcaaaggttgattatcagagtttcactagaattctcacatataggatttccatataacctgcacaaataacattggttgtgacaactataagaactgagtattttatgtaagcaatattcagttatagtccagattttcactcataatacgatgatgaataaactgtttttggttatgatgtccattctcaaataagaatagtgtagcctgaaaactgttatataagcagtataagcttgctttaaataaatgaaatggtgttaatcatcaaaatggaaattaactgcgaaacttgcgtgctcacagttaaatatccatccgcaacacagaatttttatgcaggaatgtagattgatagtgtattgcatatatgtaggaacgtacacgacagtaacatttggtggaggaggactaatttcagctggaagcatattgagagaattattttggaagtccctgcacaattgacaaccatgtcaaatatatgttattgtcagaacttagaacaagatgaaaaaatatatatatatattcccaaaaagaatcatacagtacaaggcttccgtttctgttagggttgacgccagcccaaatttccgagggaacagaaccatctaaaagattatttttaagtgacctgcaaatttgcaacattgacatgtttttaaatgcattgtttttaaaaaaaagttcatagagggtttaatttgtgttatgtcaaaacgagtggaaattgtaagcaataatgagtggatcacaatatgcaccagcaagaactgatataacctcaagtttgtatgtaataaataagaaataatgtaaaatgcatgagaagaacagaagaaatttttaaaatcaaattcccccaaaccaccaggttgatcacatgcgagcacctctttaaatttgctatcctct

SEQ ID NO: 45064 - DNA, 2390 bp, Oryza sativa
tgttttgtttttgtgcacataagtacgtacgggagaagacatcgtataaacctgtacgtacatgacaacagtagtagctcttaaatcatatacagagaaagttgaaattttttaataatagatataatccaatggtataaaataacgggtccaccaatttaagtgaaaatcgacggtgagatttgataatgccaagtggcagcctatgagcgtttgtagcatgccatgtggcggtttaggagcgtttgtaggaagtttaattgacttttagtatataatagataatagatagatagatagatagaagattgcatacttactgtatgaatgtttcgttcttgtaaattttatcagtgatatgcctcacaatcattaacacattatcagtgtactgcctgctgccactctgattcgagtcaagtttgttgtgcagagcactgctccagttaatatacgtagttcagtaattaatttcggaggtcaataatatcgtcataccacttattgtgcttcttgtaagtgtcacatggagccatctttgttattccaatgatattggcccaaatcgatttcatcaaatttcttggaacatgctcaaattttaagtggggtattaccgtattagtgggaaatgttcgatctttctatagatggtgctgggtacatatcccaagtggtgatttgttgctgaaagtgctcctccttttgaaagattgtgttttcagtagatgctatcactgaagaatcatttgatgttttaggtttttagctcttagcattatctggctgcagttgttaggccaccttgatttgatgtagatattagcctgtagccattatcatgcaagatctaatttgttgtgtattctcagagtttactgtactctcgatgctgtaaccgtcctttcttctgatttcttttagagatattaaatgttaagatcatttcagacttgcattctgtgattgctttggttactgcaactttattagtgaacagcaccttgctgtaatcttgctgattgaattctattttgatgtgcagagtattacccagttcagtaattaattcgtgagttgctcaatggaagttattctagtcatctcactcgttttgcttcttgtactaggagccatctttgttattccaaaatccaacaacaatggtaaaagttgcatcaattgcaatatttagttttagttgctttaaactaattggcactgactaatgtaatgcaggtaaagggaaggaaatacaatcaccaaacggtggaatggtgaatttctttttctatatttggatagtgtagttttctgtaaaagttgtacatgtaattttatttaacaaaaagatttatctcaaaaaaaaaaaaaaccccatgaggcttcagaattcagaataagctttctgtttattgatctaaggatacacttgactcattgttggttcattaaaagtacactccattctcactatttgcccatggaatttcacattcagaaatttaggagctatacaaagaaagaggtatcgactcacaacacaaggaaggattgttggatcatagtcaaggacaaggttggaagaagatgatattccagttttgcaattgattttgtgtaacaaaactatgaagtttgaaattggaaaatttgcactattttgtctgatgattgctgatttcgtgattgatccaggtgtatgacgtaacctcttatgtggaggaacatccaggtggtgatgaaattctaaacaatgccggtggtgattcaacagagggatttttggggtctgtatcttatcacctcaattataccatactatgtcaatattgttcttgaatcttttctggagcataatactatgttgctgctttagcatgaatcgcagaagtgtctcatgttactttgctgcatcttttccgaggtgaaatctaatttagtttttatagtaacttactaattgacagggctagacttatggatccctgtttactccatcgaaattactcaattgactaacatagtaaatgttgctaatgacatttataattttctgtaacagcaacaagcaaaggcaattacgctcttattttacctgtcaatgaatttccattctttctggtgtattccaatggtattgtgcaatggtttcctgtgtttgagtactggtcatgtatttttgtcatcattgaaactatttatgctcagcgacatacacccataaatccatatccgtgattttagggacatgtggatgttactgattttaatacatttaacattgaccatttcaagaaccaaaaagaaaatctagatgatggatgctccaaagggtagtgttactttctcaactgcgacactgaagggatctttcttctcatatcatt

SEQ ID NO: 45065 - DNA, 1416 bp, Oryza sativa
tacgcgtcatttttttatgactcaggtaaataaaataactcttacgcgcttttcagaccgcaacatggctttagagtcttcgagatcatcgaagatttctgcatcggcaaactgaaggactgatgatgatagagatgagaggctcaggaatctcccaaatgtgaacccttgcgttccacggatgttccttgaaggaatgaaactgtctcctgcctgtgatgaggactggccccaagctctgtggttctcatttcatctttgacctggcactcttactagtagcagtgtttggaccatatggactatatttatgtgagttcaatctcaatgttttcgtcgatttatctctttgaaaagatatgtttccttagatttatggaactttctcagataagacaacgaaatgtgccaacttttgtatttattgtttctactacaatgacaatgatatgcattttttacttggtccaattctccccctggtcgtgtctgaggattacacggctattgggtttcaggaaacacgtttggaattttcatgtgctcatgcttgtgttggtgaagtaatctgggtggctacaataagaatattttttttcaagatctagtccatttttcctgatgagaaaatcaagagtttgtacaactattttggttcatttgtcctgatgagaatcatgatattgtacttcaagagtataaaactgctgacaaaattatattctttggatgctcagaacatgatcaagatcttattttccttgacacaaatcaataataataatactaataataatacaaagaaacactctcatttggggaaaaaaaagagagaaaaattaagtactagtactactatttctcatctctattgacctaggaagaaagcttctgctcttcttccctcctctgttctttcatggcaacagctaaagaacagagggtggtcaccatgaactgcttctctagtgttcatcagctatgtgaggatcggatcgggttggattggattggattggattgggttgagtttggtcaccattgatctggttctgttcataatctcatgcgaagaagctggtgatatcaatggtgaatccggggtcgaactcgaaggcgtcgagggcggagaggtcggcgtcgaccatggcggtggcgggcgccggctgcgcggtcgccgtcgtcgtcgtcgcggcgacgagcgcggacaccacctcctggagctcggcgtcccgccacgcctcatcgccgccgccggccgccgcctggtggaacggcgcggcggccatcgagtcggaggtcgccggcgaggccgccgacgacgcggcggcggcgaggcggttctccggcgtcgacggcgcggagaacgggttgtgctgatccggcggcgccaggccgctcaccggcgacgacagg

SEQ ID NO: 45066 - DNA, 3616 bp, Oryza sativa
tccggcttgccggcgccggcggccaccgccttgtggacgcacgtgtgctcgccgtggtagatcacgtcgaacaccgtcgcgtcctcgtcggtgcgctgcacctgcttcgtcgccatgcatccctgcgagtggcggtgggtgcaacggtagtaacccctgaaaaaaaatgtttttagaaaccttgcaatcgatcaaagattcttaaaattcttcagaaaagtttgtgtgatttcgaaaacaatcaaactaattggcaggattatttgacaacacatccaattagatgcatgcaaacaaacaggtggtcctatgatcctatctgaatttctgacaggtggagtccaagcatttgagaacagaggaaaggctgcagctgctttcaccatgataaagaaaagacagccacaaacaaccaaaccaagcaggaaagcaaagcagatatatctttgatgatgccacagcacaaagcttatgaaaaacgcatgtgcagattaggctatgaaaaaggtggaaacaaacaccttttttgtactgaaatattggggggaaaaagtagagggaaatcagaaaaataccaaccttgggtgcttggctccaagaatctctttctgcccatactttctccagctatggccatcatctaccggtggattctccacccctcccgtcgagctcaccctaatctgatgcctcttcttctccgtcgacgtcttcctgcaaaaatcaatcaaaaaaattcgaaacaaacaaaaaattaaactcaatcaatcattcccccaaaaattcagctaaaaatgaacatgaacaattaatctttgtatatattcacctcttcttggtggccttgaaaggcaagtcggagacgtcgctgagggggctgggagtcgccgagtcgaggtcaccggcggcgacagcggcggcggagcgcttgcggtggccgtcgaagtggccggacctgatcatgccgatggagcgctcggtgacggagaagatctgcgaggccaggtgcttgcagaggtcgggggagccggagccacccaggtgtccctccagctgcctcacgagctccttgatgtggctcagctccgtcaccaccagccgccctcctccattgccctccatgctctccatcacccctcaacccttgatcgatctcttcctgctctcaccaacctagataaattgctagctagctagctcgatcttgcaggttgcagctaagctcgcttcgcggtacaagaatggcaagaacgaccaagaagagtgatcaagaattgggtaaaaagatcgagatggcgagagtgcatgtggagtgaggcgcagctgccaggggagctcgagcttataaagaggaggggaggaggggatcgagaggtagaagaagaagaagaagaagaagaagaagaagaaggggattggagaggtgaagaaaaagcgcgttggtggtgagtgggggagaagaggattttgaccggtgagagaactagatggcgacggcgagagggggttctttggatttgattggccaacgccatgtcggatcgatcgggctaagctacattagcttagctagtggacagtgttggggtgatgcaatgatccattaaacaaattttagattagtggagggttgtacccaaaagcgtcagcttggacactttggtttggaacaacatcaaataaaaaaaaaactagatttgaagggagatttgtacctctaaatatgttttaaaaagaaaatgtaagtgtattggggattgaacatgcgatctcgatgttaaaaccacacacctcttgcaactgcactatcaagtgcaaatcaaatgtgtatatatatatatatatgttggtggaaatacttttgtctgttctactttatttctggatgtttcggagatggtttgtaattaaaatgtcagctacaaagtaaccatggattaaattatgtggaagatagttttgtattagcacatatgtttgtgagcttgaacctatgcacaaaatgacattggttgtccgtaaattatttgtcattgttttatatatttttcaggtaaaaatttgatatatgctgcatagataccacaatcaactcgataatgtaatggccccatcgtttggcttttcttttaataagccaaaacggcttattagagaataaaaataaatttgtaggtaaaacttttatatatatattctcggtgacttaaaagccaatgctgaaaaagaaactacgttgaaaatacctcaaaataaatatcaaaattaagtttgaaaattcaaattttggctttttctttggctgaataggctattcgataggagcctaaattattgttttatatatttttcaggtgaaaatttgatatatgctgcatagataccacaatcaactcgataatgtaaattaagtgtggaggaggactaaagtccaaaatagctaaactaaggctagttaatttacttgggcgagaagttcactgatgatattatacgattctacgtggacacgtacacacagccctttgccactactcaaatctcttgtctttgtttttttgttttttggtggcatcacatctaaaagaaaaaggttattcgatatacaaacgacgaacgctaaaagcctatatatgtgacatattgcgacgctgtccagttcatattgggaatattttcatgctgtttcagttagacatacatctctttcaagtgctctggtcggtatatgtgctactggctcgttttttttttcttaaagaaaatgctagtagctttgttagttgcatggtgcttttttttgggttgtttctctaagaccttcagttgctatcatttcactctgtttcacactgaaagtactgcgtccattcattcattgtccgtatgaaaatcagtggaggcttttttttcctcatttcttgtctcttttacacttactgtgcctagtgtttattccaaattaagggcaggtaaattgtaccttttgaaaatgaagaggatcttattgaagttatgtatacgtatggcatctggaatgtacacctggccggccgcctgatgttgctgtatcatgagcacgaaggctaatgtcattcagatagtgatgcttaaaagaattgatattgaaacgtagggtagtatatatgatagaaacgcatgtgcactactaattataattaagtagtaccttttggaaatgtactaatatatgatcagttcattgttgatttgttgattagagcggaaagaaaaaggaaatttattgatacccaaaatatttttgttgtatatatatatatatatatatggtacgcgtggaattaaaacaatgaacgaattatttctgcataagctagaaataaccatgaaagcaaagcagcacaacatatcactaatgtaaaactaacccggtttaaaacatgggaatttttacaaaaacttcacacgatttttccaaatatccttttttctgatatgggcaaatattactacaaaatttcaaatgtgtgcgcgccaaatcctagtactctctatagacgagtcaaacacattcaaataacacttatttacaagtaaccatgcgtactaaattaaggctcgtcgacaagtaaat

SEQ ID NO: 45067 - DNA, 23957 bp, Oryza sativa
agttttttaaaggtgttggtttttttgctttttcagtttgtgaaggtgggaaattttctataggtatcagtgtgcactttcggtatctatagtactgacctatatatgtagtgtatgctaatccatacatagttaatcacatattgcagaaaaagactactcaactgttaatcatatcaattcttacttttgtagatccatgtgccatatggctcattgtataaaaaaaacctaaaaagagtgccatatggcttggccaagccagtagaaacctttcatgcagctagctagccagacgaacaaacataaataactcacaagatcatgaaggggcccggggtatagcaaccatgcagatcagtatagtagaggtgataattaaggttgctactatagaataaggagatgaataggataagaacagattaaccacatgtgtggcctaggaacgtacgcgttagcggaaaatatcataaacaaaaaaaaatgaaaaggggattacgaattccatgcggcccccagccccccaggaagacaaggacagctcgtttggtgggtgaattaactgcctagaaaacaaaacaagagggaaaaagaaaagcaggagcccactgttagcttattttttttccccaagcactgaaagtgatataataatatactatatgctttatctatttggcttgttgctactatatacatcatctacgcggtattttgttcgtctttttctcagctactacatgtctattctgattagaagagtcgcctatagatatgtatgtttttaatttacatgtgatgttaacgtgccaaagtttgggtgtacgcgtgtacgagctactccagcagcttggaagcatgcatgcgtgctttgacatgatcactttttctacaggaaattaactcgtctgtacggttaattgttgtaccatatcattttcagtcgcgtagcaaatttcttatagtgtaataaaccggtaactacgtacttgtcccaagcgactaattaatctattttaccaccagcaccaagtggtatgcatgacctcgtctcaccatcagttgtggttgtggcacaaatttcagagagaaaacaatactagtatacatgtacaagtagcagtattgctagctcacacgcagcttcatctcatcggggcgatcaaattaatcatcaccggtgagcggacgcaggtgagcttggatgattaattaacctaaacatagttaaagccaaaagtatatactgtacaaatatccttcgattgattagcacagagcgagcaacctttcacaaattataagcaagttgcaactcacagcctaggatagtaggatagatacatggaatcccagctcatttatcacatggcgaaagctcttaaccaataaactggaccgatcactgtatatgatgcatcctcacagtaccctcaattgcatgcatgtgctaccatattttatgcgtttgcaagtggaagttgtgcttgcttctgtagcaacttgcatgattgcttcggggttcactgtatacacactgtagtatatagtagtactagtactacaggccccccttgtcaactgtgagacaagagcacacataaattgataagcaagaactttcataaattttgacaatttgactcttgtaaaaactaattttacaaatgaatcatgatcaaaatttatttcagaaaagatccttttgttcagcgccaaatcgtatggcgctgaaattagacacatcagcgccacgtcaactgccaacgtgaattcaacgccatgctatttgccgctaaggcatctaagttcagcgccataaaagggttattttcataataagttttggccacggttcatttgtaaaattggttttacaaaggatcaaattatcaaaatttgtgcaagaactttggggtagcttagctgtccggcctttcccagggctggtttgcaaaaccggccggccccaggttttgggtttgcagagagagagagagagagagagagagtactactagtagtacagtactcatgcaatagccaataggccggtcactcactactacccctgcatatgcttggtacgtactcctgctgttaattaatccatcatgtcgatcaaattgaaggctggcgcgacaacgtcctagacagcggccaggtcggaccgcggggcgcgtagtttcccgcggggtgcgcgtgcccatgcgcatgcagtggccgcgtcgtccgtgtcgcggcttcgtcgtcgtccgcgcgcggggcgatcgcgcgcgagtgattgagtacgcggcgggcaccgcgtcgtagcacgtaatagtacggtggattatgcccgggtagaaaactgaaaagcgagggggggggggggggggatcccggtgcatgcgcctgctgcgatcgatgcttgacgcggtagctcgcgagacacgagcgacgcggcgtcgtctatcgatggatagctcgcggtcgcgcggcgatggaccgacccgggccggtatagcaagaagccactggtcgttttcgatcgaatacgttgaagaatatgcacacacatctcgcatctgtgcacaccagtgttcgctgtcaatcgttgtgaaacgcatcctgataggggctggcctgtggcccgcctatatggctatatcccagccgaaccgaaccggccaccttgagttttatttccgtccaactgtacacaccacactgctccaccccgtccaatacatacatgctcttatagaatactagatgaaacttacgtgttgctgcggaagttttattatctactaatagtagaaataccatgtaaaaatcttaggataatgtttatacttgatcgactattgaaaaataaatataagcaattaaggtgatgtggatcaattagagaaggaaaaaaatacgatatagaatcatccaaatataagattaaggtgatatgacttcataattaagatcagaagaaaacaagaaagataatttgtaccatagatcaatcatccaagcattaggaacaattgggatgatatggtttaatgagaaaaaaacaaaaataacattaattacacttagtggaaacacaccctttataaatatataggatgccattataaagaaaacgatttttgcgaacataccttttatttcacatgcaaagaagacccatatgtaaaaagatttagaatgtatccaatatagacctgtatgtgaaaatatagtctatttttgcatgtggatctgtttgttaagaagtccggatgcaaattttggtacccggccggctccacctccttttcttcctcatgctaagtcttttcatcttctcactactccaccctatctcctctcctccccgtctactctcctctcctccatcgactctccttgacgatcagcgatgggagcgactagcgggcaacactgggagggatggtccactgctggagccccgcaggaggagtgcgtgatcggtgaaggggtgaggaggggtggtattggaggcgtcggatatagcacgacggggaggagcaacggtgactagggtgatgacgatgtcaacaacctcatatttgtcatctatatgttgttattccctcatattctatccgataaagttttagttcccttgtatgcgcactaccgttcatgcattagtatccttccattaggatggtcgaaaaagactaaactacccttctttctactcatgctaatggatgttaatcctctcatgaggaaggcatgtgatctgaatgacctggttgagcaaccttttctgctcctccacattgcccagcccatacttccacccaatctagagtgaaaaaaaatactagagtgagtcgatacggttctatttgaaatataattctcttaccttattttttccttttgcaagaaggcaagaaaaagatctaacagctgttcgaggaatcactacaacatatcaaggctttcttgataattcgtatgactaacagcgaatccatcattggtgtacgataaattctcaaaaaaaaaaaaagagaagaatcttagtaaagtttaaccacggccgattcctaccaagtcacaatatatatcatgctacaaaatcgtcaaaatatgttgcaaatcatgagacctacacgtcagcactttcctagtcataatgttatgccatgtaggattacaccttttatggggcagtacaacaacaaccagtttatgatggtttcggtcatcacaagtgctatgatgataggaattcgtcatgaatatctatcacgatgatccatttttatcacagaaggtaatccagatggggcttctgcaatggcgtcctttcatcacaaggtcatcacaaaatacagcttgtgacagaatttcgctatttcttgaagaaagtgcctcgtcaaggaaggctggaaccattgtagtgagtaaagcttcatgtatcaataaatgaactcaatcttgaacccactcgcttgggtcatgagactagcgtgggggcctcaatacattcataggtctcatttcacttgactatgatagcattctaaagatcaatatctcacaccatcatgaagattgcaaaggcagttgagtttgataatgccattgacatcatccaagactttcacctggtttgagcaataatgattgtggcacttggggaatttggaggcgccaccggctatgaagaggtggaattgggcaggaggcagtatggatgggagacattgctaatatgtaatatgaatttgggagaggagccaacatcaacatatacggtgttttaattattattatttttttggaggggatgggcggcaaaggaatcgactgatactagttgatatctcacgctttgttgcgggatatgtcgatgaatgtatgttatatattatagaaatggtagagatgtacatatttaaataatgtgaaaaatgatatgaagataatgatttgacattgcttgcatattgagttctaaaaaaaataacaaaattgtaaatcatatgtcatgttttcatgatatttaaaaaactttagataataattgttagtgggtcatgatgtggcacacttgaatgtgatttaaaattatctcccttgaaaattttgccatttgcaaaaaaaaaaagaaagaaaagataagggctgactgctgagcttgtaatagtagtcttcgagtgatgtgctctcacgacaatggcatataagggaagcagagtttcattcaatggcgtttaaatacatactccctccgtcccataatataagggattttgagtttttgttttcgttgtttaactactcatcttattcaaaaaatttgtgcgaatataaaaaacgaaaagttgtgcttaaagtattttggataataaagtaagtcacaaaaaaataaataataattccaattttttttgaataagacgagtggtcaaacagtgcaagcaaaaactcaaaatcacttatattatgggacggagggagtagcaattttgaatgtaaataagaaaagttacaatttggaataacaaaagaagaaataaaagatcagtaaagttgatagcccaatcatatctatatatgatccctgagaagtggaatcgatcgactgccgacgactgcaattaatatttaagacccatgttgcgaaaacccgggacaagagagcccggccagcttaatcacaccgtacctcctgggctcctttgctgatctggccggtcaatcgatcgagctagctagttcgttctcctttcatttttttgctaccttttctagctagatctggaccttaattttcttcgttgatgcaaatacgtataggcatagaaatatcttatatttgtactttgtacagttgcacacttgcactagttcatgtcaggggtaattacgatacagggacttggtctcacactatctgaattcccgatatggatcgtcagtgatggatcgagatgtgcaggtggctgctacagtcaggataggtagctgaagatggagagcgatatgatttttacgtgagggtgcagtgcatgtggctcatatctggattattaacaacaacacttatatgcaatttgtgttcatgatggcactaattaataattaccggagaaaactaaaaagttagaatattcgtgttgagttttctccaactaatttcgaatgtagtattgatctaatgacgatcgattgaccgggcctggtggccctgatgatcgatagtgctagctaattaaatcaaggtcaaattattactatccggctatctggtagtgcattatatcgacagcgagctagccaactaaatatatttgacttttcttggatttatttatacctacctgtgccaattaatgggacctggacgtcaattcgtttgtattaatcagttagacaatgctgtgtatatgtacttgaagagttaactgtagctccatttaaacgaactaaattatatgtacacttgcatgattaggatcagttcaaacttattaagaagtgttgcattcgcggccatgactagaaaaggtaaaatgcacttgcgtgattaattagttttccatatatccatcatcatttaaaaagccaatcctgcagcatgatcttgtcatacttccgtaattaatttactcccttattgggtatgaggaatttattaggggttaccaaattacctgcaaaccatactggcaattgatagcggaaaaccttaatttttttttgttatatatacaaacgcacaaaagatataaccagttaaaaacttcgaattattcgagtcatgtatatatatccaaattaatgtcgatagagctcgcccagcagccgcggcttctaatagtaatataatcccatggaactttcttcggaaaccacttgcaactgtacatgatgtatctcctacaagaaatggtaggcatatatagtacgtaatgacgatcagaagtcaaaaggctcaagaatagcactgctgaaaccatctgcatgcgacatcttttctgaaatcagatgcattggaaaggcgtacagaacccagcaagtagctacctaggaagaaaactaaatgactaggagagtatttatactcctagttgcacacttggactgagtcgactgatgaacaagaaccttaatttatctccatatataggtgatttttattgaggacaatgcagattgcccttcaggaaccaaagaaaatattagaaccttttttcccccctctctgttcctgcattgtgctttcttcagaaagaacaccgttaacgttattgtgtgataaatcagtagagagcacttttagaggaaattaacttcagtaagttaaccaacttgatagtcttaattataagatatttttaatttgaccaggacagttaatggtagcagcgcatacaccatatgcagtacgaattaaatttcgcctgcatgcagaaaaggttgcaagcaagcatgcatgcatcttaggcaagagctcaaattattgatgcgagatatatatatcttataaaaaactatgggtgggggcctggatgtgttgtttactgtagcaatgtttatgaacttgccttcttggctgtagtaacgggctagaagaataaattagaattgttactggtcgtacaccatgtactgcaccagaacatagttagaaataaggttgtagttgcatatccatggcattgagaagaagtccaattatctgtttggaaagtcaaccatatgaaattaaacaatgaaccgaatggacactgtctgtttaatatttatttttgtcatatacatattgcagtgttgtggatgcatgcatgctgcctgccagtatatgtccatcaaaagctaagaataataaccagctaaacgtcgtggagtattaattagttacaacgctataaatccaaagtgacattttttttacaaacaaatcttgagaagttacgttgtgctactttctaactatcactaccataaaaacgatttttcacagcgagacctataaattttaaaggtggaccatatttttagctgtgattatccgcctactatgtggagagggatatgattttcctccgcgtgcaaaaaggaaatttcgcaggcaaacgcttaaggggccacctacgaaaatatttttatttttgcaggtggacctcttaagccgttcacctgtaaaaaattaatttttgccactaagactaccgcttgcaaaaactgatggccgaaaaacccactacaaaaataaattcccacgtctccacaacctcttctccctctctctctatcaccattagatcctctttctctctccctctcctcagagcacacaagccctgcttctctccctctcctcagagcacacaagccctgctacaaggagcggcggcaactagctcgcgcgaggacgagcggcgatgaggagggccaccactggcatcgtctcggcgaggaagagggtcagcggcggcaacgacttgatgaggaggagcagcgatgaggaggagggcagccggtggcggctcagtgaggaggaggaccagcggtagaccggttcctctccttccctccaatcatgcgggcggcggtttctctacgatgaggaggagcgttgctctgtgacgaggaggaatgtcaatggcttggcggagacggtgatggcaaccacgtggcttggcagagacggcaatgatgactgcgcacggcaaggatgacggcgaccacaagggcatcggtgaccacacagagcgatgtactgcgacggggaccaagagggaagggcgagctgaccgcatcggctggcggcaatctctacagctccaccattgttcttcttcctctagatccagatccataatttctctcttcttttttctctttatttctgtggaatatgtgaatcttgctcttctcatttgtgtggtgacatttgatttgatttgcattgcgcttgatctgtgcaaatggcagctgaatggtggagcctaagttggtcctcctagtctaattaggtacccaaacctagcacattgacatttccaaaccctatcttgtacattcatcagttgatggtttgaactaacaagatattaaggctcatgatcaatcgagtgtagagattagggaacatatcaatgaaaaccaaccgaagtactctcccttaaattatcaatagcttaattatccatgtgaataagtcgtagtccggccggctgatattagtgaatctagctatatgagaagaaagagatagaaaagctacaggacaatatgggtccaaagtgaaacaaaaggtaagagagggtggtctaaagtgaagaaaaaaagattgattaagggatggtctaatgtgaaactttgttaaaattagtagcctaatgtgcaatttacttatatattaatgatcttaagttttacaactttcaatgtttgtgtcaatgtggttgtggcttctgcaatggatatgagttaatttggatgtgaatttgttttatcaatgtggatatggattagagatgcagagatggattatcttatacacataagcttcccgtgcacacgccgtacacaccaactagcaaaattcaaaaaaaaaagaaataattggacacatactttcaataacattatacctacatgtgaaatcttatcttcaaattcattatattttagctattacaaaaaagacaaaattctaatagatatttacccttaaaacatcagatttttcactttttagttatagctaaaatataatgaatttgaataagactttgcagatatgtgtaatactattaggagtaaatgtctagtttttttgtataatttttgcgacatttgataggagtatacacgacaatcttgtttgtataggatataaatcatatggatgtgtaggtggagatggatatgtatgtatggattatttggatgtggatgtattgtatgtaagtgtatgtgtgaggggatttgggtgtcatgttgtggaactattgggtagatggactatgtggatatggatatatgaatgtgcagaatgaatatataacctgctatatgtttatttgcggttgctatttgtggtatacgtatagaaccggtaccaatggagctcccagatataagttggcagccctatagttgtcggctgttgtttataacgactcctatataaaattataggtgccagttctaggccagaacccgtacctatatacgaggttgctaacatttcctacaagtcccatcggtaccggttctacctataatcttatataattaagtgctagttttagatctggcactaatgattgagatcagtttcacttagtgtcgggacctatgcgtttgggacataggcgccttcctacggtagtgcgatggtacacaagttaaagatatactagaaagcatatatgtacgacacctgatgttacctcatcaatagccatatatatgcaaaaactctttggttagtataggcgtttcagagaatatgatagcttacgcttcatagacatgatgtttggagaaaacgatgagtagtatatatgtatccatgtataaaacttttaaggcagcacagtggtagcttaaaactcgttatcatgtccattacatattgcatggtgactcaaaaacacacatgtttctttttcttaaaaaatacacatgcatggaggttgtagctttggggcatttgtctcctttagccaagcaagacgaagagcctatctgaaaacctacaagggcgagaaggccgccaaagctacaatggatatagcttggggaaaatgcatatgtcataacgcaaattaaccagttaatccgtacatagctttatatatctacctcgtcaagcaagtaaaacccaatatgcaataattttttttgccggaatgtttgacgagcaattcctaatgcactagactaacattctattttcagacaaatggaagactaaaaagaagggcaagagtacatttcatacctgtctttatcagaaaagctcatggaattttccaaagatctcgtcaagtaaaacgcatgattgatcctgatcctgtgcttgcatatgcatatatagtacggaccgtcagatatgtcaaagcagatgggtttttcgtgacagaaaatgaaataataatagttgtcactatcggttttcttaattggatgatccagatctgacaaattgaaatggatccagtttaattttggatgtgagctgagtcgtcgatatttctccgaatatcctatttgccaacctggtacgggttgggatgagacagataaccggaataatgacgattgttctttacgaattttatatgtgcgtggccacaatacaagccacatatttttatatataaatattctacgatagacgacacactaaactcttgtgtcaacaagtttatatttaaaaataataaaagaacaattctacatgtcttataaaagattaatatatcatcattttcatatatttgtgttaatcctatctataaggttcatcctcgttgctaattatatcttctctcattaagatacatcatctcaattaatttgagccttcgcatgattcatcaagggtgcaaaatgcctctcttctcccaaacaggtctagttctgtcaatttaatggccccaagcaaagctagaaagatgggccctttaatacagctctgatgatataataatgtttctaacaaatgtaatgcatgaaaaaaacattcttatcaaacaagttgtatatctttctcgcctggtcttccaaaatctaagttcctatggcctatgggttcatatatccggagcatacatatatggggttggccccttgacttcgaggcccagtgcggtggcatggctcgacccccctcagggacgggcctactcccaaaggtcacgccatgcatcctaatcatttctaacctttgataattgatcaaggcattagagatagagaaaacatatcaaagagaactttacatactccctccatcctaaaatataaaaacatatgaccgaatcagacattttctagtactacaaatctagacgggcaacctgtccagactcgtagtactatgaaatatctcatctgattttaagttcttatattttggtacggagagagtagcaagtaagaaaaccgattttacatcttacatctcctattttgctatgcaattcttccggagcaatacggcggggttcctatctagttgttttgatggtacgtgtgcgttaatcaaaattggttgtagaattatactagcgaggatgattccacctaataaaatatcaaaaatacatcttaacattactgcaaaactttttgaagggacaccaacaatatgaaattgagtaaattaaagtttaggtcaccttttcttaccaaactttcactttgggcaaccatttatctaatatctttttactttgcactagttaaattttgttttttttttacttcggaccatccaaattctctccttgagccgtgtctagcttcttcctcccatgcaataggacggcttgcatgaagattgacgttgtgggtatgtcgacgcacttaaattcattcatgtgctcgagatgagagtttggtggtctaaattatatataaccatgcatggtctaaatcttctatctattatatactaaaagtccattaaacttcctacaaacgctcttaggccgccacgtggcaatctaaaaacgctcctaagccgccacgtggcagaaatacatccaacccttaattttcatttaaattggtggacccattattatggaccattagattagattaaaaaaaaacccaccccttctcttccgcctatgtatgacaggtgcgagggtattgtgccggtcaaaaatgtcatcagcagatatacgtcaagcaaaatacgtatatacgcactgttcaccagaagaaagtaggaaataaatatacatactacctctgtacgcgtgtacgattaggaaagaaatgttaatcctttcgtcctaatatggaatacgaggttacttattattatgcacatgtttcgatgctaagtactgagagatcccctcataatttccccaaagcgtaaccatgtgtgaataaattttgagctagtagggttgcagccacgagtaagtcttcccttgttattgtgtagccagaatgccgcaaaacttccatgcctaagcgaactgttgagagtacgtttcgatttctgactgtgttagcctggaagtgcttgtcccaaccttgtttctgagcatgaacgcccgcaagccaacatgttagttgaagcatcagggcgattagcagcatgatatcaaaacgctctgagctgctcgttcggctatggcgtaggcctagtccgtaggcaggacttttcaagtctcggaaggtttcttcaatctgcattcgcttcgaatagatattaacaagttgtttgggtgttcgaatttcaacaggtaagttagttgctagaacccatggctcctttgccgacgctgagtagattttaggtgacgggtggtgacaatgagtccgtgtcgagcgctgattttttcggcctttagagcgagatttatacaatagaatttggcatgagattggattgcttttagtcagcctcttatagcctaaagtctttgagtgactagatgacatatcatgtaagttgctgataggtttccagttttccgctcctaggtctgcatattgtacttttcctcttactcgacttaaccagtaccaacccagcttctcaacggatttataccatggcactttaaagccagcatcactgacaatgagcggtgtggtgttactcggtagaatgctcgcaaggtcggctagaaattggtcatgagctttctttgaacattgctctgaaagcgggaacgctttctcataaagagtaacagaacgaccgtgtagtgcgactgaagctcgcaataccataagtcgtttttgctcacgaatatcagaccagtcaacaagtacaatgggcatcgtattgcccgaacagataaagctagcatgccaacggtatacagcgagtcgctctttgtggaggtgacgattacctaacaatcggtcgattcgtttgatgttatgttttgttctcgctttggttggcaggttacggccaagttcggtaagagtgagagttttacagtcaagtaatgcgtggcaagccaacgttaagctgttgagtcgttttaagtgtaattcggggcagaattggtaaagagagtcgtgtaaaatatcgagttcgcacatcttgttgtctgattattgatttttcgcgaaaccatttgatcatatgacaagatgtgtatccaccttaacttaatgatttttaccaaaatcattaggggattcatcagtgctaagtattaattagatttttttttaaaaaaataaggccatgtttcgatgctgtaaaagtttggccaaattttttttgacatatacggacacacatttgaagtattaaacgtagactaataataaaaagaattacagattccgactgtaaactgcgagacaaatcttctgagtctaattacgtcatgattagccataagtgctacagtaacccacatgtgctaatgacggattaattatttctttaaatgtaatctcgcgatttacagtcggattgtgcaattagtttttctttttgtccatatttggtgctccatacatgtgtccaaacatttaatgtgacggaaaagttggaagtttgaagaaaaaagttggaatctaaacacagcctaagtattagtttaaaaaacttaaaacgggttaatatgactttttacagccacatttctataaaaaaattttcaaacaaaatacaccgtttagtagtagcggaaatcgtacgtgcgggaagcgaggattggaaccgagacctgtgaacatagccaaaagttgttatgttcgtatgcgtatctaccatctgtccttccaaacataagtacacgtggtactcactatacgctgaaaaaaagcagaaaataaaacttgtagatacagttgggaaaagtaaatccatccttccctcttaattttagattcaaacctgttatgtttgtatacatacacatgatcagttcatgatccgcaccctcctctatggtttcttttactctctttattttctaccatagtgattatttaaaccataattcactatttaaaataggatctatcttcaatataaaacagaagaaaatatattgcatcctatattaactatatttttatactaactacattttaattaaaaaatgttcacatatggaatattgtatttatttattttataaagtagacgaacacgcgcacacacaccactacatacgcaacttcacactcacatccccgcaaatgcaccttctaacacacgtttatataatcctattaaaagtgcacctacatgtgcgtaatattcgttgttgaaatattttattatagcctttcttagtgaaatagcctatattctaataaaaaatgtcacattaatatccttttgcatgtccttctcacgtagcaattagtattgataaccatttgctcgccaacatgcattgctaaattagatctataataaccacgtgacacacgccgtgagtattctttgatatagcttatctttacattttctttaatatagtgcggggttacgatataagtattaaaaagtatctaaaaattattagatccataataatatcaaaacccactaactcatgttagtgagattattactcgagtgaatatttttttccatgtgtttctcgctaccattgagtctgttaatttttaggcagattgtaattaatttggtcaatatgattgaatagagtgccagataatttctcttaataaaatatgttaagaacaatgcttttattaaaaaaattgcacatggaactatgttctaacattttacatgttatgcaaataaaagtagcaaacttgacgacatagattatgacataatatatcaccggtcttgaaacattcataacttttcaattatacatgcaatttaccatcaagtttttttttgactgaacaatttatcatcatgttgtactcctttaattaaacaaaccattaatgactcataatggctatactatagtgctaaatacatcatgacatatgcgtcgacatgtaataaatgatgttatgatatttttaaataatttcacatcatatttttatatttgtatggtgtcaaatatcactggacaaatattcaacgctaatttgaatatatacatacatatatatatgtatgtatgtatgtatgtatgtatgtatgtatgtatgtatgtatgtatgtatgtatgtatgtatgtatgtatgtatgtatgtatatgtatatgtaaaaatgaaaacaatgaaatttagctatgtttttcatgcttatcaaattaaatttaaatttcatgtatattctcacaatttgttttggatgattcaaaattatttggatggtatttgaggagtgataagcatacatgatacatagatgtgaaaacattcaaaaataatattttcatcgggagaattagggtcgtatatgtcggttttttataaaaaaatttaattagatagatcataactcttaagttatcagaaaaaaaaagaaaaagatctgttcgtcgatttcaactaaagctgttggatccagtatgcatgtcacacagtaagattagatttgtaaaataacatgcctatgttcggccttggagcgatatagaaataacgaacattctctctctcagtgtacgtacgtaagtgtacttacatagtgcaagagtataccgtggttaactactttaaaataactgtgcatctaatttctaactggtttgtatatttatattatttgtgattaagctaataatttaagacccatgttaactatattttgactatagaaatgatatgccacatgggctaattttctacgcatcatgtagctaaattagaaccatgataacaatgatgacgatgctctacgtattttcatggtgtctataattttttaagtagtgtcaaataaccaactacacgcatcaaatttaaaagatgaaaaatgtatatatagaactaaaatttgatactataatttaagtgcaccaattacttaataaaaatgtgtctccactaaataaaaaatagactaaaaacatccgcataatgataccctcacggatcccatatattcttttgttcttccctatcttccctttgtctccctaactcttctcactgtcctcctaatagtccccaattcatcccataataaactatgataatatctatgcaattaaaaaaataccttacttttactttcgttgatatgttttctaaagaaagtaagtctaccttcttttcaaatgataaagaagattgtaaatagttgcttataaatattacttaaatatgatataatataaagctaataggttagaaaattataaaaacaattaattaataccgatgaaaaaattatggaggaattgtggcaaatgtgtctcaaacttagcgttcgacggatgcccgcgtgaatgcgcgggctactttctatttatatataaccatgcaaactacctagtcgaaagtgaaaaaattagataataataaaggaacgttttgtgacgaattcattaagtgaaggatggtttgaagtaagttgataataaaattgaattgaggaaaattgatggaacaaatagtatttgaggaatcattatatttaagaacaagtttcaaatgctagaaaagctaatatgtggatggagggagtactagtagctatactctagttccatattgcgagttttgtaggaaagtatattatcatctataccaaataattccaaatgtaacttagaactgaggcataatcaataaaactaaattaattggaaatttgaaacatgcagatctttacccaaccgaaatgttctgttttttaggttttctagatctaccaagcgtataccgcactaaattctacgcttaaacaaccacacaccacatacgtagaaaatatttctggattattaagcactttaatatactccaaattaatatttgtttcccactatattcccacttcttaagattgcttttagctcttctagattggtagaatttagtcgtaacgaaaatgctggtgattagctaggtgctaaaatgtcactatcgtgcactggatagcccctcatgtttaataaacaaacagtctactgctaaacaagagtatattgtctttcaactatttgtcttataatgaaaaaaaaacaaatgcacagtagtagtgattctctagattttggatgctcgtgactaatcaacctacaccactgctgattaattagaaacgtaatatatacaaagcaatgggtcgagatctcgaaatctcggtttgaacattggcctaatcgtcatcgatctcatgaatgacttgagtagtgatcaaatgatgtctttgtgctacaagccttgtttttcctagggttgagataaattaacgaaaggagaaggcagggatgacgcttgcgatcgcaagaacctgacgctgacgcccctctctgcatgcagaagatattctttcctggctcaagaaaaggcaggagctacctatctttttgcatttttattgcaatcccagcagaagatctgtcaatctctagctatgtagcgcgcagccgaggataagaaagcgatgttgctagatgctccttttcgtctcctgccaaaccatgaaaatttccatgaaagcacacatgcacattgcgcagaaactaagggaggagaaccgttgtccaaagctaggccgcgacagcgaaaaggagacgttagtcagtttgttccagtacagtggtgcaaggcacaagatataaccatcacttgctgctaaagatcacatgattcattgaacaaaatactgaaaattggcgattgctactagaagaagaattagagtccagcttagctaacttttttcccactgagatttcatacatctatgtcttatttcttctctttttttctcttttcttttatttcttctcttctcctctcttctcgacgcagccggcggcagatggggaaaggcggccgtcgagcccggccctggccgagctctgccgccgccaccgctcgctgggctcggtcaaggaggggccggtgagcctgttcggaagtagagcagcagcgggatgcgcgagcggcgcgccgcaggactacaacattgtcaccaaccacaagccgccgccgccgagaagcgtcgccacgctctgcccgccgaggacaaccacgatgttggcaaggaccaccgcccaccaccgcagcctcttgctggacacaggcggcggcgccgccgcagttgcatctgctcgagacgtgcccatgtcacactctgctaccacgtcttcttggcctcggacacctgcacatacgaatcatccgtctcatctatataaaagctggactagtttcgatcgatctcacatcacatctcattctaaaccataatcgatttggcagttcatgaccgagagagagacctgtaatctgcagctgaatttcagcagcatcgctcattgtgaggttcagaaaaaggataaacaacaagatgtgcctagtgctcgtcgtccataggtccagcagcagtggaaggctggaacttgccaacttggagtcgtcatcaatcagtgaaacgataaaagggttgatagcgcatgcacaaggggctaattttgccgtcaaacgtttgaaaactactccggcgagtcaatgtttatgtcctgccccggccgagctctgccgccgccaccgcttgctgagctcgcgttggaggagcgcggcctcatcagagacatggctgctgccacgacgattacggccgcgaggcagctgctgcctgctgccgccgcctccgcctccgccattggcgtcggcgcccatgtagctgctcccccgccgcctacgcccgcctgcgcgccactctgccgcccgcccgcgagcggcttcgtcccccaccgcctgcgcccgccggctaccgccggtgcaactgctcccccaccggtgcccgtgaagaagacaggagagaggaagagaggtggagaggggatggggaaaaaagatgctaacacatggggcccatgtgggtcccacgctgagtcagctcacatcgaataaaaccggagtcacaaaacatcgagggacctagtttacactggtactgtaagttgggggacaccagatatctggttttatggttgggggatgattttctaactcgatgataagttgagggaccttcggtgcactttttcctaaactcgagtcagggcccaactcctaaactgacctgctaatatttgcaatggctttggtaaaaataatatttatttatttatatattttaaatatttaaaaataaattctagaatcaatatattataaaaacatactgctcccgccctcctggagggcgggacaaacaaatcgtcatgggggagggtgaggcatatgatgtgacagcggggagagggatgcgccgtggtaattttgtagacagtcccttcccgctctccactaggatgatttatcgccgggaagagggctgccagcaaaatcccacacacgtccctcccggcgattaaccatactagtgcagggcgagaaggggccaccttcaaaattaccgcaactagtcaggaagagtggggtataaatcacactagcgttgtggtaattttgaaggtggcctcttccctgctgcaacgtcatataccctgctcttccatagggcgatttatttgcctcgccctacaataaggtgggaggagtatatttttataaaatattgaatctgattttttttaatctctctaaaaaaatctctttgcaaaacaatgggctctcaattaatcccagattttcccctataaaaaaaaattaaacccagactttgtcaagaagcccacagtaaggttagggcatgcagtgggcctagtaccgcggttggtgcgggcgatgagattaactactggcccatccaaaggttggagctgcctcaatctgccataagcccacgcacctgaattacagatcaagatgatttatgcatcgtgtcaagaaaagaaaaaacagaagatttatgcatgatccattccaactttgtgtaacacctcagaaacaagattgtgtagatggtaacggatacttacgaaaaaattataaaacgacacggtctgatataaggttgtctccgattcttgcgttgcggctgaaacaaaatctttatctttatctttatctttactattataaaaattaaaaatgtttttatcaactttttggtacgtcatctgattccggtcctccatagctgtgtcccatatccgtgcaaatctgccatgtacgcgatctaatcgaatcaaaacaaaaccctcatatcgagtttgattacgtcgccaattctaattcatgctctccttattgttcgtttcctttgtcatgtcatctgtgtgtccgtctccatcgtcgcctacgtggctacgtgggaatcccgttcggattttcgggaccgctcacatgtgacagggagtcctctaggacacggcatccagacgcacacaagcctccaactgcataccttcaagagatccgccggcatgacgtacggtttgtatgagtggctgcacacaatccactcatacgttcgaacttcgcatgcatgcggctttgcactcgcgtggccctgttctcgtcgcacacggtggtatactggccaatgtatatgctagggcgcttgtggcctgtgttggtatttcttagcgatattactaggaataaaatttacagcaatgacgtagaaatactcctgatatattatagttacagagttcatccgcaagcacactaatatacctttgtaacattttacccgagagtattccagcggtattgtatttatttaatcccgtcggaagatcatagtagagagaaccagactaataatttatatgttacttataataattatagtctaagtaggggttacgataaattaaatgatagagtgatatacaagtagagaaatactcattctcatactaaaatatctaagctaagtggaaagaaaatagaaggagaatcttttcctatacttctagtatacatagtatacgtacattctagttatctgattaactagtttaataccctctatccgatgccctcctggtacatcgagaagccatccctgactgtcgagttccttacgacagcctatcattaccatacaaccggggctaaatacggaggactaccatcctcagtaaattaacttaggactatatacacgcgcggaggaatatccgtactgaggtgtcactatcagtggcccacctctcatccgcagcatataaccccaaataatgatatcccgtaatctagacaccatgcctaaactaccagatactactctaatatcatcgtcatatcatagagtaattgcataagcaaacattgcccgtaccgatgcatctcccagataagctagcagtataatcagtataacatgaacataatgtaaagctggcattcatatactcggaaagtattcaataccataaatgtataaagaagagtattctaataaatgtacaaagcttacaaaagaggaaaatagagctactagagccatacctgaactcttccgaaggctaccggacttcgatttctactctatttctactccactagcttaagaacactaaactaaacttgacagaatatgagagagctttgcttgaggtgtgtgagtgaagtgagaagaggacctccttaaataggctgccaatgacggttgtggcatttggaatggtcggaattgccctccaaccgtcattggggagtgatccacaccgtccagaagaaatcctgcatccaacggtgctaggggggttcggccgaactaggggccggcccaaccagcccaggttttggctggtggcatcctctgttgcttctcttcgcagacttgttaattttggctcaattcatcttgtcaattatgagttttttgcctattcgtgcataagtctgattctcgacatcatccgattgatttatcgtctgatttgatgtcgattctactccactttatggttattccctgcaaaaggttagtgaaccaactactagtggaatattattattctaacgtgaatatgcattgcaagcataactagttctcctctattttggtaatattgatggtcgaaactgatcgctaatgaccgtcaacaaaaccccctaagcttgaacctttggttgtcccgtgtaaaggacgaaaggaaacaaagacttagttgttgatcaagagttgctactatgctgtatatctcaaaggtacaggtgcaagatatatgtactctatctcaaattaaataatctttggcacggtggcttacccttatccctgattcccacgagatattgcttctccttgccttgaacaattgaaaaacagaacaacaattagagcatgaatcacccaatctttattcaacttttattccagaagttttcaaatgattttgtaaaagaaaagccaagttcctcaaatgattcactcattctctctaagtgtatcaatatgaattcctcaccatttttgcctttttgattcctactctaaggtttgatatgtggagctcggtagggattaaacatacttgcattcatatttattactaagtaaaaaactcagactaaaatagataactaaacatactcaagataaagatcgtgcaaagtgtgtgatatatggtggaaatgtaatatgaagaaaaataaagaaaatgcttctcttttgtgcttacttccttctccca

SEQ ID NO: 45068 - DNA, 7643 bp, Oryza sativa
  unsure (1)..(7643): unsure at all n locations
ggattttctttttaaggagaagaaagcacataaaagcatggagaatttattttggtggtagtatacaaatggaatggaatggataattgctaactctcagtgtaggagtttagcatttgcatatatgtgggtgtatgatcttgatcatagagcatgagaagtatctacacaagtcacaagaatttgataaagttcgatggaatagcaagtaaccaaaatttatatggtttaatcaatgaagcatatttttggctctagtaggaatttatatcaaatgaggaactttcaaatttatcatttcgaaaaacaaagcatccggaattcaagtcaaactaggactaggatcatagcaactcttatttactatcacatatctcacaacaacttagactcagattagcaagtgcagctcatttacctcaggttcctagataattgttggctacttatatttaatttttgagagagcacttacctatgaacccatatatgagagatataaaacaaagcaactattcatcatttcaacaaagagaactagtttgtcttacctagcatgacaaaaccttacctatctttttggtattttctattttgcaagtttttatgttgttttcaggtttataggatgcaattagaaagcaaacatgcaattggaaagggaaatattcaatatgatacaagttacctcagtggggggagagatgtttccccacaagcttggctttcgctcagggtccttggtaaggattgaacccctgaaagcggaagtatgtttgaaggtcatcgggcttttgctgcatcaggttgttgatgttggtgaactgagcatcagtagtttgttgccattcttgcgcttgtgctatgtgttcctcgaggttgtattggacctctcccatatgcatatcaagggtattcattctccgggtgatttcacccaagtcccaacgagaggaacttgagcgccattcacctggagatagaggcataccacttgatctgggggttgattgctcatgtccccccactgtatgtcatgaggcacatgccgtaggtcctcattggcacttgcccattttgagactccgatgctgtggcgtggagcttggctccatccggttacatccccagtcagctcccaacctgcctcatacgtttgcacgggtgttgaggatgatgaaccttctcgttcattccttgccatgttgcatatctccctgtatgttcgacctacacaagattcttctatggtctgcaagggaatggttagttcatggcagttgtagaaatgataccccacattaggcaacgggaattcatttgtacaatcgggaaaaaagtaagtcaaagatccatctactccatgtttaagaatatgcctttgcactagataattctcatcaatacagggacgagcggctgagatataagcaatctggtcattgacgtcccctagtcccttggctatccgagtaatcaaagaactgcactcaacaggagcagaaaatcttatactttctaaccattgccttatcatacatttcacagtagcaactttgatcttcctaaccatggcaaacatgataattaattcatccccctaatgggtctaagatcacttctaggaaacaaagtcatagcaatccatttgtgcataagcctaagtgtaggattatgaatatcattcgtcctaggtttcttgcaaattggagaaccataaatatcttcccaaaacctatttttctcaaacgcagaaattcttttctgaagatcgattttacaggaatcgtgaaaatcaagaagtatacttaatccttccatgaaagtgtgtattccttatggaaaaagcgaaaggaaattctatcttctatttctttcaaagtgcacatgaatcgcaaagtaagcgaacaataaccaggctcatctaccacagcaaatctctgccaaccaacaactttccagatagcacgaaagttagtatccatacctatcttttccaatagctccagagagtattctcgcgtgtgagtatactcccggtctcttggcatgtagtaggcttgtctttcctgatcgtcgacaaggtcgaagtcggcatcgctcaagagacgttgcagaatgtcggcatcctccatcgagacatcggttgatgaacgagcactagactcatcatgatgacttgatgaagggctggatcccttgcacagacgaggcaatcgcttcattctgcataatgaagcaagaacagactaactcggcgggggttagtatagcaagaatttcacccgccggttagttttcaccaaagcaacttttatgtatgcgactaagtatttgaatttgagggaaactatcaaagcttgaatgaatttacgagcaaagtttgaagagggaatgaaaatgaattggaatggggtgcattcccctctcacagctggccggcttatatagggcagccacaacggtcaaaaatgacatgtgggccccttagccgttaccctgtcaaaattggtaggtagccgttgcctggctggttcggccgaacctctggtgggcccaaccggccccacttttggccattggaatccaacggttagtggggtcgtggcatagtgaatttttgttgaaaattttattttggtttgctctgaaaaattcatttgaaagaatttcttcaaaattcaaaatcctaaatgcaagttttgaaattcaaacatgtgttgatgcaaaaattcaaattgttgaaaataaatatgcgaattcataccaatttacctgttggcgaaggtcgcgtcattttgggtccgacgtgcaagaccgtacctcctttcagtttagttcacggattttccacccgtctccggaggggatggagcgggtgtctttggcttttccttccacaccttctttggttttggtgcagaagacggcttcttttgagctggctgctcttgctttttggccggtgtactgggttttaccggcgtcttctaataacggttcctgggaaacgctgtttcattttccagcaaattctgcatgaacttcaccaggctgtccgtctcgggtggctccacttcgacctcttggatgttttgcaggtttggcccatacttgattctgacactcaaacttttcttccttcccgttaatatggaaacggatactccccgttcccacgtcaatgttggctcctacggtgctaaggaacggatgccccaagatgtcgcgtccaggtagtcacgggacatgggagtgagtccattatagatgttttacaagataagccagtcgtccatcccatgatgaggacaggcggccacatacttctgaagtcgttcccacgcctcaggaatggactcatcccccgtctgctggaaacacgatattctcccacgaagggcgctggttttgcccatcgggataacttcgataggaatgccgtagaacatttatcccaggtgtagatcattgcacggttggcatagaaccacagcttcgctttcccaagaagggaaaacggaaacagccacagcctgacggcgtttggactgacacccttcatggtgtatgtgctgcaaatctccaggaactgttgtaagtgagcattggcatcctcattaggtttgtcgcagaacaggctagcctgcgccatcgtgatgaggctggacttcagatcgaaatccacttctcccaggttgatctgcggcccaatggccacgttgtcagctgagggagcaacaaattcatggagggtcttgtgactcttgtcagccatattctggaaggtcggtggcgctggtatggctggtttctttgtcgggagagttttctgcggagcgacgactcgcggcttgacgctccggaaaaaaagcttctggattttctttaaagttttccggcaagttgaaaccagtcatgcaataccgtgtttccacaacaatagtgaaaacaaccaaggttagcctgcaaaggatagtgattatgtagaggtaaatataaagtattagttctggtaatctctattataattctttcccagcaacggcgccagaaatgattgttggtatttcttagcgacattactaggaatataattcccagcaatggcgcagaaatactcctggtatattatggttacagagttcatccgcaagcacacggatataccattgtagcatttcaccagatagtattgcaagggtatcgtatttatttaatcccgtgggaagatcatagtgagagaaccggactaataatttagatgttacttgtaataataatagtctaagcaggagttaagataaatcaaagggtagagtgacacacaagcggggaactactcattctcatactaaaatatctaagctaagtggaaagaaaatagaaagagaatcgattcttatacttctagtatgcatagtgtacacacattctagttatataattaagtaactaataccctctatccgatgccctcttgttacttcgagaagccacccctgactgccgagttccttacgacagcccgtcgtgaccatacaaccggggctaaatacggaggagtatcgtccccaagaatttaacttaggactatatacatgcgcggaggaatacccgtactgagctttcaccatcagtggcccacctctcatccgcagcatataaccccaaataatgatatcccgtaatctagacaccacgcctaagctaccagatactactctaatatcatcgtcatgacatagagtaattgcataagcaaactttatacccgtaccaatgcatctcccagataagctagcagtataatcagtataacatgaacaaatgtaaagttggcattcatatactcagaaagtatttcaataccataaatgtataaggacgagtatattctaataaaagtacaaagtttacaaaagaggaaaggagtgttactagagccatacccgaactcttccgaaggcatccggactccgatttctactctattcctactccactagcttaagaacactaagctaaacttgagagaatatgagagagctttgcttgaggtgtgtgaatgaattaagaagaggaggtccttaaataggctgccaatgacggttgtggcagttggaatggtcgatattgccctccaaccatcattggggagtgatccacgccgtctagaagaaaccctgcatccaacgttgccaagggggttcggccgaaccaggggccggcccaaccagcccggtttttggctagcagcctcctctgttgcttctcttcgcagacttgtgaattttgacccaattcatcatgtcaattttgagttcttggcccattcatgcataagtctgattctcgacatcgtccgattgatttatcgactgattggatgttgattctcctccactttatggttattctctgcaaaaggttagtgaaccaaatactagtggaatattattattctaacgtgaatatgcattgcaagcataactagttctcctctattttggtaatattgatggtcgaaactgatcgcaaacgaccgtcaacagcctgtttgcacgacggcagggcaggagcaaagccactgagagcaccaaccacctcacctgtcctcccaaagctgaacatatacatacacatgatttgatatttttttcttccccgttgcaatgcacgggccattttccagtcttttttagaaaataaattctgcttccacccaccgttttcattcgttcgtctccccaattaagtggatcactgtcgtccacgtatcactactaaaaaccgatttttgtggacacactccctattttatacaagcggaccaaaagagcgtccacatgcaaaaagatttgcatgctatttggttatgagttatgacccacatgaaaaaaaaatcaaatttcacatacagacctcttacgaaacccgcatggagaaagaactttctgggcctcctcgttttcccttttctttttaaccgtccccccgactcccttctcctctacttatatctcgctccctcacttagattttcttcccctctactcctcccccctatgcctcctctacttctccctccttcagatccacaaagggagccgatggcggggtagcgatggcggtccggtggatgtggcaacgacagtagtgggcgggagggcgaagctcgaggccagtggatctggcggcaccgccctcgagagggtcggatccgtagcactcggtcccgctatagctcgagggcggtagatctagtggctctgcccttgggaggggcggatctgctgccctacgcccgggggtttatggcgaggacaacagccttgagctcgagtggatgagagtgggagctagggttttgggatttcggtttcttttggaaatttttttgttattttttcttttcgcatgtgggaggtttaactgaccgcccgcgaaaatcatttttttgcatgagggagcgttgcccgcatgtaaaaactctgattttcacaaatagttatgtgcatgcggacgaagtgcctgtctgcgaaaatacattttggtagtatggaaaaagttttctgtagtagtgtatacagccatgtccgatacaattccatcctctttctcatcactcacgacctcattcgtacgtagactaagaacaaaccaaagtcacaatcgatctgcccagattgacacggctgcacatatgagtatgtcgagtaggaggagaagctgctcatggacgggttccctaaccaatctctgctctgcacgcatgtctcgcaagaagccaagcaatggccgcacatcgcggtatcacctcacaccgtcaagcattcaccccgacaaacatcgagaatctccctttgcttcacatcatgtaggtaagttctttttgcacatcgacgtggcacggccgtgagaattaacgcaaagcgtggatgaataagtgcttattttctctgtagagtatgatgggtttcggaagtttgtgtctaggttgaaccgactatttaagatgatttcccgacgaactttaaagtatgattgcctaaaatattttgaagagcagaagctagagctacaagatatgtccagaaactgtacttctaatgtttttgtgcagaaactgtacttctaatgtttctctaacaatggctatgtggacctcaaaccagactagaggatatatatgtataacgtggcactttattgatgctgattggaaggtaaaaaaaagatttttaaggttctcacacttaaaaacattgcacatggatgttgttatattcaatacaatcctagagaccatataagattgtattgtgaagataaattgttttcatcactttggataatgctaacaccaatagtgcaatgtcgaagttattgaaagctaacgttttgcaaaagggtctactgcatgggcaagggaagctattacattaacattgcatgtcacatgttttgaatttaatactctattgtaatcaacatccatgggagcattaagtatattaaaggataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45069 - DNA, 1084 bp, Oryza sativa
catgcatgcttgtgcttattacagcatcaacgaatttggataaagaggtcactacatcttgcgaatgcacatcatgctaacccttcccttgaccatcgtcaagagaagtgcatttgccgaacggtccgtgaggaaagagattctaaaatagttgaaaaagatgacgatgaacaagaagattcaaagacaattacggagtctacacaagttatggccgtctgctccacactcattgcaactgtggcattcgcagcagcttttacattgcctggaggttatagagcagatgatcacaccaatggcggcacgccgacattcgtcggaagctacggtttcgatgcattcgtcttggccatcacatttgcattcgtctactccttgttggctacatttagcctcgtgtattcaggaatgaccaaagttgactacagcatccgcttggagcaccttaactcggccaatagcttggtctggctatcaatcaggtgcttgctagctgcatttgcattaggtttatacgttgtcctggcaccagttgctcacaagactgccttgcttatctgcctcatgtgttccgttgggttattgcacgggcatacgtcaatgaagacacagatccgcatggccgtgctcttacagggaaggattgggtttaaggtgtggtggattttgggcaggaagatacttcgaaactttctgcactcattttggcccttcctgattatctttggttggccagcttatctgaaatggaggcaccaacagtagttagactcatatatatgaccaccaaatatgtcgtatttgtaccgctgatcaccatagattgtatttcttatagtatcccttttgctattgtgattttgtttctatggtgacaacatactgtattgtgtaccattctgggaaaactattgtatttttgccacatcagttcaaattatgacaattcgagtccattattatatctataaatcctatataactatctgaacgcacagagatgtagcctagaggggggtgaataggttttactgaaattcacaaacaaattgcagtggtaaaattcagcagaaccggaact

SEQ ID NO: 45070 - DNA, 4948 bp, Oryza sativa
  unsure (1)..(4948): unsure at all n locations
ctatgcaaagaacccagaagatgtgcaaggccttcaacccaacacttctagcaccacaagggatcatgtcttttgtgatgaaaaacttcatcactaaaaggctgtttctcatcacaattacccccttgtgacgaattttggggtcgtcactatgttgtcaccactactggcgtcacaagtagcatagtgatgattttttttttcatcacagataatggctctgtttgtgataatcctatcgcaactaataagcagtacattagagatggtatcgtggtcacaattacaggagacactagtgacaatagtgccctcacatatgtgaacgtgtagtgatggaatttttttctcacaatattgtcgacggttagtgctggtttgctcgtcactacatattactaattaccgataactcatcatcacaaatatacctttgctaataacttttctcacatatgatagggtttttgtgataagatattagtttatattgagaagtaaaaaccacaagaagtaagatatattgtggtgaaatgacgtgttatttgttgcgaaaactggtcattctttacaaatgtagtagtgaccaagctaatatgtatatgtgacaatacctttatcacatatgaagtaatgcatcagtggagaaaaaagggtattgctgtaaggaaaacttttatcactaaaaaattaaatatccagatgcaagttttatatatgtgactaaagtcttgccacaaacaacacgtcttttatgacaatattcagcatgtgaacaatgacaaaatctaatgatgaaatctcgatagagcaatggcaagttcaaacattcataactgagcacccctttattcatgaatgattacagtatgctcggaatagagcacttcagaactcaattgaaatatcacctaaactaaaaaggtgtaacgctccgctttttgtgagacgttaaaaactaattcagcaaaatcctaatttcaaaaattccgttatttgtgtgcgagtctaagttgtgccaagatctcaattcaatctccatctttgttccccctcgtcgccatcaaaatcgcccacctcaaaattccaattccgactcaagtctccgaaattcaatcgcctcctttgaatcctcgccaaatacctgtcccgattccaaaatgtccgagtccaccttgaatccattccttggctcctccgtatttcgctgagttcaaatatgcaatttgaattcaaatctcgattcaaatccaagctccaattcagtcttctctgtaaaagtctatttttgccttctccctgttttgaatgggccggatccactctccagcccatctctcccctttgccatctccctcacgtgcgctgcacgagccatcgccgagagaaggatctccctctctctcgttttctctctctcgcgtcgacgccgcttcccgccgtcgccgcccaaaacctccaccgccttcgctcgttcccgcgcgctcgcgcgtggccgactgctcggttgccgccgcgtcaagccctggcgtcgcctgcgtcgtgcgctgccgctctgccgctccacgccgctatcttccaaagccgagagaggcagcccccctcacttactccctctccctccttcaacttttcccgaaacagcaaggagcagagctccctttctcctcctcctttttcgttttgcccgaccaccatcagcgtcaccgcctgccaccaccttgaccacgcccgaccgacagctcctctccttgaacgacccaaggtcggttctcccaaaccaacatcgccacctataaaaacccgagcccctcccatctccctcactcgtttctctcgtcgccacaatcgcgccttgtcgcccctgccctgcagtcgcccttaccatccgtcgccgaagcaccagggagaccggtgcgtgtgaaggacgcgagaagaggactccgggcgccgtcatcttccccttccccggcccgaggtcggagaggttgctcccgcgccgtcggccgctcgtcacagcgcccgtcccggctcggcagtgcctcctcccgttccccttcctcgctctccctcgccccctctagtctgcgtgatagctcggtggcactcccgaacgcgcgtggacatcgccccgagccccgccgccgcctggcatggcctcgcggccattgccgtccactcccggaggccaccgctcgtcgccggccctccttggtactcctttgtcccatccgtcgccggaactggattccttgaaccaaggatatgcttccaccccttttaatcgaacccccgttgctccgatgaagtttcccccttttctcgccaccggtgtgcgccttcctccagcgaatccgatccggtggttcacttcctctcgtccgtcccatcgttccggtgtactccctctctctcgaatcgtcgcgacgagctccggtgaacttggccgccgtccgccgtccatctcggcctccccttcttcctcctcccgccggcccgcgtggctgccacgtaggcgccacgtcggcgccacctcggctttgaccgggccaagccagtcagttgccccctccctccgtcttccctcccgtgcgcgctgtccatggcaagccatgcggctgcacgtaggcccaccgccattcgtccacccggcgcgccgcgcccgaaccacggaaaaaccgaggccagttgagatcagtctccctccgaaaacctagcgcccgctcccgcgtgcgccgcttccaccgtgcaccgcctcactgacaagcgggcccactcgggaccccgcgaggtgagcccggtccacccggctccccttccccctctctctccccgcgcccctctcttgggctgcctccccgtagcccgcaccggcccaataagctcggctgagccgcgcaaatcctctcgggccgcgccaagctactcgggaaagtctggttcctatccctccttccttttcttatccaaagggattaataaatccttttccctttttcacaaatcaattccttattcccaaaattccatgaatcattttctttggtcccgcacgtcagtgactgtcaataatattcttgagaatattatttctataaattccataaaccatttctcctattccaaatattccaattaaacctccgaaatccatatctcccaatccgtaactccgtttgactccgttcaacttccagtaattccataaaattgagatctatataatggcactattatttagtctaaataggatctttattttggtcttttgtttaggttttcgattgtttgcgtatagttgcggttaccggattttcgtcgattgtggttttctcgaagattcatgaagcttcgcgaagacctttagcaaggcaagtcaccctttgatcaatatctcctataattgaaaaatcattattattttgtttgcaacttgaactattagaatcacacctataacatgcttggcctcggtttgcatgtcaaaccgacggacctacccagtagtcacacaaattcctgcaggccgtactaccctgattccttgtcgctccacccttgtggtacttcggtatccggctctctgagcgcgtataccaactactccacatacaccgttgattgtcgataatttgggaaatgggtttgagaagccttgaaaacccgacatgtggtgtcggtgtgtttgaaaataaaataaattgtgaaaactcgcgatgcgggagttgtgcctatgtggcactgtcccgtattcgcatataaggaccgattcctgtgggaaactcatcgaacataatcaaagtgcaaccacaaggtggaatgggacaccctggctaagtaactagtcggttcagggaaacctcgcatgccaatagttgggaacgccggggcggggtcggttggagccaaaccgggttcctggtaagcaaggaagagaagcttgctgaattaccgatcgaggtggttggagtttgatttgtgaaaactaaaatggcctaaatttatgtgaggatttgatccttctatgtggcatgaggtatccctaggtcggcttgggaaaggctttgttgcgaacctccgacaccgacgggtgttcggaataagttcgtatcttgggggtacccctctgaagaggttaactaactgttcgaatagccgtgcccacggtcatgggcggatgtgaggtggttcccgttgcttagatttgtttgcctgtgctttgtgaaaagttattatggtgtgggaatcataaccagaatcagccaatgtggccgatggatgacctgagtggtcagaaacgaatctgtgtgattcgggatgtctgcgggcatcatagactaggcttcccgagtagaagcggattgttgtgctgctgggcagcaggactttgggagtccgagaaaaaggaaaaaggctctgggagacgcttaatcaagtgaaatggctctgggagccgagaagtaatgatctgacccgggtggtcggtacattaccatttgagttgttgaaaagcatctcttaaagtcgaatcgagacgcaagtctcttttcggcccacacttagaaagaaataaatcacttagtgatttcaaaagtggtttcaaacaaaggatttgcaaaacaaccttgcctctcttcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45071 - DNA, 10413 bp, Oryza sativa
cccctaatatattatggcaacatgccctcctattttcagcattttcttaattaatattggaaaacatactttgtaataaattatttaaacaactatatcatctaaatagctattttttatccgtgcatgggacgagattatttacaataaaatttagaattcaatacctacattaaatatattttaaaagtaaaataaatgtatttctttgggtcatataatgctagagactacctattggtcactcgatatatattaagaaaaatcacatagatttttaaaccatatgagtggcaacattttgcttatattagtaaatacaacacccgacacattttctaataggtctaaaattatatctatattttaaaaatagataactaaagactacgacccgttggaatatgcctcagaaaaaaatttccgtcccttgtcctgctgtacatatacctcctttgatcctctcgccttattatttttaactaacaacctaatatttaaaaaacatagctaaatgacttataatttctaaaattatatttgatttttaatttgttttaattattgttttatttacagttaattaaataattcaatatccattatagttgtattttactatatagaaattaaaatactcctatgcagggcaactgaatgaaattgaaaaattataacagaatgaaaacatgtattatttcatattaaacaatctacgcaataaaaaccaaaaccaattaaagacctttagagcacacttaagtcaccatatgtcacattttaaaattataaaatatttcatttaaatcgatggacccattattttcaaccattagatttaatttacgaaaaatcttacgctgccacgcgtcatgtcctgaaaatcataaataatcttaaaaattttgagaaaaaattaaacctatcatcattggttttaagttacattatttggagaagttataaaaataaatcgcatctacctcctcgcccccttcacatgcgcgcagaccactgccaatcccatccctatttttgggtaggagtaaactaaaagagaaataatcaatatgttaaaacaaccatagtttttaagctacatgtctgatttctaatataattattgctctatttataattaaactaggaatttaagatccgtatccttatattttcctatatacaaaatatggcattcgaccacattgttgacgacaaacccagaagtaagatttaggatctgcacaggagttaagcagatctcctaggccagtgtgtgtttttcacatcaacacacattcagcccatgtgctttgcataccatccaaatatgattcaaataccttaaacaagttggctgcacatattacatcactatacatcattctgcaaacatgtatagctaaattaaatcaatagttatccaaacaaaaattacaaagtgaactatgaaacattttttttattaagggagaacaccctgcccttttacgtgtgatttgaattgctgtaaaagaattacgaaataatccaatacaggttgcatcatcatatgttgtttgtcaaacatgcatagctaaattagatatacattgtctcagcaaatacaactaactaaaatatgaagtccaaaccaccaatgcatagaaaatccaatggctttagttagagaaaatccgattacttcatgatttttttaaaaaatatgtgctaaaataatccaagcaagctaaatgatcttccgtgtatttgctttaaactatgttaccatctaattgactttagatggtgcttaatgcacttttagtatatcattgatatatgttcaagcgtgttgttttggccttctaagcattctgggtaactccgtttattttctttgctcatagaccattcaaaaggtgaatcatccctatatataaacattaatcatctgcaaatatattttgttgtatatatatacttaaatgattaactttggagtccatttagattttatgatataacaagacatggaaatattagtaactaagctccaccaaaaatgtgatcacaactgcgatgaatcacaaggcaacctctgtaggtgcaatgaccacatctcaacacggtgactaggagctgcataaaaccgtatggcgggggaaaaggaacaatgaatttagctaggtcttacattttcatcaatagggcccatagcattcaacaaacaaagaaaaaaaacaccttgcttttaattaaataaacatgttttctaaacaaactaggtctaactcctttttagatgatgatgaagattatatataattgcttatacatattaattaaatactatatagtatatagcatagagaaattatcaaagtgatgcaacgaagaatatttgctgaggaaatgcacttccaaaacatggcggaggctctctgataaatatgatccattttcaaatacagtgcacgatacatgcccgcgcgaatgcgcgggctaccttcctagttatcttaatgcgtctaatctgaaaagaataaaactaaaagatggacagttactgcatcggaagtacactaatctctggatgtagtaaagaaatttgacctttgcaaaatataataaccgcagcctgcctcattctagtacataatcaaagtgggcatgcgaatctaaaaagaaaaaaaaagggtatccttgcaaatcccagcagaaaatcagacaatgcgtcgcaaacaggtgaaaaacggcatcattctcatgccagaatatactgaaaacccgaattttagttcagaccgggtcctcaaatctgaggcggttttctgcaacgaatcaactcttgcgcgcaatcatcctaccgccgactactgaaagaccacagatctctcccactatttccccaccgagatccacgaagttggcgcctggcaatccgcattaatccctcgccataggacgcagcaaaaactacaggaacagaatgcagtagggagcatggaaagttctagaagcgcacctggagaggagagcccgcaagaagagattaccagtggagcttagctgactgagagtgagtgagtgagtgagtgagtgcgcaaccaccaactaggtacagaatctggatttagaccccctgaagaggactcgtttaatattcccaatcggactaaacaagagtgtcttctgatgtcgccatggccggagctccctgcatcagccaatgcgccagcagaaaacagaataaactgaaatggtgacagcagaagaggctcagctcatatgatgaggggatcgtggggtccgtttctttgatctgaactgggtactgctcgaaaccagcggatcagtaaccgtggcccccggtttcatgggcacgattgtgtgggcagttggaatgttgggatcttgctgaataaagaacaggatcagtattgaggcttgacagttgagaggatgggcctctttgggtaatcagccatttgtcctcagtctcaaaataggtacagctatggattttttttcggttttagatttttttttaatatttacagaaataatctatggacaaaaaaaaattgcagaaatagcccctgccgcccacctctggggcggcaagctgacgtggcaaacgggggaggaacgggtggtgacggagggagggttttttgcaggaaaacccttgccgccctctggtggggcggcaaggggcccgaatgcaaaaaagccagtcggggccggctattttgcaggcggccccttgccgccctctggccgggcggcaggcctcgctgcctataaaaggcctgctgcccagcccccagccctcattcttctctcctcaattccagtgaaaaaaaaagaagagaggggaggagaagagaagaaggggcgaagccctgccggattcagacgccgatttcaggtaatattcatagatcctatatgtgactattgagttaaatagtgtgtattctttaaaaatttgtttgaataaatgcattatatttttagggttttagttgtactaatctagaagtgcgtattgtagatatcggtaactacgtagatctgctagtttggaattaatacattaccgttgcattggcttacacaagaagatgttacgttgtagatgtttattgcatgaaagagtaatatgatctagttatttcgttgacagatatgtcgaacaaacaaatattccaagtttaccatggaccaggaaacgtccgttacgggccaactggggtagatctgtcagattttattgtatcagaaaggggaattgatagaccggctgagaggagtgtaccttctataaaaggatggttaatgaggggcttgagagttgatccacagacaagtgacataacaatcaatgttatagtaagtcgggcaactgagggtttttattgggaactaatgccagttcaaaactctcgagtgtggagatggtatttggaaaatgcattgcaacgcgggtggcctctagctttggttccgtttgttcacccgaaggatccaggtgtgcagacgaacatggatgatggcgagggaccaagtgctgaagtaaacgagacttctgtggaggaggtcaacgcacgagaggacgggggcgtagtagctccagtgggcattcaaccaggtggagtggctgacgagggggagactgtcggtgccattgtggatgaaatggagaggaaggattctgacaacgagcgtgtagaggaaggtgattcgtcagatgatgagacggatattaatccagcagaatgggctagtgaggatttttctgggctgatcgtctctgaagaggatagtgtgagatgggagtacaaagaaaatgaggttattcagggagcgatttatagtagagcagaagatatgaaggaggcggtaaaacattttgcagtgtcacttcatagagagttttgggttgccaagtcgaaccggtcgcaatatgaagttcggtgtgttaaggaaaaagattgttgtccctggagagtgcacgcgtataaggggaaatggaaggattattggacagtgtcagttattaccaagcatacatgttttctacctggtgttcagaaataccacaggaacattacatgtgcatttgttgcatctgagatgtatgcgcatgtcatcgataatctcacatatgaaccaaggtcaataatccgacacattgaagagacatacaagtatactattagctatgccaaggcctggagggccaaacagaaaataatagagatgagatttgaaacttacgaagcctcgtatgacaatttgccatgcctgcttggtgttatcgaggaaagaaaccgtaggagctcttacgaagtgaagaaattcccctcaattgaacatcctggcaagagtgtgctgcaaagggcgttcttagctctacatgtatgcaagatggcatttgtgaactgtcgtcctgttctctgcattgatgggacattcttgacaggaaagtatcagggccagatactaacagcaataggggtagatgggaacaatcaggtattgcccttggcatttgcttttgttgagagtgagaataccgacagctggtactggttcctgaaattggttaaaacaaaagttgttggtatgaggctaaatgtatgcctgatacatgataggcacgctggcattctgcgagcgataggagagttgcagtttgggagtatggaacgaggatacctcggtgtttgggaagatgtacagagtaggtggtgcatgcgtcatatgggagctaatttctttaagcaattcaagaacaaggagctcatgaacatgttcaagaggctgtgcaatcagaaccaggagaaaaaattcaatgcgctttggaagagattagatgagttgacagccaaatgcagtgatcagcgtgcagcggctccatcgaccgccgttgctgaccctcctcaagctcttggacctctcccaacggatagtccaacattggttagaagaactggattggagattcggaaattttctcagtggattctgcatgaaccaaaagagaaatgggccaaggcgtatgacacaggtggtgctagatatggaataatgacaacaaatttggcagaagtttacaactgggtgatgcgcggtgtccgtggactgccactagttggcatagtggagttcattttacatgggacatgcaggtaatttagggatcggttccaggcagttcttccctctatgccgaacaacagcattttgtttggagctttcatgcatgaaaaagctagaggagttgcgtaaaaaggccatgaaacatctagctctagtgcaaggtacccaacagcacaggtttgagatactatgtcaagataaggcaggcaggggtatctaccgcaagagagtgaagcaggagtgtgttctcaaagccgacggcacatgtcattgctcttgtgcaaagccgaagctgctccacagggcatgcacccatgtcattgctgcctcagaggagtgtctataccaaatgtaggatatgtgtcacagtacttcaataagcaacaatatatcatacatggagcggcgagatttatgggttcggcatagctggggagttcacagagactaacgatgaagtactcaatattcctgacccatcgaagctccgaggcaaggctggaaggaggaggactcatcgcatccgcaacgatatggacgagtcggaggctggtagggtgaagcgttgcagcaaatgcgatgaacatgggcacacctacaagcattgtcctaaagacaaggagaaaccaagtgcggcggaggcaggactatcaggatcagcagcagatggagctcgccctacgggtgaaggcactacctccactcgaccacgtcctaggcgtcgtcgtgccacgtctggctacgtggtgtagttcttatgttctatgtcggcatgtggatttgcttgtaattcgtttcgaacttatcgatgtgtttatgtttcgtcgtgtaatgtcagacttcggcatgtcatgtctttaggtctcgtgatgtaacgttggactaaggcgcctaacgtctttaggtatgctgatgtatgtcggacttcgatacgtaatgttatgttatattattgaactctacatatatgttaaattgcacgtcatcgttatgtaccattagtaacgtttgctatatttaaatagcctgtactcttgttgtacataattaatctcatgattttattactatttcataattttgcaagttatcttttgttttacagtactattttttgaattgttctaacacgaaacactatatttttcagagatggcacgtcaggatacacctcagttattggacccggcgatagatcaccgacaccggtctcaccttactgcggtgcagggggctcagcttgggacgttccgggcacggacgtgcggtgagctactcatggttcacgactcctttgtcgagaggtacgaacagtgttttactataagttagttgcactgtaatattttttataatgacatattaatttgttattgcaggctacgtgaggccggcctcctaccgatgtgtcggctggtggaggctgcggccggtgacgcggacccggccagacgatggtctgtggacaggtccctcctagcagctttggtcgatcgatggaggccagagacgcacacttttcacttgccgtgcggtgaggtagcccctaccctacaggacgtatcgtacttgttggggctaccgctcgcgggagacgctgttgggccagtgaccacggctgtggactggcaggacgatctgacggcacgtttcgcactagtacagcgcgcaccgcacctcccactcgagccgttggcacactaccgcaacaccggacctacgaagaggtggctgcttcagttcaccgtgagtgttttttaccgaaatgacaatcgtattacatatttagtccgtagttaaggtgcctatcattttatcgacggcttgtaggttgagcagctacaggcggaggccgacgagtactcctacagccgatgtttggaggcgtacttgctctggctttttggctgggtgatgttctgtggcggtcatgggcacgcggtcgacaagggactcgtgcactacgccaggagcatcgccgatgctgcggtaggcgaggtgcctcagtggagctggggttccgcgttgttggcagctctgtaccgtgcactttgtgagtcttgcacgaagacggatcccagcgcgacctttggtaggtgccctctctttctttctatctgggcagctgagaggattgcgatcggccgccctgaggtggaccagcacgcatacgaggagtcactgtacgaggagcgaccagaggtcgactaccctacgatgggtactctgtggtgccgtcgtcaggtacgttgcatcgatcttatcgtattgttaagttaattgctaagttcattgtacatcacatcgatcgtttcgtattgcagcgccgatgggctcacgtccaggttaggcggtcgtatcctgagtttgttatggagttcgaccgccttctgccgactgacgtcgtgtgggagccctacagtgccgcggctacccaggctcgtgcgccgttgggtctgtccacactctgcaccagggaccaggcgtactggatgactacggttccgatggtcttcgacatctgcgttgagcctcacgcccctttccgcgtgatgtggcagttcggcttccgtcagccctttccagtaccgtttccgaccaccgtcccagctgctgttcactggtaagatcttgcactacgctttcagttgttgcattaaaatctgcctgttcacaataatttgtaacatctgtcgtttcacactaatattacacattaattcgcaggtactcgcgcaagggtcagcagtcagctggcgactggcccgccaagttggcgacttttgttgaggactggttgctcgcaaccgaggaggtcgtggaccacgagggagagccacacactgaggagtcgtaccaggcctacctacgctggtaccagccacgcacccgtactagggtcaccttcgctcccttggagcagcagccccacgttgcgagcactagagacctatatgccaggcaccgcgaccaggacttcgctcgtgctgtgagtaccctgcatcgcaccattcctttatgttttcatgtctttctcttcgtcaaattttacgaatatttatgaacaaattaaccatgcaggtcgacgacatcaaccgggtcgtcgttgacggttcaacgacgatccaacgtttaggcgcggggattccggtacccgtagaggagcacctgacgacgtacacgcggatggtggagtcgatgcgctcgattctccgagtgctcacctgtcgtgcagacgacgttgctcgggcagacgcagctgtacagcggccacccgtaccgactggtccccgtccagctgcgcacgttcctaggccgactccccctccgcacggaggtaagtatttttattactatttctgtacatgcctcgcacatataagtgagccgtttcacttgccgattgcttcaggatttcgtgcaccgttcagcaccccgccttcctcggctaggccttctgttgtgccccccacaggtacttaaaaaaacaacattacttcgacaatcaatttacatacattttatgtcttagcttacaagggtcccgttgtcgatgtgtaggtttcgcccagttcgctatgacgtaggccgcccacttctcccaggctgcagggtcagcgtctcaggcagctgtgtcgacctcgcactcaacgcagttctggcagtacaccgggacttcgtcacaggcagccggcacgtcgagtcagggtccaccactggaccatgctgggacctcgtcggaccgcttgttgccttccaccttcctcttcgacatcactgacttcgacttcgcttcaggcttgacagaggacgtcatcggcccctcacagctgggaggcgcaccgccggtgcagacgcaggaccaggcgcaggccactcctccgtgggacactcgtgctacccgtgctgtgccaccggatcgttccacgtgcgagcacaggcccggaggaccaagcgtggtcgcggcgcggggcagggccagtagagcagtcttctctttgtttacttgcttcactttccagtactgtatgcttgtgtaatgactacgttgttgttatatgtgcacgatacctttcggcgcatgcacgatacctttcggcgcatgcacgactactttctgccgcatcgatgcagcctcctttattcgcgtgtgatacgagtatttgcccgccatttggcgcatacgaccaatgtaactttcggcgccgatcatgcatgtatctttcggcgccaatcaggcgtacccaccataccccaccacgt

SEQ ID NO: 45072 - DNA, 4213 bp, Oryza sativa
cccaggtattttattatctgcatatgcttattcattccgtatgggcaatcgctttattcttcgtaacactactctattcggcagacccgcactacggcttgcgcatacatcaagtgggtcgatacagaaaatcccgttctcgacctaaccacttgtttacaagaaggtcgctggtatttcgcatccgaaagtactaagcaatacttatagagaaaagcggcttatgaacgacaatgtcgtgaacaacagagcgactggcgggtgctaactacggcactccctccatgggaagcccgtccaagatgcaggtgtggtgatcgttgtcaggttcttcgttccataaatcctacaacattgggttgaaggttctttgtttgtccaaatattcttgacgacgatttcatggttagaatattttgattatatgaatccttattttctcacaacatttactaactttgcttgctttacatctattctttcctcccaggaaccaccaaggagatgtcaatacagagaatggatagacaccagaagggttctaactccacctagccgtgttgtgcagcttgaactaccagagcaatacagggttactaaaacgcggtttgagagaggagagggatcctcacgtaggggttagctattatcggacaacttggcatattgaaatttctactgtcatgcttccttgtcccattactacatcgtcgttgtgttcaactattgcactacctccctcctagttcgaatctaatatcatctatgtaaccgcaatgcaaatagttgtatcatgttcaaattgtactactatttcttcatgttacataattctccttgtttaagtccatataatgtttctacgacccagactgcgataggccgatataaattattcgagtactaatacgtcgaataaggtacaaaataatacctcacttaacatatgaaattgcgcaacaactaacttcaatacatttttataacaatattaacaagttttaccaataaatacttctttatttattattaacataacatagaaaaatcttttggccgtacttttttcatcgggcggcaagggacccagatgaaaaagtacggccgcaagctctttatgggcggccaaaattgcaattagccccttgccgccctctgtacgggcggcaagggcctaatcgcaattttggccgacggcggcagacggcgcggtcgacccaccgtctgccacgtcagcttgccgcccaccattagggcggcaggggctatttctgcaattttttttggtcgatagattatttctgtaaatattaaaaaaaaaatctaaaaacgaaaaaaattctacagctatgtagtattagaaatgggccgtgagcctttgctggtgttctatcagggctggaccatttcagtttgagaccttcataaagaaatatcagacagacgtgcaggtaaatggaatttcttgaggactgaggtcaggagctcactgaaaggaaaagaaaggggaacaagtggacatcctaaaaattaatctctaaaggcccctttgaatcgtaggaatgaaaaaaaatagaggaataggaaaaacacaggattcggacagaaatacaattgtaaaacagaggattgcaaaacacaggaaaaacacaggaatggccgtttgattggaccacaggaaaaacgcaggaatcagatgagagagatagatcagatgagagagatagactcagaggaaatgttccaagaggttagacctcttgctaactttcctccaaaatgtgcataggattacccattccataggaattttaaaggattggataggattcaatcctttgtttcaaaggccttcaatggatttttttccgtaggattgaaatcctccaaaattcctacatttttcctacaaatcaaaggggccctaaataaaatgtaggcaaaaggaaaatgatcacaagttcaattcctcatctccttcttttatggataacaagttcaattctgaacacagttttctgaaatttctaaatcacttcaaatagcatatcatgttgacaaaccaaaaaataaaatccacttgtcgcggaatgggggtaaaactgacggtaatgcttgaaggaggggggggggggtaaaccggaaaaggaattgatggtgcgtactcagtagtgacaaaatcgatggaaaagagtcagcaaagtagcaggggcgacgtcgaaacttagcagataggtaagtgtgtcgtaaggtccgattggcttcactgctacaacttattgggttttagccttaccagccattcgcgttgggttgataccctgtagccatagttgacgcagtcgaatgtgaccatataaataaattgttgtagccaaggaggtgtatatatatagttgggaaggctaattctcatggatagcgtgcggtctttatgtatcacatatacatgtaaggaaaaaaaaaatccgaatttccctcctagctatatggtagtatgatacccctcatttcaaaaaccagacattcttcaccctcaacttttcatatcgaacgaattaccccctgactgactccgaaatagttttggtcctacgcagttcaatcaacatagaaaaataaaaaaatggtgggatccacttgtcctcttctttttgtcatcacatgtgagccctactttttttttatgctaactagactgccacgcgtaagctacttcctccgtttcgtattataagactttttagcattgctcatattcatatatatgttaatacatctagatatatgtatgcctagattcattaatatctatatgaatgtggacaatgccagaaagtcttataacctgaaatggagggagtatgtaggaccaaaattgcttcagaatctgtcagggggtaattcgttcggtataaaaagttgagggtggagaatgagttttttaattgaggggtaatttgtactgccctgattgataagggataattcagactttttcctgaatatgaatataagtagcaattcgtgctgccacaaatttgcatataaatagtttgagaaggctaaaacaacttgcatttattgatttgcaaaaaaatagattgagaagattaaaacaacctgtgttgggaatgaaagagtggcatacaatatgcatataaaaagaaagataatgctttgtcttggagatttcctcttgagagatgaaaacatacacttttcaaaagaaactaggatatcatgaaaacatacacttcccaaaagaaagtaatattagttgttcacaatacaaacattaaaaacttgaatcctctataagggcataggcatacactttggtgaaggaactaattaaacaaagttgattaaaaaaatgtttgctgcctatttattagatttgtagtgtgctcctaacaaaaaaatgatttgtaatgttcatacttttaaaatgatacataagtaagccctatataggtctatatgggtcaactgcacaggatgttatagactttatactaatattaattatgtttaaactccaacggttgtagaggaaaaggtcgacatgtacaaacattaaaagttacaatattacaacttcaacggttattttgaaagtatgaacattacaaatcattttttgttaggagcacactacaaatctaataatctaataatgttgttttgacttattgttgtgttagaatgggggtctatttttttaatattgctcaaagttatgttcatattacttttattatatctattattttttatcaacgtatgcacgacgataatatatatataattatttttataattctataatttcttaagtggcacggaaaagtcggaagatgtagccctaactaacgtgacatatttattctcaaagttgaattaaattgtatgagtttttaaatgcaaaataatcaaaagaaataagcggatcaaatattagtattttgatttagatgttatatttgcttatttgtttcgcatagaatttttgtttttctaaaagcgtgaaaataggaaaagaaataggtaaaaaagaggggaaataattgagaggagggaatagacgtgtgaaacgtacgtatatacgtacgtacatgccatcaggcgcaggtgggcccagatatgggaagacggtttttttatagataaatctaatatggttacatataatgtgttcaccaaatttaat

SEQ ID NO: 45073 - DNA, 7136 bp, Oryza sativa
aggatgtcacatggcggtttaggagtatttatagcaagcttagtgaatttttagtatataataatagaagataatagattatattcagtttgttcgtcaattaaacttgaggcgggccgtactttggtgaaattgctgatggacgactaatcgcgcgccggatcaacctattagcatttttagcccacgtttttagtcttttctattttttgtaatttgtgtcatgggtaatttagctacagaagttgggttgtggagcacgcacgctttctaaacggttaaacgatgtattttttgtaaaaagtttttatacgaaagttgcttagaaaaatcatattgctccatttttgaaaaaaaattagctaataattaattaatcacgtgttaatggaccgcttcgttttccgtgcgcactgtgctgttgggaaatagctccagcaaacacaccctggctgtgttctttgctcctagttcccaacccctctctatcgtattccgcgcatacgattttcaaattgctaaacaatacttttttgtaaaaagtttctatacgaaacttgcttaaaaaaatcataatgatctattttttttaaaaaaaataagtaatacttaattattcacgtgctaataggctgctccgtttttcgtgtgaaggagtttggttcccaaccatccgaaacgaacacagactaaactcagctccacctttttaggttattttatgaggtgctctactcaaccccgctcgtattctagatgaagctagagtgagcttgagctcagcttgagaagagatggaaatatgccaaacatatccttattgggctgattcgattcaatgggtcaaatcgggcccttttctttttttaacagattgcacttatttcagtccatacatataaagtttacgtatacaagatttaaatatatatacatggtgtacgtacatatacacttatatctatgggtctgttcggattgatatcaaataaaccttaccaaattttggcattgtcaaatttttagtaaaattggcaacattgccaaattttgataggattaggttaataatgttgccaaaattctatatacattaccaatatttaataacaaactacatataaccacgtaactatcaattttaccaaataatagtatggtataaaatgccatcaatctgaatgggccctatgtgtatatattcttagtatgtaaacaagcgtacttatgcatgctacaacgtcgagacgtgtgagcaataatatagcgcattagtccactgctagctccaattcatctatagccaatcttataaccaatctattatattattaaaggaatagaaaaagttgcctccacgttcgctctcacggtctagaaattttcacattaatcggagaaaaaaaaagcagagtccatatagaaatacaatttagaaatagctgaaattcggaattaaaaaataagaaatattagaagaggagactacattccatatagaaatacaatttagaaatagttgaaattcggaaataaaaaataagaaatattagaagaggagattagagtccatatagaaatacaattaggaaataattgaaattcgaaattaaaaataaggaatattagaagtagagtatagagtccatatagaaatacaattagaaaataactgaaattaggaattcaaaaataaggaatattagaagtagagtatagagtccatatagaaatacaattaggaaataactgaaattcggaattaaaaaaaagaaatattagaaaataaggaatattagaggtagaatatagtctatatagaaatacaattaggaaataattaaaattcggaattaaaaataaggaatattagaagtagagtatagagtccatatagaaatacaattaggaaataatagaaatttagaattaaaaataaggaatattagaagtatagtatagagtccatatagaaatacaattaagaaaaaaatagaaatccagaattaaaaaataagaaatattagaagtagagtatagagtccatataggaatttaaaattaatctaaaatttggaataaacataataaaattaaagtagagtttagaatccatataaaaatacaatttacaaatggaagaagagcctaaagtccatatagaaatacaatttacagataacgaaaattcagaattaaaaaaaaagaaatattgaaagacgagtctagaatccatataggtatataatttacaaataactaaaatttgatattaaaaataattaataactaacacgtatatataatacaatataaatattacacattagtagtttcgtaaagttagtataaaatttaaaattatattgtcattttaatatatttgaataatacattgagaaaacatatatgttattacatgagagaaaatataatgatgctagctgcgcaatctgcgcgggctaccatgctagatcatataatagttgcttattatactattaatatatggtcccatacatacattgcgtcttggagtccgcgttgcagctagctacagatctgtagtctaatgctcttatctctcatattttatctcactaaaatatgtttacagctggctaatagtaacgtggacccttagaattggataaaattttagatagtcgcttgtcaaactgctaaatgataggttttgtatgaaactttctatataaaaattgctctaaaatatcaaattaatctatttttcaaatttataataattaaaactcaattaattatacttaataccatcgcattttacgtaatagacttgatcttcaatcttaaataacaccaccgaagtctctgacaagaagacccgtgctccccgccggccgccggtggacggagctctgtgtcaaccggagctcgagctgctttccatcaccggacatgatgaaagccttgatctgttgccggcaacgtagtttctctgccggccaacgcgacggcgcgacatcccctaatcactctcaatccattctgtggtaaggtagggcaaccgcaggtgattggagaggcaccctcaaaatctcaatccacccgccggcgtacatctccgctaccacctgctgcgcgtggcgtgatggctccaagctagctttccccgccgcgcccgcctgaggatccacaccacctgctcggctgtcacggctcgccccacatcgcgcgcaggatgttcgacgaattgcctgacccggacaacgtctcgccgttacgcgtcgttgaccagactgcgcctgcttcccccggcatgtgcacgcccacgccgtgcagctcgggcttttgctacagcacgttcgtcgggagtgctctgcagctctggtgcgcatgtcccggcggcgcagggtcagacaggcgctcggtatctctcttcttcctctgttagatgtcttgccgttacatgattcgtcttgtgctgatttctgttggatgcttatgctaaacagggaaatttacacggagagacatgttgcaatatcactgaacataccgggtggagatcatttctgttctatattgttggagggcgcccaggaattctttgattcattcagattttaccatcaggttgcacagatttggtttctggttcattataataagcaataaagcaacaagatgacccaaaggatgaattctttgcatctcccatctctccacaggtaccaccttttggctccatttgcttgtcttctttggcctaactggtttcctccacagctgcatagctctgtcagattatgtgataagaccaattgcatgtcacttgaagccggttatgactccacaatgcaacattgttgcaagcgttggactatgtgataagacatattgcatagcctactattaatgaatgggtttgggccaattatgaatgctaatagtccgccatttggaaggcttcaacctggttagccggccggccagtcagacagctaccccgctgtcttgcaaaattatggctagcagttctcccaagcatcagcagtggcagcaatgagctctcatcgccttctattcacacagcttcacctctacaacttgctgttgctcatccatgttcaccatgctacctcactcaacttcagatttgacttctccgagcctggttcgtactgtacccctggttcagagatcgcctgtgctggcgatgcctacccctacgcccatacgattgagctgacaaagaccgacatcagcgacagaaacctctgcagcatcggccgcgtgtggtatgcacggccggtgccgctctggaacaacaccaccggtgaggtggccagcttcaggaccaccttctccttccaaatcaagccggccaacctggacgtcagtgctgacggtatggccttcttcctcggccattacccgtcaggcatccctcatcgcagctatggcggaaacctcggcctcttcaatggcagcaacaacaagaacgcaacgggcaccgctaggatcgtggcagtcgagtttgacacctacatgaacaaggaatgggagaaggatggcaaccatgtcgggatcgatgttaactccatcgtctctgtcgcggcaacctcaccggacaagaacttagcaagcggcaccaccatgactgccgatatcagctacgacagcagtgcagagatactggcagtcaccttctggatcaacggaacctcctaccatgtcagtgccagcgttgatatgagaagatgcttgcctgaggtggtcgctgttggtttctctgcttctaccggaagctccattgaagtacaccgggtgctgtcatggtcattcaactccaccctaacatggatgaattcttcagtaatgccaccaggagcagcacctgtgcccccagaaactatcagctctgaaccaataatgtcaccaggagcagcacctgtgcgcacagaaactttgagctcccaatcacaaggtaaattacatggtataatagctatttcagttgcagtatcctttgtgctggtatgtgctttcatgggttttcttctacgacgtcgattagtatggaagaaatcaaatgaaatctctgatggagattgtcagattgaacttgatgaaattttttattcaaaaaaggaacttgatgaaattaagtttgcaaaaggtgttggccccaaaaggtatcattacagtgaactagctgctgcgacgggtaactttgcagaggagaagaagctaggaagagggggttttggtcatgtttaccagggcttcctgaaaactgatgatcaggaacggcttgtggccataaaaaagttctcaccagactcatctgctcaggggaggaaggagtttgaggctgagatcaaaatcataagtcggctgaggcatcggaaccttgtccaattaataggatggtgtgacagttgcatgggactcctgattgtttatgagctcgtatcagaaggtagtcttgacaagcatatatataaaaatgcgaggttgctaacatgggccgaaaggtacaatatctaactcatcttttgctgaatatgtttgcttttttcaatttagaacttcttggagaacagagataagagttgtactcatggatgtcagacttgcagtctaatggtaactcatggataacaaacttgcagtctcatggtaattcttggatgtcacacttgcagtgtaatgatatgttctttttaaagaaatcatacaacgagtccaatgaaaaaaaatagaaatcgtaataaatttttaaaattcgttattaatagaagacatatccttttgagtatcttactggataagtttggtgattaataaggtgtgcttctagatagagccactggcccacaatcagggcaattcacaggatagcccaatagattgcagaataaaaatgctgctcacatctacttgaaaattgattaactaattaaataccagcagccctttgtacttcgattgtgaagttgatatatagttttcttctaatcacaaggctatgaaggttaggccaggactcagtcctaatcaggtgtttatttttgctatggtatatctatccaactataacacaggactagctaaattttcaggtagatttgagtcaattaaggaactaaaattaagaccacattgcgtcttcagttggtttcttagaggttcagctgtgtataatctttagggataattttatcatccttgagaagatacctagaggcacaatattttctaatgaaaaatttggtacttcgaggtactaagtactttcaggtaccaaaaattttagtgtaaaatttagatacctcaaggtactttctgaaggactgtaaaaattctctttctttagaggttcagctgtgtagtttcctagaaaaatataaagaacatcattaaaatttagtatttagcatgtagaattcaaatccatccacattcaccagaagttagttttttgagttagtctccggtcctcgggaggtactagtctcttggtgaaaatagctacaaacaatcctctcttgccatccatatcattttcactacgatagtctttcatcaacaggtacaagatcatcattggccttggctctgcactccactaccttcaccaagagtgggagcagtgcgtcgtccacggcgacatcaagccaagcaacatcatgctcgactcctcctacaacaccaagcttggggactttggcctggcgaggctcgtcgaccatggcgccaagtcacggacaaccaaggtcgtgctcgggaccgccgggtacatcgacccagagctcgtcaacacgcgcaggccaagcactgagtccgacgtctacagcttcggcatcgtcctcctcgagatcgtctccggccgtcgccccgtggaggaaccggacgacagcgacgagctcttcgtgctgtcgagatgggtgtgggacctctacagcaagaacgccgtcgtggaggcggtggacgagaggctcaggtgcagcgacgatggcgacgacgagctgcagatggagcgcgtgctcgccgtcgggctgtggtgcgcgcaccctgaccggagcgaacggccgtccatggcgcaggctatgcacgccctgcagtcggaggaggcaaggttgccggctctt

SEQ ID NO: 45074 - DNA, 10557 bp, Oryza sativa
  unsure (1)..(10557): unsure at all n locations
gttcatggatggataattttgtcgttatacttgttcgagcggagcatcctctatccctatttttatcagtttatatgcattgaaaatttagggggctgctataaaaaaaatcccattcagacggatgaaaccggttacgtatgaggtcctaaccggtatcaggtgatttctatcaggttacctattagacgatatcctaccagataccaggcaatttcgataccaagaaatcacttgatatcgattaggtattaggggatgatatattagaggtattaggatctgttatttaatcggtcaaagtaacctgaaaatttatcaggtatcaggtattaggatctgatgtacgggatgccgttacgtagcattcctgaaaatttattagaggtcaaagtaaaatggaaatcatgaacgtgttcaggtgaaagtcaggaattttacatttgcggatggatgagcctgatggaatggatgagaaagtgcaatttgtttttgggtgaatagctaatttagtccttcaagtttcaacgaaggcttaatttggtccttcacgtttcattttatccacatagctcctccaaatatttgttttggcttgaaatcattcttgggcccacttaatatgccatatggctatttctagtcaatatttctattagaaaatgtcccttctgcccttaatttgtatacaactatatactagataagagaaaaccaagatgaataaacaacattgcatatgtacttcccattattttaacatgtgcacgtaaacttaagcaattgctatctcatacactttctagtacatattttattttcgttttacataatttaatatgcattatctataaaaaaattcaagcatacaatttttctcttatatatgtgaatgatgagggggtataagtgtcatttatcaagagaattgtcggttcaaggataagtttgaactaaaatgaaaacttgaaggattaatatggatagattgaaacatcaaggactaaaccaagccttaggtgaaacttggaggactactttggctattcaccctttgtttttcatctcgtgaaataccaatagcacaacattttttcagacaatatgtacaactgccctgtcagatcgcgtttacgacgacatagacggtaaggaaaaacgccacagcattcaagaaccagaacaagtacagaactaacaggtaaacccccaccgaccggaaacgccgcccgatgcgccgacgcgtccacccactgtcttctccggcgagggcacgaggcaacagaagcagtgtggtgaaggtcggcgctggcacggcccagacgaagctgagcgcgaccaagaaggcgaacggcagcacgaagatgctccacaggatgtacttggtggtcgtgctgtccagcccggagacgacggcggccatgaacgccaggatcatgctcatcagcgccatccagaggaagatgagggacatgcatatccacgccgtgcttgagcgtgccgcccccctgccgtaggtgaggagcatggtggcgatcacggaggacgccatggccacggtgtcgagcaccaggaaggcgttgtaaggcgtcgtcgcgcggaggttcgccacgccgtcggagttgtaccctcctggcacgttgaacatggcggtcagggcgatggtggcgatcagcacggcgacgatgccaaggttcttggtcgttttctcgttccattccttaacatttttgctgctccattgggatatgcaatcttgtcgttgcgccccgaaccgagctccattggctgacagtctgagcaaaaaaccaatctgacagtgaaaagaaaccaatttttagttcgatgcaatcatgaacaaagctagctacgactagtttcgaatcgagagtactaccatgtgcaagaaaccggttgtgtttgatgcgaggtcgaatggtgtttgcccttcgttgttaacaatgttcagtttgatgtttctgctctccaaaattgcgagacgcgggttcccggccttcaccgcgtagtgcatgggtgtgttccctttcttgtcttgctcattgaaaagctcagcaagagatggatcgccaaggatgtatgacactacaggttcatggcctctctcgatggccagatggagaatgtttctgccctcgttgtcgacaagctcggcagagtctgggcattctttcagcatgtcttggatgacatcaagatgacccatcttcgctgcgacatgaagaggtgtcaatccttctttgtctgggatgtacatagccgatggcatcgactgaatcaacatgctgatgatctctcggacgccatcagacgccgcgtagtgcagcggagtgctttccgattcatcgggttccttggccagattcgagttccatgacaataactcgcgtgtgatttctacatgagactgaaaattagctctgcaacaacattttcttggaaaaagtttcgtgtctctgaattctgaatagctgaagaactaagtgaagttttcagtaggtcaacggctcacctacgctctgaagaacagctgcgtgcaaagcgttctgcctcttggggccagacgcagacgcgtgcttccactggacgatggctttcacggcgccaatcgaccgcccgacgacggcgaggtacagcggcgacattccgaagttgttcacaccgcaagacaaggccggagcggccaccatcaggaccttcaccaccgccacgcgcccgtgccgtgccgccacgtgcaatgccgtgtcgcccgcgctgttcttcgtcaccagtagcccgggagcgccggatccatgcatctgagctagcctgatgagaagggacaccatgtcgcgcctccccgccctcgcggcgtggtgcaacgccgtctccgacttggtggtctctttcggcagcagcgccgccaccgccgccgcggccgtgtcgtcgccatcgcagagcttcctcacaagcccaatcttcccttgactggccgccaagtgaagaacggtgttcagccctgcggtggtctcgtccaggacgcactggccgtcatgccttcttccttgttcctctgtcaataaaatagtcaaattaatgtagacgattaatttcagattcgtagattgcactctgcaaattgggatgcaactcgatacatgaatgtacctgctgccgttccactgggtgaaacaagaagttcctggagcttgtctacagatccagagaaggcggcgcgatacagctctgggcacatcaacctgcgtcccgcattctgctgctccggctgggtggctgctgctccggcatggacggggtcttctacgggaagttgcagcagagggagttggaacgccgtgtcagccggtgagttcctcgcacgacgtaacgcggctctcaggtcatcgtcgccgagctcgtcggcctttctcaaagcttgctcgatttgctcggcaaattgaacaccagcaacatgatccatctctctcgtatggtggaaattacaaatgttagccaggctcttcaattcgatcgcttgatattggtattactgtcgcgtttaggcgtttaattaacaatcagcgccttgtaaggttacttggcaggtcaactcgaaagtagtcgctacattgtcatcgctcgcttgatcttctgtttttcagtattttacagaacacaacactgaagtatgtgcgcgcacaataaccccaatgaacacatactctcactggaaccattttcgagaagagaacttttatgttgtttgcattccaaaaaggtaaagatccaacggttctcaatcataggaaccatgttaaaagtatttaagtattgatataggtacttaggtactaagggtaaaattataattttgctagtagagtgaaaatggtataattatttcctaaattataataggtaccgcataggtacgaccgcacgtgttaacatctatatggtgtcagcgttgtgtgtttttatttgcgccattttctcttttgcgtggtttacgttgtattcaagttaagtcatttatcggcactaatatcaatcaaatattgtctcctgttcaaacgctcgaccatgccaaaagcttcttcttcgaccgtgcctcctgtggctgcacccgtttaaactctagaagaacaacataagaggagatcttgttttagtcccttatgcaaggaatttgtgaactacataaataactaatcaactgcataaataagcaaagggtaacttacgaatacgcttgcctagccatcgatcggccgatcccgtctcctccaacccttaaccataccggcgcttctccctctgtctccctccggtgaacaggttcaaaccctagaacacacaagaagcaaagggagagaataaaggagacgcgagtgttacgttctaatcgatcgctaaagatctctaaatcaatggagtatcctgatttacctttttctctacaatgatatcgagatctactatgatataccgatcattggttggaggtattcaattcacgtaaaaaaaactcatgttttactagctaattactcaattgccatcatgttacaattattttgttccctaccttgcccttcacttgatcaatggtatagattattctatctccaagtacctctaagtacctcgcaaacaccgtaaaagaaactgggccgatatggcttgagattcaaaaattcaccatgtacgtctcactatcaagaagcacatggcataccattgaacaaattaattatccttaaatgtgaacacccatgttaagtttttttctcgataactcatttcttaataactagatgatgcaccgcactttgctgtgggatatatgttagataatggagaaatgatgaaacgatttggattaaaatattatcaaaatgatttgagaatgatgatctagcatatgtatgtttagttttagaaatgaagtaaattgtagatataattactatatgcttgcatgttgagctttgtgtgtttaatgggttgatgtggcatgcttgcatgtagaatttaggagtgctaataaatactatacttgcatgttgaacttagttatttagtgggcattagctttatagaaagaagagattaatgatatttcttctcttaaatcaaagggattgtattattatttggctgcccattgatcgcatgcatgattttccataatcctttttaatggagagcctttttaatatagagtgactaggggatgggatcccgtcataggtgtgggtttactttaatgaccaagctcccatgtcccaccaagctgatctcccgcatgcgaagcactaggactccctcggcttcttgtttcattggttgtagcaacaacagggaaaggagggaggaatcaaggagacaaagggagaagagataggaggtgctagcagcatgtggcttgccggttgatcatgcaagacatgcatatacctcgtcccccgctttgacacttggtacctggcttcccggactttggaacctctaggtaccagctgatacctaggtatcaaactacatacacctaggtactagagcctggtacctgggtaccaagcttgatacctatgggtatcaaccatgatacttacaggtatcggcctgatatatgcggatacatgtgggtgatgtcaaagttcaacaagtactagctaagtatgttgcacccatgatgtacttgcagacaacactggtgagcaacacggtggtgacatcctccagatcccgaatctcctttgccatagggttgaccttggagagcatgtcctttgggtcctgcatgatctcctgcttgctggtgtccccctcggctaccacaatagttgcggccacggggggtggcgtagtcagcgaagctcttgatgccaacccgacaacgatcatcccgagcagattttcatggcaaagagggatggaaagttcatgatggaggggtggtccttagggggtgaattggaggaggaggtgaagaaggaaggtacagggggccaaaccatggagggagcactgtagcaaggtgctggttggtggtggggatgagaggagtgggaagagaggataagacaagagtggagaagaaaaaggggatggggagactcagttctattaaccatcccatccacgcaatgccgtagtctagtttttctgtttttaataacaatacatcaaaatgatataattactcaaacatcattcttgcgctctacatagttaggatgcatacaacctatgattataaaaaagaacgacatgacatcaaatatcatgccgacaaaattcatgcagttgtcatccctacccgttttcctcttccttggttctcacagtgatcccgagtccagatctagcaccaacacttgtgcctgcccttgctgtctccattcttcccgccaccaccgcctcctcctccttcagtatatcagcagcctcttcaaaagctctgaccaccatttcccgtagcacctctccttcatcatctctaaccgctaatgccaccagatccgcttttgcagtccccgcccatgcctcctagctaaatgatatgccttgaacgcagccactacccatcctactaccctcccccactcatgtagtttcatcggtgtcatagcctgctcgtatctacctcccacagtcggtcctccaccaccccagccttccctcacttcatactacccctcccactgccacaaactccaaaaagcttaatctggctggagctggtgacaagggctccatgaggaattcgacgtttttgtgtagtcatcctcaccatctctcttcctcatgcttaactggaggtaaaagacgatttcttgaccttagatttgtttatccaataacgttcattattgtgaatcaagatttggaatatgaaagctgcattattatttcagatttaactgtcagttttagaactcgttcataatttgcttgtataatgcctacatgctgccctaaagttgaaatataattaggataaaacctatccttctaaaaaaatatcttatatctgtatatctattgatatgttattctttattatattatttagatagttcaaattcaagccaccatgttcatgctaaagacctaataatcacagtgttaattgcaggacaacatttacaccattacatcattgtatgtctagattataacggtgtagattgctcaatatagttatatgcacaatacaattttatctcttaaaaatccaagggttatataacaaatataattctttaaataaaacatatctattatgcaatgaacaatattgtaactatatatgaacataaagtaggggttttatatgaaatccacatataatttcattaatttaggctccgtgcaaaattgtgagtaaatctgctagttattatattattgtgatggaacaaaaaaggccaccatatccggtttagaggctgacaaatttccacaataatcaaagaaaaaatagaaacaattgcactcactactacaaaaaccattttcgcagacgtgaggtcttttttttccaggcaggtatggtcctcggagccaaatggccgcctacaaaaatgtaaaccggggtagagctcgcctagaaaaatggtttttgcccgcctgcaaaaagcatttttctagtagtgactgttagattgatgtgcgtcgagattataatggtgaagattagtcaacatatattcatataaatacaaattgtatttgtattaacggaaccaagctaggttgatgcaaagtacaattgcatttaagaaaacaaaagtaagagttgtatgcgaaatccatctagctacgtgcaaagtttctagagtctaggatgccatactatgagcagggatgccacacaacaacagtttgtttagactatagtgctcattataagaagttctctaagtctaaattttgatttcaggttggaatgtcctatactggtcagagtttctgtttttctagtgaacttgattcactgattgctctttgttggaagtgatcagaatatggacgaattgtcggaatgtctgatccattgagcaatccgttatttcaaggaactcagttctctgttggggttgaaattttcgactggaaacttcggatgttgcatcggaatatctgacatcccaaacaatctgatattgcaaggacgtcgactctctagttgaggcagcatccaatctgtcctactagtcggaatatccgatggtccaaaatataattccaatttaccatgaaactcaagtctctgtttggttcgaattctgaaatcagtgtttatgatggcaacatcagaatatccgactagttatttttcaaagaaattggattgtgttctagctgttggggacctgacatatggatcggaatacctgacctcacaattggaatatccgaggtgggatgaaatattcttctcaacaggcgaatttggggtttcctatttaaatccaccccctagcctcttattggttaagccattcatttcattcagatattccatggcttgtatattagaggcttgtgcaagagtgccatgtatctttagatcatattcttactctctcaaatccctcttgatctccatgatttggatctttgagtgtggatatggttttgaggacctagtgttgcgtgcattctctcgattattgagcaccatggtttggttcaagagtttacgacttctagatgttgacgacttctagatggctacaagttgctaccaagccaacaatatgaaaaggttggatcttgctagtgtggatgcaacctagaggatatggttagaaaagaaccgagtcgttatgagctcctcaacagagacgtagaaccccctcaaggttttgaactccggaaaatacatcgttagccctaatctcagggaaattatttgcctttttcactctcctcactttactacttgttgtcattgttagctagttattgaatgtgcatcattactatgatttgggttgctccagttgttttaggttattggcttggttgttgcgttctttgtcatgtcaaaagattagaagatccatctgtttcgttcatatccgatagctatcaaatatctgatctagaacggaatatatgaccagccttcgttttactatttcacactaagttttaaagagtctctctatgtttcaagcgatccattcaagaagtaaatcaaatttgattaatttaaaaactagcttcgttcaaatcacgtaggaaaattcgtcgattaccataaaatcaatcaatcaatcaatcaatcaatcaatcaatctatctatctatctatctatctatctatctatctatctatctatctatctatccatccatccatccatctatccatccatccatccatccatccatccatctatctatctatgtttatagtccattaaacttcttacaaatgcttctatattgtcacgtgacttctaagatgttacatgacactcaaataaattaanaaggaaattgaaaaaggcgaannnacccatatcgtagttgattctcattaaatttggtggacccattatttacaactattacacttatcttgaataaaaaaagtcaagtaccaaaccaggccctgcctacgcttgtatgtaggtcatacatccaccctctcttcgctcaatttcttactcctctttaccacctattccttatatattatgttttacaagcaaaatacccatgctttatggataaaagaaaatatgtaataatatgctatggagatgtttgcttaattgaacacataatattcactagtttcaatcaaacattagactattatataatattagaaaacataaggcattaacctccaaaagtacaaaagtagtggtggtggcagaaccaccacaatcagtgtcttttctagtattatagattcgttagaaagcaaaattatgttaataaatttagcaaatatgacatctataccacatccgcttatgtgtttagattatttatgactaaatttacttaaagaccaaatttcactatagttcgattttgaaaacaaatatgtcacttttggacttttgcatgacattcaaacaattattaaaaacatgaagaatttatcatcgtgcataacttcacaataattaaattggatctacaatcacaaaatgagcctaactatgagtaatactcccaaagtatattagttagaaagtaaaatttgttctagaaaaaaagattaagtaactatgatatctaaatcatacaattttttatccacttatgtctttagattatttatgactaaatttatatttaaagaaccatattcaatataaatatactttgaatagagatatgtcacttttgggatatgttttttgactttttcatgctattcgaatcattacaaaattatgaaaaaaagatataggatttattactgtatataactgcaaaatatttaaattagatatacaataatagaactgaaataaaactaactattactcatgttataaaatattacttcccccattctga

SEQ ID NO: 45075 - DNA, 21442 bp, Oryza sativa
gctccggagccaggttttgatcatgaacagcacaaagccgccgttgcctctgtctgcagcggcactcaccatatcggtgctgacgccgtcgtggatgatgctgctgttgctctgagagggaaatgacgccgaggaagtcctctagcttcggctgtaggacgagcgccgacaagaaatagatggggtgatggggattggggtcggccggtcggggatggattggggaatcgatggaggattggggagaagaagaagggcaaaactgtcattttgtatgatttctctctcatcaattgggtggatattatattttaatgtgttcagtgtcctgcagcaaattaccacattttttaagtgtcctcgggcaaattcaaagtctttgcggtgtcccacagctaattacacattttttgagtgtcctgtagcaaattttgtcttaaaatatatacacgtgaattatatgtcccaaaattatgtggttggacttatatgtgaattgaaggcccgaaatttaactaaaaaaattttagtttccaattaagtaggtaattttttttataaaatttgtgaatagagatttgtatctatatagaaactacagtcccgtaactcgcatgttcattttcgggatccctagcatgggttcacgtaggatccaggccgtgttcgtgttcgtgcgcacgcgtcagacgaccccggggttcgctatagtggtgtacgcagatatctcttcctagttcatggtgcccgaccgaggcaatctgaaaccatgcaccataatggcatcagatatatagagatgtgaactgtctcccatagagccacgatatagccaggtacgtaccttgtcctagcttctacctatgaattgtttggctaatcggttgtgcacatgcatgccggtttaaatgcctgtaaatgtggtatgttttaattttgtgctaaacttaagggatggtagcgatgtatatttggttcagtgggtatcaacactatatgtgatacattcgactttaagtttggcatatacaaatttaaacggaacaaaagtaattgtaaatagtacactgagttgttccactgttaatatatgtttgtggagttatatattataaatcatatattatcaaagtttattaaaaaagcatataacaatttagaagatgaaagggcatcatcctcggggaaaagaaaccatttcccccttctatatccttctaaaagaaagaactgaagcgaggggaatatattgtatcaacaagatctgcgcgaaatatgtatgcatgtgttgtttgtgagctataagtaaccatgcatcgacatgttcctcttgctccttgtattatcgttggtcggatatggcggtatcaaacactcgagctgtattgctcttgctatcggcgtggccatacctaatacagctttgttatgcttctactctctcttacaatttctcggatccacaaagcttcacctcaggggatctacattttgaaggtgatgcatacctcggcgacacctcggtcgtcctggccaagaagggcaccggcgaagtcaacccaaaggccggacgaatactgtacaagcaaccgtgccatctctggagcaacaccaccggcgaggtaacgagcttcaccaccaccttctccttcctcatgaacggcggacagggcgggctggcattcttcctcacgtcctacctgccgatggtcgccggcgccggccagaacgcgccagcaggcggcggcgatcagcaaacggtcgccgtggagttcgacacccatggaatcctgggtggagcccgaccatgtctacgcacaactcgtcggagaagaaagcttacaaggtcgtcgctggcgaccttgccaacggtgaatcgaagattgtgcggataaactacatcaatacatcgaacgttctcgctgtcacgcttggtgatctcaagacgagcacttctctcatactcaacacaagcgttgacttgaggctgtttctgccgcaagaagttaccatgggtttctcggctaccactgccacagccacaggctcttcacaactcgtgtcccgtgaggtgctctggtggtcattcagcacatacctgacagaaggtaatctgccggcactgaaatccactcctcttttatctggtatgactaagtactcgaattaataagggttaattggatttatgccactgtaaatatgacaattagaaaaatatcactactattcacgatataggctgggtgtcactggaattttgataaattagatccataccactccgtcgcgttttccatcctttcccgttagtttcctaactccgtgccgccgtgagggctgagaccgagactgatcaacaattgctgaatatctgaaatcaaaaaccaaaaacgatgtacaactagctaatcgcaacatgtaaagatggatttgtgaaagtaattaatcaatcaagaggtgcagtgtgtcactgatgcgacggcggcgtcctcgaccgaccgtccagtttcagcggcagaactccggcgttcgacagccgccccgccgtcggcttgaacccgaccacgccgcacagcgccgccggcatacgcacagaccctgcaaaagcgcggcagcgtcggtcacagtgcatgcgcaagatcgaagagatcgagaccgagcgtgtatgacggtttatttacctccgccgtcgacgccgagcgcgacggggcagaggccggcgcagacggcagcggcggagccgctggatgagccgccggagacacggccggggttgtgggggttcctggtggagccgtggtgcgggttgttgccgctggtgaggagcgggtcggtggcgaggagtggaggatgacgccggccggcaactccgccgccggcctcagtggcggagctggacagaaaatcgaagggggccagccggcttttgacagttcaaaaaattagcaatttctcttttttttcatgcattggcaatacataaaagcgaatagtttgcaaaagtcgacgacaaagatcagctacagatgttagattttgaaatttaggattggtgggtacatcaagttcatagtgacgtaattgatatctcaaattggctctcttgttctaaaaaatcagcaggatagaactttgaagctagagagcacactttgtcaatgttgaatgaactgaatgaatcacttggatccaaagatatacacaaagtgagaacctttgttgcttgttcactgaatctgctatgatatatggaggtaataaaaaattttgtttttattgggaggggccatggccccagccagccccccctcagttccgccactggccggcctttatgccctcggcttcatggaaagagtgggaaagacagaaaacgtgacggggtggcatgatccaattttttaaaatttcagtagcatccaaccgatatgacgaatagtagtggctttttttaatctgccatatttatagtggcatggatccagataacccaattaataatagttgtgataaagatctcatatagatccactcattttgttgaaagaattctctatactgcatggaacatttggaatcaacgaaatgctctcatttttcagaatgtaccaccttcgtttgtttcctagaaagctctctttaagattgatctttctcttttagtctttagattaaaagtttctgagagacaagctttatctcagtggataaacattttgtaaattatttgtattccttcttcccctacagtgtttcccctcaaaataatagtcgtgacgttgcattggattcaactaaatttatggatttggatttgctataaatgtggcgttgcattggattcaactaaacttatcaatttggatttgctataaatgtggccagttttttctacgaaaattagtatattttttggccataggatatatatgtgctagcgcgtatagcagaaaaaatgtgcaaaccgcggtggctgggagtggaatcaatccatgctattctaggttgtagtgatagcatctaaccaattgagcatggtagcattgttgataagttaattcttctatttatattactacgtaaatacattgaaattacatatataatttagaaacttacatcgtaaatacactaaaattatatatgtaatttagggacttatagtgtaatatatattgtctttttttcatgaaaaatatggcggcataaatagtctccaaaaaaaattatcatgtacttcaaaattatcataaattgggttaaatatggagtactctctctgttcatgtcacgcccggaatttctatccaaaattccaaacgcttatatgtgtgtaaaccctcgtccaggaatcagccgaggtacacaataacaaattgataatagagtacaattattactctaattaataagcgaataaaatatcattacagaggtagatagttcctctcaatcaataaagatctaagcagtggaaaaataaaataaacggcgcagacggctccactccacaggcagcttgaccaaggctacacctaatcctccacaccatcagcatcattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaatatttgagaatttaataaaacggttaagtattaattaaacaatattaatccaacgctatacaacataccctgttgcataggcccaaccattctgaacaaccatcccggctgcacagttctatctccaaaccaggaatataccattccaaaccaggagctaaacagattattaccaattatagcatcttctattatggtgagaagggtgagactaatcatgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaatacccctcgcacaacacaatccactgcagtgcacttttcctggatcataatcacccccttataaacaaggcatggactccccagcgacccccgtggacttatctccgccacttctcagtctggtgctccgcaatgaaccatgctatacaaaagataaagccgttgcccatgctggcttgtggttagcacggttaatgtttcacaaccgaaactcgtgaaccggtccttaattgtcatgagcacgaccatcaaaaccatgtgctcacaacccaccattatcaggttttagttggcacattaattaactaaccaatcacgattgaccatcgtgagctatcattaagccatcattaactaacagtgagtcaagagttatcccaatagtgagctaatgtttctaagcagggctaagcaattatatctaatatctagttgaaccaatatatataaagctcaactagtcaagttatattaacccaaggtatcaaggaataaagtaatcaagaacaaaagggctataacaaacaacaggttaattccacccaatgacattcgaaaataaatgcaatagttgaatagaaacagtagctttaaataggatcaacatgctcaaagggttgtttgggatctgtgtgacttgccttgctggccttggaactcttcaaattcttctcctgtgaaaacggactctccggaaacgtcggaatctaagcagaaagaagcaaaatcaccaaaacagcacataaacaagcatgaacagtacatgtggatatttttaacatgtagatctcaattttagaaaaatttagagacttgaaccaactaaatccgagtaagatgaattagttatgaatttttgaagattaaatcggattaaaacacttatatagattttaattgaattatgacgcaataatgaattatttttgaaaaggaaaaagggatttattgcgtcagcaactagggtttcggtggaccgggcgcacgggcgatggttcacgcgaacggacagccgagatcaacttgatccaaaacggacggccgagatccatcggtccacgaccggctcacgggagagggcgacgatgacgtcggcgatgacgtcaccaccggcggtggctcggacggctcggacggcgcacgctcgccggcgaacggcggcacttcggcacgaacggagagcaccaatgggtagcggacggcgcggcgaactcaccggtgaccaaaggagcggcggaggaggaacggacggcaccggcggcgaggaggaaacggcggaggagatcgggtcgacggcggcgacggtgctccggcgatcttcggtgacggcgaagcggcggacgaggacggcgacgacttggtgatcccgacggtggacttcccgagcgacgacgacggctggaacggtggcggcgcgcggctggagcgacggcggcgacggcggctcgaggtctcacggcgctagggcgattccgacgacgagaggcgaaggcgagggtggcggcgggtagaggagacaccggggagccttttaaaggggctaggaggcagcggcgaaggcctacggctgccggcgacgagaaggaaaggtcgggcttcggaggaaagaggccgatccgaatcgaactcgattccacgaacttccaaaacgatttagccgatgtttccaaaagggaaaaggtagaggagatcccgaggatcatttcccctctatcaattcggccggaaacggaaaggatcgatcgaatttggaagggaacggcggcggcgcgaaactagggtttcgggcggcggccgaccggaggaagacgacgaccctgacaagcgggacccacctgtcagcgacagcgagggcgcgcgcgcgggcggcggactgggccggctgggccgaggagagagagaagggttttgggccgactttcggcccaaagccaaaagaagactttttaaaacctttttcaatttaaattatttatgaaatgcaattctatttattaaaaatacttccttagctcaaataaatctcagaaaaatctaggaattatagaattaagcaaagtatttaatgaaattttatctagcaccattttatattggaatttattatttaaaattagatcttctcttctaggcttttaaaataaattctaaaaattccaattaaacatcaatttatatatttgaattctcagggtgtgacagttcacctataaaaaatgtgaactttgttgaaacaccattgaaacatttcattttcatggatgaaatatcaagcttcaagccactaaaacatcacaaatatgcaagaaaaatcgaaggttgatatgaaacaccatcaaatggagtatccattgcaattcttcaacgcaacccaaagaaacatccgaaatatattagctgaaacataaaaagatcacaaaaatgtaccggtctcttactccttgcgaccatcttcattggcgctgccacccctccaccgtcgttcgccacctcgccagctctctatctccgctgtgagcatttgcatgtaagagagatgagagataaagaaggacacgggataggtggaatgaggtgttaggaggagcccgatattttttttccatcgggcgctcggataggtaacgttttcgacattttccttcacgagccaaataggtgtatatatagatggccataagacccgctcggcacggcctgacccaggcacgggctaggcacggcccgaggccatcgggccaacatggcacagtcgacacttcgggccatgccgtgccggcccacgggctgcactttaggcccaggcacggcccactagtagttgggccgtgccgagccaacctgaaggcacgggcggcccatcacgtcttctttaaaataagtctattccctctcctctttgggctgtgacatatatgtagctaaaataaggagagatactacagatggaattccgttgactgacgggatagattacacaaatctgatgatcgtaattacgtgggtggacatacatgcactagacaagaaaaacgtggtctcgcttctcttcttaggcagcatatgtgcatgcattttttttctagaaaaagaggaaaaagaaagaagaaaaaggatacttgagagagaaaaaacatagcactgaccaaacaaagctactggtacctactcgtatcaggtatattgccaatacctgctagctacacatatcatcactgatacgtgatacttacatatagcatcgttattaactagtactacctccgtcccaaaataaatatagttttacactatttatctccaacgtttgatcattcgtcttatttaaaaatttttttatgattactatttttattgttattagatgataaaacatgaatagtattttatgtgtgactaatttttttaaaaaaaaattaaaattttttaaataagacggacagtcaaacattggacacgaattaccacggctgcactttttttagaatggaggtagtaccaacatgtatcatcaccgatacagatacttgtgtgttaagcatcatgattgatacctgcaagtatcaggtatcatcgttgataccttaatgtatcatcattgatacctcaatgtatcatcgtcagtaccaataagtatcattatgtagtatctggtacttataagtatcatcaccgcggcaacatatcctatgcacacaggccctcatgtgtacacacgtgcataccaactaaaaaatgtcacaaaaaaatctagaaaaaatcatacacatactttcaattgtattacacctagggttaaaatattaacgttaaattcattatattttagccgtaacaaaaaaaacaaaaaatctgacagttttaaggttgcaattttgtcagaattttatcttttttgttattctctatgtagaatgaatttgaagatgcgactttgcacgtagatgtaatactattgaaagtacatgtataaattttcctagaattttttgtgataatttttagttggtgtacacggtgtgtacacgcgaggacctgtgtgcataggatacgctcctcatcaccgatacttgtatgtatcaggtaccattgccgatacttgctagctacacatatagcatctttattaactaataccagcatgtatcaggtaccattgatgataactgtagatattattgtcgataccaagcagttatcatcacgtactatcatcgctgacaccaaagatatcatatagtatgggtaatatagatgttcgtgtatcatactagagttgatatcactgtacacgtaaataaaaattctaccagctaagtgtttcatcttaatacatatgattaacttaaataggattagaaaaacaaatgttcctaatatgatcattctagcagcctaactactagactggttcacgtgtggcctaaagtcatagacacagacgtggccaccactcataacgtaacttgctggataggtctaggctctaaagctctagcaccgtctatataggacaatatatagagtgtagtactagtaatagtcaacggatttgtgggccctagttggttgattgactgactaggcacaaatctcgacgctcagtgtgggcagttgtgcgcagcaccttgacttgggcagcgtctaatttattttattaactatcccattacacaacggtatcccgtgctgtacattttctctaaaataagtctattttacattcctactttttggagcatgctatataatatgtctatttttctccctatactttgtgccgtgccttacatatggttgaaaataagtctgttttgcacccttaaacttcgtgccgggccgtgccggcccagcgtgctgaggtagcaccccacacacggcattgctgttgggctgggccggcccaaatcactgggccatcgggcctcgggccatatggccatctataggtgtataggctgacttgtgtaatggccctgaaggcctggatgctgccctctttcttttttttttttcccaatcctcttccaatcagggaaacctagctgattgatgcctctactgagatttgggagcgtcgtccggtagccctgcggccctgccatcgggctggggccggcagagcaaaacgctcgatgcctcatatgtcaagacttgaaaaatcaggaaataaaattaccaaaaataaaaaaaacagtgcttattaagtcatttggctttcttttattttaacatatccttgtatatcgttcttaacaagggacgagccaactactaattatagtctcccctatgattgcttatttgatcgacatgtttatatccttatttttctctaagtaggtgcatgtgtcttcagatcggaaatgctactaggcgagggcgatcgattccccccctcctccctctccttctctccacctggttttcttttttgtcaccgtattattttcctattttagtaaatttatgtacctaaagtttatgcacctcaagtttacacatctaaagtttagagaccaaaagtttataagtcaaaagtttatatatccgattcaaatttgaatttgaattcaaatattatatatatatatatatatatatatatatatattatttctatatatctaaagtttatacacctaaagtttatatatccgattcaaatttgaatttgaattcaaatatttttcatatatagtatttctatgcatctaaagtttatagacccgattcaaatttgaatttgaattatatccgatttaattttgaatttgaattcaaatattttataaatatagcatttctatacatctaaagtttatacacctaaagtttatcgatccaaaatttataagtcaaaaatttacatacccgattcaaatttgaatttgaattcaaattttttatacataaatttttctaactttttggttttttaaaatttttttatggtgtactgtaataggaagagaagaaagggaggaggaagggaagaagtgggaggagtgcctataggggggggcggatccgatcgctaggcgatcgcctgttaggccccccctcttcagatgttatatgactgtgagctacattcgttagtcccgctcgatctatggttctttgtacgtacgtattcacgtattatattgtgttacccaatggatattgccttcatgtagtacatatttttgtaattgcaatgtggtttctttatggatttccttggattggatatattggaacacccgtagtcagctatccaatccaacaaactgtgtcctgtgaccatatgggagtgggaatcgaactaacaacctgtgtcctgtgagatgtaatcttgtggtactagtcatctgaccgagcattgatgaagacaaaaaatagacaagttacacctatatttgttttttactaacaaaaaactgccaaccttttttagatgatggaataaaatccggcctttgctcaacgtgctacaaccaattattacataaattcgctcgaaagcgaccacacaccaaagagttcacataaacacatcaaaatttaatgaaatgcaagcacacaaactaataaacaccaacacaagataaaaaaacataatttattgaatcctttttgtgaatttccacctgaaattggcagagagctacatgaccgtagacttaaagtctccaacatacattctctattagcttgatgtcgtcatcacacctttggtgaatatgtaatggaatgaatatgtcgctagttttcatctttttgagtgagtgctaggggatgctggaaaaaaatgtattccttacagcagcaattgcaaatgtttgagaaggcgtcaattatctatctgttttgttttttctgtttgaaacgtatcaacgatctatctatttattttgactaaatagaaagcttctatttatgtgatcaggtcaaaccctgttcaaaagactaattaaataaaaatttgagcagtctttatgtttttttttctcttttcggtttgttattttttcactttcaggatgtgcttttgactcctccgctgtctttgctagcaggtactccggctgatacagctaagaagtccaacaaatcactggtgattggaattgttgttgggaacttgggactgtgctacttatagtgacgatgctcattgcagcttcactttgccgtttaagtagatggattacgtcgaggcctccacccatgccccttggagaatattgtgcaggcggtctttggccaagttatgggaatgtaggcatgggcactggagaatatggttttgcgtcgccttcacagactccgttttctttcgaagtattatcggaagcgacgaataatttctccgaggaacggttgctccgtgaggaaggtcagtttagtgcattctacaagggggacctgacacatttaggcatctctgtagctgctgctgtgaaatggctgaaaataaagtcaggacaggcctttgcggtggagaactacgtgaaggagtttgcaaccatcagcctagcgatcagacatcgcaacattgtgccgttcctaggttggtccagcgagcaagataatctatgcctggtatataaatatgtaaagaactggagcctccacgatcatctctacagtccaggaagacttcttacatggcctacgaggtaagaaaaatttagagtgcttttctgaatgaggttttgtatcgaactatctcacggtacatatcctaaagcatgaaaagaactactttagaattgaagttaattaaataaaaagggaatagatagagtccaaaattaaattgagcaatttttatgtcccattagagatacattattttcagtctcagttttatttgtgggtatcttaatactaatgcaaagggaccacctatatatttgtcagtaatgtataatttcctccaacctaattctacctaccttttgattttaggaatgaaatataagcatccacaactaaataagagggctaaacacgagtaatgttcttaatcgtagttttaggctgatgttctccctgtgttcgtattccaggtacaagatagtatttgccataggctccggccttaagcacctccatcaggacgtccgccccacattcccgcacggcaacatcaaaccaagcaatgtgttgctggacgaagagatgaacgcaaagctcggcgatttcgggctgcctcggcacttctttcagtacgatggtgaaaccgcctctagctcatatcgacaaatgccggtcagctctcgaggatacgtggaacctgggttactccacacggatcaggcaaccacctcgtcggacgtctacagcttcggagttgtgctgctggagattgcgtgcggtcagccgcctattatcctccagcaagaccaggctgaagcaaatagccttgttaaattcgtctgggagtgccacaaaaagggttcgataattgaagcagcggacaagcggctgaatggcgagttcaaccgggagcagatggagcgcgtgttgcgggttgggctcttgtgtgctcgccgaggcagcagccagcgcctatccatgggcgacgcaatgatgttgttagagggggttggattttgatccctgcagaagatatccactcgttatttgcatgtcactaaaattgttatgaaaaaaattaaaaatatttgaaaagatgtattaatatacaatcactctgaaaacatgcaagttgaaattcaatttctacatctcgtaaaaaaaattgactatgaataaatagctgtagtttaatttgttttttcattgtgagagtcggagtttgcatgtttgtagagtgatgtatcacataacaatacatatttttatttttttcataattatttaagtgacatgcaaacaacaaggaaacattccctcataaaacaaaatagtttcccttcttaaagtttgtcgtccctgtgcccaaccttccgccaaggattccgattccggtgccaacagctgcagatcatgaacggtgcacatcgcctgcaggtcgtacatcaccattgtaggatcgaacacaagtaaccaagcctaccagagggggggaggtgaatggtagggaaaaccaaaaacccaaaaccgtttagcggaaataaaagttaccctcaaatcgatggaaatctcgacgtagtcctgtcgccgctgatcggaccgctcgcacgccgtcggtctaaccgccgccttgtcgccggttgaaccgcctgcctgccgcgggtgtgaccgccgtactcaatgaaacacaaatcgaagaactctcaaagtagatgacaactttattgcttctctctgtgtttacaaagtgcaacaacaacactccttacaaaaatcttgactaaactcgaaaccctaactaaactatcaactcaattgctctcaaagcgataccgggaagcctcacgctccctctctatttataccaaaaaaacctcctactcaaagtaggagaacaactcctagtcacactaggactctatccaaatcacaatctcctaaagcctgcagcctcacaaccaactacagtcaatccgtgtcctagccaacccgacatggacacatgtccgtctcatacgaagtcccggtcggcctcggtctcctaccatggcgtcgctcctgccttggactcaccgagccaaaacacatgtatatgtatacatgcatccatgtactgccaactactgcagtacacttgcatgcatcgatcaataccacacatatgcatgctacagtaccacgtgtactatagcaccatgtactcttcctcaatttctcactccaatctccttcgcaaacaccagcacttgcacgcacacctcgtgaagcccgttgtgaagatctcttccacacgatgtccatccaccgtgtgacatctcgtatccaacttcgtcacccggtatccttgaccgtctggacctcaactcctccctgagtttagtcccgatcctcaccgttgaccgaagttgtcctccaagaatcctgactctagtcaccttctcacatggtattccaaccgcactagacctctgctcctccccgagcattgtcccggtcctcaccactgaccaaggctgacctcaagtcacatgcacacaatcagacaaaacaaccgtttctgggcatagatattacaacctgacccacattagtcacacgcactcacaccaacatccacacatactctcaaatcaattctttgattaaatcatttgcagagccaattgttcatcacaaatattaatcatgacaatgatttcacaaccatcagcaagctagcttacgacttcggtgtgttcaagtcgcatcgttataaggaaagatcaatatgtgaagacagggaggtatagctcgatctatatatcatcgattggtaaagactgatttcttattgtatcaagttaatcttgtttggagtccaagttgcatttagatacatacactagaacggataccctcatctcaaacaggcggtaagccccgtctcaatcgggcacggcgtccgtaacagtctagaagtcactgatatgaaaaataatctcaatcaggcaaacggccgtcactgatgaacctatctcaatcgggccctaattgaagcccgtcaccgatagctttgactcagactaccagtcaaactatagcctgtcacatatgacctatctcaatcgggccacaaatagagcccgtcacagatgactactaacctcaatcgggcttaaactagagcacgtcacaaatgatactcatctcaatcgggtctaaactatagcccgtcacagatgactgtcatctcaatcgggcattaactacggcccatcacagatgaccatcatctcaatcaggcattaagttatggcccgtcacagatgagtataatccacaaaataaaaactttgttttttggctagcctcaggcctttgctagccatgctcgctgcaaaaatgacagaaacacagatatccaatatccccagctccctagcatcacccattcatatatatgcattcacatacacaaccatcaatatatttcacacaaccacattcacagaacatccattttgatctcatatttcacatctatttaaatatttatcatattgcacatgcaaaaccaagttaattggatcaaatatttatttagcaagtattaacataaacataagaaatatataaataaatataaaaatcacagttacataatcaatgttcatcattgcctaaacataaaagttcaacaatgttcatcattttagtttaagccgaaacattcctttgggattaattatttcgcggaggatgaagccggctatctcctcgcgaatctcctcaaagctggtaggcagagacttggtaattttgccctacattgtcatagatcgagattagttgatcgatcatatatatgtacttcgatgtagttagttagtctatcacaattgagaccaccgacctcaaaccctgtcaaagtcttcaccttttctttgtacagaaggcgcatgttgtggcacacatggaatccgcactggtcacctatttgttgcttcaccgggaagtcttttttgtggatgaggatgtgatgtcttgtcttcctgaggcctcctctttgcacgtattgggcccacacttcatctatcgctagttgaattggggtccaatcatatgcgttcttatcaattctggagttcaggtagtgacatgtactccacttaggtgttatgaccagaaggatccaatggtcactacggcattaatatagtgaaagttaatcagtactgaaggaacgtgtcatgctgttgtgtatatttagggaacacacttaccattgattataggtgcacataatgcactccttgtctcagtgggactacaaggtgtcgtagatgtagttgaccattccttgacggtcattctcgagatttgtgacagtgaccacttgtggatcaaggaaggcagcttccggtgcattctcctgacactattgccaatttaacctacacgcaagataaacgatcttgtaagcgagttaaaccgattgttattaccaaattgagttgggcgacaatacttacaaggagtagcacttaaggaggcttgtatccaccgctcggagccagtagaggtcgaatagatccttaaagtcgaccacgatataatttgttggaccaagaaatggatttccatcgtgctctccaaggatatcagtagctttgtttggtctcctggcgttagatttctccatgtagtatacgtgaaggtccttgcaagcggtgcccattgcagcaagcacgtcatctccaaccaatggcatgcctagttagaactcctgtggagcgacgtatttcttcttgacctctttgcccttagtcttttcctgccccttgcccagatctagcttccttggagctagaagcgaggcctgcacctttcctcctcctcctctcccctttgcatgggtttatcgagagtaattctctgaggggaagagtgtgccttcctgctcttcttcatcggtgggggttcatgaatcgccttgctgtcggcctccgttcggtcctcccaaaaatccgtgtcgtacttcaattgcacatcataagattgtgcatgacgatcttgagcaggaggggctgaaggagaagaggagggtctctttggcggacgaccgcctggttcaatggttggcctcgctgtaacccttatctcaatgaggtccttgggccattggatgaaggtaccacgggcatttcctagtgataggacctcgtcgttcggtggatactttagtgggaacagctcgtattcgggcttcaccgagttgacttgaacttttgcacagtcgcccctaagttgcgctccatgcactcttgtctctggggtcggcttgtacgcaagtccctcggctgctggaaccgtgaaggtcggcatcaccctaactgtgagtgtgcagctcgttggttcctgcgatagattcatcaatttttagaacattatataacatatggattcgttaagcctttcatgtattgtggacgaaacttttaccgttatgtggtcgacggcgctgtcgaccaatgttggattttccgccacctcagttgatgcgcaattgctgcgcttttgggtgggacttcctaactcttcgtcgcagcagcaacagcggcctgtgggttatgttgctcttctcggatctcttgcctaatcttggccctcatcgactcgagcttttcattgaattcagatgccagctccgctctgatcgacgccgggatcttggctttaaggcgtgcatctttctccgccttgttggaagtccgcttcttggactgccacgcgtagtctggaaatccaaacttctagggaatggaggacccaatgccccgtgtccttccacggtgttccttgttgcccaacgctttcgtgaggaggtcgtcctcgcgtctttgagagcaggcctcttgcgaggcttgttgctcggcaaccatctccttatgcattacaatttagttgggttaaataaactgcatgataggaaacaatgtgatcatctattttgactagacacttactatagcttcgtacactcgttgatcttctggatttggcatgaaaattgtgccattagcattcttctggtatctagccctggcccagttcctagcccgagggtgtgggatatcggcaaacacccgcggcgtgttcgattcctcctcttcttcatcctcctgctgccattcctcttccttaccggcatatccggcggtgccaagctagtgtggatactggttcaaggtctggagcatcgaaatgcctcgcttcttgctctggactcggtggtcgacttctttgcgtggaattcgtcccagacccatttcgtgatacaaggaaatttctctgttggatcgggattcgccgggttgaagacgaactcgccgactagcttactcttaaagttcttccaagcattgcccataaccttaaaagcagcctgcctgataaggtactcgtgctcctcaggataatcaaaactctccttgaatgttagccaagcactgtccttctctgcggccggcacttgcttgatgtcatcctatagaatattgaatttctgcctccctatgaccccgcagatagacctaaatcggctcaacattttcctaggacttgtcggcaagcctatttggttcactgcagttatgcggtaccgttccttagggattttgttccctgtcctaggagtacgtgcccttaaggacccactagttgttgtcgacattggttctccttactgagatattgtctattttttttcaaaatagcgagaatacgcgatttagtgcttcaatggctaagaattcaaatttcaaaaatcacttagtcacataaataaattaaattgcacatctcacagatctaacaaactgaattgaatatcacataaaaataaattaaacatatcatcaatcactaaaatcagctattcatccacatgacacattcatctattcatccacattcatctaatcatctattcatccacattcatctatgcatacacattcatctatttatccacattcatctaatcatctattcttccacattcatctattcatacacattcatctattcatccacattcatctatccatctattcatcactaaaatcattcatgcaccacattcatctattcatcattcatgcgcgatggaggactcacctgggggtcggcaccgggctcggtggaggcggtggcctcgggctcggcgagggaggacgacggcggcgaaggaggagttggcggcggcctcgatggcggcggcgctgggctccgtagagggtgtcaccggggtcggtggcggctgcgccgagctcggtgaaggtggcggcaggctcggtgaaggcggtgtcgggcgtcggagaggaggatgcgacgacaacgaggaaggacgtcgccgggctcggtgggggtcggcggcggcggtccgaatggaggacgaaggaggagaggcgggcagcgacaacgaggaaggccgacgccggttggtgtggaggctcggtggcggcgacggcgggcttggcgagggaggatgacggcggcgctagggttctgaggaggcgggaaactgtagcgggacttagaaaaattttcgatccgatatgaaaaaccctagttatagtaaagtgatttgtcatctcaaacgagaattaccatagagcccgacacagatgagtcatcggtgacgggctctatactaatgcccgattgagatgacattcaggctcgtcacggatgactcatctgtgacgggccctacggtaatgcccgattgagatagattagtctctatcgggctataactaacgcccgtcaccgatgactatttttctatttttccatttgaagtatttatatctgtgagtgcaatatatataactgttgtataaatgatttcaaatggaaatatggtcaacaacaaagttgtagagcttaccaagatctacaacttttattttggtcatttttctacataacttttttcccaacagtttgaaattgaatttgaatatataacaaatttaagcagcatttgtaaatactaaatgatttcaaatggaaaagtcatcaacaaaaaagttgtagagcttatcaagatctacaacttttgttttggtcatttttctatataactatattcccaacagtttgaaattcaatttgaatatatgacaaatttaaacaacatttgtaaatactaaatgatttaaaatggaaaattcataaacaacaaagttgtacaactcatcaagatctatcacttttgttttggtcactacttcatctgatagtaacactgtttagaaaattgacacatcagtattgatgttcataaaccagatgagagaaatgtgatttttgtgaataatattactatcactttgtcggatgaaaaaatgaccaaaacaaaagttgtagatcttgatgagttgtacaactttgctgtttatgacttttccatttgaaatcatttagtatttacaaatgttgtttaaatttgtcatatattcaaattgaattttaaactattggggaaaagttatacagaaaagtgaccgaaacaaaagttgtagatcttgatgagttgtacaactttgctgttgatgacttttccatttgaaatcatttactatttacagatgatgtttaaatttgtcatatattcaaattcaatttcaaactgttggaaaaaaatgaccaaaataaaagttgtagatcttgaaaggctctacaactttgttgttgaccatatttccatttgaaatcatttactat

SEQ ID NO: 45076 - DNA, 4478 bp, Oryza sativa
atgactcatctatgacgggctctatgataatgcccgatagagatagattaatctctatcgtgctataactaacgccctttcactgatgactatttttccatttttccatctgaagtaattatatctgtgagtgcaaaatatatagctgttgtataataactcatattattagtcataattttttttcggatagtaaattatttcaaatggaaatatggtcaacaacaaagttgtagagcctttcaagatctacaacttttatttcggtcatttttctatataactttgtttccaacagtttgaaattgaatttgaatatatgaaaaatttaaacattatttttaataaaacaaaattagccatataaatgactacacatatcaagtctttgtaataaaacaaaatacttcattcattacaatagataagtacaaaggcatcggtcatgaggttttgccttccgtatgatctgaacgagcatatgccacagcctcttggggatcatcgtcaaggtcgatgtgaggtcttacatgaagattctggttgtattttgcttcatcgacgacgtggtcaactccgacaattcggcgcttgccatccctcacgatgtgcagcttcttgtttgaggggtcttttatgtagaatatctgctcgacctgtttcgcaagtacgaatggttcatcagcgtatcccacccttgataaatctactaaagtgaaaccttccttgtcagctttcacacctgtgcgtagattcacccaatggcagcggaacaaagtaaccttgaacttgacgtactttagctcccagatctcctcaatgcggccgtagtatgtgtttgacccgacttgatcctggaatgcatctatacggacaccgctgttttgcactatgcttttgtcatcttgttggacggtgtaaaatgtgtatccattgatgtcgtatccgtgccatgtgtctacggtccaagacggtcccatcccaacaactgtactatctcatttgggacatccgtggatattgtcacacgattcatgaaccattcgttgaaccgagaattatgttctctgttaatccatgtatcagatcgccccaagttcttatctcggattttcgctaagtgctcctcaaaatatgggccaacttctgccatatgttggagcacagcgtaatgagcctgcacataggaagcctgacaaccttccttcatgacgagacgctggaactctgataggatcggtatcgaacatgtaattgacgcagaactcaatagcgtcctcggccgtgtaaccttcaatgatgctcccctcgggtttagctctgttacgaacgtaggacttcagaactcctatgtacctttcgaacggccacatttctcttagaaaagccgggccacatagttttatttgcttcaccagatgaacagggagatgaaccattatatcaaagaaagacagtgggaaaaacatctccaggtgatagagggtattcaaaatatcggtctgcaacccatctagatcttctggatctataaccttctgtccgattgcattgaagaaggcgcacagacgttagatcgtgtgacgcactttgggtggtagaatgcctctgatagcaactggcatgatttgtgtgattagcacgtggcaatcgtgaaacttcgttccaaccagttttagatcatccaatttaacatacttagttatcctcgctgaatagctcgatggaactttaatatctttaaagcatgataacattctgattttctcatccttcgacaatgtgtggcaggctggagggaggtacactctacctgtctctgcctctcgtatgggctggagttcactgcgaatattcatgtcctgtagatcaaggcgcgcgttcaacccgtcctttgtcttcccgagaatattcaacatcaggctaaccaaactctcacacacattcttttctacatgcatgatatcaatgcaatgacagacatcaagatatatccagtaagttagccgccaaaatatggattttttcttccacataccgttctgctttgtcttgctacgttttcttttcttcccaaactcattacttatgtccttgaccatattgtggaccccatctctggacaaatccttgggagcaggctaaagttctctcttaccgttaaaaattttcttctttcttctaaatgcatgacgtagcgggagccacctccgatgacccatgtataccatctttcatgatttcttcagccaccggcttcgtgtatgttgcttgcaatcggagcatgccttctttccttttatagtttgtccggaaagattaccgagtgcagggtagtcattaatggtgcagaacaatagaattcttagcttgaagtcctcctgaccatatgcatcccaagtttccacactttcttttcaaagaatctcaagatcatcgataacaagctccaggaatacatcgatatcattgccgggttgcctcggaccttggattaacaagcacaacataatatatttccatgttaaagcataaccatggcgggaggttatagttcgcaataagaactagccaagtgctgtgagtactactcatgtgaccgaaaggattcatgccatccgtacatagacatatcctcatgtttctagggtcggcagcaaagtctttgtgttttcgatcgatatttctccattcaatcgaatccgctgggtgtctaagcatactatcattctttctctccgtggcgtgccaacgtagtaacttcgcttcgttggggttggcaaagattctcttgaaacgatcaatgatagatagataccacacaaccatagccggaccactcctctttgacttctttccttcatcagcacttttctttcgcttgtatcgagaagccttgcagacaggacaagcatataagtctgcatattgcttgtggtacaatatgcagtcgtttggacaagcatgaattctacggacctctaaccccagtggacacagaacctactttgcttcgtatgtcgtctcgggcaatatgttctcagcaggaagcatagccttcaaaattcctaaaagatctgtgaaattcttgtctgtccatccactacttatcttcagcttcattaggtccaaggtaactgacaacttagtgtgtttttctttgcatccggcgtatagagacgtctcggaatcactgaccaacctgctgaacttaatggaatctctctcattctgggctgggtcctcaacgtcacttaacatgtcttgcagcagatcgtgatccacatcaaccatttcaccgcccaattgagaaggtataaacatgtcatactcatcttcatcttcctgattatgcacatcacttctgtctgctgctgctccacttcctgattcttgctctccatgcttcacccaacatgtatagcccttcatgaatcctcgttatatcagatgaccgtgtacaacctctccgctatcaaacatattctcattcttgcaatttgcacatggacaacagatgtaatcgctgtttcttcttttcctatcctcctccgcggcgttcataaaatttattacgccatttctgtacttcagaaaatgacgtttcacagttgtcgcatacattcaacttcgatcaattgctacataatgaaaaaaacaaattagaggcacatcttataagatcagtattgctaaagtaagacgtgatgaaattgctgaattaatgattagtattactcacttgattgctccattttgatcacttttgggaattttctgttttccttggaaaaaagacaaaaaaaattgccccctacagcctcccaccaaaatagtgaacagtgagatacagttacactaggtggggggtatttatactgtacaacaaatatctgtaacggccctaaaacaatcaaccgtgacgagcatacaagtaatctctatcaggccttaataaaagcccgtcaaagaagagtgtcatctgtgacgggcattaaacttatctcaatcgagcctctagttggagcccgtcacagatgaccgtcatctgtgacgggcttcttttaggcccgattgagatatggaaccctcatctcaatcgggccttaactatggtccgtcacagataagtgttatccgtgatgggctctagtttaatgccgatctagcatgtctgtgtgaccatatcttaatcggacgaaacttcggcccgattgagattactttcttgcgacggtccgcaaattccaagcttgttaggggccgtcacagatggaaggatatgtcctagtgatatatgcagcctacagaacgtggaagttcacgttgaggctgccatatcccttcagctcgtttggatggagtgagtcatatgtagaattttttttatttataatttttcttattaaaagttttacaaaaataattttccattttgaaaattgacggaaatagtcgcctaccgccctctgggaggg

SEQ ID NO: 45077 - DNA, 2549 bp, Oryza sativa
gccctccacgagggcgattttgcactgtgcggggggccgcctgcaaatgggcggcgagggggcatggaattttgcaggcggcccccttgccgccctaggggagggcgatttttgcctccccctataaagcccagcccctcccctatgaaatttcattatattcactaaaaatccaaaaaaaacgaaagagagagagaggggagggcagcagaaggggagcggcgaagccctgctggttcgctcactttatcacaggtatgctcccatacatcttttgcatttgtactaatatattacgtttgagtacatatgttgcgttttagttttagttccatatattttagcagatctatagcacacagcacatatgtgtagatccagagcatagaatataatagtatgaattgagacatagacagtagtgttaattgtaagatgtagtttagtttgatctggagaatgtaacctacttttagaaatttagagaacaatattgtagagaatgtaacttagggcgtagtacagaaatgcgaggttaacgcagttattgttttcatcaggcacaatgtcaagtaaggtcacatttcagatagttcacggtgaaggaaatattagatttggtccagatggtgttgatctgtcagattttgtaatgacatctaagggcatcgataggcctgcggagagaacatttcagtcaatttatagttggttgttgagaggatttagaatagaccaagaagtctacacaatgtcagtatctgttgtagtgagtcgtgcaatagaaggttatttttgggaactaatgccgatggacagcactgctgcttggagacggtatgtggaaatggcttttgaacggtcatggcccctcgttatatttgtgtcggtacaagagaaagatacaaatgtttcaatgcaaaccgaagatgtggagggtcctagcaatgcaggggatgttgttggaccatcgatgcaaaatgaggaaaatcaaccaagggaggagcaggccatgggcatggcggatgagggggagagagtcggtataattgttgatgaaatggagagggaagattcggataatgagcaagcggaggacgacgcatcatccgatgaggaaggtgatgtaatggccactgattgggcaaatgaggacttctctggtcttgttatatcagagggtgatcatgtaccctgggagtataaggagtacgaggtaattgagggtgcaaggtatgctcataaggatgagatgaaggaggcggtgaagcattgggcagtttcattgcagagagagtttagggtggtcaagtcaacaaattatgtgtatgaagtgaggtgcatgaaggaagattgtccgtggcgtgtccatgcatataagggtaaatggaatgattattggaaagttagcattgtgaccgagcacaagtgctacttacaaggggtggagaagtatcaccgaaacatcacttcagcttttgtggcaagtgagatgtacagcagtgttgttggtaacattggctttgaaccaaaatcaattattaggcacatcgagaacaaattcaagtacaccataagctatgcaaaggcctggagagccaaacaaaagatcattgagatgaggtatggcacatttgaagcttcttatgataatttgcctcgtttgttagccaccattgcccagaggaataataatacttactatgacctacatacatttacatcggttgaagatagaacaaagagtgtgctgcaaagagcctttttctcattgggtgcttgcatcaatgcttttgtgcattgtcgacctgttctatgcatagatggaacttttatgacaggtaaataccgaggtcagatattgacagcaattggctgtgatgggaacaaccaggttctacctatggcttttgcatttgtagagagtgagaacactgaaagctggtactggttccacgcgtgatcgtcttgtcacatctaatgaataatgtatctcattgagttcacatatattgcagtgaaaacgacgctatataattgacaatctgaaggcaacctcttcatatcttctttcccactaccacaccacacacgaaaatggaagcctattaattggtaatacgtaatctagaattgagattatgtacaacattcttcactacaattttacattttggcagcaaaccaaatattgatcaaatgcaattttaccttaccaaatatttggtagtgccaaaacttgcttatattttggcattaacaaaatatttgtacggtaacattccaaatatgccctaaaaaataataaaattgtattttaccaatcttggagattttaatcttgtatagttttcaatataaaaagatttgataactattgatattatataaaaaaaatatagagcacagtacaaaatcgccctcccccagggcggcaagggggccgcctgcaaatttccatgccccctcgccgcccatttgcaggcggccccccgcacagtacaaaatcgccctcgcggagggcggcaagggggccgcctgcaaatttc

SEQ ID NO: 45078 - DNA, 5354 bp, Oryza sativa
ccgccccctgggagggcgatttttaaaaatcgccctcccagagggcggtaggcgactatttccgtcaattttcaaaatggaaaattatttttgtaaaacttttaataaaaaaattataaataaaaaaaattcgtcatatgtaaggatggtgcgtcaaagtcagctgttttagtcggtggtgagtcacgttttctatttttgcacgagaataaacggaaaatgcatgccgttgcaagttaaacggcacaaaatgtcacctgtgtattcatctttgctccagcaaatgttcgtgtgatgtgcatctaatctagctaagcagtaagcagcgagaacgtactctgttgtgtacacctcgtgcttgtgcggtagcatggtctgtcgatgtgtcttgtctccgctaccggcccatcgtgcattgccgatcgagccggcctcggctgcaattcgcgtccttgttgctcggctgcattgcctgggcgaggttccagggtggaccgatgtggcccggtgcatcgttcgtctgttgttgggctggtgaatatcgatcaaagacaatgctataaactgaccttttatttcttgcaaaatgttatgactggcgctgacaatacggcaaaattccaactatactgattacttaatggcgcgtatagatggccatatggcccgaggcccgtgggctggcccaaggcacgccactttggcctagcccaggcacggccgggcctaggccgtgccgagcggcccatttggccaactataatggtgcgtcgttcacttgcccctttcgtcccagaaaaaaatcaaaccctttttgggacagagtagtatttgtcattagaaaattgataggagtatcagttgcacatttgggcccaccctcttaagtctcaacactgtcctttctttatctagcaagatcacatcacaaaataggccaagaaaggtggtgttattttctcctaaagatgaagattaagtttttacgcaaaacgaggtggtgttattgagttttaattattacaaattgaaaaattgattaatatgatattttagagcaattttcatatagaaagttttcgcatgaaatacaccgtttagcagtttgaaaagctgccatgaaaatcttaatcttcatccaactcttgttggagaaaagaacgggacctttggccacgcccatgaaacaggggctactgttgccaatccgttggtttggagagagctcatatgatcccatcccaccacatcaacctctttggtcaccacctctgtttgtttctctgtcgggccaatcgccattgacgcagagcaccagccatggtgagagagtgtcattatagacggattgggaatgttgcccacagtggagtatagtaaacgaatcctcttcaggggtcgaaatataatccatattatgtgcgtggttactcttcagtcttcactcactcttcaatcttttcttaagagctaatgggcgaacgtgcgccaaaccgatctcacgaataggtatgggaatgagatatttcttcacacgtgcgcgtactgcttccgtttcttcacactaaggtggtgtttgaatctcgtgagaatgaagatgaagataaagattaagtgtttcacgtaaaacgaggcggtaaataacgtgtgattaattaagttttaattattacaaacttgaaaaatagattaatatgatattttagaacaactttcgtatagaaagtttttgcacgaaacgcaccgtttagcactttgaaaaacatgctatgagtatccaaaaatttattatccaactctaaaatctgtcacatgacagatagcaattccgaataaataaagtgcgatacaaccagcgcgtggagttgggcttcaaattctaatcccactcgtttccgatgccatactctagagatatgttgaaattagaattcagcaccaactttagccgaacccaactccgctcgaagaactggaaccccaaacccaattccacggaccggttccaaggatccaaacggaccagcagctgcttccaggaaacaaaggatcgtctctcgttagaagttaccggtgcctgatgaactagagtctcctcatcaggctgcgtcaaaggggaagaacgtgtcttcgtttctagcgtggaattgaacgaccagagcagtatgttgtgcagctgaatcgggtggccggtggtcgacgagaagccgacggccacctcgctcggcaagcttctcctcagatcaacagtcgagttgatgcttctgcagggcgcgccgccgatccggacagattttgttagcacctgcgttctgtggtcgtatccaatatgcacgaacactgtgccttcgccgccgccggccgatccgtggttggtgtctccggccagtgaccacggtggtgttgatgatctgcagcttgtagacgacgatggatgtgacattgacgacgaccgtgctattagtgtagtctcgaactcgacctcctcaatctgatcatcgccgtccgttgtaacgcttctgctgtttctgttgctcgacgggtagtaaggcacgaggaacacagacatgcgaggaggagagccgccggcgccggcgccggtctgctgctgcgttctgaggcagaaggtcatggtgaagctcgcggcagcgccggtggcgttgtcccagagcagcacgggctgcgtgtgaagcaccctgccgacgctccggattcctttgctccacacggtagtagtactgtctccatggaggcggccatggagatcgaggatgcttgtggtcgtcttcaggtagaagaggctgagatctttagtgttgtagtgaggctgggaggagaagtcatagctgaaggagagggacgaaacgccggtaggcggatgggtggacagcagcgagatcagcagcacggagagtagctgccgaggactcatgttgcaggtgcagcagatctcatctcaatggctttgtgcagcaatacatttgatcggtaaatataactaggtataccgtatacactaggaatacataggagtacatttctaaccctgatagcctgctgaaacatgattggcttgtagtctttcgtcgtagacgacagatatcatcgatctcgatctgaactcaacggaaaactagtagaataagagcccgacgttgctctcatcacgctgagcgagtacaacttcacaccacatgacttccgtcttccggtcgtgatccgctgatttcccggaaatttcgaccgaaggtgctgcgtatggtacacaacatatttaagtatttggtgtttaatactttgccactatatttttcttgagaaatacagtgcaaacgcatgtattcacagtgagcgcaaacttacccatatcaacgtacaagcgcacatcctactcctatgaacacaaacgcaggggtatataatgggtgcatactcaccactatgaccatatgaacacaaatgcaggtgctcacaacccgcgcagactcacccatatgaacgcacgcacatgcactctacccctatgagcacaaatgcaggcgcacacaatgggctcacgcccataacgcgcgcacaatcactcatataaacacatacatgcacaccctacttctataagcacaaaccttctccataaccctatgaacacaaatatacaggggtctataaacacctttgaaagacagggtcggcataccataagtttaaggaagtcaccacgggtgcctatgaacacaaatgcatgtgcctatgaacacttttaaaaaacggggtcggcaccacgggtgcctcgctgttaatgggtacgttgctgaccaccgaaaaaataattaaccataaaaacaagcacgtgttaaataaaggatttgaatccgggtggatttattccatcacaagaatctaactagttaagctatgcttacttcgcttttgccactctattctctatcagcctcatcatttggcatattttctgaatatgccaaatggcatatttgcaaacgaaaatcaatttgtgaataaaacttttatatatgagttcttagcgatctaaaagcaaaggctgaaaaataaacttcaattaaaaaaccccaaaatcagctccaaatttaatgttgaaaatttaaattttagctgataaacatatgaatatgccaaacaatgaggccctgtatgtctatagaggagtagtaacaaattgttaaatgccatacttaatagcgtggcaaataattaaatataccaggtccagactccagaatgacagaccgaccgagctaatccgctacacaatttcctcacagcgtacggcaccaaattcccttgatgggcggtcatcttattcataggattcgcttagcattgtacaggggtttgcacttgcttttcaagagcatttatttagttctgtttccatagaacgcatttgaatattttattttttgtactaagagtttgcaatctgttcttgttcaacttataaataagctcactaatttttcaaaagacgactcccctaacaatttaaagcgatctatgaaacagagacggtgtatgtgttggggaggggatacacgatctttctcaaaaagtttaagcctcgagaagaattaagaaagggctatcctgtattaacaactggaaaaggtccatttcacgtcctcaagctatttcattggatcatttaaccacataaactatttttttcctcagtttacccccacaaaattattgaaaatggttcactttaagcagacattttatactatagccttaaatgaaacaattatcaaagtagaacagtcaaaatgtactgccaccgtgttggctccccatgagggcggacgggcagcgacaaccctagcagctgcccgagcgaggtgtcggcaaagccggtgactcgctaggacggcggcagcgggcctcacagctcccgcctctccagatcgagcacgggcggatctgacgatggaggtccacggtgccgtttcggcactgggcagagagcaaggcggcagatcgcggcctagggcaacatggcgtcgttggacctcggaggctagcgaggatgtggcgctagcatcagaccctccttcaccggtcggcgaggagactggtaggtggcggggtagaggaggtagcggtgatgatggaggaggtggcgttggaggcagggacgaggcagcgggctcagttacgggaagcgccgctagatatggcttccccctcgcctaatccggtgctcccctatttcggatctggcctcttcagtgagggaggacagatcacatgtggttgtgattgcagctgaggaggcggtggctgcggcgtagagagtgcgatggcgcatggtg

SEQ ID NO: 45079 - DNA, 1168 bp, Oryza sativa
aaacgaacacagccttggtgttgtaggacgagccgagtatgatgttgcttggcttgatgtcgccgtggacgacgcactgctcccactcttgctgaaggtagcggagtgcagagcccaggccaatgatgatcttgtacttgttgatgaaagattagcgtagtgaaaatgagagaattgtttgtagctatgtccgccaacttctggtgagtgtggatagatttgaattctacatgctaaatttaatgttgttatttatatttaggaaactacacagctgaacctaaccaactgaagatttagctagtccttaattttagttccattattgtctcaaatctacctgaaaatataaacagttgattaggagtcctaaaaaaaaaaaactacttctcaactgtggaataaactcaaatgagtactccctttactataactacgtgagaagtagctaaccttcatagcctagtgtttagaagaaaactacttctaaacaaaagttaactgtgttctcaactgtgtactctctccgtcaactgttaactgagtactcatttacctttatattttttcataggctatgtcaactgttgtgaggaccctcaggagtcctcaactgtgttatagttttcttctcagtcgtagaagtagtttttttggttgtcctggcctaaccttcatagcctagtgtttagaagaaaattacttctaggactgtaaacggcctttcctacaccaaaagctagctattgaggtgaggggctcccccacttatatcttaggtcctttatccttcacattgatgtcccttagcccttcaccatctcccccttcgcacattggtatctctcagcccttcaccatctcccccttcatacattagtgtcctatacgggccccaccggcccacagtccatcagttatacgggccccgcatgcacccacggtccattaggtcttcacacactgtgtccatcgggccagagatgttaacctagctaggctctgataccaattgtacgatcgtaaatggcctttcccaccccaaaacacggtcttcacacacttcacacattggtgtcctatacgggccccaccggcccacggtccatcaggtatacgggccccgcatgcacccacggtccattaggtcttcacacactgtgtccat

SEQ ID NO: 45080 - DNA, 13230 bp, Oryza sativa
tcctgcagccctagccattgagatgagggactcccccacttatatcttaggtcctttaccctttcacaaacaatgtgggactattcaaccctactaacttcaccatcaaagttcaatggtttgctagtattttgttgatcaattttcaagttgatgagtgtgcatcatttttattgtgcagtctattaggctatcctgaattggcctggttgttgtcagtgggtctttccagaaacacaccttattaaccaccaaattgatcaagtaagaaactcaaaagatatatcttctattagtctcaaattttagaaatatattacgatttctataaattttgttcgttagaatcgttgtatgatttctataataaaaaatacatatcattacactgcaagtgtgacatccctgagttaacatgagactgcaagtgtgatatccatgagttaccattcgactgcaagtctgatatccatgagtgcaactgttatctctgttctccaggtagaaggtctatctttaaaaggcaaacatattcagcaaaaaatgagttcgatatcgtacctttcggcccatgttaaaaacctctcatttttgtatatatgcttgtcaagactaccttcagatacgagctcataaacaatcaggagacccgtgcaactgccacacccaggttcactatatcggtttagtggttttgatcgggggtcaccgaaatcccgaaatttcggaaatttcggaaattttggtccgaaatttccgaaattttgaacaaaatttagttgaatttgaacaaatattacccaaattcatgaaaaaattaaaaaaattcaaaaaattcggctgaattaatatcgtttcggaggggaccaaaatgaatttcggaaatttcggtccgaaatttccaaccctagtcacaccaaccaattaattggacaaggtttcgatgcctcaaccgacttatgatcttgatctcagcctcaaactccttcctcccctgagcagatgagtctggtgagaactttttgatggccacaagcctttcctgatcatcaattttcaggcatccgtggtaaacatgaccaaaaccccctcttcctagcttcttctcctcagcaaagttacccgtcgcagcagcaagttccctgtaattataccttctggggccaacacctttcgcaaattcaatttcgtcaagttcaacctgacaatttccatcagagattccatttgatctcttccatgctaatcgacgtcttagaagaaaacccatgaaaggacataccagcacaaaggatactgcaaacgcaactgaaattgctattgtgccatgtaattaatttaccttgtgatctgggggagctcactttttctgggggcactgctgctcctggtgacattattggttcagagctgacagtttctgggggcacaggtgctgctcctggtggcattactgaaaaatccatccatgttagggtggagttgaatgaccatgacagcacccggtgtacctcaatggagcttccggtagaagcagagaaaccaacagcgaccacctcaggcaagcatcttctcatgtcaacgctggctgtcgaaacaagatttcggcaatactaaaaggggtggctatcaagctaggaaagtggatgggtttagagacaaagaattttatacaggttcaggccttcttattcaagaagtaataccctactcctgtccggggatgattccgccgagtgtattattgattgtatgatctgaggaaaaaatcgcgccctgagaggcatccggacccctccttatataggggaaggggtccgctttacaaaatacagtccatatcccaacggaacatgggattacagataaaatacaatcgtaaccgactaggatcccgagtatttccttgacatacaagtttagaatctaacccgagtcctcgtgaagatattctatctctattcggtaccctgtacccagctggaatataactgccatgtagatatggggtatccataatctccacagtagccctcgagacctttgcagtcgacgaaatagccatcaccccctggtactagacccagtggttcgcaatgtcaagctccggagaactctcatcgatggtggcaatgcactcaacatccttttcactaagaccctggacgatatgtagattcctcgcacggaattaaagccgagtaatgcacccttccacagtgttatcccaggattatcagctacaccacttggccagatcactcttccggttactttcggcactcgggagaattttcgcacagaaaacgtttgtttcgaagttgctgatttcgagacagcgtaccatgctatactcggacgaccggctctagccaaattcatggccgtcccacactacacctacatgatgatgaagatgcctggtcctcgaggagtcatatcactacggagcgacatcaagcaagccgtcacatgtgacaaagaaagttgcgagatggcccaaacccgcgagatcactctcgctcgcgaagagatccgactggctgcgaccacggcaagcgaaggagaaatgcctgtgaccaagctgtcaaagaccgaagaaggcgacgacaaaactaagaagattccactagatccctctgatcctaccaaaactgctgtaataggcgttgagttagattgtaaataggaaagcgcgctcatcacctttcttcagaataataaagatatttttgcgtggaaaccatccgatatgcctggtattcccagagaagtgattgagcactctttacatgtcaaggaagacgccaaacccatcaaacaacgactccgccgttttgcacaagataggaaggatgcgatcaaagaagaattaaccaagctgttagcagcaggcttcatcaaagaagtcctccatcccgactggctggctaacccagtcctggttcggaagaagaccgggcaatgacgtatgtgtgtcgattacaccgacctcaacaagtcttgccctaaagatcttttcgggttacctcgcattgaccaggtggttgactcaacggccggctgcgagctactcagtttcttggactgctattcgggatatcatcagatccgactaaaagaatccgactacttgaagacctcgtttattacgccctttggggcctactgctacatcaccatgccctttggattaaagaacgcaggagcaacctatcaacacatgattcaaagatgtttttcaactcagatcggccgcaatgttgaagcttatgttgatgatgtagtcgtcaagaccaagcagaaggatgacctgattgcggatttagaagaaacttttacaagcattcgtgctttcaggatgaaactaaaccctgaaaagtgcatcttcggagtaccatcagggaagctgctcggatttatggtatctcaaagaggcatacaggccaacctggagaaaatcaacgccatcctcaacatgaaaccgccgagctcccagaaaaatgtccaaaagctgactggttgcatggcggcgctcagccggttcgtttcgcgactcggcgaacgggggatgccctttttcaagttgctgaagaaaactgacaatttccagtggggacccgaagcacaaaaagcctttgaagacttcaaaaaacttctcactactccaccagttttggcctcgccacgtccgcaagagccgctactattatatgtgtcggggacctcccaggttgtgagcacggtcctggttgtcgagcgtgaagaggaaggccatattcaaaaagttcaacgaccaatttatttcgttagcgaggttttggccgactccaagacaagatatcctcaggttcaaaagttattatatggtgtcttaattaccgtcaggaaattatctcactattttcaaagtcactcggtcacggtggtcacatcgtttccactcggggatatacttcataaccgcgaagcaaacggacggattgcgaagtgggccttagaattgatgtctttggacatatctttcaagccatgaacttcaatcaagtcataagctttagctgatttcctcgccgagtggaccgagtgccaagaagacatgccagaggaaaagatggaatattggactatgcattttgatgggtcaaagaggcttacgggcgctggagctggggttgtcttaatttccccgactggagaaagattgagctacgtattgtggatacatttttctgcgtcccataacgtggcggaatacgaggcgctgctccatggattaaggattgccatctctttaggcattcgccgactaatcgtccgtggagattctcagttggttgttaatcaagtcatgaaagaatggtcctgtctagatgataatatgaccgcttatcgacaagaggtatgcaagttggaagataaattcgatggacttgagctcacccatgtccttcgacacagtaatgagctaggagacagattggccaatttcggttcaaaacgggaagcagccctaatccagtcggctcagtatttacaagggttgcaccgttatcataatcggaatgttcgatcgcgagcctttctagtcggcgacctggttttgaggagaattcaaactacacaggatcggcataagttatctcccttgtgggaaggaccgttcataatcgctgaagtcactcggccaggttcttaccgactcaagcgtgaagatggtactcttgtcaacaattcttggaatattgaacaccttcgtcgattttatgcttaggcatttcgtttgtatctttcctctttgactgctaacttcaagtttttccttgaagtttttagtcggggggttactataataataatggaacattatttttatcaattcaatttgcttacttgatttatcattgccctgcttgatttttttggcttagacaatgaggactgaaagttttttaataacttttgcgagttttaggctcaataaggtttgacaaaagcttttaagaaatcagaggctaagtttgaaatatctagcacatcataaattcatcagtattgtacaaattgatcttccatcatcatcagaatcactgctactaatcagtgtcagttttttcatcgtcggaattatcagacccagtcggccgaaggtcgacatcttggaatctctcaactacgtcagcagcaatcttgtcagcggctttttgcgcatcattgatgaggttgagggttgtttcttcgcttgtcccgtctgcaaatccatcaacggcgacaatatcgattttggggtataaagatttggtcatagctaatgtcatgcttgctcccatacttctagcctccctgatattcttgaagtaagtatccggagcgactctcagcttgtcgaagatctcggaagcgtcaagtgtactcggaccggcgttattgaagaacatggcttggatgagtggggtagcggcattagcgactttatccctggccccttcaagcctattgatcttgttgactaagacatcaaactgtgcctgggacttgattttgcgatctgcacgaatagattcgtatcaacaagtggctataagaacatggggaatcagttatcattaccttcaacatcttttaaggccaagtccctctgctttgctagttcggccttgtccttctccagagcctcgacctgcttctctaggtcagaaatcctggcggcttgcactgtaatgcttttcggttaatcgatatgacaaggaaggcttcacgaatacgtcagacagatatggcatttacctttggatgaaccacttagttcataattagattcttgaagctcggagattctattcctcagatcatgctcagttttcctcgcgagctctctaacctcatgtagctggcttctagtagcttcaagagttccaagatgaggaactaatttctcaagagttgcggtcttcgcctcattcctaagatggattctctgcaatacgaatttactggcgttttagcaaaacatgaaaggggataattaaagctatgcattaatggacttacatttacaatgcgagtagcctcgctgagtgcctttttcagcaagcatacttcctcatcttctttttgtttgtttattacgattccttgaggttgcctatcattgtcccaccacttgactaggatgggagggcgcgagtcttcagctgcttgtatacggggaatttcttcttcatcactaatcattagtcctaatgtatccattgacaaaggttagacaattgatcagagtcatttggatcaacacggtttcaggcaaggtgtttacctgtgatgatttccggacggggacgagtcgactcttgcgccttaacgggggaccctggcatcgggtcgttgctggcatcttgtctacgagggctgtctgcccgagctccaacttctggaatctcttggcttggcctagtgtccgactggttttcagtcgggggctcctgattaatttcggctccagcttcggccgactcgtttccaatcggggattgatcaccagatcctacattatcggttgctggctagttgtcactcggctgatcctcagcagttggctcggtttcttttaagttcgttcccatgttggtcgggtcagagtcttttccagaaggatctatatcagatggtttcctgcaagtttggttatcagtattatttccgcactgggtgcgcatcaatgcaagggagaccgttatatgatttgtacctggaagacttcctgatctttggcacaggacgactagatgtttttttccttggagtagcctgcttcggcagtttcttggttgcctctcggtctccaggctttctagcagtatcactttcgtcgtcacttgacaccaacttccttttgcgtgaatttggctggccggctggattggaggtatttggccgggcttcagaacggatcttgggacccccgctcccttgaccggtttggtggtggggtgatcggcgttgaacgactgggggatccaacttcatcaaagcaaattcctgggcgtaatatccttcattgttgattgattcaacaaaaagacaagactatattttgtgaaaggttgaaatgtttgattacataccggtggaggaggattgaaagcattgaatggcacgactggcagcaagtgcgaatagctgacgacgatagcattcgagaagatcttgtacatcctttccttcataaccttaaagtcaagaggtcagccggtcagccggtcagccgtccccctccccctctctcccctggctcgtgggcttggcccattggccagccttcctcctcggcctaacaaaacaaaggaagtttacttttactcccttccgagtccggtgctcacacaccgaagagctaaaagtccgcaattgctccctccaattgctcctcactctctctcttaccttcttattggccccactcgtcaatgagtcaaagataatcttgagattgtctttccaatattccacaaatatttctctcttctataaattcagtaaatcattttatcttatttcatgggttaataaatctttttcccttgatcccataaatcaattctctattccaaaatttcatgaatcattttccttataaatcatttcctttggtcccgcacgtcagacggtcaataatattcttgagaatattatttctataaatatcatgaatcaatctccccttgttccacaaatatcttcctatgccagaaattctaattaaacttccaaaattcgtatctctcgatccaatcgtccgattgaccccgttccacttccagtaattccataaaattgagatctatttaatggcactattatttagtctaaatagggtctttttcttggtctcttgtttaggtttttgtttgtttgcacatagttgcggttaccggattttcgtcgatcgtggatatcttgaagattcgtgaagcttcgtgaagaccatgagcaaggcaagccacctttgaacatattgtgcctatatttgaacttaattatattgcttgcaaaatattatgcattgataggattacacttaatttgtttgccccgtctgaaaggcagaccggtgggcctacccaacttgttgcatctgatccttccattgttaattgttatatcatgttcccttgtaaccatctagttgcgcctcgatattcgtgcactctgtgcgagtatcgacggtcgccttcaaacttaaaatctgagtaacttcttgggtaaaacttagtttacaaaagctttggaaaacccgacgcctgggtcggtgccttgtgaaagaaaatgagttttaaaaaaataaaactcgcgacacaaggccattcctgggcggaatacttgtgcggtcgcatctaaggaccgattcctttggaattacatctgagcatacaatagtgcgaccacacgggtggaatgggacacccctggctgagtaaattgctaatcgggggagacatgtggattcgccggggtggtgtcggggaggacccctgggcttcctggcacagtatggtctgggacctaacctgttgttggtctgggacccctctcgtcggcatatggtaaacctgtgtcggctttcgaaatgccttgtcatgaaagcccttaggtcaccagacgtggccgttctacacgggctgggtgattcgggttagtaatgtcgtgtgggtaaagtgtaccccctctgcagaagttaacaaactgttcgaacagccgtgcccacggtcatgggcggatgtgaggtgattccttagcgtagtttttgttttaccctgttttatgaaaaggtgttaaggtttgggaaacctaatgcatgggaagcatttagctgtccgggggatagcgggaccgggtgtccctggaagtgattggtcgtttggggaccactattatcgggaagtttggaaaattggtttggtttgggaaaaaccagatttgaagccaactctaggagttgtgcaaatcttgataaataaatttgttacttctcacctcccgaccgagctgagacttgtctcgctctggttgtagaaagcacacacttagattgttgaaaacttgaaaacaaaactgtttgcaaaataacagccttcccttgaagcctgcattaaccacctaagttcccctagcttgctgagtacgtaagtactcacctttgctctctatataaataaagttcagtcagctccgaagatgaagttgaagtgaagtaaagattagggtttcgtcctagttccctgcagctgcctgtggtgttgggtgttaggccgttggttccgctgctgctgctgttggtgttcgcctcgtccgtgtcgtcggttgcattctcgggctgtctgagctgcaacctaagttaaggtaaataagtcctctatttattttaagtattgcaatgattcatatttgtcaccgtgggtaccagcgctatgtcctgggactggtactgagatcgcggtttcgtaggaagcggttcgcgccgtttttcccacgacacgctcctgtcaggtgccgttgtacggcggtgctagattaggggcgcgacacctgtacccagctagaatataactgccatgtagatatggggtatccataatctccacactggcattgatatggtaggaggttccgttgatctagagggtgactgccagtatctctgcactgctgtcgtagctgatctcggcagtcatggtgttgccgcttgttaagttcttgtccggtgagatcgccgcgacggagacgatggaattaacatcgatcccgacatggttgccatccttctcccattccttgttcatgtaggtgtcaaactcgaccgccacgatcctagcggtgcccgttgcgttcctgttgttgctgctgccattgaagaggccgaggtttccgccatagctgcgatgagggatgcctgacgggtaatgcccgaggaagaaggccataccgtcagcgctgacgtccaggttgaccggcttgatttggaaggagaaggtggtcctgaagctggccacctcaccagtggtgttgttccagagctgcaccggccgcgcataccacgcgcggccgatgctgcggaggtttcggtcgctgatgtcggtctttgtcagctcgatcgtgcgggcgtaggggtaggcatcgccagcacaggcgatatctgaacctggggtacagtaggaaccaggctcggagaagtcaaatctgaagttgagtgaggtagcatggtgaacatggatgagcaacagcgagttgcagaggtgaagctgtgtgaatagaaggcgatgagagctcattgctgccattgctgatgcttgggagaactgctatagccataattttgcaagacagcggggtagctgtctggctggccggccggctcaccagtcaccaggtttatttgaagccttccaaataatggctgactatatattagcatttcacaattggcccaaacccattcattaacagttggctatgcaatatgtcttatcgcataatccaacgcttgcgacaatgttgcattgtggagacataaccggcttcaagtgacatccaattaatgtagaatgacctcttttttttttctataacatgcaaagtacaatctacttgctaaggaccctgcttaggaaattaatttctgacagagctatgcagctgtggaggaaaccagttaggccaaagaagacaagcaaatggagccaaaaggtagtacttgtggagatgggagagatgcaaagaattcatcctttgagtcatcttgttgttgtattgcttgttataatgatgaaatctgaatgaatcaaagaattcctgggagagcttgccctccaacaacatattccctccattttaaaatgtatgatgtcgttaacttttcgcataacatttgactatttatattatttaaagacattatatagatatcatttattgtgttgtgacttattttattatcaaataaaatataatcttaacctataattttacatatttataatttaataagataaatggtcaaacgttatgaaaaagtcaacggcgttatacattttaaaattggggtagtaaaacaaaaatgatctccagttgttatgttcagtgatattccaacatgtctctctgtataacttttcaggtttagcataaacatccaacagaaatcagcacaagacgaatcatgtaatgacgagacatatctaacagaggaagaggagagataccgagctcacaatcaccaagggtggcgcctgtctccctgcgccgcccgaacaagcgtaccagagctgcagaacactccgcacgaacgtgctgtagcaaaagcccgagctgcacggcgcgggagtgcacatgccgggggaaggctaggtccgatgcgtataggcgaggcgctgtcccggtcaggcaattcgtcgaacacatcctgtgcgcgatgtggggcgagccgctacaggtgtggatccaccggcggccggcggggagcccgggtcttcttgtcagcgactcttcagctagcgttaggcccatcaaagtacggcccgcctcaagtctaattgacgggaaaaagtacatgaaaggtctctcatcttgtaatcggattataaaattatcccccaaccatgaaaccagatttatttcatctctcattttccaaaaccgagtcactttaaattcttgggcggtttcgacaccggctttatcctatatgacagctaagtcagcgtggaacccatgtgagctccacacgtcagcctcttcttctcctcccctctccacccctcttcctttctctcctcccctctccacgggcggcaaccggcggagaggagttgggctggcaggccagtgcgctaggcacagttggtgggtggcgggggacgagcgacggcatcaccgagcttgactggcgtcgcaaagagatgggttaagccgcgttagtcgtgggaggagcacgacggctgccatggagactcacgctcgccctgtccacatcctctccgatccgctgcctccacatcggcggtcgggtcatcatgctccctagcttccatatccttcgctctgtcgcctccgcgtgaagggatgccgccgccgacgccgctcttcccctcacttccctctctctctgccttgagctcgacgcggagcgccgtttccatccacgccaccacccaggtgccacgagcccgacgaggagcgtcgcatccatccacactattgtcgtcgttgccacatctacactacaccataacctagtattcatggcacttaactgccggcaataaaatgaagttagtagcgaattatttgccgggaatatatcaagtgccggcaataatcttggacatcatctcatcagccgggaattaaaaaaataggacaacaaattaagtgccggcaatggacaaatataacatgtcaattgatctgccatagataatttaagagatcactttatctgccgggaatttagttactgggaaatcaaattcacagtgaactgtttgaggaaatattggcgggccaaaaatattggcaggccgagcaaggctccaaggcatggaaattttcgtgggcccaacatccgcggagcacatggttccactcccatcgtgccgcacccgattcctcatccgcgtcatctccacctgcacgccgccgcacgctggttcctcctccgcccaacgccttcccatcgctgcagttgattccatcatcttccccacctcctccgccgcctcctctagtgcttcacccttatgtgccaccgccgccgcaccacgcgctccacccctctgcgacgttgactcctccgcactcagccgttgcactccactccatccgcgctgcctccaaaaccctcgactccaccaccaccttgactccacgcaccgccatcgactcctcactcctccacccccgatgcctctcctgctcgttggcctcctccccacctcctcccaatcgttgccgcctcctcttctttcgcctatccttcttcagcacaacccactgcattgagatcaaggaagcaccgaggaaatccccttgttcaggtgaaattcttcgggttataccaaatctgtggtttgatttttttttcctcatggatggatatgtgaattttttttatcaatgacttgattatatccccaaaactgattagaacacgtcgtgtatcgatggggttggggg

SEQ ID NO: 45081 - DNA, 2745 bp, Oryza sativa
cccccccccccccccctaatggctcacgcgccgccgcccctccccaatcgcgcccccctctccaaccctaatctctccctctcacgcggcgccaccgccgtcgccgccgccctcgactgccgccgctccgccgttgttgcatccgtcgtctcgccgccaccgatctcaatcgcgtgatttccttttcttatcccgaaatcgtgcaaccctctcaccctaaccctaatcttgtccccgccgaccgacgcgccgcccctccccgctcgagtccatgccgccgcaagttcgccgtcgcaggccgcgtcacccggatcagcgttgacgtcgcacgccttcctcctcacatcgcccggcatacgctcgtcctcggtcatatcggcgccaccgccgtcgccgtcacacgcagtcctccccgtccacctcgccggcctcgcgccctcgccgctcccaacctcgcccacgaggtaactatagtttttgttgctctggatcgattgatttacggttgggcgtgaggggattgcgacaagccagtgaggtcactgttttggttcatatcttcatgtaaatcttgatgttgcagttcaggctgtcaggaattatgttagctcgttttcgtccatgctgttattactgatgtaaaatgattgatgggttgaaccaacttgtcagcattaacgattgttatatttcttaagcttgcagaaccaatttatatcataggccagttgatttaaaatgctgaaacaatgcgctgagcttaaatattttggttgaaatagaatcctgagggcctgctcttcctttgctagctataagaataaagctaaaagaactgaaacaaaactcaggtaaaaagtgagccaaataaataacttggagccttgaaataacttggagttctcgtaatgcagccttggaaatgagtaatgtgatctggtttttctttctaatgcagatcctactttgatatggttgagacttcataaattagtacacttcctcgatgacccttcaatgaatgcctaaatactagaggtacatatttcttaactgaattatgatcttagatgtcaatttggacatgcatgtacaatattaatggtgaaaatgctatccaatatccatagaactctagcttaattttctcgggggtagagaccagtcaatttggaacttttagcaggctttctacttggtacaaagaagattatttatggaagttcatgctttttatattataattttgtatgaagttgagctttaacaactggttaataaatctttcatggtttctttgctaaccatctttacctaatacatatttgtcctaatcttttaagtaaaagaataaaatcagatcattttggaagtgtctgaaatctaaatttactgctgaaaacaagtacttaatgattctctgaacttgagcatgtccctgaaactgaatgatatgtactgatagatatcttacgacaaagtgcacatagctgtaatgctatctcttactgatttaatgcactgatagatatctcactagctagaaggtttagtctactattgaaggctcttttctattagctaatagcttctcaggtattattttacctgttctattgataggactgatagagctgtcaatttttttcagggtttctactgctctctagggacagccatatatctttgagaatattgattttatccccctatttgagtcatatacagagactgctgttgaccttgaatttatcccacagcatttgtgtgcatggagatatactgaagtctttttttccagttattcacaaatataatctggtacattgaatattcagtttaatcatatcagattttcaacagagaatgtttgctatgtatccctaatgaccccatttcaacaaggttctgcacaaatctgaagatagagttatgattttctcaaaattaaccatgatgttatccttccttgaactattcatgtaactaatcggatagaatatatagcttctatgcacatatttatgcttttaaatcaactgtaagtttcttccttgaacagctgcattctatccttcaatgtcttcacaaaatacttttttttttcatcctatccatttttttaccgtctatttaatcaaatggcacggtttttttcgaaagggtttcaccaatccatattattatccatttactgtcattaccactaatcatggttgctgcatggaaacaaaaatggtttctctttcatgttaacagaagctatgaaccatcagtgatataagtgaaatcagtgatattatgtgtatgtgtgacaaaaaatgagttattatctgcatgtgtttctcaaatttagatagcaggcctaatcttttgtcgagctaggagaagccctgagtgccctggttagggataacctggagcttttttattattaaatgaacctggagctaaagagttttttatgttctgttgtagctgccagaatggaaaatgcctgaacattgctctgaagatgagtacatcttttgcaagtcttgatctgtgcacctcttcagctggttgtcagcatgaaaaatttatgattctgacatatgtctgtgaatatgtttgtaacaatgaattctaaaaacatatatctctgaatacgtttgtaaatttagttggattttgtgaagttttcagtgagctttggaatgattatgagatagctaaagatgactattgcttgtatggaccaacatg

SEQ ID NO: 45082 - DNA, 10624 bp, Oryza sativa
ctgcctaaggacccatggttatccggttttgtaaaatgagagatgagatatatctggttctgcggttagtagcggttttgtaatacgatgagaagatgagagacctttgatgtactttttccaattgatggggacgactagacgtcgaagggctgatgaatgacataaaatcgtgaaggtctaatggcgggtgatcgcccacaacaatcacgcacccccgcccctccgctaacacgcccttctctcatttctaatgcaccatattttttttaaaaaaaacaagttagagaaaaataaaacaaaatagaaaaaatctaatactcttaaaaatatattcatatgcatagactttacacttataaatatatacattaaacttcgtacgtataaatttcatgtatagaaatatgctatataaaaaatatttaaatccgaattcgaatttgaatcgggtatataaactttttacctataagttttaggtgtgtaatctttagatgtataaattttaggtatataaaaagaaaaaaatatatggtgccaaaaaaatggtgaaaaaaaaagatcgtccgcgggcaatcgctaattagcgatctcgcataaaataggacatcatatatatctgctccgtgctagtccctccgtcccctaatatactggattttgacattttgcttactgtttgatcattcgtcttattaaaaaaaatttagaattattgtttattttatttgtgacttactttattttccaaagtactttaaacataacttttgggtttttatatttgcacaaattttttgaataagacgagtgatcaaacagtataagtaaaatatcaaaatctcttatattaggagacagatggagtagtatttttttatagtagtatgcacatgcactgagtattggctgttatttttctctcatgtaacatgcacatgcactaagtgtatgcattgctgtaatttttttctctcttccatctaattaacaaaatagtaagcaaacttcaaactatgttttaatttcttctaaactatttatcagaactgtagtttaatttgtttgcatcaatatattagttgctcaaagtataatctaacataactatatttaaataaaaaaacatctagctataactattgaaacattgcgaaatacttattggaacattaaataaataagacacgcatcatttacaaaagtaactaacggaacatctaaataatactacgtgcaacatagtccaattctaattggaacatttgctatgcttctagcaaagtggaacataaaattttagtgattgaaatatatatttatttttcacatgaatataatcaagcaagatctcattgtaaagatttaatcgcaacaaatatagcatccacaatgtagtctaaaactagtccataagcaataaaatattccactcagccataagtccatagcaagaaaatagtgaaagccacccataagcatatgggctgcccatatagaataaaactaggtgaaaccccgcgcattgctgcgggaatttagtatgataacaataaaaaaaataatgtgtaagatagctagataacatcagttaagtaaattaatgtggtttatgataatttaaatttaaatagtatgtacaatggtgattcaaacgtaaaaagtaaggtggtatgaccttatagaagaagaaaagtagggagataatttggaccgtagattaatcatctaaaggctaaaaacaattgatgtgatatgacttaattagagggaaaaggagaaagataatttggaccatagattaatcatttaagcactaactaagtgaggatgaactttataagtatataagatatcataaaacatatacattgaagtattatgtgaattatgttggatgataatttaacatgtttgtgtttgaaaagctcttaaattataaaaactataaagatatagcatgtttgcatcatgtttaaatgtgatgattgttagtggatgatgatgtggcatcttgttaattagtggatgatgatgtggcatctttgcatgttaagcttaagtagttagtgggagatatctttatagtaataggatatgttatttgtctctatttcctctctccttctaatactagttgatatctatatacattgtgaagataacaataattatagttcatatatgggtcccatctatatgggctatttttgctatatacattgtggttaccctagtagaatcatagactgtgtatgtagttttggggaaaatgattttaaaaattgtgtttaactaacacgtgcatgcaattcataaaaaagaaaatgaaaaaatccaaaaaaaatcaggcaaagtaatttcaaaaaattttaatccgaaattttgaaccttagggtctgtttggcacagttctcaaccaaacagttttagctccacctaaaataagagcggagctaggtgaagcgctatcataaaatgaactagagaggcgaaggtgattttagactgtgctacaactccactccagtcctaactcctaaagataagtttactattgcgtgctgcgtccgctcgggcacgacaacctattgcgctgctgtggtgctcgtcttatgggtcgtcaaggtagcgagaatgtaagaagagacgaatagctacaagtggcgacattatagggcgatgccagcggcggactcatgatatggtagtggacgggggatgtgtggccagaagggaaagaaggaagaagagaggcacactgatatgtggattctatgatatcacgtaggcgtcacataatcactgcataggaacaacgtaagtaagtcaacttgtcatattggtgctacgtacgccagctaaaaccgctattaaaacagctgatggacttaatttacacagattttagaagtcggaggatgaattatacccgattttacagtttaaaaacataaattagactttcttgcactgacccacaaatattaggcccacttatgtgtagttcttgaacaaacagctcagcccatttagacccatcaaaatcgcaactaatcacgacgatccgaattggaaaaaggtacaccggaggtccctcaacttgtcgttgagttacaaaatcgtccttgaaccgcaagaccagatacaacacgtcccccaacttacaaaaccagtgtaaactaggtccctcgacagttttgactccggttttatccgacgtggcagctgactcagcgtgggacccacgtgggtcccacatgtcagcttcttccccctcacctctccacctctcttcctctctcctctttttttttctcacttctctcatcaattgagagttgggcagggctgatggcgggggaggaggccggtggaggaggtgggagtccggcggccggtgatgggcgatgaggcggcggcgagtaggagggcctctccccacgccgccgccaccaccaccgccgatctgcggccatggaccgccgctcgctagtaacgcccgtcctcccacgccgccaccgccatcggggaaggaggtgggcgcgaccgtcggtggcggagcggggcgcgatcggcggggtggacccgggcctgggcatggacggcagccgccggtggaggagttgggcggcggcggcggggaagggcgggcgcggggggccgtgcagcaactgtgacatatggcaacagatttatttgctcatttcatccattcattaaaacaggatatctcaaaatcatcaagcaatatatgggcacatctccagatatgcaaactgcaaaccatcagtaagaaagtaagaagtaatgagaatctcagaatggagaacaagcatagccgcagcaaccattcggcgttcctcagttacgcatcacaaattgtttcagacatttagcatcaccaccgaagcaggtagaatgataaaaggaaaaacaggaatggaacataacaagtgttcagatccctatgtttctgtaggttattaagcaactagctcatagaagtcatatattctcatccagcactctaccatcatcagttcatcaccaaaaaaaaatcatcaaatctttcataggctgtcgcagcagagcaaaacttcctgtgcattagatcaccggtttacctccagggttggaaatttcggaccgaaatttctgaaatttcggtcatttcggtcccctccgaaacaatattaattcggccaaaatttttgaatttttcaattttttcatgaatttgggtaatatttgttcaaattcaactaaattttgttcaaaattttggaaatttcggaccgaaatttctgaaatttcaggatttcggtgacccccgatcaaaaccactaaaccgatatagtgaaccctgtttacctcttgaggcggagaaagatcaccacggcaataactgccacgacggcgccgacggccgcagctccagccatcaccggcaatgcgacaggcgctctttgtagggccccaggtgtccaagcagctaccctcttgtcctccccagaggcaggggcagcggcggccttggccctaaccctctcggcgcggcggctggtcttctcgggctctcggcggcgacggcggcgtaggacttgatgcggtgacggtgacctcgtcctccgcgacgctgctgttggggttggtcttctcggcgacgatggcaacgtaggacttggcggtcgcacccagctgctaccccgccgcccgagcccgccgcaccgtgcccagctattccggcaccgtcgcttgtgggaaagggatgagaaagaaagatacgtggagtggggaggggaagaagaggctgacatgtgggacccacgtggctctcacgctgagtcagctgctacgtcagacaaaaaccgaagtcaaaaccgccaaggaatctaatttgcactggtttcataagttagaagacgtgttgtatctggtggttttgccgttcaaggacgattttgtaactcgatgacaagttgagggacctccggtgtactttttccatccaaattagcccacctaacattgtagtgcaaaccaacatttttgcccgcttatgtgttgttttcgaataaacggtacagcccaaatgaaccggaccgctgccaatggctaatcctaatgggcgggtgatcgctccctctcctcaccagcgatcacccgcctctcctcctgtacagtacattatctcctttccccctttctcctcccttcttctctttctactacaccataaatatttgaattcaaatttaaatttaaaaatgggtatgtaaattttttacttatgaactttgggtctataaactaatatttaaatttgaattcaaattcaaatttgaaatgggtatgtaaacttttgacctataaactttgggtctataaactattatttgaatttaaattcaaatttggaacgggtatgtaaactttttatttataaactttgggtctataaactattataaactattatttgaactcaaattcaaatttgaaacggatatataaactttaggtctataaactttagatgtatagaaatactatatataaaaaaataattgaattcaaattcaaatttgaatcggatatataaacttttgacttataaaatttaggtctataaactttaggtgtataaactttagatgtatagaaatactatagataaaaaatatttgaattcaaattcaaatttgaatcggatgtataaacttttgacttataaattttaggtgtataaactttagatgtatagaaatactttataaaatatatttgaattcaaattcaaatttgaatcggatatataaacttttgacttataaactttgggtctctaaactttaaatgtgtaaacttgaggtgtttaaactttaggtgcataaacttactaaaataggaaagtaatgcggtgccaaaaaaggaaaccaggtggagggagggggggaggggtttatcgctaacccaccgccaggcgagcgatcgcctattagcctttccggctgcgaatttcctcacattaacatagaacaacttattcaaaatttatctcatacaatataattttaactacaaacattgtctaatttattccactactttcctattttaacaatatttcacctttcttgttaatttctcttttataagtgggtgagaaagaagaaaggaaaattaaggaatctataatatactacctcagtctcacgaattaaagccgtgaacaccttctgttttcctttttcttgatgttgatgtagttgcactagcaccggcctcctccttgatttacctgcacaggagtgaattgcacaccacccgagaagcaaaagattcgagagtcaaggtggaaaagataagcatagtggtataattaatgacaagggccgacgaaaccccttcaagtgcatttgagatcaattgggctctctttagagttttgggaattaacataggaaaaaatcgtcctctctccctaacgcatcctcctctttttatttacactggtgggacttaagggtaacccagataagactaagttaatttcttactaccgatcacagtaatattttatctctctttttttttgggaagtaaactagtggaattatctcctccataattgtatcgacagtggactaaaaaatcaaccaatattcaccttttgattttgaggctaactgatgagtctactaaataaaacagctccataaggtgacatgtcacagcaacatcggacgtctctgagacccagtcttaatttagcggctgctaattgaaacttatgccccttcattgaaaatatcagtcaaggctctaacttatacatatcccggttagaacataatcttaattaaacttaatttacgagcctttagcatatgcctctacgatcaaacgcttagcataataatttgatcctgggacatatatacctttcatagtaactagctgccctggctctaattagtgaatagaatgtgctccacgatacaaagctctcagcagatcgatcaattaaatctaagaatttcagttactaattaagtttaacgtagtttttaatcgatcagctgctagtactttgcatgattgcatccaattaagctctagataagaccacgtacacaatagaattttatctttctttttcacaagaccaagctgctactccagttagtaggagtatttatttatcgtcgacgtaggttatcccacttggccggccggctgtcggtcgccagcaggtggctttcaaaaattgaagccgacgatccatatgttcatgtcattctcgatctacctgccaaccgttactcgatttttattaaattttttggacttgtttatttttttaattttattaatagacattttcaaaggaatgtttctgaaaactaaacctttgtaccacgccagcagtgttgttttgccactccacgtggcgtggcaagaggctggctgccacgacagctgcgtgtagcatgacaaagttatttggccacaccagacgggctgtcgtggccaaaaagtttggattcgaaaatactttttgaaaaggtctattaacaaaatcaaaacataaaaaagtctaaaaaaataaaaaaatttcccgttactcgtcctcctaggtattaatgctgcgagccggcctcacgatgccacgtacagcaacccatggccaacatctatatggacgttagacaaattaaagagacgatctgttcatgttggtgttttcgatcaggcttgtatgatagagcactattcccttagaaataatatagagagtttgcatacttctatttttgtcaagaaaaaaaaagaattggacgtcacacgctcacatagcactagcaatctaagtcgcgccttcgcgcgaccataacccgtcttttatttccgaatatgataatatactgtttgtaataattacatttgttaaattttaattggtctatttgcatatttgaattctattatttaatttttttatgaattgaactttgaagagtatttggctcaatgtttgagcaattaggttgagatataattttggattatgactataagtttgtttatctatttgttagttacgtatatttttgtaggtggtagatattttttatcttacctatttattcatgattgttttaatgaacggcacatccgataattttaaatttactaaattatttagttgtgaatgtaggatttgttgtaattctgttgacataaaatccatagaacacacattattctgtatgtttattaggttactttgtggctatgtaaagatatatcgagaattactttttatatgtgtggtgttttcactttatatggatttgatttcaccatatttattcatggttataaattgaatttatgaacaaattgagacagtaatggaggtgtaagtggtggccaggaatcgaaagaccgacacttttgatgtgggcccagaaaatgcattcaatttgaaagaagaatcaactaaatataagtttcacattttgatagtaaaggagtttattttgtttttattctaaacttgtctcatgtgcacggagaaaagaggatggaattgatttggccttgcagtattcttagagttaggagaggttgtctaagatactctagaacattcacacattttccttgggatgttctctacggtactctagaacattcctactccctccgtcaaaaaaaaacaaaccatggtttccgtgtccaacgtttaaccgtccgtcttatttgaaaaaattatgaaaaaaattaaaaagataagtcacgcataaaatattaatcatgttttattatctaacaacaatgaaaatacgaattataaaaaaattcatataagacggacagttaaagttggacacagaaatctaagatttgcctttattttttggacggagggagtacattttttacaactatacttaagtttcatccaatcgtaaagattgattcgacttattttgtctttaagtgcatccgacggttaatacttgttagatgacatggcatatcctggtttctttgtgagatttagttttcacatagagatatcaatgtgctaggcataaataacatgttataaagatagaaaacaatctatttggaaagaaaggggaactgaaccacataaacgatccatttgagtattattctttcagcgcgttcctctagacgaaaacaaacatcattgactagtacagattctctcatctgtgacggcccatcacatgcctgggcaatatgggccgtcagaatgaagtcatctcaattgagcctaaattaataccgttgtagatgtactcgtacatatataagcaaggtgcatataactatagcccgtcaccgatgacactcatcagtgacgggctcacagttaggcccgattgagattactacctatatctcaatcgggcataattactaggcccaacaaaggcccgattgagatggccttactgccagtcaccgatgactcttgttagtgtcgggcttctatttatgcccgttagagatagcgcccgttacagaagtcgtatttttggcccgattgagatatattttgcacactatatatactccaccagtctattatctgtagttatcccactgtgcactattctggtgggaggttgaagggtgcgattttttgtaatttttttccaaagaagaacaggaaaatcataaaagtaagtaaaagggtactaatcatttcttattaatttagtagtacttatcttataagatgttaactatttcatccgtttcatattataagactttctagcatttcccacatttatatatatgttaatgaatctagacatatatgtgtgcctagattcattaatatctatatgaatgtggacaatgctagaaagtcttataacctgaaacagaggcagtaatattttgttcatttttcaaccatggatcgaagttggatgtatatgacttctttgaagcagcagtataaggaatttgtttttgattattattctgtgatgaataattggcattggagattattggttttgatatttggaatttattttcaaagtggttttggagatgattggaattttacaggtgatctacaggtgctgctgttttgggaccggtcagaccaggcaagttttgccggtcagaccggcgtgtatcgcgcggtcagaccggcacagcccgcggtctgaccagccgacgctgtgtcggtttcgatttcaggttgtttgtttggatatccatgattgtttcatgaatatgacttctagatggatactatgcatatgtaatactgttatttgctactaatgagtcaagttggggatagcttggtcttggaatatggtttctttgtttgttccatgtgtaggtgaattgatgccgggagagtatttgcggtgatggaccgggagtcggcttggggataagacgatgtccagattggtcagagatcatggtggatactaaggctagagttcaatgcacgtggaaggtgaaggttccatatggcataggatgcggagttgaatttggaaggagtccaatttggtggaattggttatgtaaagattgtttcttg

SEQ ID NO: 45083 - DNA, 5506 bp, Oryza sativa
ctagtatgagtttggttcgtggctttaggctgcctacctcgggtataaatagagagcgagcgtgaggcttcctagtatcgcttttgagagcaattgagttgatagtttagttagggtttcgagtttagtcgaaatttttgtaaggagtgctgttggtgcactttgtaaacacagagagaatcaataaagtcgtcatccactttaagagttcttcggtttgtgttttctcgggtgcggcggtccaacctgcaggacaccagcggtcagaccggcgacataagggcggtcagaccggcagcggcagccaggcagcagcaggtgatttcggcggttcgaccgatcgatctacatcggtcagaccgacttttactaggcggctataccggcgcatacgcttcggtcagaccgcgatccatcgaatttgagggtaacttttatttccgctaaaatttttggtttttgggtataccaaccattcacccccctctggttggcttagttattatgattcgatcctacaagtgatatcagagccttgttttcttctttggattttaaccgatccaaagtttttgcaatggctaaaaagttttcaactaagcctcatgttttcgatggtactgattttgcttattggtgtgataagatgcaatcttatattatggctgaagattatgatgcttggcaaaaggttgcacaaccatatgtgattcctgaacagattgacactattgctttgaaaaccgagtctaataacaattgaaaagctcgcaatattcttttgagtggaatttctcgttcggattttgatcgtgtttcacatcttaaaactgctcatgagatttggaatgctttgaaaaactttcaccaaggaactactaatattaaagagcttcgtcaagatcttttcaaaaaggagtacataaaatttgagatgaaaccaggagaagctttggatgattatcttggtagatataataaaattttgagtgatcttagatctgttgattcttcttatgatgttaattatacacaatatgaggtttctcgccactttttgaatggtcttgacatgtctatttgggagatgaaagttacatctattcaggagtctgttgacatgtctactttgactttggattcgctttacacaaaactgaaaacacatgagatgaatattctttctcgtaaagttgattctaagttgagtgctttggtttcttcctcaacttctttggatgttgattcttcttcatcgaagtcttctgcatttgctttgtttaatgtcatgtccgatgatcaactcgaacagttcgaggaggacttggttttgttaactaacagactttcttgagctgtaactaatgtgaggtacatgaaaagaggtggaccaaatcgttgatttgaatgtggtgctacggatcacttttgttcgcattgtcctatgcttgggagaaataggatggaagataagggtgatgagaagaccaacgacaacaagccgaatagtatagttaaaggagggaagaagatcagggagactctcaagaaggcttttgatcaagtctatgccccgtttgggccactaagcgatgtagatgatgagagtggagatgaagataagggaaagaacatctccggtgtttgcttcatgccgcgtggtgaatcggatttagagtgtgaagacaatgaggtacatacttttgaggatgctattcttattttaagagagaaaaataagaagtgcgagaagatgtatagaaaataggagtttatcattgaatctcttaattctgaaattgctagattaaaatctcttattcctaatgatgatgattgcaaaagttgtgaggttttaatgaatgagatttcaaaaattagagatgtcaatgctgcacatgatttgaaaataaatcttctcaagctcttggatttgctttgcacacacgcactttggatgagttgtttttgactaaaaagttgttgcaaaaatattaaattgattttcatgctagtttgatgtttaacaacctcatgatgttttggattgctcaacacgcacattaaataagatgaaactaaaagaagcttatagtacatggaagatgttgtgaaaaccaataaaatgttttcttgccccaaatgtcgtaaaagcaaaggtgttatggtagattgtcaaaattgcgctaatttggaaaatgagtttcttatttgaaaagttatttgcaaagattttctggaggtaagaaacaacttaacatgattttggatcagtctagagtgactagttacaataggggtgttggttttagtgttcatgattatttcaccaaaaatcaaccaaatgttttgagtataactgaacgtggtaaaattttgacaaaacctaatgaaaagaaaattgtttttaaatctgctagaattttgccttctctttctgcaactctaaaagaaacaaaaacaaatctttcaaaaccatcttcttctaaagaaaagtatacttgttctttttggcaaagatggacatattgttggtttttgtttcaggttagctcataaacagaaaaaggagagagagattgcttttgcaaaatcgaagtggcaaaaatctggttttccctcaaggaaactggtcagaccgtagtggatcccacggtcggaccggcgaccggtcagaccggcagcagcgcctcggtcagaccggcccctggtcagaccagctcctatgttgcggtcagaccggccttggagaaattttttgaaaagttctcaaactatttttgcacgtggatatatgcctattggatcttctggtcgtgtgtctcagtactggattcctacatttttattatcatctaacctcagtactatggcttcgacttctgcttgtgtgtagactttggtggcgaggaaggagagcatgtggatcatggattccggttgttcgcggcacatgactggtgataaaaattggttctcctccctcaaacgggcatccaagactgaatcgattatctttggtgatgcttctactagtgccgttctcgctacaggtttggttaaggtaaatgagaaatttgaattaaagaatgtagcttttagtttcacaaattgttgatgaaaattttgaggttcactttaagaaaactggaagtaaagtttttgattcttgtggtgattctgtgttgaatatttctcactatggaagagtgtttaaagttgattttgataattcagtttcacctgtgataacatgtttggttgctaagtttgataaagatgtaatgttttggcatcgtagacttggacatgttggttttgatcatctcactaggttaagtggtttggatcttgttcgtggtttgcctaaacttaagaaagatcttgatttggtttgtacaccatgtcgtcacgctaagatggttgctacttcacatgctcctattatttctatgatgacggatgcgccgggacagctattacatatggacactgttggtctagctagagtgcaatccgttggaggaaagtagtatgtgttggttattgttgacgatttttctcgatattcttgggttttctttatggcaactaaggatgaggcttttcaacactttcgtagtttgtttcttcgattggatcttgaattatctggttctttgaaaagaattcgaagtgataatggtggtgaatttaaaaatacttcatttgaacaattttacaatgaaagaggttttgaacatgaattttcttctcctcgtgttccgcaacaaaacagtgttgttgaaagaaagaatcgtgttttggttgagatggctggaacgatgttggatgagtatcacactcctagaaaattttgggctaaggcagttaacaccgcatgctatatttcaaatcgggttttcttgagatcaaaacttggaaaaacttcttatgagcttcaatttgaacgtcaacccaaagtttcacatttgcgtgttttttattgcaaatgctttgtcttgaaatttaaataagtttgaggcacgctctaccgatggaatgtttcttggttaccccacacactctcatggctatcgtgtacttattttggagactaacaaaatcgttgagacttgcaaagttttttttgatgaggctagtccaggtactagacccgatattgcaggtacattgtcacaggttcaggggaggatggtcgtatttttgaagacgagagcgacgacgacgacgacggcgaggtcggctcggccggtcagaccaggcgctagtccggtcagaccgccggcacacctccggtcaaactggcgcaggacgtgcggtctgaccgaccagggtcgtcggctgagggttctgttgatactattcgggatggtcctccagagattacaaattcgaccagtgagggtacagaacgtgaaacaacttcagaagtcgctgctactttgcacattcaacgatgacatccgccggaacaaattattggtaatataggtgagcggactactaggtctatggtaacgactcatgatgtttgtgcaaattttgtatttgttgcttcttttgaatccaaagatgtgtcatatgcattaactgatgaatcgtggattaacgtcatgcatgaggaacttgaaaattttgagagaaacaaagtttggactttagttgaaccaccttctgggcataatattattggaaccaagtgagttttcaaaaataaacaaaatgaggatggtttgattgtgagaaataaagctagacttgttgctcaatgttttacctaggtggagggtttggagtttgatgaaacttttggtcctgttgctagaattgaagcaattagacttttgttgacttttgctcaaggttttgaagcaatcagaccggcgcagaccgcggtagttcaagtgaattgtcgtagtgtaaggaagattgattagttttctgaccgaccgacgctgtgtcggtttcggtttccggttgtttgtttggatatccgtgattgtttcatgaatatgacttctagatggatactatatgtatgtaatactgttgtttgctactaatgagacaacttggggatagcttggtctcggaatcatagttattgagaccggaccagtaatcgaactagtgaggctctcggttcaatggttcactggttcaaccagttgaactgtcagtctaaaccagttcaatacatgttaaatatattaatcattctatcctaacacaagcaacctggtagcctggtggtggggggagttaactcccacacatgtggtcgtgggttcgaatcccacccaggcatattttcgctcgtttttcctcccatgcacgcacgcttcgtcccttcctcttcccatcccacgtgcgcttcaccacgagcccggctcggaatatggtttctttgtatgccgggagagtatttgcggtgacggacctactcccatgcatgcacgcttcgtcccttcctcttcccatcccacgtgcgcttcggcgcgag

SEQ ID NO: 45084 - DNA, 5477 bp, Oryza sativa
  unsure (1)..(5477): unsure at all n locations
cgagcgtgaggctcccggtatcgcttttgagagcaattgagttgatagttgagttagggtttcaagttagtcgaaatttttgtaaggagtgctgttggtgtactttgtaaacacaaaaagaatcaataaagtcgtcatccactttaagagttctttggtttgtgttttctcgggtgcggcagtccaaccggcaggacaccaatggtcagaccggcggcatcgcagcagtcagaccggcggcgtaagggcggtcagaccggcggcggcaggcaggcagtaggaggtgattttggcggttcgaccgatcgatctacatcggtcagaccgacgtttacaaggcggtcagaccggcgcatacactttggtcagaccgtgattcgccaaatttgagggtaacttttatttccgctaaaagttttggtttttgggtataccaaccattcacccccctctggttggcttagttattgtgattcgatcctacaaatctttcctccctcaatagccaattggatatgttgcctgaagactttgcaaccattagtagcatgagaactagaattatgccacttaaagcacccgcaatggtaaagtaatgtgctatctataagacatgtacatctcagcaatagactacattggtatctatagctctctaatccattgcctcgtttttctctatagactatctccaggttagtagatagctttgctctctctcttcatttaatctcttccaagtaggaaaatatgctaacatggatctcttgtagagagcctatagataaccattgcgggtgcccttatagtatttcttcttccctaactcctcagccgatggaattatgtgactagcaggaagttggatctgtttctccagaagtagtaaatcaaaaatcttatcaaccttggtgatatcaaagtcatatctttcttcttttccagaattctttacccattgacatggcacaacctttttactcctcacccactcagctgctgctacctcaaagtcatcttcctcttcagaatcatacatatagggatacgcttgattgactttcttgaaattcttcttagcctctgcaaacctctgctcatgtagagtcaccttttgcgccagatgagacaagctctcaaagtcttgagatgagaactctttaatcggagttatcaaaccttggaaagcaagatcggctaactgtagcatctattcctcatatctctgaaccttggatgtaatcttgcacagtttcatcatgcctttgtattgatgtcaaatcagaaagcttcatctcatgggtcccgctgtagaagtaactatgaaactgcttctccaaatgggccccaccgcattctctgctcccacctaccattgccacaaatcacccacatattttagaaaccctctattaatggaatttggtttattctttgttccaccagaaatgtttcacctagtgtactgacaatgtttcaatatgtatagatataatattacagtgaactgaaatattgcattgcaacaaaaaacccacatattttggaaaacccctattataatagggaattcgtttcattttttgttccaccgaaaaatgtttcacctagtgtacttataatgtttcactatatatggatcaaatattgcaatgaactgaaacagtctttcactatttactgaaacattgtttttatataaggtgaaacaacacccgatttaaacgagtgaaacattttcgatctactaagtgaaacaattccgatatacctggtggaacatcatgcaacatttaaaaataatttaataataagctaattttttttcgtcagaatatatccatgtgtggtcttgttttgaagatttaattgcaatgaatttaatggttcaatcagatcatgatttagataagtaatttaagagaaaaatcaatttaaagtagttttgcacgtaaatcgggcgttgacgtcatgctgtcatcagcgcccgatttttctccaaaccgatcaggcgcccgacccgtagactcgagaatgacagggatcggtctactagcggggggagcaaaaatcggacgctccccctgccccctgcaccctgcagcttngncnancncnnctgnncacgcgtgcatgccacctgggccccaccacagtccctggctccctgcccccctgcaataaaatcacccacatattttggaaaccctctattaagggaatttagtttattttttgttcatagtgtactcacaatgtttcgtatagatccaatgttgcagtgaactgaaatattccattgcaacaaaaaaacccacatattttggaaacccctattaagggaattcgtttcatttttttttctaccgaaaaatgtttcacctagtgcaattataatgtttcactatgtatgaatcaaatgttgcagtgaactgaaatattctttcgctatttgctgaaacattgtttttatataaggtgaaacaacacccgatttaaacgagtgaaacattttcgatctacttagtgaaacaattccggtatatctggtggaacatcatgcaacatttaaaaataattcaataataagctaattttttttcgtcggaatatatcactgtgtgatctttttttgaagatttaattgtaacgaatttaatggtgcaatcggatcatgatttggataagtattttaagagaaaaatcagtttaaagtagttttgcacgtaaatcggacactgacgtcatgcccgattttaacctcctcccttcggtcatccaagccggagtcacgtccagttttgataatgtgagaagagatgaaatgggttccatctggatatataaaaccatgtgtacaaggtttccaattgaacttatgtccagcatgttaatacctacgaaacaataaaataaaggaatgcatgctttatgtgctatttcaactatatatgaactataaacataacaatgaacaaaacttgcacactagctataatagggaaataaaaaggataaaggtagcaatgacaagctttcaacactacaaatgccaaaaattaatttgcacggattttgttgccatctccaccgatgttatatgcaattggggaaaaaagcgctcaccaaagtgagtactcacctatgttatgcactatatagtccggagtagtatgtaatacggaacccgacataatcatcatatgcgtactctttatcagaggtggtaaactaaagcagtatttaggaatcccacatctccaacagatgatcaatatctgacgtcgatccgggtgcaccgacagcaccgtaccgacgcctgaagggaggaggccacacgatgacgtggaacaatggagagaagccgcgcataccgccgcggcggcggcggcggcgacggcaaatgaggccgtgccgtcgtcggctaccaccgagcagcaggaggcgcgtccggatgatgagcgggcgccaaaggatcacaccggctgcgaatgcaagcccaaggtggtaatgctcccggagctactacgagccgccagtcatggcgatctccagaggctgcgcgttctcctaggtgtcctacacgacgatgagtcgccggcaccgacgacgacgacgacgacgaccagccaagacgacgacgctgtcgtcctggaggtttatcgctctgcacccctactaccaccaccctctactactgcaggtgaaggtgaagatgaagggacgttgtccctcctggagggaaccacgtttcagggggactccgcgctgcatgtggtggcgagcagcggagacgacggcgacttcttgaagagcgcaaggctgatctatggcaaggccaggcacctcctcgaggcgaccaacaacaatggcgatacgcccctccactgcgctgccagagctgggaatgttaagatggtcacgcatctcctcgagctggctggaggcgatggcgccggcgatcaacggaagaagctgatcctgaggaaaaaaaaccaccagcatgagacggtgttgcacgaggcagtccgcctcggcaacaaagatttgatcgacaagctgatgacggaagatccagagctagctcgtcatccaagcaacggcgccacttcaccgttgtatctggctgtgatcttgccaaatccacaagttgcgatgcagctgcatgggtatgataaaatgctgtcctactcgggacctgacggacaaaatgtcttgcacgctgctgttcttcgacaaagaggtacgtaattcacaaataccttgtgcgtgtactgtttgatcccacaatatataataacaaatgcatatatggttcgattcacagtacttctttcttttttggccttttgatcctggcatatttcttctttctatcaacttcagttttcactctatatatgtttcaagtagtatttcaatttgtctattacgcatgccaccagggttagcaatctccaattacgatttttgcctggggtggctgaaagaaccgaatttttttgtacttttttggccaattttttttgaaacttggatgaatttgaataaaatttgatcaaattcatagaaaatggaaaaaaacaaaaaattcaggcaaggtatgtgcttgccgatgggggcgaaattacagaaattttggaattaattttgttccgaaaaattgcaatcactgcatgccacataatacagtactattcatatatcaagagggaaaaaaaaagttaaaccaacttacaatttggaacggaggttccaaattagagaaaggaaatgacaaagtgatatctctagcatgtaagttttgtgattgaaatatacacttgaattgtacaacaactttcagatctcatttatgtggatataagtaattggaaactggaataatacaatacacatatgtaatttagtcaatatatatagagacatgtttgaagcaagcaagggtcaatataggacaaaatatattatatagtcaatataattttgagtaaatttcaaattgatcaaattgtcacaaaactgtatattttaaatgatctactctctccgtcccaaaatataagtttttttagaccttggcacggtcttcgagatgctactttgaccaacaaatatctacaaaagtaaattattttaaataaaaagagttgcatattataatagttcgtttaacaataaatatagtagcatcaaatttacatgattaatctttttttatccttttgctattagtagttaaaaattaaaatgtttgatttggcactattctaaaaatgcttatattttgcgacagagggagtattacaaagctacttatattacaaaactacaaatttaagatggatcatcgcaaaactatagaattaataataaagttataataaaactacaagtctagtgccatttaaccacaaaactacaaagtatataaactcctatctaacagcagcactgttagggatttaaactctaaa

SEQ ID NO: 45085 - DNA, 1369 bp, Oryza sativa
ctaaaaacacataaaatcgacacctttaagcaattataggtatcggttttaaagaaaaaccggtattatagtataggtgccggtttttatacaaaaccgacacctaaattataagtgccggtttttaaaaactggcaccttaaataaattataggtgtcggttttgtataaaaaaatagcacctatatggagccgagccggccatatccatccgcccgtccttatccatccgccttatccatccatccgaccgagtcgctcacgtctctctctcgctcttgctctctcgcctctctctctcgcctccctctatccctctctctctctctctctcggcggcccggcggtggcccgtcgaggtaggcgtggcggtggctggcaacggcgcgccctcccctccgccggatctagctggaggggaggtggtggaccttggggacggccgggcggtggtccggtggaggcggttgcggcggccgcgccctcccctccgccaaatccggccggagaggaggcagcggacctcggcggaggcggcacagcggctggcggcggacctcggcggaggcggctggcggcggccgtgccctcccctccgctagatctggacggaggggaggtggtggacgtcggggacggtcgggcggcggtccagcgaaggcggtggcgccagcggcgcccgatggatttgttggatgattttatagttcttttagatttttttgtgatttgtggatgattttatttctgaatatgtttcatctgtgatctgtgatatgtgatttgtgattcgtgatttgtgggggtttggggatggagtagtgacgatgattgtgagttccggctcgattcgagtcggctctttttttttttggctcgtgcaaacttataggtgccggttctattttggtataggggtcggttgtttttattggtgccgaccaataggtgccggttggaaaactggcacctatagccggttcccaagcggcacctatgatggtattttactagtgtcaggtgtttggaattttcgaagatatcacttagggtcttttttttttttctgggcatgtggttttgacaagccctatacatatctttgtataattttctcctattatatcaatataggaggcacaacttttgcccactcttaaaaaaagatattaaagaaagttccaaatgcatgcagatgcgaccggaatgcttttgaattggaacagggaccttactggaaaaggtgactcacacggccggacacctctccattttgctgtatcgatagaaccacccacgaagattccatattaccacaagatattgttctccatcatgcgccacatagacatatacactctttgtttgg

SEQ ID NO: 45086 - DNA, 1128 bp, Oryza sativa
ttgaagcttaaaaggacgatcagttgagccgggccgggcaccgtagtcagctggtgggaccaaagccagccgctacagaaaagccatcaagggggtcccgggcttcgacggcacccggagctcaaaactgcaagagtcctcccaggctcatgggccaaccccgcgcttggcccttgagggccatgagaagacgttcgccatgacccggtcgccatcccccgccgcctctatgatcgctgtgcagaactagagggacttggaggggtcggcgccatcgtcgtacttctcggtgaggcagggctggagctttggggggcccttggacattccgaagactcgccacaaagacctagtagccaagcttacctggtggggatgtggagggccttgccccctgcctagggtggcgcgacactcctgaggatgctgcaccttcccccgtagcggcggcgcgacactcaccacgccggcgctcgaaagaacctcaaaaatcacgaacgcgccccctacctggcgcgccagatgtcaaagaatgaactcctccaccagggaaccgtgaggccccctttgtgagttcggccgggggcaacgggtgatattcgagggcttggtgagcggagctgtgtgatcttgagggggttaggcccctccaagacgatgagacaaaagaggtttatacaggttcgggccactgagaagtgcattaccctactcttgtgcatgattgattgaatgtagaacacaagtgcttggggttgcgagacccaagcgccagttcgctcggaagtcccccctccatcactaggcctggacctccttttatacctcaaggggttaccacatgggcccaacaacctaacctagctctggtggagaagtattataatctttgcattaaatgcatgtcttgtctcttgacttgggaagccaagcacacgtcgtcttgatgatggggcctgtcaaatcttaccgcctaacacggggggtgcccctattagtcaccatttaatgggtgaagacttctggggctcctattacaccgggaaacgggagccttactttgaccagagcaggaggaccgactccggctgggataagaggatgagaacctctcaccatcggggcgca

SEQ ID NO: 45087 - DNA, 7187 bp, Oryza sativa
  unsure (1)..(7187): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaacatctgaactttggactcccatttcagcgttctctgcaactgcctgttcaccgcagacacggaagctgctgtgtcttatgacatgtatgacatcctcaattggagggttcaaatggggagatgatgttctttccagtgattgaataggaggggatcctttttctagtgcgaagtttttcgttgaaacaaatggggcaatatctgctactgatgaaagcaattcttgcactgtgaacttatcctcatcattctgtacaatggcattggcagtgctctgtgatatcttactgcagggcacgttgtccttgaaaatactcacctgctcagatatatcagaagatggctccaaggctaagttttcacaaacatcatcattactagccatactcttctggaaattggtggtgtttagctccgagctaggcattgctgttaggtcatgtttttgtatggcagcgtcagggattgagcacttacaagatgaaaccaactgggctgatgaatcttgttttgatggttcagacagctcggtattttcagcataagcaattgtggaactggaacaatcactgctgtcttccttgatagatacagccctcggtggagcagattttgcccgtgcattgccaactttcatttgaacacccccaagaggacttgggggagccattggaaaacctggaggctcaatgatatcattatctggaccatggacaggtcgacaaggactttttgcacgctccttgatgaccttattgtgagctcgttttgtgtcagcatgaagtggactctctgctcccagtggcctacgaggggggatactaaggcgtctagaataacttggtggtgtcctgttcttgacctttccaacagctgcatcaacatcttccattgcctgcttggcagggtctggctgcagcggctcatcctgtttaattttagcttttggagaatgttcgacaataggggactgcaagacagtaaccaaaatattagcaacacaaacaaagtgagtttagcacaagaaaaagagcaatcctcaccaaatgcttcagaggaggagatgcttgtgcccgtttcacaggttcacagatgacctttgctgattctcgtgatgtcacttcactagattttgaactggaggagatgtcactgctatgctttgaatcatcagacaattgttctctattacttggtgaatttagttttacacggctagctctaataggtgaattattttgcctgagcttgctctcttctcttagagttgttaatatcttcttgatgatttttggctgcttaatctcgtttctaggccgctgatcaacatggatggatttagatgaatcttgcctctctaattcaggacccacagtttccttattgcttttaacatcatcagatcttgaacagtttttcactgatacatgatcagtagcttcagcaccttcagtatcaatcgtgttgttggaacttgtagatggccctgatgtgttcctttcacttgactgtatactgtcaatatcgcttccagaaatactactacactgactaccagacatgcttttctgactgctccgtgaactggtaatgggtttctccagtgagtgaatgggatgtgatatatcagcaaatgggcggtattgattaacataaggttgaaggtatgggcttttaagaatctcagatgcctgtttacaaagtgtgtacagatattgtcaaaatctactaaatgcaacaaacaagtattgcagggaggtttctgtgtgcataatagctaaccgtaggccgatgttcaggactcttcctgagcatgcttttgataagtgatttcctgcattcaacagcaaagagaccattttagctaaccttatactagaatcccatctcaatatgacaatggaaaggtgaaataatttgtggagtaaaaagtgttgtgtctgctatctatcatttgacttggaacacagtgagaaagacaatacgtggaagagctagtttgtcaaaaggaaactaacaacggatatgacgatgaagaaaattggattttatgaacaagaaaaatgagaaaaagcaaagactccatgtatgatcaatacagatatagtgaatgtgcacttacatagatggagagtagcatggaggcaaagggccaatggaggagcgatttatcttactaattagtccagccatatcctgaaacaaacatgggagtaaacttaagataactgaactttgacaactttgagtcaaacaccatcaatttggtaaacactacggaagaaaacaaatatatatttttaagaaaacatccatatgtatcggacaaaaattgcctgcaaagactactaatttcatcaaggttttcaaacagtacttctaattgaattattataagtgcatatggatttagttggaagcaaaatattcgaacttaggagagagtagtaaacctcttcaaataaaatttgaaagtccatgagatataagatctacatcattcacataagtccagaaatgaatttcctggatggatcatgaagaactctgatccaatatgctatgaacctgaaaaagaaactcacccttctcttataaaatggcacatggcatgtgtgtgaaaattcacatgcacagagataaagagaggaggaaaaaggataagtggtcctgcaaaagccactatttgctaacataatagtgactgacttcagcccagagttcaccacacctcagaaggaagagtctaattttctttattttaagtgctttttttacttcttaaatgaagcaatataagcagtaaaatacaaatagcaccgttctattagggccgtcattaggaaccatctgcaccattaataagtgcacctgatctccatcaatctatagtgccatgtttgcttgattgcaatttggtttgtcacacgtgttgcatggcacataaaaaataatcaatttactatatactggtgaagtttgtgtaatccggccattctctttaatcctaggatatatgaagtcaacgtttagaactaccgattcttattaaaaatttgataacactatattttgaacgttttccaagagcatgaaagacgttatgtattggagattgtgttgatgtcaaaaatgacaagtcaacaagtaaaaaaaaaagcaggagcacaagataggtggcactaattagaaatgggactgcttttgtattaacattaaaatatccatgggcggataatttacagatatccaaagaatgagtgataagaattaaatcatccttggcatgccaagaaactgtttctaggtaattatagtgatctggggaatatgatctgttaacaacttacaaatgccttgaaggcaggccgatgagcagccatctcgtacatacaacatcctgtaaatatctatatcagttagaaattcacacatttaaacatatccatatgagcaagggaatattaccaagagaccatatgtctgacttgaatccgtaaggaatgtctgcaagcagctctgggcacatgtaatttggtgttcccacaacctaagaagcatcatgccaaaatataagaatttgagaacataaaggtatttagctaacataatgatattccacttgaacatatagggatcaattcgacatatgtttcaatgttccatgcagtgcaggataccaaaaggtaagcaacagaatatagaagcaggattccaaaaggtaagcaacagaatatggatgacataagagatggttaccgaagaggttaaatcatctgcctttaaagtcttagccaggccaaaatcccctgcaaataaaccagagatatttaaatgcacaaaatgaggcaataccacaattatttgaatttagatggtaaactaaccaagacggatgtcctgatcttttgtgagaaatatgtttgagcactgcaaaaaaggacaaggacataaaacattactgcttgctcaataaattaaatgcaagcatcactgatcttttagcataccttgaggtcacgatgcaaaacaaagtttgaatgcagatagtccacagctaatgccaattgagcaaaccatttcagtagtttctgagtgttattcataacagttagtacccttttacacactatttctaaatgaatacggaaaaagggctataaaaaggttgcgatcacctcctctggaaagtatgttccatttgctttcttcatcagttcagccctgttagaaaacactatagtgagacgacagtcaactaaaaatgtagccgagaaactaatcccccaggccccaaccaaataaatcgcactcacatatcaccaccttcacagtatcccgtcacgatgcaaacatagcagccctgtcaaaactcacaaaataagctaaacaaagcagaaaaaaaatataaaaaatgtgtataagtgtgtgttcctcgagagcaaaccttctcaacccatgcttccttgaactcaacaatgtaaggatgttgcaggcgagcaataagggccatctgcatatatttttaaattgttcaatgcagcatgaaccgatgaacgaaaagggcccaaggtttcttgattttcactgacctcttgatgagcagacttgcgacagcgctctgtttgcctcgcgagccgaattttcttcagcacatacctgcaagctagtcagatgtcaactacctccttaaaaggaaaacataatttacagctaaacagaatagagacgcatatcatactttttcttctcggtcttgtggttcacgaggatggcagcaccaaaggcgccacggccaatctgctccataacctcgtattgatccatccgtgaatccatggttcccaatctcttaccaaaacttcagcaatttcacagcagcaaatcaccctcgcagaacttcaatctccagtactccaatgcccaatctccacatctcctacaggcaacagctccacgccggaagcgatttctgcaagagcatcggggaaaaaacataagcgtaaatcgaacagcactacgctttgcatcaaaatttaacaaaccatactcctgttctatccaatagaaccctcacagtgaatttactcaaacgagaacaacaacaacaacaataacagaaatccaacagaaacaccaagcctcacaaaatccatggccgacgttttcgcgtctgtactacgcacaggaaaagagggagaagccacccctcacgagaaaaaaaaaagaagtgattgagaagcttagcaactgtactgcacacagttcccaccaaccgcgcgccactgcccgagacagggaccttaccgcggctctccccaccgacattcgccacgatcggagtgctccggctacgacgccgccgccgccgccgctccacggcgggatccccgccgaaccccgcgacgccccgttcgccggcggtggggcaccgcgatggggcgtccccgcgctcgccgacgaggcctctgctcccccgcacctgagacctctcccgctgcaggctgcagccggtggctcgtcgcctcctttgggcgattcgatttgatttgcctcttcgctggcttctcgtttttgttccggtgtgagttgcttttgggtttttaaaatcgccataagggtgggggaaagagcggcttatatacgccatgggcgccactaatgatgaaggggttaatacttaacagcgatgtgcggagggattagtcgctgtgattaggctgtttgatgtatctgatgattcagcccttgagacgcaaaattaagagttaatcagttagacctaatcgtgcattatttgttcgtagcgactgcgaaatcgctagaacgcgcaatgctttctccacaagatcagccaaatcatcgaagttttgaaacattaacgtgattccatctaatcgtgggttgttaattggcacctgattcctatgtactcgggtgacatccgtcaaaattttgaaggtacagtcagttctgaatttttttggttttgatgtgtcaggagattgcatttgttcatggaattctgaatccattgtaattctatgaacaaagcacacaaaaaaatgacacaaagctctattttggtttattaaattcattgtttttacttttcaatgaaacagtcggttaagtgtaatattggagctgcgacactaaactcttgtttaatactagtaatcagtaatttttcctcttatgcacaccacatgcacagcctaactgatcctaaataagaacatgcgagtaaccgaagcttgctatatacagtatgtattgtgcaattgtcacatcacaatgttccgtgcccgataatatgcctcatcttgcttgctacgttgagccaaccatattatgattgattccttttattaggttcgcgtgtgatcaatgctcttttttctttttctttctttctttttttctttgcctcgtgggaacggctccaactgtgtcatcatagtagaacctttccaagtagggatttgatcatgaccatttgaaattaagttcttttttaagtgaaatgctcagattttgcgatacggttaaaatccattgtatccttaaaatacggccctactattgccaactttgcaaccggtggaactgaagaagcacacaagcctgaacttttttatctatgaaacagtcttaataaacttttgaatactcgtgacacgcttttcaaattactaaatggtacgttacatgcgaaaactttctatatgaaagttaattaatttatttttcaagtttgtaataattaaaacttaattaatcacacattattaccacatcgttttgcatgaaacacttaatctttatctttattttcatcttcaggagatttgaacaccacctaagtgtaacattagttttcaccgtgtttagatcccaattttttcttcaaacttctaactttttttatcacatcaaactttcctatccagggtgtgtttagttcacaccaaaattggaagtttggt

SEQ ID NO: 45088 - DNA, 20205 bp, Oryza sativa
  unsure (1)..(20205): unsure at all n locations
gccaaactactatttttagcgtgaactaaacacagcctttacaacttttactcttacctatagactgtagtctgtagatgaccctgttatgtaaagtgctgagatgaaatttttcggagcaatttaaagctaacctcagctaattaaaccaaaagatggcctaataatggcaaggttggaaatgggtgaagtgatggatcaacgtccctttgctactaaaagaagcattgtgcttgtgatttctatatgctagtgctcgcttgcccactagtttacttagattagtttaagtgatattttgtttagagtggctccaatcagatgcacacatatagccagtggcactagttgtcggcagtgccagctcattgctcaagcaggagaggactgagaatttctgtatgttctgtcatgtcggtcaacacttaacagaactatccatcatgaaacattgcttagccattttctgcaagaacacacccaaaatcatcgaccaagcaatgtagctgccgaaccaagcaacaaatgcagcgtatattaattcaagaacttggcttgccctgacactctgctctgtcagaaactaaaaagaaaaagaacatataattccatgtgcacagcaaagtaaactattattgttcagctgtaatatctcatcagcttttgtctactccctccgtcaaaaaaaaaagacaaaccctaatttccgtgtccaacatttgaccgttcgtcttatttaaaaaaattatgaaaaaaattaaaaaaacaagtcacgcataaaatattaatcatattttatcatctaacaacaatgaaaatgcgaatgataaaaaaatttcatataagacagacagtcaaagttagacacggaactccagggtttgtctatttttgagatggagggagtacatgttaacatgacacagttggtttattcaattggatcagcgggagttatccacaaatctggtttattaaaggttagtgctgctctttttctgtttgtccaacaggttagtgagctaacccttctaagaacaaggtaccctggtattgaatggttgggaagacaaagacctgtctttttaatggcaactgctgagctcggcgctctcctcaacaatgaccactcaccggttccacactgatgacaaggttcagggctagggactcggtaacaagcagaggatcactgaaaacaagccatgaacacactgaaaacaagccatggacatgaacaggtgaatcccatggacactgtacttctggtcaaataatttataaggtttcaaaactgttctagggtggcaattgaattccgaaggatgaattgcgtgagctcaattcaatgaagaagaggagcctgaacttgcaggcttacaggcacagtaacagctgaaacaaacatattagctgcttcactagctcacaaaactctgcagaaactaccgttgaattacgatggcccatcttcagtgcagatatgcatcaaaaggttatgggccatgtctgacaggctgtccctcagattaagttcagatttcagatggacaagcacaagcagtggataaggtgatactcctactgattacagatttatagtactacagatctgcatatttgcatgtggcattttgtcatactagtatatttgagctcctaatgtttgtctttacctaccatgctaaaacacaaaaactttggtatgcactaccgatccagtgcccatttctgatccatacagagtttaatctgattcaggagagaaattggcaataaccaaagtgcctaactccattggtagtactgctaaaaaacaagccatcaactaggtcagtactgctgatcaccattgttaggtgaggcccctagcaatgagtaataaagggaaaccataaataccatgctagaattcagcaaagatgttgaagacacaattatgagtgcagcaaagttttttttaagtccttggagtcatcatatccgtaggtttccggacactggcgtgaacacttgtttactgcaaaccgaaaagttcagacctttaaccccagtggccattgtatgatacgatcctggttataagtactataccatgacatcgaactgatatatgataccacggcaatgatcaggatggacccgagtagctaaaaactatggcgacaacaaagaaaactaaccatatccccgtacggttcgtagtaatgaaagctcttagctctctaatctcttgattaatttactactggttcgaactgactactgcctgtacaaactaaccctatctctgaaggtaggtataccattggcgtcaagactcaagagaaaagcaagatgctagacctttttcctagccccagttttttttttcaaaaggagatgcctaataaatattttgtaagttgccaatttgatatcagaatacttaaccctcatttaagaaactcggtcagagagggatggtgcaaccaccggaggcctagctatacgctgacatagaggcgtgcaccgtgcaccacactattaaaaaattgtaaggtttgggccaacagaatcaattgatgagccagatcgatccatccattgagtggttaaacaggtctcgaaaagaaaagtatgagaattaaggattgtcatgaataatccttgacattagtcctaaccaatcgagaaaaaagggattaaaaaaaatggattaaattctcaacaaaagcgaaaggcgaccggtttgtgcggccgatcgagacctcctggactctttataacatcatcaaagcgacccgggcttagcaatttggtgcatggattagtttatagataagctactcccactcaaaatactcgatacgttcagattttgaagggttttcgcgagcagcgtggccctgcttggagtaaggtatggtctacctaactgttgtgttctgcgctcgtggaatttgtgttttatgtcccaagtcctaacgttatcgtttgtggtacacactatatgcctttcatgaagtagtaccactattgtgatcggtcaccgatagcaaactctctctttctcttttcctgttaggtgaagagaaatccaatctcttcttgttatttgctccaataaagcgtgttatcacttatcaacctctacatctctactctctgtggagtgcaagggacgacgattgatcggttacgatagggaagttaattatggatgtagaggttttgtgaattacatgtacgtacggcggagtagtcagcagagagagtcaaacgtgcactgatgcagctggtgtcccctggtcaagtgattgctgccttgctggcactccggagctgccgggcagtcacagagatctatctatacctattctccgtgtggtcatcaggcctcatgtgccccccagctccgagacgcatggacacgttggtggcaagacaaaacacaccggaggggattcattggcgccaggctgcccaggcgtgggcgccatgtgcgcgcctgcgtgagtccgtggcgtcgccagcgtggacacagcaggaggcgcacggcacgtggccccgtggcccgtggcgcctcccccctggacgcaacgcgcggcgaaggaagcgagcgttccacgttagagacggcgacgacgcctcacgcccgcattggcgccgtgctctcctgctacgaggcgacgactacgtgcggccgcgcgcgcggcactttcagctacggaagcgccaatttcagctcgtgatcgatcggtttcattgccgtcggttgggcagcgggcactgtggcagcaatgcagcagtattcgccggaatcttctaactacgtactaccgatgttgcagcagcgtgcggccatgtgtctgtacgtggggcgtaataacgggggactcgatctggagtaggcggcggatggtgcggccggagaatacctctgcatgggcgagtgctctcgctccgtatcgtgcgatagttcgtccaccacgcgtccacgcgagcggccatgtgggaggagggggcaaccatcatgtgcccatataccggtcgcgtgatcggtcaatgccccgctctcgtactcgaatcgtactcgttgaaagcctccagctctgctagaccttgacatgcttagtaggtacaacgcgacagatgtgaaagacaagtggaccgtgacatgtgttgtcaaaacgacaacctcatatgtcgaaagacgtggttactcaacagtggttggaaagaaacggagtgtataaattttagaatgtttacttcgggatcccccattacatggccataggggactatttatatccccattacatgttcttactactagggttttagattatacagggaaatttacatgattacccttacgaaagggacatttacaggggtgcataatgttatggaggctcatgggcccctgatgggccgtcgggcgatcgccggccctatagcccctaggcttgatgggccggaaaggcttcttcggccctcgcgggggcgaacttgccatggcgaagttgtcttcctttggcagatactcttcgccttgcacccctcgcctggggcgcctctggcctggcaaggtattcgcacgacccttcgcctctcgccgttcttgcttcatagtcttcgccacgggtttcagcagatttggtcgaagggcctcatgccatccgccaacaagccccttgcgggcaagggtgagagtggaacttcggccgagaccgtgcaaaccatgtggtatggtatgcgacgccccctttcgaccgatgttcctgccgaaacctacattgttcctgtaaataaaatttgttatttgtgcggttggtattattttgccgctcttcgcctcctgcattcggtgggatatacacatatattttttcttttcccgggccgaaaggaacaatattgggctttcatctcgtgggcttttttactgtgctactcggtcggtgggaatttaccgtttcgcctacccttgcgacacgtggcgctttattattggtgggtaggcgaacggtcgcccgggtgagctatatattcccacccctctttccttttcaccaccacacttgctgttttaccacgtgcactctcttcctccgttcctttcttccacagcttttcttgacccctcaggtgtttcgcccattctcctccttcgccaccgcatacacgccgttcgccatggcccctcgcaagccaaaccctgcttcggcgaaagggccggatcctggccgggtcaatgatgacagcaccgcatttttgggggtttctctcgtggacgacgtcgagctggcgaagttggtcagctctggggcgttggttgatgggcaggctttcgccccagggaaagccgtggtgccgaagcctgtcaacaatcggacggtagtgttcgccgtcttttttgaggcggggctacggtttccgtgcaacgtgttgttgccggaaatccttcgccttttccaggtggagcttccacagctgagcccgtcggcgctagttcggatttccatcttcgattgggcgtgccggacttccaggtttgagcctagcgccgagctcttcggcgccatatttttcgccaccgtgaactcgaagacggtgattactccggctggaacaaagaagacagtgttcggaagcgtgaactttaatgttcgccccgagcggtccgatctctggctggtgaacgctgccatgtcgaagtgggaccgccattggatggcgaggtggttctatcacaccatccctttagaggctggttccgactcggcgaaagccctccggtgccggcgtagggcgattgcgtcgaaccggaaacccaagatcgccgtgaacggcgctatggaggcgcggttcgttctgctgcgcaaggtttgctcccgccttagctgccgcgacttggtggaggaattctgtatgcttcgcatctttcccctctcccagtcatggcaagttacggttgatcaaggcgaagaggttgacggtttgccgaacttggttctccttgagggaacgaacagtaagactgttcttttgctatacactcatgtgttttgatattttgctttgtctgaccttttaatgtagctataccctttacttttgcagcgttgactctcgaccaggctgaagccgaagcccgcaggatgatcggcgacgtgtcggtcgtcaagtttagccatctgttgacacgacaagcggctgggcgggcgaaccgagtttacaacagcgaattacctccccgggcgaacccccacaaagccgacgacgatgttggaccttcgcgaaagcgaatgcgcggacaagtaaagcttgctcctaggaagcgaagagttcttgcttcgtcagactccgacgccgacgacgaggacgatgccgaagagcatgacggcgaggaggaaggagaggaggaagaggaggtggaggccgtggctgaaaaggccgcgagcgaaacgatcgaagaccgcgtcgacacccctggctacactcctactccaagtccaggtcacaacgagaccagggtggagtcgaacagctcccctcttcgatgaaaggatttggaaggggcgaaggccctagttgtgttctcatcgggcaaggcggcgaagggggtccggtcaaaaagatctctaaaaagaaaggactcgtcgacatcgctcgcgttttcagcgacgacgagtcttctgacgagactccgacttcacccgctggccgcagtctggacctttcgaccgctccccttcttccactcggcgttgctggggcaggcggtagcgcctccgccgaacggatcgtgacggctgcggcgagggtcttcgggagccctttgcatgaaccagctgtttcgccgttggtcaagacgaaggggaagggtgcggccgccgaagcatctgcctcggagtattcgcttgtggcgcccccacttcgcccctggtgatttcgagacccgggcggaccttattccctttgtggagggagtaagcaatcttgtcctacccaccggcaccccgagcctattcaccgaactaaatgaattcgatgaggggtgttctgctattaaaagcttggcggttcgggtatgctttttctcccttcttcgttcgttttttttctcatgtgtctcacaattaacattttgttctcttcgcccgttcctgtcctgcatccagattcttgcggctcactgttcgacagagcgaaccgcgcgggcccgtcttgacggatttaagaaccgtcttcgggccaaggatgacgaaattagctgcaagaacttggaagtggaggccctcgccaacaccctcaaagaggcgaaagctgaagtcaagcgccttcaatccgagttggagaaggggaaagaggccagggctgaggtcgatcgcctcaaggctgaactggagaaggagaaggcccattccgccgtgctgactgattactataacctcactgagccgaagatggaggctcttcgcctgaaggttagcaaggccgaggcgagcgctgcggaggagtcacagcggttttcgcgggagatggcgaaaaccaccgaatccgcgagaacggcttgccaaacgctccgcctcgcccttactgacataggcgcgaaggtgcgaggggtccctgccgaagatgcctcagccttcgacttctccgagtggactcaacaggctggcggttcggtttcggattgcgccaccgcgtacggcgattgctgtgcgcgcgtatcggcggccttcaccttgggccttttgcaacagttcggttgcgagcacgtcgccgagttccctaactatgcgaagggggactgggagattagtgcgcagaatatttcgcccgctcttcgtgcatggcgaaaacagttctggcagaaggacggtcggtccgctgccaaggcgcgccttttggagcaactagcgaaggcagaggcggcagaccggtgcgaaggagaggacgcagcgagcgaagaggttggaggcgatgcccaggatcacccagaggtgtgaggccctccgccctttccttagattttttgtagtttcccttctttttgcgtttgcctagagaggcaaacgatgtatattcggcaggctgccggtaaccctccttattgtagccaaaaaaggctttttgcatatttggaatgtacgacaaacttagccactttttgatggttgaagtctttggcgtattattatttcgctcatttcgcattacgccataccttccctttcattcgcctattcttactatgtaaattgtgttttgccctttctgcactgtctaccagggtgttcgccgaaagtcgtgccttcggcccccttctaggagctagcgaagtcaaaactgttgcggtttcaacgttcggcgagcgatgcttcggccgattcgtttcgccccctggcctttttcgctgatcaggcgtttgccttggggtttttccacaaattatcaatcacacaaaaaataagaaggcgagggacacagaggttttatactggttcgggcctccgtggtggataatagccctacatccagttttttgtctcttttctctctctctctttttttcttgccgaaaggcttacatagtgccgaagggcttacatgacggtatgtacatttttcacaagttggcgatttgggtgccacccattctagacatagaagcacttgagagaggcggcgttccaggaatggtcgaactcttcgccttcgagtgttgccaggcaaaaggatcccgtcctggacttgtttttgatgaggtatggtccttcccactttgattcaagcttgccaaccgctactgggtttgccttcttccttaggacgagatgaccaggcatcagctcgtcggttgaacttatctgttgtaagttgccgaagtgcttgtggcatacttgcgcatgtgctcgagtgcgtcgactctgatcccctccaagagttcgagcgacacttcgcgccctttttcgcccctagagaacatcacccttggtgagttagccccttgctctgctggggtcattacctcatcgccataaagaagtatgaacgggctaaacttggttggtcttgtgggggtcgtccgaagggcccagagaaccgacagcatttcctctggccattttcccttcgctgcccccttgagccttttctttagtgcttctaggatcttgccatttgtacgttcggccgccccatttgactgcgggtgcgcgaccgacgagaacctgatttccaggttaagtccttcgcacatttctctgaacttgtcagagtcaaactgcttgccgttgtcagtgatgaactcttttggcactccaaaacggcaaacaatgtttttccatacaaacttttgtactactgccgaagtgattgctccgaggggttcggcttcaacccatcgagagaagtattccacagccacaattgcgaacttatacccgtttcgcgccaccgggaacgtcccaatgatgtccagttcccacctggcgaagggccatattggcgcaatgggctgcaaatcatactggggcgcggtttggcttcggccatgacgctggcaactttcgcatttcttgatttgctcaacacagactttcaacacaatgggccaataaactccttgtctaaacactttggaggccactgttcttgcggcctggtgcgcgccacatagcccctggtgtatctcctttgccatttcctcgccttcagcaaaagagatgcaacgaagtaagggttgaagtaccccggagcaatagagctggcccgagaccatcttatacttcgtggctctgagttgcaagcgctttgcttcttcttcgtcctccggaagccagccagtttcaaggtgtttcacaaacggggttcgccagtcgcatgggtcttcgtccaatttcacctggtcgatttccatcacctccgagctgtccatgggcacacttggtgcgtgtaggacttcgaaaaagatgccaggcgaatgtgggccaccacaagcaacagatttcgccaaggcgtctgcttcctcgttcagtcctctaggtaagtgttcgaccgttacgccggcgaaacacttttccatggaccgaacggcctccaaatacctcttcatcccttcttcttttgcctcgaaggatttgtcaacatggcctgccaccaacttggagtcggttcggatcagcaagcgccgtactcccagtgctttcgcctttcttaggcccagaagaatggcttcgtattctgctgcgttgttggttgtgtcgaactgcagccttgcagcgtaccgaatcggcataccattcggcgtaatgaggactgccgcaatgcctgcccccttgtgcgaccacgacccgtcggaggacaccacccagaattgttcgacggcctcaggctcgggagcgaataccggtgtccattcagctatgaagtcagctagcacttgagacttgatagcagtgcgtgcaacaaaatgcaaatcgaacggggatagctctgccgcccacttgctgagccggccaatgacttccttgcctcggagtatttcacccaaggggtactgtgatggtactatgactttgtgggcctggaagtagtgcttaagcttgcgcgaagccattaccagggcgtaagcgagcttttccatttcaatgtatcttgtcttcgctccttgcaatgcttcgaagacgaaatagaccggtttctggccgaaatctgtttcttggacgagggcagcattgactgccaccggcgaagctgctaagtatagtagcagttcacttcctggtgctgggcttatcagggccggcgggctttgcaggtattgctttagctcgtcgaacgctgcttggcactctggtgtccaattaaactttcccgcaccccggagggtcttgaagaagggcaaacctctttcggctgcctttgagaggaatcgactgagtgccgcaattcggcccgcgagcttttgtacttcatgtacgctcgacggaggcttcacttgctgaatggcatcgattttctcgggattcgcctcgatgcctctttcggaaacaaggaagcccaacaacttgcctgcgcgaacgccgaaaacgcacttttctggatttagttttatgcccactgcgcgcaaattgtcgaaggtctcctgtaggttggacgcatggtcgaaagtcttgcggctttttacgacgatgtcgtcgacataagcttccacgttccaccccaactgcttgcaaaggactttgtacaccagcctggcgaaggttgctcctgcattcctcaggccgaaaggcatcctgaggtgacaaaatgtgccaaatgtagtgatgaaagatgttttggggatgtcgagcgggttcatgtggatctggtggtagccggaatatgcatccaggaaactcatgaatctgtttccagctgttgaatccacaagctggtcgatccgtggcaaggggaaatcgtctttcgggcatgctttgttcaggtctgtgaaatcgatacacatgcgccatttgccgtttgacttctgcactagcactggatttgccagccactctggatggtcaatctcttgaataaccctcgccctgagcagtttttggacttcggctttcgccgcttcttggcgattggcagacatcttgcgcaacttctgttttcttagcttggtatccggcttgactgctaggtgatgcatgatgagatctgccggaacacctcccacctcgtcggggctccaggcgaagatatcaatgttcttcttgagcacctctaggatgctctcaacttcttctttgcccatgtcgccccctagtgatacgagctttgtggggtcggcatcatcaatctgcacctttgttatcttgccgtgaggggtgtgctttggtgcgtgcttcggccgatcatgcagctcagcctcaacattgtgcactgctctgttgattatggctagatcgccttttgaagcggccgaaggttgaagccccttgaccactattactcctgtcgggccgggcatcttgagcttgagataattgtggtgggaaacggcttcgaacttgttcagggttgcacggccgaatatggcgttgtagttgtacgggatgtcgacgacgtcgaacagtacgtgctcttcgcgtctgttttcccccgagccaaaagctatcagcaaaagtgcttggccgagaacttgtactgcttctccgccgaaaccgcggagcgatgctggtgctggggtaagggcctggatgggcaaccccaacttggcatatgcttcggcgaagataacgtcggccgaactccctccgtcaaccaggattcgttggacttcgaagccagctatctcggctgagatcaccagaggatcttgatgcgggaacataactccttcggcatcttccggcccaaaacaaattagttggttcagatattgcggcgccccttcacccgccgaagtgatgttatggaccattcggatctgcatcttctcctgccgtttggataactgacctggcgggtcagcccttgtaatcacttggattacccttcgctgtgcatcttggtgttgttcggctgggggtgtttgctcctggactacttcacgaggtgcttcgacagttgctccctgttgcggccttggatcttgtgcattgccacgttgcttaatgtttcggcattgctccgtggtgtgcgaagagtgtccatggaaggtgcagtagaggtcttttcggactttcttgcgggctggctgctgatggttactcgcttgctgggcgtcgaactccttgcggagggcttgcacttcttcgacagtcatcacagccttgcccgcacggtcggttctgaacttcctccaggtcatgggggcttggccttgcctcggcggctgtccttggatcgttggctgagactggcgaacggagaggggaggtggttcggcaacttgaacttgtgcttgagcttgagcagcggcgacggaggctttatcgtattcagcttgtatagcttgccgtcgtttggaatcctcctcgccccttgcgaacctgtcaatgatgcgaagtaggtgctcaagcgtctgtggctccttgttggcgatttttcttgtgagttcgccctcgagcagaccagccgaagcagcgtttatgaccgacgcctcagttattcttgaacttggcaccgggcttgcgagaagcgacgcatgtactcccttatcgactctcccggcctttggcgaatgccgagtagatgttgctgcgtcttcggctcctcataggtgcctcgaaagttaaggacaaagacatcgcgcaattgctcccatgagtaaatgctattggctggtaaattgaaataccaagaacgggcgatgccgtctagagcaagatgtattacctttgccttggtattttcgtccccatgagccgcttcgatcgctgactcgtagatggagaggaactccttcgggtcagtttcgcctgaatagcgtgggacgggtgggaatttgatctgaggggggattggacgagtcttgattcccccactcagcggtagccccttttcacctcccgccctgtttaccgcaccttgctgcgggtatggcgtggcgaagggcgaaatcacggcttgtgcgtggggttgggctatagcattcggctgcccagctccgatcggaggtacttgctgagccgccatggatgggtcgaaggttggctgtgaccatgtcatggcggcttggattggtgcttggtttgccccgaagcctggggttggtgcttgctgccgaacggttggcgcctgagcagcgttgacgaagtcgaactgcggtccttgattccacggcgaagctcccaggcctggttgattcgacggcaaccaattaggcgtaccttgacttgcattcccctccgggtgagccaatggagttgtacttgaaatgtagtggggttagttgagttgctgaaggaaagcttggagttgcgcctgcagagccgaagccccttccgccattgtctgtgacgtttggccaggtggttgatgctgtacctgggcagcggctggttgaacttgcagttgcacgtgaggggccggatgcgctgctgcagtcgatggctgcccggcgaagtacattggcgcttgctcgacttgtggcggaaagggctaggtcgtcacttgctgatggacttgaggtgggatataacccgccgaatactgaaggattggggccgacgtgaccttggttcgccttgctacctcgtatgcttgttgttgttcttgcatttggcgaagcatgtcttggagccatgtcatgttctgtcgcatggcttccatgtttgcttcggcttgtgtttcagggtcagggctgacttgggcctgcactgcggcaaggcggttggggccgctgccggctgcgacggtgcggcttggggcaccaacagttggcttgtcggcaggatctccgccctggtctggagtgcccttgccgccgcagtcgccttcgccacatcggccgcgctcggcacttgcacagaggtggctggggccgaaggcggtagtgatggcgcatatgtggaagcagatggtcctcctccatcttcggctgcgggcgccgaaggctctgctccctcctcggcggccatgtctgctccggcgtcgctttccttccgccttgtaaccttctccttcacgaccttcttcagtggcattcgctctcagtggtttcgctcggagttccccacggtcggcgccagctgttgtcgaaacgacaacctcatacgtcgaaagacgtggttactcaacagtggttggaaagaaacggagtgtataaatttcagaatgtttacttcgggatcccccattacatggccctaggggactatttatatccccattacaggttcttactactagggttttaggttatgcatgggaatttacatgattacccttacgaaagagacatttacaggggtacataatgttatggaggctcatgggccgctgatgggccgtcaggcgatcgccggccctatagcccctaggcttgatgggccggaaaggcttcttcggccctcgcgggggcgaacttgccatggcgaagttgtcttccttcggcagatactcttcgccttgcacccctcgcctggggcgcctctagcctggcaaggtattcgcacgaccgctaggtattcgcacgacccttcgtctctcgccgttcttgcttcgtagtctttgccacgggtttcggcagatttggtcgaagggcctcatgttatccacaacaacatggttcgtacaaactactcccacatgttctctctatttgcaagatggacgctgttattcggttctgcgttctgtggtctgtaccacaagcaggagcccataggcgctcaaacgaatggccacatatagcacatctttagggcccatataatgcttttgtgacacagtcttctactcctctctggttcaatacaatcaaacaatcagcccaaaagtgataatggaggttatgatcttgctctactgatgagtacaaaggagaagaaaatttataacctttagccttcaaatgtgcaagttggtactccctccgttttttaatatatgacgccgttgactttttctcacatgtttgaccattcgtcttattcaaaaaatttacgtaattataatttattttgttatgagttgttttatcactcatattactttaagtgtgatttatatcttatacatttgcataaattttttaataaaaggaatggtcaaacatgtgagaaaaagtcaagcgtcatctattaaaaaacggaggttgtacatttgaggttccatacaataaggcagtacaagatttacaatggcgtaactatagctggccatgtacaattcatttctgaacattatttatttatttccccttcccatgtgattgttacacagttccttcttttttcctcagaaaccagaccgagagcttccccagtaccattgattgcttttacaactttgacttggggcggctcactgttgcttcaatggtcccgtgtggttcatcggtcggcaggtacacatcatcagcaaactgttcaagaaaataaaaatcagttttcgagatatgagagttccggagtagcttcaattgcaatcccccagcatgagatttgctaacattgcacaagaacatagtggattataacatcatgtattttctctagattataacgttgcaggttgacaatacggcaacacttaaattcattccaatcatgaaacctagcatcgtagtatgactgtagtagccagaaaaaagtcgagcaactaagatttctatgaaccaatactctaaaataggggaattttatctccaaatccattatataattaagaacaataatgaattaacgactctgtttttgtatgtttcgttttctccaaaaagccgaatcaaatatatctgatctgtattaaaaaagagagagagagagagaaaagaacgataatgaattacggatataaagcatcagttcaagttcgtatttcttaactgatcccttcaatttagctattaaacagaaccaagacctcaagtgtgtttggattagaattgccagtttaaatctagatgtgaattgaaacccaccattagccctgagaagaaagtacccaaaagatcaggaaaacagaacaatacaaatgcagtgctacaattctcaccttcactaatcctggattttctttgttccctaagttaacagggataaagtggaggttcggcatccttagctgaacagatgctatatccgggaaccttaaaaatgcacacatatatttagtgaatgtatataagaaggccagaaggactaaatatgaccaagaaaaagttactgcaagtaacaaccaaaccagagttacagacctgttgagaacttccttagccatcaggtatagtgtattctgcactgatggactatacactccaacatcaggaggaccaaagaacgtatctgcaagaactttctttacgtcctgatacctttgtgtgaagcagaatgactttgatggaatctgggaaacatgctcaaaaggatacctgacaaaaaaaaacaactaataagcacacaaacaattggatgagcaccaagtaacttaatctcccctaaaattgatgcaatagcctatgtaaaaactattcatctacaaggcatactggtaatataaatgatgttgaactgaacagaccagaatagttaactattatagtactgaactcgcttatctcatgccttgaatgaccatagctttaaatgaagataataaaatggtagaatagtggtggatgacagaatttctcaggtatataagaagagtagcagacctccaccaggcagttacttctgttgctacaatcctttctcttgtatcaggaagaagtgtgtagcgatccctcacaaatttttcgaacccggactgagagagacaaggtggtgaaaggttagcatgcactagtacaaattgagcatatatgtatgacaaaaagcagtctggttttgttaaaatttatatttccttcgtttatacttcatcagaagttaactagttaaattattttgcttttctgacacttcagctagcactttacctcacatttttgcatttaattccttcaagcatgcgtagtagcacttgttacaagtttattcctagttcaaaagtacaatacataaactgtctttacaagtgaacccaagcaaccccagtgtgaaaggttagcatccggcaaaaatacctgagttgtctttagcagggagtatccttggattccagaatttatgagcaagtttccagacttcttcacaatgacctctgtgacgtgcttctcaacaccaagtttgaaccctaaaataagataaaatggaacacattaatgaaggaaaatatatattgcaaaatccaacttgagagttgcaagcataacaatgatcatgggaaatttgaccaaagcctagataaaggccaaagccaaagcttaacaatgaacatatttgtattctagatgcttctgaacaaacacatccggtttattacccaatattcttcagtaaaagaaataaagaaaatgtccaccatctgggacttatatgatccttaggactgctcatgctacctaagaacaagatatttttgttaccagtgtttagggatggtgaagtaatgttcaaaaggtgttgccaagggctcatcttcccgtcatttttcatttattcatccgaaacacatttgtaacgtttaggtacaaattaatgtataaatgtaactaaacagttgcttttgtagctgtggtttcacaatatagaaaagagaaaaaattgcctggtgaccctactgttgtaatttattccatttgcacaacgatccaaccaatactgggaggtaggtctggtgattcttagctccgttcggtagtacaagttcccaactcctactcatcgtcttccgcgcgcacgcttttcaaactgctaaacgatgcgttttttgcaaaaagtttctatacgaaagttgcttaaaaaaattatattaatccattttaaaaaaaatagctaaaacttaattaatcacgcactaaaacgctgcttcgtnttgtatgccggggagtgagggttcccaacccttactcccgaacagagcctaagaatagctcgaaacttctatggcaggttttatgaggatttccaagaatatgtaaggatgcatctgtattacacgctcacgttgatctgcgtagaactgctcttgctgcaactatacttgtacggtgctctttcttctagtaatataaagccacttaaaaaagagaaggtttgagggtctagcttttgtgctctgattttagtagtgtgatggaaatttggtactgttgtgatattatactctgttattgttaaataaacctgggaaatttgacaccttgacctcctgacaataaaaaggagttttctaacttgagagcagactaaataatccttatgcttaaccattgaaacacacctcttctttaccttaagctactgaatgatcacgcaaacagaaagcacaagtgataaaactcttctcaccgtgggaatgaggcttcccatcgacaaccacacgctcccatggacgctcggcgatggtcaccgttgcctctgagacctgcccgaataggaaggcacccaaatatatcaataaaactcccaacttgcctcaaatacatacaatcagtcaaatcacacgccatttttatctacctgcgggtacagcgaggtgaaatgccttccaagaatcaccgcgaattcctccatggagacaatctccgtgcattccttggccttcacatacacctgaccgaacaaaacaaccacaccgaatcaatccagattctagaaccagacaaggaagcgcgagggatcgcgggcttacggtgttcttgatggaatcggtggcgacgatggcggagttgtcgtcggaggtgtaggaggggaggcagtcggagacgacgctgacggccacgttccactcgacgatgacgtggcctcccgcggccgcggggcggcgccagacgcgggagacgcggacgcgggacttgccgtgcctgccctggagctcgaggcgatcggccatggccaccgcaggggagggaggggtcagaggctcaaagcaacggatccgatctgtgcgagtgcgctctgcgctgtgcggggcgagctgctgcgttggacttggagatgggatgggccggggcggatgcgtacgggatctccttttgtagagggatggtggggcccactcattttgtagagggatggtggggcccggacacagtgggcggaagacgagagtgacgtgtcccacgctcgcgctgttcgagttggataatgtgatgcggtgagtcggtgacctcggaggaaattgtttagcgcggctccgacttcagctttattttttaaaaaaatacattaccaacgtgggtgtagtttatttaaaaagttttagctttacctaaaataaaaataaactggctaaaacactatcataaaataaactcgaaatagagttgtatttggcacaggttcaaataaaaaaataatataaacatatattcttagctctcgaaatttatgaatttaaatttgtaattacagtgatagtgtttgaatgttgttcctattttat

SEQ ID NO: 45089 - DNA, 1602 bp, Oryza sativa
atagtgtgcaaaatagaagcggcgtcattatgcatttatgcataaattgtggtacttctcttgctttattgtactttatgcacggattttattttgcataatttgcaaaagaaaaccaaaacttttattgctggaaaatacaaccaatacttattatagaaaagtattccacctccggacttccgcgagtcttagaaaataaagaaacaaatccccaactgccattaagtaataaaaacaattgaaagctaaaactaccacataggttttaacaattaagcccatatacgttacgccgtccataacgaaacaaagttcctctcgtaaccaatttcaagggtgtagcaccgttacatataatatcatgtttcttatgtgatagcatcataaatcaataatggatccagctttaacacatgaagacaacctacgtggggattgatattttttgataatttttttttgttatcagatactttatcattttggcaacgctaaatttactaacatggtgtactgacccaaaataaaaccattttttcgtagaactagacactctcctaagccaaccaccaaaaatatttctaccattttgaggagagggatttaaagcaaagaaaacacatagtcatgcaaaggatcctcttacgaagagagagaaactaccacttctatgtaatgaccgtacaaaacaaacttttttatttgatagtgtaaccacgatcaattattgacaagtaatttagatccaacaatcgcttaccttaacgagatattaagcgagttgttactggacgtgaattcaccgttccaaatccgatgaaatcaatgattgtctttcccgcatactgaggaaactgaaagacgcgaggatagttccctcaaaaaaaaaaaaagacgcgaggataaagcagagcggagctggccgtacctaaaaggctaaaaccaccgttcccgttcgcacacagtttgctgcagcacatagtttccgtctctgcttacgatgattatacttccaaatttcaccaatacaaaaacgtgaatctttgaaagattttacacgtgattacgtgagccgcaccagcgtccaacaagtgatgaatcatcatcatatcggatgatcattgactcgtgccgatgcacgtagagttagctgtacaccttataaaaaagtgatttaagccatgcagggtttggttggtgtggagttgcgaactgccttttctccaagttgtagcaatctggagtacttcgttgtggataaagtcgtaatggatagtgttgatagcacaggtccacacagcactatgttccaagcacgtattgggatcaacattgtcgtttcttttggcggagaagaataaatactactggagttgctgtcagtggtgaagccaaaacaaattaaagggggtgcaccactcaaccgtacatgtagtggcacatagaattttcaagccatggtatacaaagcgtatgatggaaatatgattaaaaattcctactcagtattgtaagtattgtaagacacatcgaaccattgaatatgggtgtgtttttctgaggagaggaaagtagaagaaagcgtttgattaattaaat

SEQ ID NO: 45090 - DNA, 16995 bp, Oryza sativa
cacccttattcaatggttcgatgtgtcttacaatactgagtatctcttttgttatggctcccttgattttatatttttaagtaggaatttttaatcacatttccatcatacgctttttataccatggcttgaaaattctaggtaccaccacacgtacagttgagtggtgcacccctggcttcgccactggctgtgcgtttggttgggcaagggcaacatgtagagcaaacatgtcgaaacaacgagatcgtagagtaccagtgtctccggtcaatggattgtttggcaatgaacttgcgtcatgaaaacgaactattctagattttgattcactgtccagactccaaacgtcgattttgacgtgcacgaccttttgacacgagctcatgactaaccgcagacgattttgggtatatgttttggagtggcaccgaaaatttttgtgcttcactcgttccaatataaatgcaatctaatacaaatataacatatcttaacactacatatataaatagacatatattaagattcgtattaataaaatatatcacatatgtattatattatgttgtacttatattacaacaaaagtattcgtatgcattaatttttagtacgggttatttttcaaataagttttctaaaagaattaatttgtcaaaatataaggctacaatactactatctgaatcaataactcaatttgagcaatttaccactaatagcacgtacacgcacatgcagagaagctcggttagtcgattaaatttacctacgctgtagtcagcaaatcagtagggcttcaccgctgcccatccactccctctttctctctctctctcttttgagcgattataatgaatatttagaaagtgggagggtgttttatacccgaggaagaaaacacccttccataggacggccctcgcggaggacgtcaaggaagccgcttgtaaaaaatggcagcccccaccccccctatagatggccaaataggtcgcctgggccagcatgattgggcataggccgaggctagtcgggccaggccatcccgaccaacatgttgggctaggtcgtgcctgcgcacgagttgcactcccgacccaagcacgacccaataagactcgggtcgtgccgggccggaccggccagaaagcacgatggctcatcgtgcttctctattaaataagtctatttttcatctctcatctctttggttgcgtcttatatggctagaataagtctatttcctccctcatctctttggaccgtgtcttatatggctgaaataagtctattttgtacacatctttctttgggttgtacctcaaatgtctaaattaagtctatgatggatccctcaactatttttctttggtcgccgagccatgagggcccaccgtgccgagggagcagcccagacacgaccgggccggcacgggccaaattgtcgtgccttgggccagcccgtcgggcgtcgggccatatggccatctatacccgctttctgggagggtggtaggtggggaccaacggtcatctgccatgtaaagaaaagctttgtagggacggcttttttttttctaaaaaaaaacaccctcccggagagctttgggcgattagttttgtaaatccctcaaacgaaaaattattatggtacataaataatttaaaagataaaaaaattccacgacgctacgagtaggctgaacagaaattcgtcgagaaactgaacttgattttctggcccatataggcaagaataagcaggatcatgggcctcctaaacgagaccgcaatgtccgataagagaacgaattcagcctgcacgagagcgtgccattcaatcgatggcccaaaaatggaataagtttactttgtgaccatcaaaagtgatcgaaatctaattcgtgtccctaaaccacaaaaccggatatctcgacttctgaactcttaaaaccggtgcaatttggcgcctacgtggtagtattgaccgggtctcctttatacgtggcgtttaggtggcatttagataaaaaaaatatatgtgggacccatttgtcatccacacataaaagaaattgtggggccgacatacatgtggagcccacaatcatcctctccccttcttcctcctccctctctctccattctctcgccgcggtcgggttcatccgggggcggcggcggcgggcgggagggcgttggaatcacctcctgctcgtggttcttcgcaaacgcctccgggtcggcgcagagctcggcggtatctcagccgtagtagccggggaactcaccggagagcgggcggaggtacatgacgcggtcggggccgtaccacgggttgccggggaactccatgacggcatggactccacccgcgtaagggttgcccttgagaccggcggtcgcatcagtgtcgtgacgatgaccgtgagcaggagggtgaggcggagatgtggtccttactgctcgcttctcgacatgggtcctccctgtcatccattttttttcgtggtggtggcggcggtggagttgtggtgcttcttgatatgtgcatatgcacgtatgcacgccaatttgtttgcttgttgttgaattgaacagcttgagattgtgatggctctattcgacagggatgcaaagtgacgagtagatattgcgtgtgccgaagatgggtgtgcgcagcgggttggcattgtccgggacacgaggctataccgcccacctccgccgccgctcccgtagacgccgctaccgcttgagctacgcggattcaaccggtgtggcgacgaggtgcagctgcgtgccctgagtacgattccggcgaccgtcgagggagatggggttgtcctgtcgcgtgggggcgctgctagatgccccggccaatggtggtgtgtggctttctgtcgtggcccagctcccttgctgctgtcgcctgttgtcgcccgccgccgtcgccgctccagtgcctgccgccgccactcccacgtctccgtcgctcgcaggccgccgcgccacacccgcgcctcagccgctcgcagcgcgtgggtcgccatcggcgaggaggccgtggagctcagcccgagcgccgccgccgtcgtcgctccagtgcctgccgccaccactcccgcgtctccaccgctcgatcgccgccactccggccctcgccacccgtcgcgggagagagagagagggagtggcgaggagggagaagaaactggagggagggaagagagagaagggacacgtgggtcccacattttcttttatgtgtcaatgacaaatgggtaccacacatattttttagttctaaatgccacctaaacgccacatgtaaaggagaccaggtcaatagcgccacgtcagtaaaaccgccctccaaaaccgtctagggagtcaaattgtaccggttttaagagtttgggggtcaagatatccagttttatggtctagggtcacggattagatttcggaacttattcccccaaaaatcgatcggcagtgctgtcgacctgagtccatggccgaagggccggataccgtggttcacttcatgttaacccagtagtagtttcatcttttagcgaagttattataaacgcaactttattccatcactctgtttaattccaaaacatcaatttgcttctactacagtgacgcctgaagacacaatcacacaagaaaacagcactatccttgtcgctgcatcttgtattctgacaggcacttgagaaaatctcgcacatatcgatcgttcacctcatcatccccaaacaccttggcgagctccttcaccttaaccccgaactcgtcgccttcctctcccaccatgactctcctcagcgcgtccacgatgtcgttggccgcgaacgagccgtcgtcctcgtcgcgagccacctcgacggcaaccttcttctcggcgagctgcctggcgttgaggccctgctcgaacatcagcggcagcagcaccagcctgacgccgttcgcgaggccctcggcgatggagttccagccggcgtgcgtcaggaacccgccgaccgatgcgtgagccaagaacttgacctgtggtacccagcctcggcagacgactccgcggccgttgacgcgctccttgaagcctcccggcaacccgtcgccgtcgccggcgtccggcggcgccctgaatgcccagatgaacggcagctcggatgcctcaagaccgagcgcgattctctgcagctgttcggctgtcagcttcacctcgctgccgaacgccgcgtagacgacggagtttggttcttgcctgtccagccaccgcaatgtctcctcgtggccggcgacgtcttgtggcggcggcggagggaacatccctattgggatcaccggcttctggtagagctcgccgagcagctccagccactccggctcgaactcctggttgctcctgacggcgacgagctggcatccttcgatggactgactgaaccggtagctctccgacacgccggattcgtccgggatcaagctcggtttgaacagctcgcgcgcctcgttgccgcggaacgcgacggtggtggggaaggggacgtactcggggacggcggtgaggtgcgccggctccgtcttggcgtacgggccgcggccctggagcgtctccgcgggaccgaagaagcagagcgccgcggcgccgaacaggctgaggaacgcgcacggcacgccgtgcctcgaggcggcggccggcgcccagtacgcggcgtagtcggcgaggacccagtcgggcctcgacgggcccgtctcctgcagcagccgagacagctcgcgggagaaggcttcgtcgtaggcccggcggaggtagggccggaggtcgttggaggggaggtcgatggtcgcctcggcgtgctccggcaggtgctcgacgcgcggcagcgggatgtccacgacgcggatgcgccccgcgagcgacggcggcacgtcgatgaggcggcgggtgttcctcggcgtggagaagagcgtaacccggtggccctgccgagccacgcgcttggcgaactcggcgaaggggaggatgtggccgaaggccagccatggcagcatcaccacgtgcatgctgccgccgacgccgtcgccgtccatccgaagaccgtggcgattggccagcacacaatacggagtattttccaaccaatttggagggaggagaagaatgggtagctctaccgcattggcttgactatcgatggtcaaatagggcggcaacgggcgtatacaaattgggaaggagcaaagcaaacaatttgtgtggctgcgtcaaggatgatgatatgtcatcacgcttggattggatgtaatgcagtatcactatcatgggtgaaattcagatggcgatatgcagcctgtcgctaataaattataaatatttctcctgcagcatcacgttgatggatactccatctgtgtcatggatgggaaggagtactccatctgcatggatgaactataaaaaaaagcgtatattagggtaggaccaatttcaaataattaaaaaaggtgaggcttcgaatctaatttgtgtaacccaccaccttatagagctagccggaagaccccatagacatttctactgtggacctactcaaaatttgaagccgtggggccataagcataaagtcccactacacatgaatgattatagaattgctaattctagaaattataaagggtaccccttataatttcgtttaatccctcccacaagcataaaggccttagttcgtttaaaccctaagagatgagaaatggaggggattgaggaggaataattccataccacaataggtgtggaataatcccctccaaatccccctcaatctacttgtgggagggattaaacgaccaaggcctaatattcactttccatcaattgatgaatttgaattatcccatcttatagcttgtgggtatagtttgtgaaaatatgagaaggacaaaacgaaatgatctaatagtatattttagtatatttcatgtcagtgtatgctgaatttgattatgtatggactttataataattggttgtagctcgttgagcaaatgccggaatattattccattatcaaaaaggacattttatacataatcaactaattatgttataaacttgaaattttttacttctgtttttatctcttataatattcgttgcaatgccttttagctagtactccatccgttctaaaatattacaacttttagcatttagattgtcttaaaatataacagcttctccaccaacatttccttctcaatcaatcacgacccatcaccattcaatttccccaccttctccacttctcaaccaattacaatctttcaccattttatttttcctacttttctaataatcgtgtccaactctaatactccttatatcctgggacaaatctctactattataaaaattgaagatgtttttgccggtacttttggtacggcatccgtgcttgattcggtttttgagttcaatctcttttggaaatacagatccgtgtttgagtcggtttttaattttgttcatttttagaaatatagaatgagtcatataagagatatctttaaaaaacttgcatgctaacttgagacgatcggacccctaattgtggctcatgattttgtaaaaagaatatccaagcgaattcccaaagtgaatttcacctaagctaaaccgtacaacaataataaaattaaaatagccttcacccgttgcaacgcacgggcatttttctagtatggtactacataaaagaaactatagtgatggtggtgggtccaccacagatgacagattagataatcagagcatgtagatcggtcgaacgttcggaccttgaaaaacccccaaaatacgtttcaaatttaaggttgaaaatccaatttttgactgataagtatagacatgggcgaaaagatgaggccgtaagtacatatactaggcgaggccggtggggggggttggatatggatatgacacaagttatatctagcctagtccaaatcgataatatgatgggctttatttaggaataagttcaccagacgttcctcagctatacgtcgagtctgttaaaggtctcctgaccacaataccagaaatgtgtaccctaaactatgtaaaaccatccaaaacaagatcccaaggcagtataggtacccggttttgctaacgtggcatcctaatcagcaaaaataaaaaaatgtggaacccacatgtaagtgagaaggaaaaatgtagggcccacatgccagcatcatcttcttcctttctcttttcttctcttctcttttgacgccgacaacagatggggagaggtggccgccgacgactccgcgccactcggcctcgttgacggcgacgacgaccaaccggcgcgctgctcggcctcttgctccgaacaacccaacccacaacccagcaatggatgagagggagatggccgcgaggagagcgccaagcctagctcgtcgtggcgtgggtggcgtgtggtgttgcgggcgatggggttcgaggacgacgactacgtagatgatgcggtcggtgaagttgtgaacaatggcgatggactcgcgcgccgccgctcggacccaggttgagcgccttcttcaccctcgagaacccagggatggcgtacgagaaccgccccgtgaacgtgtcggcgaacctaccgctggtggtggagccatcgttgacctccgcgcgagcgttgttgtcatcgccgtctccacgccctcaggaccaacggcaactgaggggataggcaccgccgacgcccccgccctcgggagcagcggaggcggaggcggagacgaaggcggcggccggcgggtgagagcggcgactgcctctttccccctcactcatcggctcatttgccccctcttcggccgtcctcctctctcccccctctggccggcctcatcttccccctccccgaccggcaccagctgccgccgccgccgcctctcacccctttgctaccgacgggtgaagaagagaagggaagctaaaaaaaaagagaggaaaagatggaggagaaaaaaagagagatgttgactaggatgtgggccccacatactttttttaaattttttttgctgactaggatgccacgtcagtgaaattgggcatctatactacattgggaccttttgtggacggttttacgtagtttagggatacacatttttagtattgtggttaggggaccttaaacagactcgcgtacaatgagggacgttaggtgaacttattccttatacatatgacgtattgggccctagtccaacgtaacgaaatggatagggtctatcttgacttggaccaggcctacaacacaagtccatgtccttcgatgactgcggaaaatttatttgggccattaggaaatcaggattaggctcagagagaaagacaatagaattaggagtagattaactcaggcacatggctcgtcccaaggagacattgattgtaatagaagttccaattatcctgtcacgtcagtaaactactcaaacttctaacatcctagtccaaacaatcagccgtgctcatctgcagtaatccaagccagacattgatccatacccctatgccactgcctaagtcgaccagaccatcggtaacagcgagcccggagttgattaaggcgcaaacagccgagttcgcagttgagattagcatcagcagcgagttaaaaaggactacggtactgcaccctcctcaaaagagacggaggctaccgccaaatagaattgttagctgcaacacctaatctgcagcctagcgtaattaattaaataagctaatccacagatcttaacaccccaacattccctggcacgcagcgcacggtcagcagcagatggctggtaggaaatggcccatcttgtagccactaaacccaaaagaatatgcccgagataatacaatcaagtgctaaaagccacctttcaggagcctcaatggcatactagctgcgtggatacgtgtgaaaccagagtgtcatctgttcccatatctttccaacttgttggaaataataattcattagagcaaatcttttactataatagctaattcatataatagttacctataaatatatactaccacacataattaatatctggtctcacctctcatacacacatgtatattggagcccgtgttatagctggctataaatttgtagtccgctgctcttatttcttctttcttatcttcttaaaatatgtttatagctggtttacagtacatgctctaataacggcattctgatatttgatagtgacattaatcaatctttactccatagtgctggagtaccaaagttgtttgagatgatatttcgaagcacttcggtttggtgccaaacttttgatatttgaagtattaattttcaataccgcaggtaaaacatttcaatattctaccaattcttttgtagtgctaaaatctccctaggcttttgattatttactggtgtataaatttgttttaagaatattcagaactaacgagcagtagataattttttaataccgagagtgccccaggtggagagaatgatggcggtgggccgtcatctcctaggaagcagtgccaaacccttccttcctcctctcgtcccacctcctcgtcttgctccacagtacactcgcacacccaccacacgccgtctctctcaaaacaaaatagaagcccaatacagccagtacaccaatccccccactcccggtcccctcggattccgcccatgccgccttcccgccgagagccctagccaagcccgctcgctgcttgctaacccccctccgcgcgcgctcacccgagtcctagggttccagcgagcggcgaggaggtagctcgttcgcgcgcgcgtcaaatcccatggcgggcgccgccccgctgcgcgactccctccgccgcctctgcaccgacgtcggctggtcctacgccgtcttctggagggccacccgcgccgccgactcccagcggttgtgagcgctctcactctgatccccttcccctccctgaattttctcccacacacctcagttcaactcgacttgctagttgctaccaccagtactggtagtgtactccgtagttgctgccgccgtggtggaattggctgcagaagaactgcgcccctttttttttttgcttcctaggactgcaataaatgccattgattgccacctttgccgcaaacaactggacaattggtccttccgatggcgggttcattgattttggctggagctgagttcgaattgcactttcgtttttggcttttgtgtggcaggaaattggtgtggggggatgggcactatgagcgggcggccggagcgccgtcgatctccggcttcgaggccatggacctgctgctcaaggagaaggccgcggcgttgcggagcggcaccgggcgcggtggtggcggcggcgaggggcacgcggctgatggcgccgcgggacacagccatgacagggtggacgcgctcgtgcacaaggccatggcgcaacaggtccacgtcgtgggagaagggtaatttggttttcgttactagtagtgttttgttttggatttgtgctctggttctatgggggtagtggtgtgatttggttctgctattgctgttgctggccagggtgattggtcaggctgcactgacagggttgcatcggtggatcgttcacgatattgttgatgagtgtgaggaagaagatgaggtaattgccttcgatattgccctagttggtggtgtagctcaaatttaaaatatacatgccttaagtacatttaggactaggagttacaatgtggattgattcataaattagttgctctgaacatatgatgtactgttcatcataccattccaaattagagctgctgtttcagaggacaaatcccctttaatttgttttctaggtcactctgcttgctttgctaactctatttgttgtatattttttttgtttttctgtagcgaatgagcttgaatttcgttgttacaactctttagttccatcttgatgcaggtattgctagagatgaagggccagttttgtgcaggaatacaggtctttatgctatttctttcatgttccattaccatcagcttccccatccctcgtgttcatctaaagatgcttgcttcttaacagacaattgcagtgatacctgtccttccacgaggcgttattcagcttggctccacaaaaatggtaagttacttactcattatggcctcgtgaaggtgctgagattacctactccctccgtcccaaaaaaactcaacttctacagtttgaattttgtcccataaaaaaccactttctaccatcctacctaccctcagcacgtaaaacgagaaattttattccttcaatactctttacctacctatcactcttactattttttcaatgattaaaggtatttttgtcattctccatctccactaatttcacctcgggatgctaggaatgtattttttgtgggacggagggagtatatcctagtcctttgcagaacagtaaccctttatttctgctttgctcacactttcctgtactaatgaaaagaaaaaactttactctatcacgaggttcaaaatatatggttttctttatatatatttgtctgcccccaacccccccttttttttcatttccacttctgtttcctacttgtagtgaacttgaaccgttctgctgacaattttgaacagtgtgcctccacaaattttgaaataaagattaggttaggggtcttattctatatcctatataatccgtcctggatcctgatgagctagcagaaacaacaaaaaatgttccttctgttttttgttttatttgttcaattcaaaattcagtggtttctattttgtttcaaaggttatggaggaagcagcatttatagatcatgtcagatctttgtttcagcagctgggtagttcaactgcagttgttccgtgtggttcctttgtacaagattcgattatgagaactccatttcacaaatcacttggtgtgcctacctcttcgcactcggaagaccttgctggtggtggaaatacttataatgatgacatgattaaccaccagttcaggcatcagaagtcaccagcctcgacaattcagtcatttaaccctgtacaacagttctatgctgggcctactttctgtcgtccagtaactattgcatcacgttgtgatctcttccaacctgaccatggatcaacctttactttgaacagtcagtcagaggacaatagatcgacagctttactcaaaaatagtgtttcacattctaaaacatcaaatgatgccttttcacacgcttttaaccccctcaatgaacccaacgtctccatttcaggcagaagagagtgtgtaagcatagaacaacatggttcttgccgtaatggagaaatggaaataacaataggccgcactgcttcttcaagttgtacaggcaaaacaaatattatcaataaagtggatgatttgctgagtcaggattgtttggtaggttgtcaggcaagcaatgccacatctgtgaacagaaagtttcagacaatgtccattgttgataatacaaagcttcaagatggttcttatgcaattccacatgctgcacttgttgactctacccaatattcagactgctttcaatcgcttcttggcacaatccaaggtagttcttccagcaattcaaatgcaattcatgtggatacttctcataatgctgtccatggaaagagtaacttttgccctttaggagataggaatgctgctaattcaagtgacttggctgaacttctggcatcgccaataccattagagttgactgggggaaacgatttgtttgatgtactgcaacttcagcagaagccaaatggttcaaataatagtgaagtaaacaatcgtcaatcaatgccttatggttcagagcaagctgttaagtctctgattggatgtgtggatgatgatttcactggattgatcacagaagctgatccagaccagctcctggatgcaatagtttcaaagataatcacagggcacaagcagaacgtggataccagtgcttcttgtagtactacagtggcaggctttgacagaccacttcattctgattgccacctatataccacaggaccatcatcagggccaatattttgtaattttgccagtgttgctcctgtagcaattaaaactgaagggcctgctgcaggttccaggcaatcatcttctagtatagataaatctgcaggatgctctcagacacaggaaagttacaaatcacagataaggctttgggttgagaataaccatagtgtaggatcagatagtctttcaactggacaagcatctgacagtctttcaactggacagtgtaaaaggagtgatgaaataggtaaatcaaaccgaaagagatctagaccaggggagagtgcaagaccgaggcctaaagatcggcaaatgattcaagaccgtataaaggagcttcgtgaaatagtacctaacagtgcaaaggtaacagcaccaacacatagatacccctatattgacctttaaaataaaacacattatttatcatatttttggtacttagatttctgtttgattaaacagtgtagcattgatacattactggagaagaccattaagcatatgcttttcttgcaaaatgttgcaaagcatgctgataagttgaagggatctggggagccaaaggtatgttgcatgatagtacttatttttagttatgtatcagtatcttgtatgaacaaggaacagccattaatgagagtgaacatctagcacaacagataatgtggtacttttccttgttatttagtactccatccatttcttattataagttgttttgacttttttctagtcaaacttttataagcttgatcaaatttatagaaaaatataataatatttccaatataaaataaacatactatcaaaatatttacaatgttatatttaatgaaactacttagatatgataagtgttgctaaatttttctataaacttggttaaacctaaagaagtttgactagaaaaaaaaagtcaaaacgacttataatatgaaacggagggagtagtgaattagctgagcccaaaacagacaatctctacattcttgatattcttcgtcgttccattttcgtcattagcttgctgctactgataattgatacaggtaaatgacaggcattacatgatcaacattcaaatttcctatggtccttttggagatctcctggagttaagagtttcagaaatcagcattgtcttgtttcagcaagtctttttggaacctgctgttcataatgaaatgtgattgaagttgttttaaagccaaagttgtcaataaatgactaatttatctgccaatagcccaataggtcaaaattttcgaaattgactgttttgtatttttcgatggtgacagacctttactatcataaatttgtgaagaatgctattaacataattttctttcttcaatgggtacttttcaagtaatcccattagatttctaacttgattagccccgatagatagaaaagaaaggtagatttcattgctatatttcattttgtcagagtgttttttatgaatacattagtaatctaactattaatttactcaagctaccctaatccgtgtgagattttcttgtttcatggaagcagattgttagtcatgaagaaggtttgctcttgaaagataactttgaaggtggtgcaacctgggcctttgaagttggtacgcgatctatgacatgtccaatcatagtagaggatctcaatccaccccgtcaaatgcttgtggaggtatttgctacttctctgttttcttagttcttgtaaatgctactgcacggtaattctgagtgatgattcgaacatgttgtaattgttcagatgctttgtaaagagagaggaatcttcttggaaatagctgatcaaattagaggtttagggttgactatcttgaaaggtgtgatggaagttcgtaaagataagatttgggctcgctttgctgttgaggtattaaatctttcctcgtctctcttcaacttagtaccagttcttatgactatcaatttttctgccaaaacaccaagcaaaatcacattctagcgtgatttgattatgaagctacaagtggtgtggactgagtagtatatcaaagtttaattaaaatattgaaatttctgcaggcaaacaaggatgtaactcggatggaaatatttctttctcttgtccatcttctggaacctagcactgggagctctattttgtcagcaggtgttgagaacactagcctgccgcgcgatagtttctttccatcgtctattccagcctctggtttctccaactgcttgtgacacgatgtaccatacctcagcaagtggagcgctgtgagtgggtaaagtttcacctgccgtgaccttttctccctgccttgttctagctgccacagatagttacgctgactccagtatcttgttgcctgtctccacggctgacgttgtggcaaattactgttcagtaagggagagatgtgtgttttgtcctaaccttaaactacatcgcagccagcctttgtgagggaagaagctttagcgtaggaaattgttgttttaggcaggctccacaagtgtaagaaatgcagtacataaatgattagagatttagagttaggatagcatcaggtttttctgctatgtaatatctgcattcatgtgcccatttggctctctggatctgctaacctggttgtgtatttgcagttcggtctttttcctctgttcagcaagtaccacttgaatgagtgcctcaccattttttactgaatactgaggtgtgtaatttggaaccgcagattaacagaatacacagattgtgattactctaagtagtacgagtaccaaggagtagataatggacttgcctaatacgtatccgtatctcattacactcattacgcatatccacaatatttcaggttaggatcccattaaggcaaagttcctccatggaggttactattgtctttgttgtattcctcgtttttttttctagccctgggatgtagctagagtgattctaatcccaaattgaatacgtgtagcatgcaagatcgaggaaaacacagcaaaatagtctcttgaaccaaagaaatgggattatcctcaaaagaataaatgagcaacctaaaaacagctcagttgagatacacatatcttttctctaggcacaatcatgttctctcctcttgatccaagtaaatttggaaaaagaaaaaaatggcagcaaaaagaaagaaaggagaaaaaaaaagaagaagaatgaacaatggagtggtggtcgtcatgatgggtaaagcgccaagaagctgggagacaagcatggcgaggccctccagaccctggagtgcagcttgagcacctcgtgcgccttctccttggtcttcaccccgcactgctccgaccgcagcgccaggcacagcttccccaccacgccgcactgcgccatctcctgcagcaccgccggcgtcgccgcgtgccgcgccaccgaccgcagcacgcgcaccgcccgctcgctcgccgcctccgacacccgcagcaccttcttccccaccacggccacgcccgccgcgtgcgccaccagctccgcgcgcccctccgcgcacgtgcacagccggtccagcacggccagcgccagctcgcacacgcgccgctcgggctcgtccagcagcagctccaccagcgccgccaccgcgccggcgcccacgatcttcacgcggtgccggccgtacgggcagagcgcggcgagcgcgtggagggacgccttggtggcccgcgccgagacgcggtcgcggaccacgccgaccacctcggcgaggagct

SEQ ID NO: 45091 - DNA, 5160 bp, Oryza sativa
gacgcaacctcgtcgctcgaaaccggtcgtagcgcggccacctcctcgtccacggccgacccgggggagacggaggccgcccacgactggatcaggcggcgcagggtgtggttgggcgtgagctccagcccgtgctcgagcggctgccgcgtgacgggacacgtccggcgggcccccggcgcggcgagccaccgcgcgatcgcggcgcggtcgtacgagatccccgtagggagcgtgacggggtcgcgcatgagctgcagcgagatcgggcagacgaagtaggacggcacctcggccgccgcgctcgccatcgctgccatatccgtcaccagtagtaggagtgcaccagccgatcgccacgccacgcacttgttcaccggaatgcgcgcgagggccaagaatatataccgcgagatggcggtggcgcgcggtggtgcgcgttcgcgagtcgtagctgttcttgcggctgcgggtagggagaagaagaggaggaagaagaggaagacgcgcgcgtcgcggaggttgcgcggctgtgcgttggtttggtcgcggttttaatttaaggcgcgggggattcgtctagtggcgttcacatgcgtcgcgtcgcaccacatcacatgctacgccgcgctttgtttactcgtcgctcgcggttggggtcagagggtgctgtatttgcgttttagtcccttgggtttctttaatttggggggactagctccctttcctccttcacaaggagaggcttttgagtttcggtttgactttaatttggtgaggtcatgagcgttccgtggctaaggtttcctctgacttttgatggtttggaaaaagtataaagatgacactgggaaattgggagctcaatgtgaacgtcttgtgcataaaatcaaaggttagtctgtagtaagatcaaaggttattattttgtatgattatattcgaaagaaaactgtacaatgcttaagtttcttttgtggcgttgattattcgggacacgtttatcttaaaattctactccaaattttgaagatttagtacaactattctaacttcatggcaccgcaaataagaggtttaagattgaagaattttgatccacatgacgagttgccatgctatgatagaaggcaataaggtatcaattaattgtaaattattgccagataagtaagaatgatgtgacactaacttactttgatcacccaggtaatggattgcccattttgcatataagtgataaatggacttctttatttgaaaatgacgcgcgtcgactatagaaactcatcaccgtcccttcagttacaaaatgctccttttcctcatataagacgaatagtccttgctttgaaacagtatcagtacacacacaattgctatcaatcctcaatcagtaactactaaccaatattatttctcattttgacctttgctccagtttcctcggagaacaccaggaggagtcttcccataattcactcaatcccaggtctccttttgcaaaagtaacctattccagtcagttgatggattggaacagtgggaaaaggctccactggttgacctggaaaatttccgagattaattaacaaaaccgagccggtcagaagcctagcgattagcgctggctctgcactgttaacacttttgtttattcagatctctgaccttgccggtgccctgcatgttccgtttctcttgagatgtgcgcgcccctgttcgtattaggtgccctaattgagggcttgagtgcttgaccaactaattcctcaattcttttttagtgctcacctgatctaaacagatgatcagctcttatctgtcattttgagtttttttttctaatatgatcagctcttatctgtcatcttgagggtttttttttaatcattgatcttcagaatctttctctggattcatctttcaggtgatgtacatgatctttcttgttgatgtgacaccaaagattttctgaggggaaaagtgatcttttctgtattaacagatccgtgattcagtgaattggttgctctctaccagttgtatccttgtagcaactagagagaaaatgagaaagcgatgtccactaggttaatttgtaggccaacttatggaatcacagtactccaagtcaccaaagctaccaaattagcgttcgaaaacggctacatatatagtagtgattgattagtaactcttagctccaattggaacttgagaactggacccaattacctaattggaccactagctagggttattttctgtttccaatggagtaattagtgagtgaaggagtaacaaaattgccaactaacctaattgttaggttcaaccaggagtttggtccaccgttttgccaaatctaggggtagatatattattttggatttttcagaaaagaaaagcctcgtctgatgtatatctgtcacttgcaattaattaaggctattgtcagaacacatgagagacctttcctcctaaccttgcatgttgttctccatcatggcatcatgtcactggtacgtttacgttggattctagatccatctggtacatttacacaatgtcaacgataacattattcagaggaattgatcatccacatcgatcgataaaagaagtgtttgacttttgctaaccaagattctaattccatcaattttctactgctaattaactggagtaagcttttgtacatgtgtggctgatactgttataatcgatgaggcaccaccggtagtgtgtacaagatcagaattcggcgctacctttgttctgcctaacccagcggtaaaaagttaaaaaaccgaactgacctgctataactgaacattgattcggttcggtaatggttggctaattcaggttgattcaagtgcttggcacgagtttttgtctgaaatagcaaatggctccatgcggtggatggtgcaaatgtgtttttgtctgacgccgacgtcgtttactttttgccatttccactttcttaactaattacctttcattaattcaggatgtatgtatgcatgcttagcagtaatctgactggtactactaccagtctatcgattagcttagcagctagctaggtggtgagatcaacgctcgcggcattgacctttcaccatcaatggcgtcacaccgtttgtttcattgtttgagcatgtgaaaaactcagtactcgtgttggttttcagctaattagctagcctggaaaagagctgaccggtctccttgctctctttaaagtgcgtcgctgtcgcaatggatggcccaaggctggtacacgtcggtgcctcctcgacgcgccgccgctgaaccagccgtgtactttttggtgcatcatctgtgctgtttttggttttctcacgattgattcgcaatcttagatagaagtagcacactgcaaattgcagtacggctctacgtacggggccactccatcaaatgatgtactactcccttgcaaatgtcaaacatacagttaatgatttctctagctgtttttgaaatactagacgtcttcacaaccactctcttgaaaaatacgcctgacgaataggattttttttctactactataaaaacacatcgtcgttctcctctgcaccccttcccatcttgtgcagcgcacattccagaaaaaaatgctagagaaaaacaaaaggaaatgtgcttattgcgcgctccataacaaaaaagataaaaaatagcaaaagaaaacaggggaaagaagagaggaaatgtggttggataaaaagaaatttccactttatgctagatccacatcttaggccctagcccatttttagtggtatggcccattgcaatacatggttatattaccagtttaatagaaaagcaaccatttgttcatctgttttgtagcagtaaatcataatctcaaaaatctcgaactagctatatatttttttcaataatcagatgtaaatatagtagtcatagtataattatattgtaatttgcatttagctgcagtacaatttgtatgcaacttaaaaaaattccacgctaacacactattttcgtgaagcggaggtcgcgagactgaatctcctcgtccgcacgtgcactatgattttttttctttccaacttaaacaaatcttggagtaataaacctaatggtttaaaattaagtgaaagctacatacatgttacgttgtgattacatgcaaatgacgcaagttacaatacaattgcaccataactattatgtacttacatttgataaatcgtgagaatgctgatgacaaaagcccaaaaaactttacgtaaatggcggcctgaatcgtagtgagccttaatggaccagctttaccacagggacaacgtgttaaccagcccaattacaaatatggttcagtttaaatttggcccatctgtagatgaggccgcaaattgggcctccagaaagtgagtaggactggcaatcaacctcttctagtcaaagacacccttgaaagctactccacgcaagcatccatagcaaggaaacgcttttcatggacagaatcgcgcagcgtaaacacaattcccagcaattctgtcaagtgtgtccggccagtggccaacgggatagttcttcgtcttcacgttgtacctagcctccatgccactgtccctgaaggcctgaacaatttgatgagtgtaatcatgacactgtccactgtacgtatttacattccagaagtgaaattaaacaaaaggattatcccagtaatacttcagttgcaactgcaaagacctgaagattaaaggaaggtgaaagaaactgtgtcttgattttgatctggagcatgcgtgaatgtgcgtagtcaactcttcaagtaagagtagttttctatgatggttattttttttggaagatttactaatgcaaatgatgctgcttagatggcgtcattagctaggctgctgcaaggataaggcaccgtatacgtgtggagaagccagcaaaatgcatggatcgatggcatcggaaagaatgcatcaatcccgtagttactgttgccgaggtatattagcatactatattcagtctaagagttgaaatcaaccgagttgactgcaacatatataccaattctactgcctagtgctgatcagtgatcacctcctctcttcatcttct

SEQ ID NO: 45092 - DNA, 4667 bp, Oryza sativa
ctgcaccccatgcatatatatacatgcgattttgtgaatgtgaaattgtaaatgtgatctagtcccatgtgttctatcccattatcatcgcgaaaccacaagccctgcacgcactgacggaggatatggccatttgtttacgtcgttcgagtacaatttgatactacaggtaagctagggctaggaggggagatcgatcggttgggagctccctccttggatcatgggccagcttcttcttcttctcctctctctcggatccagacccggccatgtgcatccggccctaggcaccctgaattctgtagagaggggagctcccaaggttgatcattactgctgctgatgcacaagtcagacgagcagtggattccaagcatgaggctgcgactgcgagaggttaactgagggcggccatgcatgtagtcgagctctctcccctacgcaatccatccatggcgccgagccgatgcatccatccgtcgtgcgtgtgaggcgttgaccctgtaaaatattgcgcgcacgggtagcgcagtgagcagtatccggtacttctgcattccatgcaccctcgaatcctcgattttgccttggtcaatgcaattctggtacagtatacctgtactttttatacatctagtagtagtgttgttgataactgcatgtacttgcatgcatgcatttcattgctacttttgacagttgaaactaaccacatttggatcatgcaagtgcatatattttgttaagtttaaccacttgtgtcagggacccaaggacgtacagttcattctgaagatcaccacacaactcactttacagcaacagttcaatggtacagcagtgatgcactatgcatccatatgaattaatcacagggattactttttttttatcattttgcagaattggccttaatcacgtactgaatgtgcagctggatggtctttataggacataagaattggcagcttgatttagctagtcttttattaatttaacccagctcattagccttttagtttaattgaacaccgtgatgatgcagataacattctactggctgtaaaatctagaaagatactgagtgactacaagtggatccagacgagcaatctctatctttcaacaagatatatgagcagtcatgccgagaccaatgaggcaatggcagctactactctcctgtgagtttaattgggctgcttttgtttgactaacaatctcgaccgagcacaagggagacaagggacacatgcactgtggaatgcttgccatgcaaggtattagttgcttcccttgttaagccacatacaaaagaactgtacatgcaaactattcattcacagtgaagatgccgccaaaataagctactagatctatagaatttggattttttttttcatcgatcgatagccatttcttctactgactattgcgctgttaaattgtcatatcaagctagtctcgtaatttcaaatagttcttgctatctttcttctacttttcatgttctgctagctagatcattgagaacacatatgcatatatcgaaatacatgcataagcaacttcagctacagtaaaacggggggaaaaaaaaaggacttctgccgcaatgctagcttcagcagaagattttctgaagttgaacctgcacataaaacttgtgattataacatcactactccatataatcaaatatttttcaaactttattgtattggctctatctcacaagtataccaattacccttaattactcccttcacatgagtgatctagcacctagctcaccctctccctcttcaaaacaagcatagctctatatgtagttcttccaaacagaaacaaaagaaaaaagttacaaaccaatcgcaagaatagcatgagatcgattagctagaagaaaaaattttaatcgtatatatatttatggcatgtaaagagcctccaatccttggcaatccacgctccaatcatgatcaggagcgccgatcatgcactcatggaggctcatggcgtcgtcgggaaacgaatccaacgagtcgtacttgggctcctcccatgtcgacaagctcggcacgatcgagcaccacgacgacaggctgccggcgccggcgacgtccgtgggcaaacctagcgagtcgaagcagctctgatccatggcgaagttgagctcgccgagcgcggcttgcacgctcgcgtccgtgcacagcatggaggtggttgcggtggttgcagtactcgtcgggtcgttgccgctcgctggactggaccactcgccgaacccgtcctggttcgggtcgaactgcgccgacgccgccgccaggatgccggggctcagatcgctggacgcgctgaacgtgtcgaacgcctcgtcgacgtgccctcccgactccggcgtgacggcgccgagcccggcgtcggtcggcgggtggttcagaaacttggcgtacagcattgcgaggtcgatggtcgagccgtccgccgcggcggcgacgtcgggcatcgcctggccggggttcgccgggttcccgaccatgccttccaggaccatgtcaggccggaccgggccggggaaccggtggccgaacgccgcgtcgcggccgctcgagacggcgtcggccgccgaccgcgccgacgacgaggacttcccgcggcggttcttgcggcagccgccgccgacggggacgttgcggagcgagccgcccttggtccagtaccggcggcatcccttgcagaagtagcgcggctggctgaggctgtagttgttgtagtagcagaacttggtgttgggcgagtcgcagcgcgggcagttgggcgccgcctcggcgccctgcttgtaccggcgatccaccagcagcgacggcggccgcggcgcgtacggcagcatcgcctcgtggtgcgacgacgacaacatcgatctctcggctcgatcgcgatcagcagcctccaagctagagatagctagctcgcttgcggccaagaatatatatggtgatgtgagatgttagctcagctcgatcgatcggtggcgcgagaggaattgattgatggaggtggcaagagagggggagagggagagggaggtggtggggtttttatatggatcacagggtgagctactagtagcacagggtgggagttttttccggttactggcgcatgtgcatgtgagtttgcatgcagacttgcagagcatagatcgatttggggcgagctgtagtgagactatttgtaggatttaatttggggttaaagaaatgaggttaggcaggagtagctcctaattaatcacccccaacaaactgtgcttgtgcagtccctccttagtggctacagtagtcttattatcgcataatgacgcaacaaccactgtgctagtgatcaaaggacattggtacaaggcaaattttcgcgtcgatctggaaaataatggagcttcaaccctgtgcatcttgtctcagtctacagttttatactggcacacaggactgatactcctatatctcaattgctctcgtgcaaaatttcgaaataactaccctctataaaagctgctacggtgttgattgtggattaaggccctgttcggctgcattagccgagccaagaatcaactggcagctggccgctggctgcaaggcagcagctgtaaaaaggcagcccaacaagccttaacccaaaaaacagatcaagtaacaaaagaaatttaaaagaatactactactacctttatttcttaaatatcattgttttttaaatatgtgatgtagttattttttaaaaaactttgactgacaatatttatataattagttagttaattaggaaaaaaataaaagaatacagctaaatctatcatcaaaattatctttaaaaagatctccctccatcccaaattgattattttatatgtttattcaccaaaactaaggataatttaaatcgcatcaattaagacatcatgcacaccattttcctacaatgcatgcattgattaaaacaccacgccaattacaccattgtcatgcacacattctcccttgctacattaattatattcgatggaattcgtgtccatgggatttatatgatgatcaatttgagaaattttggatttcattatatgatgatcaatttggtaaagagggagtatcatcaaaagcactttaagcatgtctaatatatttgtctatttgcacaaatatctattgataaaaaataagtagtcaaacacattaaaaaaaattcaacctttatgatatgtctactagtgtaaaagtggaattgttctcgtcctcctttcaccccatccctcactgtgcgaaacacacatctgctctgcgtaattgtcagatccaatgttcttcagtcgctctcctagcctatcccatacgttagaacccatgaacatgttactagtactcccttcgtcccactcactacggcgctcacatattttaatatttaactttttaaatatttgaccaataaataattattataaattcaaatttatttgatgaaaataacaatattggattgttatttatgtttactttcattataatatataattttattgctataaacattataatatgtgagaaaatttaaaccaaatattagttttgaagactgtgtcaagtttgactggggct

SEQ ID NO: 45093 - DNA, 11248 bp, Oryza sativa
atgagcgtaaatatttgtactttgctttagaaaaaagtacttagctagtagtaattcagtccacaattccagttgatagaataataagaatataaggtgcatgactatactgcgagccaattattagcgtggtcggtgcaacacggagccgttgcgcccaagtgatcgatggcacgggctggcggcacgccccttgcggtgggcgcgcgcgcacggccggctgctcggctgctcctagcgccgtacatagccgggaagagaggccgtgtgccgtgacgcgcgcgagctcgcggtagcggggggagagccccactggccagccacgtgcaaaccccaggcccccccgcggtgccgggggtggggtgcgagggacgcaaatccctcgggatcgttcacgcccattttgttatacactcccctctcgatcgatgcgtcgcgtgcggcgtaccgtcgttcgacgggtacgctgtgggaaccgcgatttcctcacacgcggttaggctctcgcgacgcaaccgcgcatcacggccaccggaccacgacgcgcgcgcgcgcgcacccgctcgatcgcaagttaatttttgcaaccagatccagctgcatagcgggttggcgcgctttgggacttgggatacgcgcgcccgggttacttgcacatgtgcatgcgagtttgcgacgcatagaatcgggccgacctgtatgcagtgtgaatatgtaatttagtttggggtttaagaaagagattagggagctcccaactgattacgtacccctaacaagccgagattgtgtgcagtatagtctctcttaagttgctacagtagtcgtgtcatgtcatcgcataatgatgccacaaccaatgtgctcctgatcgaaggacgttgcttccaccgtttcgggcccctttgaatcacaggaatgaaaaaacagaggaatagaaaaaacgtaggatttttgtaggaatggaaccgtaaaaacagaggattgcaaaacataggaaagttatgttactagccctttgaatgggtataggaatttcacaggaaagagagtgtcaggaatttcacaggaaagagagtgtcaggaatttcacaggaaagagagtgtcaggaagtgtattaatacatgtcactttggccttatccacaatatcgcaatatatattttcttctaaaagaacaacaatgatgcatatgtctgtcatttacctcgatcctacgcacacatgatggaaaaaagaggttagggtggatgttttctttcctatgttttccatgtgaaatgagttccaaaggaaaatttcctctaactttcctatgccctaatcctatgaatcaaaggctgctacagtgcctaatcctaaatcctatatttttcctatgaaattcctattaatcaaaggaggcattcacgtctaaattaaatgacagttctactgagaaatgacagtagtaaaaataaataaaaaaatctacgtccagcttacagtacgagaactgataggtgcaagcagacaacccaatggttcccgcattttatcgctccatgcacgtcgaaagaatttcgatgattctttccacggttagttggtgcatagtgatgcgtggcatggcggtgcccagcctgctacaacagggcctcatagctagccgaattattgttcttttttaccctgagggaaagctggctagccgaattggttcgataaagtgtctcgatacattttgaaaaacatacaaattttatattttagaataaataaagcatcagatcaatttgaatctctccataattacaatattgtttatgatactcatatggatatgtgtctttagtcgaatcatgagaaagtgttttcatcctctaagctgatatctccttgttttttatgtcatcaaaatagtgataacaaattgaaaaatgtttggtagatcaatatataaaatataacactccacaaacatacaaatttaaattcaacatactccctccattccataatataaggcacaaccacttttttagagattctataatatataaggtatgcatgtaggcatgcatgtaagcatgcaattaaccatgacatcttctccattaaattattattttttaaaatcatccactctcatgttacataatcctattggatgcatgcattatatttattaggatgatccaaactacaagacgataataattatttattggtatttgggttaaggtgattgtgccttatattttagaacggagggagtatacaaatagaaacacaattttatattgtataagttatttttgaacttacatatttgtaaagtgatatatctcatattgatctaccttaccatttttcaactttttaaataaattatgagtggcatgcacaaaacgggaggatattccctcaaggatggtatccacattcgaatcttgtgatacgactgcttaagttgtacttcctgtgttctacaatatagcaatatggtataggatgagaagtgtgctcgcgaaaaaaagtataggatgagaagtatccttagtataaatttattgtattagggtgtgtctaatcctatagtagattgttatatttgaaaagaaaacacttagtaggcatatctattcaaggaatggtttattaattgggtatcttcttttctttgatgatgacgattgttttgtgctcggggactccacagcaaaaccgggtcctatttatgtttgtttcccctgatccatcgaactaacaacggcgcccatgcatgcaaggtggtccaaagtacgtatagacaacagtacagtacagggctactgcaggctacacagacaacagcgagatgatgacagattgacgttttgacaggtcggtggccggtccctcgcccaatcatacctcgccaagacacacggccggacaagcgcgcactggtgtgcctggtggtgtgtactctgccgccctccatccgcccccctccccccgccacccgcacggcgcctctgcgacgtacggcacggcgcacgctcgaccgagtcttgcacggtgacatgcctgccatgccatcgccgcctactactactggtactgcctcgtaccatccgatgtctctctgcgtggcccagcctctctcgatcgcgatctgtcgtgtagggcagctagctggtcggagtggtttttgatggcgacagtgagtacattccgactccggccggacgtgtacaacgtttatttgatggacgtacgtaccggtcgacttgcgcggtgctgatcacccatgtggctcgttgaggtacgtcgtacgggcccggtggcatgcatgagcgttccttggccctaatcatacgcaattaagggggaacacggaccatcaaccacaaatttgacttgcttgcgcgagaaagcgatccagctgatgagatagctgcaacaagatgagctcgctctgacaaaagtaatgaggagctctaattttatatgttgaatttgaatttatgtgtttatggaacaacatatctcatattgatctgtcattcgattttaaaaatttgttaataactactactatttgactgtcatacaaaaataagggatatcccattaaggaataaaaagagtttctcaggtaaacgtaacaatgcatctagattaatctattaaatggaaaacaaataagattaaagttacatattttttaagagaatttattccataccactaagtttactctaattcaacgatttgtcatatactttacctccatttataatacaccattgactttgtcaaaaaaattacaatgtatcattgagtagatacttttaaggaaatgactaaaatacccttcaagtcatataagggttgacacttgattgacccactagtagttatttttttaaaaaaaaataaaattttgtgtgtgtatattttaagatatagaagtgtgtgtgtatattttaagattttctttcttgtttttttaaattattatgtagcatatatatgaaagaggtaaccccataaaaaagaattataaagcatatggatgatgatttatgtgaaaggacattaacacaagagtattctattagtacataaattataaattatatttccaaaaataataatacacgcgaaataaaaatcttgaaatatacacacttctatattatgtaaggaggctacataaaaaaatttcatgttttttggaaacttctactatatcaattaattgttatgcctttgtcggtgatatgggcccgggggtatcaggtttagagggaggaggctgccccccgatgccacgtagccctcctccgaggggagtcaggcccgaggtggggtggcggccactccttccctcaaagactagtcggaggaggctgccccccgatgccacgtggccctcccccgaggggagtcaggcccgaggtaagacggcggccactccttcccagagactggatggagcaggctgccctccaatgccacgtggccctcccccgaggggggtcgggcccgaggtagggcagcggccactccctggccgagactagagggagaaggccgccccaggcgccacgtggctccccccccccaggggggatcgggcccgaggtcgggcggcgaccgcccccctcccgtgactaggggtcgggctcccccgaccccctctctaggtcaccacatacggtgggttaggtgtccgcctccaggtacccacctacccgcatttatggcgtcccgagcagtcgcgccacgccgcatttaatgcggcgtgcagtgcactcaaccggtctgtgaccggtcgaatgaccgatgggactggctagtgcgcctgtgcgctgcttgtgtgtcaggcggcgtgcaacctgacatgtcccatcaaatagtgatggtgagaggttctcatcctcttatcccagccggagtcggtcctcctgctctggtcaaagtaaggctcccgtttcccggtgtaataggagcccagaagtcttcacccattaaatggtgactgacaggggcaccccccgtgtcaggcggcaagatttgacaggtcccatcatcaagatgacatgtgcttggctttccaagtcaagagacaagacatgcatttaatgcaaagattataatacttctccaccggagctaggttagattgttgggcccatgtggtaaccccttgaggtataaaaggaggtccaggcctagtgatggaggggggacttccgagcgaactggcgcttgggtctcacaaccccaaacacttgtgttctacattcaatcaatcatacacaggagtagggtattacgcttctcagtggcccgaacctgtataaatctcttttgtctcatcatcttggaggggcctaaccccctcaagatcacacagctccgctcaccaagccctcgaatctcacccactgcccccggccgaactcacaaaggggggcttcacggttccctggtggaggagttcattctccgacagccttaaaggcaattttggtatttttttaaaaaaaatattcaccccaacagcatactattgacgtaaaaagacaaagtcaatgacatatttaaaaaaaaagagacaaagtcgatggcaaatcgttgaacaagagtaaactttcctccaaaaattatattggaggtgtagttattcgtgagtttaggctaatcattgtgctaaagtggattgagaacttaaaataaaatcatgcgaatgacaaatagccaaaaacaataaaaggaaagcgttagtgtcctgattggtccgcgcgaaattatcggctttgtttgtgtcaaagaaaaagatgaggaatcgcaaattcgcaatccaaacaaacgtgcaaggccaaacggcaagtcttgtgagtggcagatcgccagatacatgcactccactcatgcaggtgccaagtcctgagtcctgacagcattctaagttcacggcctgataacacgatatatacccttctgtaataaagtgaaaacattttgaatttgtcgctagatcacaactcgtagatgctgtaactgtgaggtaattaagcactgataacaagtcaaccatggatcagcagatcaaacaggaagtgcttgtacagagcaggaaaaaaaaagagtaactatagaatgttctgttccggggagaatccacaaaggacgagatactgcagtatatactgaactgaatgcttgcagcgtgcccccacactgtaaaagttagagcaatgtatcacgttacttcattaatcggccaaagagtacacatggaactgacgctgttcgtcaccggctgaattgtctttttgatatgcatacacattgggtcaggtactcaggtggtttgtactttcagacgatctcatattcagcgatcgttgatgtctagctacttctattcatgtaacgttaatgctgtacatatacagttttacatgagctaacatgcatgttcttgtctgaaagtaacttatatagtactagtaaaacataaaagtttaacagccgtcttcatttcattgccgcataaataacattttgtctgcgaagtattcctccgtttcacaatataaatcattctagcatttcattaacatcaataggaatgtgggatatactagaataacttacattgtgaaacggagggagtactatgtttcttaggcagcaacagttcagatacctattagattaggctttggggattattgatccactgcattctctctttttcttcccctgttttatgtgattttctgaagatgctttcacaagagttacaggctgcaaattttacctcagaggtgatccagccctctgtggggatcacggcaatgatttagctgggacagacccgctacctaaactgttagagttgcttaagccacactcttccgtttgagctactagtaagcatcagccacacacgcagaggagagtagtatcagcaatcataacatggactattgcaattaattgctctgtgcaggggagaaaatgagcaggcaatgcagtaatgcatgcaggccaggatcatggcgattggcaagggccaagggctagtagacttgaacaaccttacattgataggacagtcgctgtacaaggatggatggatggattggttggaacaaacaaacaagggcaatacgctggcattcgtgcatggaccagggccttgtccaacagactgagaattaagcgtttgtacgtactgggaacagtaggcatggaggatgagctgcatgcacgcaggtacaggtgcagtgcatgagaaagcaaccgttagccttgtgatggaacgacaaagtgggatatggaggatggacgaatattacgtgcaattccgacaaaccagttctatccaatgcatcatatataggctcttctcagttattttattatttattgccaaaaaaaaactaaggttagtgatggcagaattaggaatgaaccatgcttgtgtccaaactccaaagtcgcctcagaaatagtcacggaaaataacaaaacactaccatgtttcctcaaccgtgtattcaatatatctggctgggagcagaggacttgctggatggtaccaagacaccgtgatcaatataatagtatatgctctgcatatgtatgtacttattaccaaaaatttatcacaatttgaaaggcgtaatatattgagcctggagcactgaagtatactttgatccctgttcaatatcctacgccgacagttacactttcgatctgaataatggacttaccagctggtacagatcgattaatgaacgtgcttacccgtacgtgtttggaccagttagtactcattactacgtacttataaatctaccggactaccgcgacaacagccagcaagcttatataggcaatggctgatcaatcaagggtgagagatctatgcagtgtccaaagcctaggcatgacaaagtaagtaacaaaccatgcacatcccctcttcggaaaagttgagaggtgtaaacttgtgataggtagtacgtacaacgtacgaacgtactccatctcggtgcaaactgtacatggtttaccaggccggccggccggccggcccggggaccatgcgatgcatgatgccagcatgcagctgatgtgcacctcacctcataatcccttccttgaaacccaatcaacagagacaatacgcgagcacgacagggctctcgctcagctagcgcaagggcgcgcggcgcgttgacaaaacccctcatgcaccgcgagtcgatcgagaccgagacgcccgcgcgccccggccggccgcgaaccagcgatcgacgactgagccccgcgcgtacggcgcccgcgggggccgcgcggcagggtggggggttgccggcgggttggtgtggccggctggccgcatgggaggagcgcgtgggacgtgccgtaccgtgggtgttctgccgggtggtgaggccgcgggcgcgcgactggcgcgagtcccctatgatgcctgggcctgtggaccacgcggcggagagactcgatcgcggcaactgccgcgcccgtcgcccgatatggtgtacgcgcggggggggtcacatgggttttggatccgtgcgcctgcctccttcaatgcgcgacggcgacgtcggcacgaaccggaactggagggaagtggggcgcggtcttgttggagatgtcgaccgcagcattgtcgtagacgacggcggctgatccagattccgtcgagcgactagcgtgcaggcgtgaatctgcgccatatgatcgatcgagcgcccaagttaacaagcctggcagtcgtgtccgatgcaacaatctagctaggcccagacgccgagtgttatactggtgacggattcgtgaacaaggcgaggtcaggtgagaaaatgacaggtgtgtgttttggcaaagggagtgtacgtgttcgggcctagcccaatcattcatcctgattcctgaatgaaaaaggccgaaaggagcttttcatagtgcgggcctgctcagatctcgtgataaaggcccagttacgacaatacgatcacaccccagaaaacaaccaattaacgaatttgttgtatatttgtcgacaaattttcctccaaaaatttatcaaatgtaattacagtataatcgtagtgtaattatgtaactttcaaaaatctctcggtaacatgttatttcagtaaaatagaggtcgtgggaacaaatcctttcacatatgtgtgtgctgtgattatttttcttcctcactagaacaaatcttgtaaatagatctaacgatcaaaattacgtgaaacttacatacaagttacactgtagttacatgcaagttacagtgtaattacatacaagttatagtgtaattatactacgattatactataattacatctgtcaaatttttagtagaaaatttatcgacaaatatataggtggtcccaccaattaatgttctttcttcatcagaaaatgtcatctggaatgcaaacgaaggaaaaaaaaaaagcaacgccagttcaacaacaatcttgatacattcttccataaagaaccaacaaattcgttgtgttcgctccgggatattgataacttaataactttaggcgtgcgctttttgttcttgtcaatctcatcctcttctctttttctgttgggaagaaacctctccttgctcctgcgttacaagttggacagggacccatcaagctaatgagcgatccgacacgtacatacaggacagtggattctgatcatcaagatatgtgtgctagactgctagtgtagtgcagtggagcctttcgctgtgcgtttttgcacacgtcgagtacgtgtgccttcgcccttcgccgatcgttacgcgacagccgatcgatcacgcgtccaaagcccgtcaatcgagtgggcatgcatgcatgcgctccatctggaaagttaatttaagctatttctgagagtgagatctcatcagatcagatatatactccgtactacattcgtgctagtctcctaatctagaagattagtagctacagggtactatatatctggctcatttttcctgttctagcttgtaacaaaaaattcactgctatgatctgaaacgttgtactccatcaaagtatcaaacgaatccacttggaaatttcggaccgaccggttttagattcccgccaactgagcctgtgaaaatagtaaccgataaaaacgaaataaaaatggtaaaagatatagaaacataaacatatttctcttataccgactgttttcgtattttaccatattccacttggaaatttcggaccgaccggttttagattcctgccaactgagcctgtgaaaatagtaaccgataaaaacgaaatgaaaatggtaaaagatatagaaacataaacatatttctcttataccgactgttttcgtattttaccatattcctattgaaattacctttttataatattgataattaccatatttttaaataccctaatatgtgtggtttgatacatagtttagaggctcgttaattcctcaatcaaatcctaagttgagtgcatggcataagaagggagaaagtttataatttaagctagtgtaagcttgaatttgttttcgcatattatattatatagttatattaagttaaatatattatttttacagcttaatatttccagaatttatatcggtttccgggcgataactctgtttttcctccgtatagtgacatttctgatttcctgatattttttacaccgctttcattttcgatttgaccctttttatcctattttctagaataatatggttaaaaaatgactgagctgtttttcgaccattttcttccctatgagtgaccatgtgtgtagaagatttatccattttctttttattttttgcgtacttttcctgtggctcatgcagaactgaagggctggaagcctggaacatgcatatacagtactctgttgtaaattttacagacgtccattaattattagggtaatttggaaccatgccattataattttgtaaagtttaaaatatatcatcggtatctcaatgacatgcaggacccatatgagtcaatgacatgtaggtcaggatggcatatgtcggtgacatgggatcaggagtatcatgactagaggtttgaggcagacacaatcgcacacgtggcctggtacccccgagggacgtcgggcccgagggtgatgcgttcgccctcctcttagtccccccgagggg

SEQ ID NO: 45094 - DNA, 11748 bp, Oryza sativa
agcacagtggcgctcacctaaccacatttattgcggtttggctgagcgtgtcacgccgcatgtaacgcagtgcagtgcactcgtttatccggtctgtgaccagtcacagaccggtcagatcgcgggttaggtggcgacaggcgatctgacgcacgcctcgccccatcccgtcaggacgagggcttctaggcgctcgtccccagctggagctagcgtgttacctcccagagatggcacgttagtcctggtcagatatatgccaggcttcatcctaaccattacaggcaagatgttttgtgaagaagggcgagcatgtagattgctaagctgacacgtggtggacaagaatgaccgacgtgactggtctgataccagtcatgtcgtcagcagacagccacgattccacgtcgcacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaaaatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcatctggcgcgccaggtaggggctctgcgagggattttctgagctctcgcactctttcgtgtgcgccaagcttttcctgttcagcccaatggccgagccagcaaaggcgcacgacctctccccgagtatgagcggtgacgacggggagccaaacccacgccgtcgagctcgtactccaccgccccctccacgccaaagtcctaggcgggagaaggcgctcgagagggccgaaggatccgcgacttcgacacccacaggaggtggagaagggcggcgagatggggagcgtcgcctcctcgtctacggcgacggcagcacgccccagggcgcgctccaagctgcgggcgcgctcctacgtcacccgcccgtcgcccatgacccggagtctccagcccaacgttggctggacgatgtggccaaattggtcatgactgcacggcagcgcctagatgctggtgggcggtcctccgccaccaaggcctctggtgctgctaccaccggctccgcatcgtcaagacggagggcgcggcgagcggcagccgctgttcgccattcggccgccactcctccgtcaacgcctccgacccgggaagatctgcgtggggaaccggatgctcgcatcagtatcgagcgccggcgtaatggccgacgtgctccccacgcaacggagggcgcctcctcgtccggagtgtcacctcaccacggacgcggggatcagccctccgtgcccccggttggtggtgtcggctgtagagcctttgtggcgagccttcggaatgtccgttggcccccaaggttccggcccaccatcgccgaaaaatatgacgggagcgtcaaccccgccgagtttctccaggtctacacgaccgggatcgaggccgccgggggtgacgacagggtcatggcgaatttctttcccatggccctgaaaggacaagcgcggggttggctaatgaacttgccacctgcgtctgtccactcttgggaggatttgtgccaacagttcaccatgaacttccaaggaacatatccgcgcctaggtgaggaagcggacttgcacgcagtacagcgaagggatgatgagtcacttcgctcgtacattcagcggttctgtcaagtccgcaacaccataccatgcatccctgcgcacgcggtgatttacgcgttcagggggggtgtgcggcacaaccgcatgcttgaaaagatcgcctccaaggagccccagactaccgcggagctttttcagctcgcggaccgagtggctcgtaaggaggaggcatggacctggaacccctccggttccggtgtggcagcttcggccgcccccggatccgccgctcagatagggcggcgtgacaggaggaggaagaagaggtcagcccataccgacgacgagggtcatgtcctcgccgtcgagggcgcttcgcgggccacccgaaaggggaggcctgcgggaggcaaaaagaacgaggccggcgctcccaacagggagcgcccaaccggcaagtggtgcaccgtccacaacacttcccttcacgacctcgcggactgccgtgcagtcaaaagtttggctgagcggacgaggaagtgggaggaggagaggaggcaggagcgccgagagggcaaatccccggcggttccttccggtaatcggcgaagtgaggccaagcagaaggcccccgccgaggacatcgatgacggcgatgatgacctaggtttccaagagcctggggccaccattgccaccgtcgatgggggagcgtgtgctcacgtttctcgccggagcttcaaggccatgaagcgagagcttctggccgcggcccctactcatgaggcgacgtgtcgggcgtggtggtcggaggttgccctcaccttcgaccagaccgaccacccaccgtgcattgcccggggagggtagattgcgatggttgtttctcccaccgtttgcaacgtgaagttggggcgtgtcctcattgatgggggagcggccctcaacatcctttcccctgcggcctttgacgccatcaaggccccggggatggtgctccggccgtcccagccaattatcggtgtgacgccggggcacacatggccgttaggtcacatcgacctaccggtcaccttcggtggatccgccaacttccgcacggagcgggtgaacttcgatgtggcggacctcagtctgccctacaacgcggtcctggggaggcccgcgttggtgaagttcatggcggcggtccactacgcctacctacagatgaagatgccggtccccggtggccccatctctgtccatggcgacctcaaagtcgcgctcacttgtctggagcagcgcgcggaccacctcgccgctgcatccaagcccgagggtggcgacgagaggcttggcgcttccgcccccgccaccccgaggcaacggatgatcacaggcgacgaggtcccggtcaaggaggttgccctgggcgacggcccgtccaagaccacacggatcggtggtcttttggacggcaaataggaagacgcgctcgtctccttcctgcgggcaaacgctgacgtcttcgcatggagaccggcggatatgcccggggtccccagggaggtgattgaacaccgtctcgccgtgcggccgggcgcaaggccggtccggcagaaagtgcggcggcaggccccagaacgtcaagccttcatccgcgaggaggtggcgcgacttctggaagccggattcatccgtgaggtcatccatccggagtggctggcgaacccggtggtcgttcccaaggcgaacggcaagcttcggatgttcatcgactacaccgaccttaacaaggcatgtcctaaggatccttaccccctgcctcgcatagatcagattgtcgactccactgcggggtgcgaccttttgtgttttctagatgcatactctggttaccatcagattcgcatggctagggaggatgaggaaaaaactgcgttcattacccccataggaacctattgttatacgacaatgcccttcgggttaaagaatgcaggtcctacttttcaacgtactactcgaatttctttgggtaaccaattaggacgtaatgttgaggcttatgtcgatgacttggttgtaaagacgcgcaaccaggaaatgttactctcagatctagcggaaacttttgagagtctccgctccgcccgcataaaactaaaccccgataagtgtgtgttcggtgtacctgcgggcaagcttctagggttcttggtctctgcccgaggcattgaggccaaccctgagaagatacaggctatagagcggatgcgcccccccagcaaacttagggatgtgcaatgcgtcaccggttgcatggccgccctaagtcggttcatatcgaggctgggagagaaggcgttacccttatttaagcttctcaaacgctccggaccgtttacctggacggaggaagccgaaaatgccctcacccagttgaaggcgtatctaagctctcccccagttctggtcgccccggagccagacgagcccttgttactctacttagcggcgaccccgcaagtagttagtgcggcattggttgtggagcgcgatgagaacaattctcatttcacgcttccccaccctgtgccgacttggcccgggagagagaagggaggagaggctcccgagccgaatggtggcccaaggcccccgacgaccggagttggccctctgcccgcttgtcagacggtgctaggagcccccgacccccaggaaggccctgaggccactgtgggaaggccgcacctatcgcccttcgaccccgaggctaaccctgtgctgacccgacccgggaaagagcagggagaagaggcccccaagccgaacggaggcctaaggcccctgacgaccgaagttggccctttgcccgcttttccgacgacgccaggagcccccgacccccaggacggccccgaagccactgtgggaaggccgcccctgttatcctccgaccccgaggtcatcagcacagaagataagtgcgccccgcgaggctgcttggacgaagagtgccccagggatgcggcccctagcgaagaggatcggccccaccgaaaggtgcagcggcccgtctactttgttagtgaggccctccgggacgccaaaacccgataccctcaggcccagaagatgctttacgctattctgatggcctcgaggaaactgcgccattatttccaggcgcatcgggtcacagtagttacgtcttaccccctcggtcaaatcttgcataatcgagagggtacaggacgggtggtgaaatgggcaatcgaactttctgagttcgatttgcactttgaaccacgccacgctatcaagagccaggccctcgccgattttgtggcagagtggaccccggctcccgagcccgtctcgatccccgaggccagcacggacccctcgcagctgcctcacaccgcccactgggtgatgcagttcgacggctccctgtctcttcagggcgccggtgcgggggtcacgttgacctctctgagcggagacgtcctcagatacttggtccgcctcgactttcgagcgaccaataatatggcagaatacgagggactccttgccggactaagagtggcagctggactggggatccgccgcctcctggtgttaggcgactcccagctggtcgttaaccaagtctgtaaggagtaccggtgctctgacccacagatggacgcctacgtgcgccaagtacggcgtatggagcgccattttgacgggattgagcttcggcatgtgcccagacgggataacatgattgccgacgaactctcacggctcgcgtcctcgcgagcccagaccccaccgggcgcctttgaagaaaggcttgcccagccgtcggcgcgacccgaccccttaggggagacggatgcgcctgaccggcccccgaggcctgtcggagtccaggcctcgggacccgaggggagtgctcccaactcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcattcctcgggaacaaggcgttgtgcttcttgccgatatccatgaaggcgaatgcggagcccactccgcctcgcgcaccttggttggtaaagcttttcgccagggtttctattggccgacagctcttaatgatgcggtcgacctggtccggcgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaggttcactaagtggcccgaggcttatccggtcatcaagatcgataagcactccgcacttaaattcattaagggcatcacggcccggtttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcggaaatcctcaaaggccttaaaaccaagaccttcaacatactcaagaagcacgtcgattcatggatcgaggagttgccagcggtgctctgggcaaaccgaactacaccaagccgagcaaccggggaaacgcctttcttcttgtctacggcgcggaagcggttctcccatccgagctcaccctgaggtctcctcgggctaccatgtattgcgaggctgatcaaaatcagcttcgcagagatgacctcgactacttggaagagcgaaggcggcgcgcggccctccgagccgcgcgctaccagcagagcctgcggcgctaccatcagcgccacgtccgggcccgatcactctgcgtcgacgacctcgtcctacgccgcgtccaaacgcgtgctggattgagcaagctttcaccaatgtgggagggtccgtatcgagtggtcggcgttccccggccgggctccatatggctggccacgggcgacggcactgagctgcctaacccgtggaacatcgaacaccttcgtcgcttctacccctgaggggagggggtcgggtgtcaggtttcgggctcgggccaaccccgcacccccctcgggcgtgcagggttggccgggggctacaacatatgcatattcttatttctcttatatctgaatttctataaaagcagtttcaatttcctaaaggctgtatctgtgctgttttttccttttgaagaatcttgacttgaaataggtcactcgtgctcaatcctgccctcgggggctcgggtcggctaaaatcgccaaacggggcccagaaccgagccgtgccccgaggcgtggtgaactccgggggggggaatcggcaaaaacctacaatcgggtcacccataaccctcggtcaccacgttcccggcctggccagtctcgacatgtggatctccccaggcactagccccgacccgcgccttttgaggaccagaacctgggcacaagcccttattcaagctaagacacaaaaggaccacggcacagatcatcctcatctcatactcacagcaagatgaaattaacacaaaaatttcttcatttttgattacagattaagttgatctatacaaaaaagaggcccgaaggccttagaagaaagaaaagaagaaaaaactgaagaatggcgggggtctgggggctcaatccgatgcgcccggatcgtcggcctcgacgtcactgtcgtctgcaccaccggcattgccctcctcgtcggagttgggggcgaacgcaagccgaggggccgagccctcgaagctgtcgacgatatggtcggcggcatcccggacctgcgcgcgcgcgcagtcctcggtcccaggagggaactcatccaacgccatccatggagagaaattggggtccctggcctggtaactcgccaggacgagctccaccgctccttgggcgaggtccctcgaggatgacttaattgtcttctcgagctcctcggggagccgttggagggccccgaccatcttcgagaggcgctgggcgaggcctccctggttggcggcgtactttacggtccgccctctccagaggcccacttgccgaccggcgcaatctaggcgggagacggcgtcccaaagcatgccgggccctacctcgcctgccaagcggagggcttcgacctccccggcggacgagtccagcgcgccctgcagatcggcgatggtgcgttcggcagctgcgaggcgggcggctaagtcgctttcgcccgtggccgccccgccgctgcgcgccctcgcgtccagctccttcgcccgcgcctcgagctcagcggcccgttggttcagtacggccctctcggcgcgggcaccttccagattgcggcgcgcctgctcctcctgcgctgcctcgcggagggacaggttgaccgccagctgttgcgccgcggcctcggccccctcgagagctcgctcccgttcggtgagcgcgtcctcgcgaaggcggaacgtgaactcttcttcggcgcaggcagcctcgtgcgccgccagcgttgcttcccggatggcgacggcggcctcgcggtccgccagatccctctccacgacgcaggcgcgctcttccagcgccatggcgcacgcctcgagggcctcttcgcgccgccgggacgccgcttcggtctccgccgcccgctgttctcgggcagcggcagcgtcaagcaccccctgggcggcgtcgagcttcttccctagctccgcctcccagctcccgtattaaaggcggagggtgtcctgcgcctcgttcatcacggtggtggcaatgagggcagccccccgctcctcctctatttccttggcgatctccgccagcaccttcttacgagtttcaagctccgagacgtgccggcggtgagccttacggcccacctccaccatggcctccaccgagcgtcgcccctcttcgacacgcgcccacgcggcgtcgagctccgcccgctctacctgcaggacctccacctgggcacttaacccatccaacaccgtggtgtttgcggcggccaaggcctgcagaaggggctctgcgttcagtagggcgatagaaggcgtggggaagagccgccttggagaggatgccacgcggctcgggccgccgatggaagtgccggactcggggatgtcccccggacccggttggtcctgagcgtcgcccgagggagtaggcccaagcgacgcgcccgcggcctcgtcgccagctgccccggaagttgtcgcctgagtgtcgcctgagggagtgggcccaagcgacgcgcccgcggcctcgtcgcgagctgcctcggaagtcgccatcgcctcgtcctggcgaaatccgacctcctcccgagcggcttccccggcctggcgggcccgggcggcctcctcccgagcggcttccccggcctggcgggcccgggcggcctcctctcgagcggtttcctcggcctggcgagcccgggcggcctcctgggcggcctcctcggcttcccgtaggcgatccgcggcctctcgccggtcagattcccgcctgagggcctctgcggccgccggatcctcggcctcagactggccggacttggaatggcgggagggacgcgacgggatctcgctgaaacaaaagaaaaaaccagaagacgaacaagatgggtgagtgaaaactcgcgttgagagattgaatacagccacgacgggtgagagacgaacctgcgagggggtcggttaaacgaccactttggaggggaaataaggtttccccgagatggttctgtctcccccatcttacggggccacttcttcttgcgctccccctcgggctgcgatgttggcgcggccccctccgggcgcctgttactggcacgcgccgccccgccccctcggggaggagatgggggaagtgttcctccctgcttcctcttcccccgggcgttggcagggcggctgctccccgggcccctgtcgcgggacccagaagcacgaccccctctcggggtagattgttcccccctgcggctcccgcctgcgccgtcgtggccctttggagctcgctcctctgaggccccgaccgccatcataatggtcaggatggaggcgcggtctggatcgctgcagagggggaggattccttggggaatgagggccgcctctacggagttgagattcagcacccgttggaccaatatcttgaagtcctcaggagcccagtcccatctcactccctggtgggtcctcgtgaagtcttcggacccggtgtactcccaggcgccccgagcgcgtcactggagcggcgcaatccgacgacggaggtagtcgccgtacaccatggcccctgtgagcccctgggatcgcaggcccgccaggcggtcgaggacggcgtcatagccatcccccagatctaccggcgcccgccagctggagacctgcgccgggggctggctcggaagtcggaggcgcgcttcgtcggcgaggggagtgtagaaccagtcgctcttccagtcgtcccacttcttgcggagggcgcaggggatgtagcggttcagcaccggcccccgtggctggaagtagcagccaccgactaccgatggcggcgacaccgactgcacggtgaagaaccaccggaacagccgaagagatgggcgcaccccaatgaacatctcgcacagatgcgcgaagatggccaatgtcatcaccgcgttgggggtgaggtgcgccatctggagatcgtagaactccagaacatccatgaagaaagaagaaaatggtggaaccagccctgccattgcaaaggggagaaagaagacgaaccgccccgggtagtctggcgccgggcgtccctcgcccagcgtgactatctcccggccggtggcagattccggcatgaagcggcgcgacagcccagcctgcctctcgctcacgatccgggaaggcggcagcacgctaccatcgagcagagcggaaccccgtgccatggcgccggaggaagagaagattaagagcgagcgcgtgtggcgaaggtagggcacaggaaagaaggagttagggcgcaagcggcgaagacaaggggaataatggcgaaaggaaggaaacagatcccttcctcagtgcctttatactcttgctaacgctgtgcccggctcctcgcttctcgcgcccactatttcgccccctcgtttctcgcgccctcgcttccactaatcccattcgcccgcttgcggcgcatgaggtgggtatgcggttgtggcagtcgagatagatcatatcgtgcgcgcgttaattacgcttgccgaccgaagcgacgttaccatatcttcagacgaaacgaatcgccatgtccagattcgtgtgctactcaagtaatgtggcagtcttgaagagaccgctcattgttgacagccgagttaccattgccgatgtgcgtggtttgtgaccgttgggtttctgcccaattgtggagaccggtcccacctgtcaccaggtcttaggagtggcgtcacgcccgcccgtttcccttaaagaaggcgatcgccctggcataacgccgggggctactgtcggtgacatgggatcaggagtatcatgactagaggtttgaggcagacacaatcgcacacgtggcctggtacccccgagggacgtcgggcccgagggtgatgcgttcgccctcctcttagtcccccc

SEQ ID NO: 45095 - DNA, 7247 bp, Oryza sativa
cacctgctcccggcgaaagtggaggtagttgtgggccgtctcatcagaaggtgactcggacggcaactatacaaatctccgtccatttatgaaaagggggggtaagtccccacaaaaaagagagaaatggtgcatgtggtatccccttaagatataaaaggaggaccttgcccactgagaggggggactggacttttccagattagaaacccagaacaagggagaggctggctgatactttgtagctccttcatacacagatctcccaaaacacaggagtagggtattacgcttctcagcggcccgaacctgtatacatcgcccgtgtcttgtgtgtttcctgtctcgcgagccttccacatacagagagcttagaatctctccctgagtccccggccgaaccggcaaaggggggcctgcgcggtctcccggtgaggagccccacgctccgtcagcatatctcaaattttgtaaaattataatggtatgattccaatttttccttattattatagccacttgcagtaatgcttggattatattgctcgttgtgaactcagtggatgggatcaaatgacagggctgctggtcaccccccgaatgcatctggcattggatgttggtgttggtcatgcatacaagacgacatcaactattgtgcgtggctgatctgtttggataacctagcttaacagcaagtagcaactgccataaaacagtatataagctcaagttgccttctcacacatactcttacagtctccttaggtcgaaatctgaaggaattcaagcaaacaactatacgaaaattaaacatagttaactataattaagctgtgctgcttgcctgccactagtctgcagatctcttatataactatatatacttcgcaattcccttttctcgctttttcttattttaaacaggctttagtacttcaattcctttccattttgaaaaaacaagtacataaaagcgtaggcatggcaagatagaacacacaacacgacgaggagtgtatgaacatgtatgcttgattgattgatcagcttaaattgctttaattttgtgtcctgaatatgttttttttagaactgtcctgaatatgtagaacttcggtgcgtcccaagctgtgccgcaacgataaggccgacacggccgatgaggcacgtccggggatgcattattgtctggacaacatcaggcgcttgctaattgatcattgacggcttcttgattagaaatcactcgctataaatgttggagtacttgacatacacctctttgataagatgccttgaaaatacatatttcaaattaattcgagaattattcttacatatttcaaattacttcgagaattattcttctatatgctataaaaaccttaaaatatgaaattattactttgtgtataatctagcaccgaaggatcttgaaatattccataaagaatcttaaaatacgttttccttagacggtagtatgatgggccgatataagcacgtttttttagcagtccggcccagaaagcccaggcaaacaaaagaaaacgtacgcgcgccaaaacgaaaccaggatccgacaggaagttgacacgtcggacgccaccctgtcctacgtggccggaacggaccacccgcgtattgacaagtcaccgccgcggtggcgccacgggagccacgtgtcacgcgcccatgagccgaccggtcgcgctcaactagtggaggctccggcatgcaggattatgattgccatttgtttaatccagtctctaatgatggatggttagtgcggtttggcgtccgttgcatttgcgggtttcagcgagctagacgccctagaccctctccggctcgtagaaaactcggtttaaacacgcaactccgtgggctcgtttcgagtttgtattttgtctttgtgtgcttttagctcggtgcatggaagttgcaagcatcttaaagtggaaagttttgtgcttgccggaaatcaaatgctcagttgttcttttcactactgttatatcaatcgtgcagggactctcgagaaaacatccttttattatttacatgctatcgaaatagttataaaaaaattaactaaatagattaatatgtggtaaaacactccacaaacatataagttaaaattcaatttctttaagttgtaaaaaaattaaattataactatttaacgtatattcatagtttttttcgtttcttgtacaggttaaatttgatcttgcatatttgtagactgatttatcacatattaatctatcctattactattttaaaatttgttcataactatttagatgatacacaaataataataatgttcgagagtttagaataatttcctcaatcgtactgcactactgatacatatacgtcctgcctctcaaaaccatggaagatgccgctgtattgtgtgttctttttgcttaattaaacttactctttctgaaacataattttaaggactaccggaaagataaggaggtcgcatagtgctaaagctcgtaggttcaaatcttcaccccctccttaattcaaacatataacctccgttctaaattaaatcaatctagaatagaataagacattacctaattcaacgaatttggtaaacaaactcttatttaaatttgtttatgtaatatcatattttattttagattgatttattttggtacacaaggagtaggtgatttctaccaatttttttttagagaatatggggaattggaagtctgaaactgaactacgtactgaagcacttccgtgtaattctgcatctggtcaaaaagcctgtctgtcctgtgtgtctcctctgaattttgccggtaatccggctcccttacgtacaataggtagtgtggtgcatcttatctccacgactcccctccattactcgcacatgcctctgaattgatcgacaagtccacagggtaagtacttctgttaaagtctttcttttttttcccccgcggtgcccactaagcaaagaacaaaaatcacacagactgaaatgacggcgacccgaaatatctttactattaaaattccactgcgcactgtcaccttcctatataaacggccaccctcgccgtgcgacgagagaactcttctcccacgagaccaacgttttctactgtgcacgtgcgtacgttggtttcctcttggagttttacacgaaggaattgaagtgagctaccaaaacatggacgtcgaacagcttcatcagcatgccaggaggcttctgtcgaacggcagggtggtgtcggcggcggcggccgccggcgcgtcgcctggtccggctgggcgcgtgttgaaaggcggcgcggcggcggcggcgcgtcgtccggcaccgttcagctcgctggacgcgacggtgatcacggtcctgtccctcctcctctgcgtgctcgtcgtcgggctcgtgctccacgcgatcgcccggtgcgcgttccgcgtcacgcggcgcatgtgctacggccaggagccgcccggggatcacggcgacgaggcggcggcggagcgatgcgcccgggtagccaggaagaagccgggacgcgccatcgcggagaagatcccggcgatcgtctgcccggccggcgggctcgatcggctcgccggctgcggctcgacggagtgcgccatctgcctctccgagttcgcgcagggtcaccgcgtccgcgtgctgccgcgctgcggccacggcttccacgcgcggtgcattgaccgatggctcgccgcgaggcagacctgcccgacgtgcaggcgggagccgtttgcggcggccgcggccgtgcagctgcaggtttaccctgacgccgccggcggccagcacgagacgccttagcaccaacgtgactcaactgtacagtaggctatcacagtagttgggaacacagtgaacatttttttgcttttcttttgtcatccgagatactgtggtcattatctctgttttttttttcttttctgttatgttcatgtcgaagtgacccggttccgatgaaatgaaggtgaaaaccacccgagtaaattttactgaaaactgcaaaaatatgtaccatcaggttgtgatttggttcaggcttgtaaacccatttgcaaatattgcacggagagtgccaacttttgaatcgtctgaattgtttcagacacgatgggagctgcatctggagtgttttttttctactttcgagaggtataatactctactaaaatattatatatacaatagaactgaacaaaaactcaactcaggagtataatatacatactctctctagtcaaatttattttatgttgagtttagttctcccaacgtcaaatatttttactagatcaagtatctcttaatatattctaaatacaaaacaaaaaaaaatccatgaaattgacgatatattgtgtgatctgttccacaatgaaatgggcaacaggcccattgagtaaattcggcccacggacgtactccaggagtgccagcctgctacaacactagtctgacgttgtgactctacattgtactgtacatacgagtattggtatagtagtagcagaattagaaaaagaggaatcggcctacggtgtatctcgtactataaaagatggatgtttgtgttgtggatttgtggtggcgtgtatctccctcgtagtctgaaaaagttaactaagaacgcatatttgctaaccacgggtaattccagattcccttgctactggttaagaatcgttttgacttgtacggggttgctgaattttctttgccgatgagttatagatgatgacggccgactgatgaattggtgacttcctgaagttcaaagcaggtacgctgaataatgcgatgcttatcgctgtttctgaagacatcattttcccctctgtctcactgcaaagtgaatcacaataccatgtgccatattcgattgtttgctgcaaaatgaaccttccggggaggaaatctagtcaatttatgaatagtttagcgcaataattagctgaaatggggaggcatgaagcacgctttttgactgcaagtcggttacatcttcattccgtcttccccccggccgtccagagtgggagctgcagctaccactgccacaaacctttccgcctcactgaattattggctcacgtaatgggttctcctgaggccttccactactggaagctgcaaagcactgtactatagctagcgtgtgcctcgttaattatacttttctgttgccaataatgcagccactattgcccagaacaactgacactaatacgcgggcaaagtgatcaactgagccgtagtattcgcgtatcaacttatcatatcccccagtgctgaaagcaccaacaggatatcaacatatgctgttcttccggcatcataggatggaactgcgtcaactttctgaaagagggtaatacagtatgaattattgctgctttgcgtggctggaaaagtcaattattgggggagagttcggttctctgccggctgcttgctcgaccgaatgatgcattctgctgtagctagtgatagtgctacgcattagtgttttgtacggtcttaatcaatcgtggtctgtagaatttgatggagcaagctcttcgtgttgcatccttggtccaatcttgtgcttgatatgtccgagtcacaacgcatgaaagttgtttcgcgtaatttgtgtcgtatatactccgtatctcctagcagaagaatatcacgatcatccgacgaggacttgtgttgacgtgacaaaatggtccgcgttttattcgtgtggccctggtgtaaatcggtttagctcagatcgcacctcggtagaaaagtgaacccgtaaatggtacgacaattggcgagttttctccccttaactttgtcttttattttgcttttctttcatttttctctctttactactgtaggcagaagccagaaaagctaaagagacgaatttcctctcttctttttttgaaggaactgaacacggtgacgccacaggagcaagtaagcaagagtatttactcccagaagcccaatccattgatcttcgtgagactttcaggagaatccaagcccaaataggtctcaggcgaacggcgaccagcccaacaggcctataattggcatccaaactaagcccaaatagacaaaagcgcggcagctggacaccttgctattcatcctggactttcgcaacgggaaactcatgggccctcaaggtgattggcagcgcaggccgccttcgccgtgctagcaggattttttttattagtttaaatttttatttacaaaaaaaaattattcaaacttatattctatccgtcctataaaaaacgaatctagtaccgcatgtgatatattctagtatgatgaatctggatagatatatgtctagattcgtagtactaagatgtgttacatccggtattagtttggttttttatgaaacggatggagtatgtatttagtagtgcatctctaccctctcttaaacggtttttatgacataacacacgactgtggatgcaagttagcagccacgcggagggaggtcaaccattttacaggcagccctcttccgctctcctaaaggactacaaatggttgctcgtaaaatcttcgtgcggccattaacatacaccaacggatatgtcacatatgccacgtcataaaaaaaatcatcttggaggaaaatagggttgtagatttataaagagtaaatttaacaaaattaaaggtaagttgatcaaattacagtaaaactacatatttaagataatataccacaaaactatatatttaacattaaatttttcccaaaactagatattcaaggtggagtgccgtaaaactatagatatagaaaaatgttatcacaaaattacgggtgtttacaactcaaacatagaaggatttaaaacctaaattttgtaattttgtaattttgtgattttttacgatacttggtcataaacctaaaattatgcaataaacttaggctgcgttcaggataaggggttgggaacccgaagcacgcattattgcataattaattaagtattaacttttttttaaataaaggattaatatgattttttaaaactacctttttatagaattttttctgcaaaaacctcacggtttagtaatttgaaaaacgtgcaggcggaaaacgagagatatgagttggaaaaaattagaggaataacacaacattagtgtcaaa

SEQ ID NO: 45096 - DNA, 2048 bp, Oryza sativa
accgacccggcacgccagtccaggtcaggtcagacaccttcggcttggctggctcagtggttcgcccaggtcgcctgcctcgtgctctgccgtgccgtgacggtgccatgtcacgttcaaacggcgaggcaaaggggaggagggtagctgagcacacacgcggtccgtgcttctgcaggcgaaggtgacgccgcagaagactagtccaacggggcggcttccacgcataaaacggctccccttgctgcgctttccgtttcggctctcccatttgtctcgcgctcgctgtctcgcgtcagcggcggagctctctagaaggagcagaggagtcccccccaagcgatcgattcgatcccctccgccgccgatcgcctcgccgaagtctccgaggtgtaagcccgttcgatctctccctctccctctccatccttgtttcgatctgatccgtggaatcgcttcgctggatcgccggtagagcttcccgtgctttgttgtccgggtgatttttccggggaatttcgcgctgttttcgtggactgtttgtgttgacctcggcgtttggacgcttgcggttgatagctgtatcctctcatgactagcaagggaattcatggcgtttgtgtactgtatgttgtatagtctgatccttggtcgggttgtatgctgcagttgcagacagcagagcagttccaatatcacttctggagatgatctcaaactgcataatacctattctaatactttctatttcctttctaacaatccgctgcgcagctagttgtatgttacttcagtcgatacttgcatcatgcatccagaattccagacaaatagttgtatgttacttcatgttgtgttttttcctttgttaacatgaaacctctgatgtgtcacatcgtgattgtgtttacctttattgcgtagttttttttaaaagatccatactgccttactgaaatcaaagcgaactcaaatgaaaattctttcttattttgcatgatcatacattcagtcccaggtgccacttctaatggttagtcccatgttgtgttttttcctatacctgatcagttccctaatgatatgatctgtattttattggttgttcgttggcatgttgtaaatgtttagtgattgctacttcattttttttatcatgcactttatttgggcccaggagtaagctcggtggcacttaagcaaaacagtgcttaagttaatatgcacaataattgatttttgaatgcattctgaatactgatatttgttgcagaaacacttgagggatggctgaagaggatatccagcctattgtctgtgacaatggcactggaatggtcaaggttagttaattttcctgccacgctgtaaaactgttagttcgcacaattgggatgttcagattctcttttgcctgctaatacatttgtagcacccaacgaattgatcatttcttcatgtggaataggccggttttgctggtgatgatgcacccagggctgtctttcctagcattgtaggcaggccacgccacactggtgtcatggttggtatgggccagaaggatgcctatgtgggtgatgaagctcagtcgaaaagaggtatactgacattgaaatacccaatcgagcatggtattgtcaacaactgggatgacatggagaagatatggcaccacaccttctacaatgagctccgtgtggctcctgaagagcatcctgtattgctgaccgaggctcctatgaaccccaaggcaaacagagagaagatgacccagatcatgttcgagaccttcaactgcccagcgatgtacgttgccatccaggccgttctttcgttgtacgccagtggtcgaacaactggtatgatgattgctgtacaaaaaaaaccatttgattttaacatacttatctaaaaaaaattgattttaatatccaatgagtagtcgaactgcgctaactagtttataaatgcaggtattgtacttgactctggtgatgggtaagtcacactgttccaatatacgaaggatttacactcccgcatgc

SEQ ID NO: 45097 - DNA, 7319 bp, Oryza sativa
ctggcatccatgaagccacatacaactccatcatgaagtgcgatgttgatattagaaaggatttgtacggtaatgtggtccttagtgggggatctacaatgttccctggtattggtgatcgtatgagcaaggaaataactgcacttgcccctggcagtatgaagatcaaggtagttgcaccgccagagaggaaatacagtgtctggattggtggttccatcctggcttctctcagtacctttcagcaggtatccattgtctcaatgcatatacttttgtttcatctgcttaacgagattaccaaactatgtgtcttaatgcatttttagtccattgtctgcaagacactgcatccttgcaaacatttaacaaactttttggtgttgctttctttgacatgctccttgggccatgtgctgtggactgtgtcaaagggtggagatgtacttgatctttccattatcttaaaacacaaaggccaagacaggactttactaggaagttcaatatatacttagttcatggattagaaataatgatttttaaaaggaaatcttagcgtcaaactgttaagtaccgaccatgtcaaaaaaaaactagtgtaattttgttgcatactacatgatgtataagacataactcctattacataaacctgattgtttgtgaagtttttagacagttctctttgtctagtaatatgcactactatttcttctttgaaattggtatttctattgctgatcattttgctctgcaaaactaatgacatccacttaatttgtcacagatgtggatctccaaggccgaatacgatgaatctggtccaggcatcgtccacatgaagtgcttctaagtttgtgggcagatttgtaccattatcagctgattgagacgtgatctgcagattgtttgcatgcgtcccatggtttcagtagcacctgagggctgttggccatggggcaatgcggaaggtgaagtcaattggtgtactggaagaaatctgtccaggtagtgtgcagtgtaggtcgtctgagtcggtcagttttttcagacaatggcatcgcatcagggcattcctaatgtatgcaatggattgttgtgttgggtttcaccgggcaacaaggatgtttgcccgtgcagtttgaaagctttttgtttcgaattttctactagccgaattgcgggtcttaatgattgtacctctagttttgttttctctcttgaagataacttatttttgtgtacgtagtaaaggtttatttgtatttgaacgacttgtagtgttttggatgttatgctttcccccttgggactgagtagcttgtttaagctccctgagcgaaggcacgtatgcgaggatagtatcacctcgctgtttgggggtgaaaatgcacattttaacctctggtaaaccaaaaataccgtaaaaaatgatttgtgtgcgcattaacaacgccgcctaggtacggcccagtccaggccaattacgctttcgggcccaacatttcgctgaacgcaagtgacaactgctgggtcccagaatccatgcaccgaacgagccagccaatcacagcacaggaaaaccgaaccacgatccgcgtgacaccccacttctcgctctcccacccccagccaatcagaatccaggaaacccctccccacggatcgcgcccccacgatccgcgtgcgcgaggtcaaatcgcaatccaagccgtccactcccctccgatccaacggtccaaacccatcttccctcgtggaaaccgcgccgctccgcccaaaatttcccaaactcccgccctcctctcccctacttaaacacctcgcatcctctcgaattccccatctcatcccaatcccccaaatccacccgagcattcgaagcttgtagaagaagccctagcctctcctcctcatcaccgatggcccgcaccaagcagacggcgaggaagtccaccggcggcaaggcgccgaggaagcagctggcgacgaaggcggcgcgcaagtcggccccggccaccggcggcgtgaagaagccccaccgcttccgccccggcaccgtcgcgctccgggagatccgcaagtaccagaagagcaccgagctgctgatccgcaagctgccgttccagcgcctggtgcgggagatcgcgcaggacttcaagaccgacctccgcttccagagctccgccgtcgccgcgctgcaggaggcggccgaggcctacctcgtcgggctcttcgaggacaccaacctctgcgccatccacgccaagcgcgtcaccatcatgcccaaggacatccagctcgcccgccgcatccgtggcgagagggcctaggcgtgatctgctcgagaggctgtgataccctggtagttctagtggtggttcctgtgtctagtctgcacatgtagagatttgatggggttccttggttggtgtttgatctcagatctgtcatggcctagttggggtgttgcgtatgtaatttatctgtcttactcttatgtgatcccatggtgttggaatgaaatggaagtgaagaattctacttatcaccaaatccgaaaattctcctggagtttttgcttctggcatggctgatgatgttcttgttacgtttttagttttcctttttattaggaaatttccttcgaaattcatttgaattggccgctttccttttgtgcattttgctccaaatgcaaaggcgtccgtgtgtctgacaaggccgggcccactgtcattcactcagtcctgggagtgttgttattctcgtgcgcgttgtggttagtgggggtgcgaccgaatcccagcattagaagggaagggaagcttctttttcgtaccctattctctacgatcgccgccccccaagccaaatccacgcatcgacgcggcaggagcgggcggctgctgcgagatcggcggcgccgcagatctcgcgcccaccagcggagatgaagatcacggcgctcctcgtgctgaagccgtcgtcctccggcgggggagcatcctcgtccggcggcggcggcgggtcgggcggccccgaggcggtggtgctggcgaacgcgacggacgtgagccacttcgggttcttccagcggggcgccgcgcgggagttcatcgtcttcgtcgcgcgcaccgtcgcccagcgcacccagccaggccagcgccagtccgtccagcacgaaggtaaacaacccatcgtcctcctcagatctgcctccgcacttagggtttgcttgctttctgacccgatgctcagatccggtcttcacatggacttggattatgtgggatatagacttttaccgctgatccgatagtagtccaacatagttggaacatcagcgggctgtggaactacagtattagcttgcttgtggatggagtaggtagcgttgcctgttagttcaatctgatacggtgttgggcttcatgggaactatttgcttgtttgtggataggtagtgttgcctgttagttcacaatctgatgcgctgttgggtttgtttcaacatggaactcgtttgtggataggcagtgttgcctgttagttcaatctgatgcgctgttggatttcgttgaaaagagtgaccttgtgttcgtcgtaaggatatctggtgaaaatatgggacctgattccaacgtttatgacgagttatgatgcaattgtttgtgcaatctgcagtcgatgttcattttcggtctagtgatcaggagaattcagtttgctgttgttaatgaacggtcatgtaaacaagttgtcctgatatttgcagaatacaaggtccactcacacaacaggaatggtctttgcgcagttgcatttatggatgatcactatcctgtacgaagtgcattttctcttctgaataaggtatgagcctttgttcttgacattcctgtattgcatatccttgtatttgacctaggatcagattcacaagcaataagggattgtctccttgctattctcagtgggataaaacatttgatcttctgaacaggcacaaaaaattatgttgtgcatacaagggtgatgctaagctgatgcatcttatttcacccaacattagcagtcctttttcttcacttctgttcaatatgtttctgcagtggtttgttgaaaattaatagaaacaacctatgtacaattttctatggcctggttctatgttgaacagaacatacatcttgttgtgttcggatactttgaagcttacccttctatctaggaactccttttcattcacctagctatataatggatcttcgaggctgaaacctggcacactatatcattccgaaactcctgagtcctgataacaagtatacacctgaatcaatgttttagtcaatgagtagttcagttctatttatttcatgcaaccactctacgtcatctttcatacatctacatacatgtgaatacgtgattagataatttattaatgatccatgaccctttgatctgctagagtaagtttcatgatgcaacacatcagtagttaagaattatcctaattatccagttattgatagaattcattttatgaaggtacttgacgaataccagaaggctttcggggactcttggaaagctgctacaaaagatgcaacagatgctgcccaacagtggcctttcttgacagatgctttgacaaagtttcaggtaaagctttccatgaacaaaaatacaatctgtttatggtttcattgatcagaggtaatggaaatgttctacaaatattgttacacactattgacctggggtcaggggatattttaccatctcctttatggaggacaaccgaaccttacaataaacaaagaaaagtgtaactgaagaagttcatttgttttacaatgtattcttccatcatctcaattgaaatatgctatgcttgttcttggatgaaaagagaaatgtccattagccatatgataagttatttgctgcttttggttggtgtctgaacatattatatgctttcgacttattaagacaactgcttttgtttgtgattttcttcttgtccttgttggtccaaactgccagtacttaaacacgcactgcatcctgcatgaatgttttcttatgagataacttgatttcattattttgtaggaccctgcagaggctgacaagttaatgaaaatccagagggacttggatgaaacaaaaattatcctagtaagtatttcttaccagaaaaaaaaattatagaatagctctgccattcatattggtaaataccaacacttcttgttctaacaaactcaatgacccgatcttgtgctggagcttacgatattgacttgaattcatattatctactgttatgaattgatatctcataacttatttttcatatgggtaaaactgcttgctgatgtgcattgtttatgttctaatatttgaacagcataaaactattgagagtgtgctccaaagaggggaaagattggatagcttggttgagaagagttcagacctgagtgctgcttcacaggtaatcatgtgttttcatgtttgcttttttacttgatgagtgcttcttactttttgttctcactgtgattcctcaagtacatttgtttaggactacacatatttttcacgcgcatatgtctgttgaattagtggggttttcttttctattatgaagaaattgccaaccatggaaatattgtataagcaaatccttgattatgtaaatagtatatatgaatctgttggttatggcacagctatacttatgccaggtttttggctgtagcctatgataattctagtctgtttattatgtgacgggagcaaaatatgatagaaccttaagcccctgtttgtctaggctgtcattcgtctatttcagttgtagaatcgctggaccctttttaacttacattttttgtttgttaagttttatcttgattaccgtttgtctccagaattttgttgagggatattgtttttcttttcttccagatgttctacaagcaggcaaagaaaacaaaccaatgctgtactatactctgaagtttggactttcctgtccttaagatgaagactccaggttaattttgcttatggacataagaacccactttttctgtatttactagtttcatttaggtccgttcccgtaaaataaatttcaccatatgtatgacttcttaccacacttttttgcccccttttcagaagccgaccgatactgtttagttctacagtaagatcaattgccgtgaatcgtgccaaagtaaaactgtcaaaactattattctttggtgatgaaggaaccttccagggtttatgttccagagcaactaacacattcattgaactgcatgtcccgccagcaatcgccaacatcttgtttccactggatagattgttgaattctcaaagcatgttggagtacacgctctgtttgctactcgtaatttatgttattgatatgattggtatttgatgtctctactatgactacagtattttaaaggtacactcgattacattgccggtaataggcatatagtagttgcgtaccatgtcgagttgatcatgagttcatgaccagccccgtgtgaaatcctcggttcaagttctttctgagttgcatataccatcgctttacctcaacggacaataaatgagcaggactttttactcggattatccgtcgcatatgcttgtcaaaagtatgaatctattcactgaaccactaaatacgaaaggcagacgaatccagtaggataagtcaaatggggtgtgttttatttctaacaaaagttggatgtttgaagaaaattgggaatttggaaaaaaagttaaaagtttatgtatagtaaagtttttggtgtattatgatgtgatggaaagtcagaaataggggaaaactaaacactgccatggtaaagcagctcttccccgagctgaccggaagctcgagcagcctagcgtgaaggtaaagcgtccagtcgcctgcgagtccccctcccgccctgtagctctcactcgaagtcgaacccggtgccatattccacgcgtaaatgctaggccattaaaggcaaacaacttctaccttggagagttggaggcttggagcccatttgcgagaccccctctccggttaaccgtttcgccgtcacatcgggcgcacagcttaacacgacgtacttggtcataatctcgcaccatccacgtcggcgtcggcgtcggcgcctctgctcaacaacaactacacccccgctagcttgctgcgttgccgtagtacgtggcggtacaggacaaagccgtgctcgcctctagta

SEQ ID NO: 45098 - DNA, 5394 bp, Oryza sativa
cgaggcagagtaagcagacgagaagaacagcgcgcggcgcggtagctgaggagagtggtgcggagatggatcacgaggcggacgcgtaccggacggacctgatgacgatcacgcggtacgtgctgaacgagcagagccgcaacccggaggcacgcggcgacctcaccatcctcctctcccacatcgtgcttggctgcaagttcgtcgcctccgccgtcaacaaggtcacacgaatcctcccgttgtttcatcgttaggcgtacggatctctcggttctcactctactgattggcacgctgaacaaaacttctcgggttgtgcatgcaggccgggctcgccaagctcatcgggctggccggcgagaccaacgttcaggcaagtgtacctggcaataactgtcatctttctcagtttcttgtctctgagattgagatagtgaggactgaggacttgcttggtgtgaccagggagaggagcagaagaagctggacgtgctgtccaacgaggtgttcgtcaaggctctcgtcagcagcggccgcaccgtacgaactcactctcttctccccttaaaccatttctttgctcagagtgttctcaatatttatggtttttcactgcgatcgcgtgcagtgcgttcttgtctccgaggaggacgaggaagcgacgttcgtggaccctgcgctgcgtgggaagtgcgtagcttcggatcagaaacgcgacctctctgcttcttgattcgagcaatctgttgttctgtttttcctgacaaaatacatgcatggtgccggttttttttacaggtattgcgtgtgctttgatccactcgacggctcctccaacatcgactgtggcgtctccatcggaacggtgcgtacacatgaaaccaccaaaccgaaaagataacactgacaactcggaagaacggcaagtcgctgttcaatttgcagttttggcatccttctaggatggtgacgtgaaaaagggagaacttttggccaaagcaacatatgaaaaatactattcctccatcagttgtgaattactgctagcatgcttttctgaggacacgagtactgctttcaaaaactgaaaatttcagcagcaaggtgttgtgtgagtgtgacagtgaaaagttgatagcaagtcttaacttttaacggattctagactctagggtcaacttgaattgtcttcgaacaatactcgattcgattcgtcagaaggacctttaatggattcctgtactacatgttctttctcttgttttatagatctttgggatctacatgatcaaagataaggagaatgtgactcttgaggacgtgttacagcctggaaaaaacatggttgctgctggatactgcatgtacggcagttcctgcacggtaatcgacctcctaatccatcctactctataaatgtcataattctcacctgaatataacctgtgtaactaatttgatgcagcttgttctgagtactggaaatggtgtcaatggcttcacacttgatccatctctcggggagttcatattaactcatccagacatcaaggtttataagacaattttttttgactaactgtttatgagacaattagtagtgatacttccgtcttttaatgtacactgatgagcgggcaaaatactcatatgtgtgttctatgcttcactctgtgcagataccaaagaaagggaagatttattcagtgaatgaagggaatgcgaaaaattgggacgagcctaccgcaaagtacgcgctacttatgttttcagaatagtgtacttcctgaagaacctgagctaaaatctacaacaatcatttacaggtttgtggagaagtgcaagttccctaaggatggttcatcacctaaatccttgagatacattggaaggtgatcattttttttgggtgacaatgtatataacctagctgtagttattaataggagcttttttgaccctctgttgtgattcataaaagtttctaataggatgtaatcaccaccaattaacattgtagtgacagtattgcttcctgatgatttgcagtatggttgctgatgtccaccgtacgttgctatatggaggagtatttttgtaccctgcagacaagaagagcccaaatggaaaactccggtacacattaagcctactctcggcatctcacttcgcttatggtacttccaatttcatattgataaacaattctgaattcaccaaatcttggaattacagtgttctgtatgaagttttccccatgtcattcctgatggagcaggctggaggccagtctttcacaggcaaagaacgggtacttatttcttcattcatttcatcttgattaaaacagcatgcatgtttagtattagcatcttgagttcttgaatcctgatacattgttcaaacttgttgctacattggcaatgcaggctcttgacctcgttcctaccaagattcacgagagatccccaatatttcttggaagcttcgaagatgtggaggagatcaaagggttgtacgctgcacaggcgaagtaagctcggtttgatcgatctggcaccatcaaggcgtgcgaatggactccctggccttactgtaacatgcatgattcgtcaggcacttcttttattcgtcttactgtacgtttgtaaaattcagtgtaatagtgttgaggcctggaacagcttcatgagcaactaaggccttttctactattatttacaaaatacatacaccgtgcatctctagcagctaaagcactaatacaacaagtcactaaggcaaacctgtgcttcctgtcttcctggcaaaatattttttcagttttgggtaccccttttgagtagatattttacggtccttcagaaagtgtacctgcggtgcgggtatcaaaattttacactaaaattttagtacctcaaggtagtttggcacttctattaaacacatgatcaatggcggtgaaggattgttctggtgttatactactggtctactgccccaagtgctcaatgtactgagcatacagatccctgcaaacttgcaaagatgtcatcttgctgttacacgtgtaaactgtaaactactcaatatatcgttctaaaatctgaactgatggacagttcatcacttacatggaatactggatggcatcccgagcagcggtcacaggcagtacctcattcacggcgacctccttgttttcattcttcttgtctgaataagttcagaaactacagagttagctgaagaagaataaaacattggtcagtgcagcgatttgagaactagtaggaacatacagtcttcaaagaaacgccggatttcctggacgcgatgaggcgaaagctcactgagatcgttgtagtggcggtactcaggatcgtccacgcagacggctatgatcttgtcgtccttctctccctgtctcattgaagatttagctccaatcggtcaagctggagtcgcggttgacgatgaatttgtattgaaaatggatgcggggtagaaccgacctgatcgatcatgggcatgagtccgatggccctagctcggagaaagcagccgggaatcactggctcctgcaattaaacgtttggacatgtgttgcagtgattatcgcacaatttataacagcatcagcatatacagttgaaggatgatcacctgcatgagcactagaacatccattggatcgttgtcttcgcagagcgttcgagggatgaagccgtagttgtgggggtaaaccactgacgagtacaagacccgatcaacctgtacaacaagagcccaaatggtaaaaaagttccacagagcatatggtccctgacgtgagtgtataaatacagtgtttgattacagaccatgatgaaccccgttttcttgtcgagctcgtacttcaccttgcttcccttggagatctccacaacctatccacgcaaaaccaagaagaaacgcatcgttagtcaagtgagtgtaaatccaagggaagaatcccttgtggcgtggcatgtggcgagggcgcttacaacgttgaacacagccggagcgtcagcgcctgcaaatacagagaaaaccccacggtgttagcatcggcagataggccggcgggccatgatcttcatcggcgcgggggcgcatgtttgtgagagaaggagagagagagagagagagagagagagagcaaaagctcagtgagctcaccggtgtcgaggtcgtgccaggggtgcgcggcgacggacctccgcgacagcgacgagaggatcctctcgttcagccgcggcgccggccgcttcggcttcgccccctcgcctccgtccgcctcgctcatttcgcacgcgtgttacgtgtgggggtgtacacgaacgtcccgtactcccgtctcccgtgtcgcgggctctcggcgtctgttgtgtttgcgcgcacgcaccgcatatatgcggtcgcggcgggaggcggtacgtaccacgtagccccgccacggcccgccgcttctcgcgagttcatgcggacttttcctcggaggcgactgctttgcctttgccgttgccgttgcgcctgatcgacaactggcgacgcgggaggcggaacccggccacacttgagattgctcgcttcgtggccaaattctggctctttgcacggttaatattgtgccggtcggtgcgttttgggaagatgctgcacggggtggtccataacttggagcaccgtccatggacggggaagtgacgcgagcggctctcgctgcaaccgctcacgctcctgtgctggcgtgggatgtggcgtgggattgggatccacggtgaagttaggaggtgtactgtatctgtgactttggggtattttcaggcgtcggatttgcagcgaatgaactaagatagatcgctacagtagagaacaaacagtgttgccgtacagttcggtttactgtttgtatagaggcagcctccatatgtgtcgccagaagtaagggccattaaacatctctataaaaatacaaatactatgcattatactgttcacttgatcggtgatcagtgttgttccctcgaaaaagaaaaaaaaggacttcttttatggacaccattcagtaaatatggttcagatgaacccgtctacgaaaaaaaaatgctgtcctaagcaccaaggatcgtacaaacctaacgaacagagcagattgacagcctccatatggaattttgcatcaaagctacagatagcatataatgctcaaacagaacaggggaaaatataattaattttaagtcagaattacactagaaaaagttttcagtttcgaatcatttgaaacaacacatgtacaagtaggtgccgtacatacactctacaagttgttgcaaaggatgaacataagttcagttccaaaaa

SEQ ID NO: 45099 - DNA, 1469 bp, Oryza sativa
ctgatcgtccttttaagcttcaagtattttcaattttttaattcattagcttgaaatcttatatttatttccccccattctattctcatggccctgcgacacccgcgtgttgcgcatttgtttgctccctcggtggtaagagcccaacctctctcccatctacatgaacgattatttgctaagtgtgggggctaagttttctagccttatcctagccttaagttgagccccgggtgccgtcgacgcccgggaccccctgtgctggctcttccgtagcggctggctttggtcccgccggctggctacggtacccggcctggctcaactgtagacggggattgctggctctagagttttcggctctcacagtcatgcgaaagtaatcgtccatgtagaaggaaaagagattggaaggaggccaccgaaaggaaagagcaaacagaatgtgtagcgtggggacacgggctcgtgggaacctgacctcgtttgctaagtggtcacaggcttcccatgatggttcggaacccatggtgggggggcctcttcgagctaaaggtttgtgtttgcttcattcatacaagcaattctttactataagtgtgagggctacgattcctagctctatcctagccctgcgtcgagctctgggtaccgtcgacgcccgggaccccctgtgctagctcttccgtagcggctggctttggccctgtcggctggttacgacgctcagcttcgcttgatcgcaggcgaagattgctggctatagaaagttcagtcctcacactcgcgcgaagataatcatttgcataaaattattgttgcttatatttatctctcatccatctcttcctcgcggtcccacggtacctatgtgtcacgcgccggcttgcctcccttggtacaaaaagtttgtattcgcttcatccattcaaatgattctttacttaaagtgcgggggctatgattcctagctctatcctaaccctgcgtcgagctctgggtaccgtcgacgcccggggccccctgtgctagcccttccgtagcggctggctttggccccgccggctggctatggcgcccaacttaatttaatcgcgggtgaagattgctggctatggaaagttcagccctcacactcgtgaaaataatcgtttgaatagatgaagtagaacatgaatagaggttaacaaatggcaggggcaagcgaggtacacggcgtaaggtcacgggcccgagagaatctaacaacgtttgctgaatatatacagaaaataagttcacagcctaaggtatgggctagcgagtcgccctcaggctggggcgaaaaaggcgcatgggtcctagtgccagcaaagaaagaataagagtcgggccacacatatcatcagactaggaaagtggcgtcaaccctgaccacctggggaaggttttggtcagggctacctccgggggctactgtcggtatatgg

SEQ ID NO: 45100 - DNA, 4641 bp, Oryza sativa
  unsure (1)..(4641): unsure at all n locations
nnnnnnnnnnnnnnnnnnnnnnnnnnnnnnnnnnnnnnnnnnnnnnnnnnnnnnnnnnnnnnnnnnnnnnnnngagaatgaaattacaataacatgttcctacttttgcttagatgagtttttcatgaagttccttcatatattctccgttaaaagtgaggcgccctaacattataggcgcgacaaggaacttggtggcccgtctcgacggttcactcaccgtcaagaaaaatagcacacgtacgcatagaaactcagcaaatcagatctctggatggcggacgcattagcatagctgaacccttaccgtcaagaaaaatagcatacgcacgaatagaactcagcaaatcagatcactggatggcggacgcattacaatagctgaaccgttacgaccttcacaacaaactatcctctcaacaaatgatgtgaaccaatgaagccgatggtagcagaaaaggatgtgagcaaattcaagcaaaaaatcaataccagcatctaacagacatttttttaagcttaagagtgatccttgttcacagcacgatagcatggagtatatatcccaaaaggttgacaaacatgtcaaaattccaagcgcttaagaaaatgcagtcttgaatcatcaacagtagataacaaaacgctaaagcaagacttccaaatttgctctcagcatagtgactggaatcatggaaatatgcactaagcgctaactgacagataacaatgaaaagtttactcctcatcctcaacaaccttggttcccaaacccttgagaccctctgcagggatctcagcaactgtgaccagagagtagagctcctccttggcgtcctcctcatcgtttctcttgcgagagattctaacacggactcgccttgggacactccggataccattggtccagatggccttgttaagcttcacgtcgatgcgtatatccgttgtgcccatggccttctgtgcaaacttcctgatctccttgatggcattcggcgccttcttcttgaaggtgctgtttatcagaaagaattatttcattataacgtttatttcaacaaatcaagacttttcaagattgcaaaacttctaaacaagaatctgcatttatctaaaaggtcaaatgtaatatgaactgtgaagttggctgctttataaagaaaatatgtgcaacaacaattagttatgcagtgctaaaaagtatgaaccacataagatgaatgaccagaattgattagcagaaccaatgacagggcaaacataacagattaacagatgaactgctataatacacactgccaataactatacataacagtgttttcataatgtaatcttgtttccaatgttttgcccaaatggaacacatgatagcatataaaggcagcacgtgtaacgatgagcaacatctatttaccgggcatgtaactgtatcaaccaccatatttagacagatacctgactatgtccggggcataatggatcaaatcattagagcaaacaatacttcaacacaaacaaatcacagtacaatgccatccaattatgaagatacgtgagaaaaaaaaatacggatttaaccagtgcgctcttacgaaatatcctgcccaaatggaacacttggtagcacaaggagaagcaacaaatgtaacgatgagcagagtccatgagccgggcatgtaactgtgtgcagccacaacaatatataaaggcagacacctgactatacccgattaaacacccaatcaaatggcaataaatagctacaaagcgaagctacggtctcgaacgcagatctacataaataggaatgtgggatcaaatacaagagaaggatccacatgaatcaaacccccctcggtcatatgattcctgctgtgctgtagctggtctaaggatatccatccaaacaaggtgtatcagccattcacgagcccacaaagtgctcgcaggcagcaaccctccgcaccagcaaagcgctagatccctaacacctcgtgaaaccaacatctagctcgtggatctactgcaagcgcaacaaagctcagggaaatggaggagagggagggagggagcgagagagtgaggcgataccatccgtggagacgcttgtggaggttgatggtgtactcgcgggtcaccacctcgtccttgcgggtgccggcgccgcgcttcttctccgacatcttcgccttgcgccgccgccgccgccgccttcgcgcttctctcctttgtctggctccgagggaggctgcggcgagaggagataaaccctagtcgcacgcgacggggtcacgcttttatagcggcgcggagttagggctccgctcgcgtactgggcctaactgtaccagaataaaaacggcccatttaactagaagaagcccgtttagatggtgatttccctttttccattttattcttatatttcgaactttgcagcttgtttctgattttgtgaaggctcgagttgagacgagctttgcttggattggtgttcagattggagagaacacaagtaactgttcattttgcagagaacacgactgaggccatgttagttcccacacaaaaactttttaccctgtcatattgaatgtttggacatatgtatggagtattaaatatagataaaaaaactaattacataaattgcgtgcaaattgcgagacggatcttttaagcctaattgcgccatgattcgataatgtcgtgctatagtaaacatttggtaataacggattaattaggcttaataaattcgtctcgcggtttacagacggattttgtaatttattttgttattagactacgtctaatacttcaaatgtgtgtaacaaaacttttcacatctagagtttcaaggccaagtttaatacttcaaatgtgtatccgtatatccgatgtgacacgccaaaacttttcaccttgaagttctagggcgtaagagcaattcagtaaacgcagcaactcctgtgcaacacaaccatccgaaattcagaattgtgacgcttagagagctggacccaaccaacagtccaacacagatatacatgcagctgcagcaccaattctcgtaggtgttattttgcaacagaggccgatgcactgaggtctacaagaatttgcagcagaggctgctcgtaggctagtagctgatgccattgggggagtacaaaaatatcagcattcataaacttcactgtttttcatcagcatttctgcagaatatgtttcggttctcaggacttcaggagtattgaaacaggttgtgctgaaaactatatacattaaaactttcaaacaaaacaaacaccagcaattttcactggattctttttgtttataaacaacaaaataattaattcttcatagatttaatgacaaacaatcatggaactaccaaacaacactggaatacagaagaaaaacaatactggaaaacagtttagatctcatatcacagttcaaacaacacataatacagtcaaatatggtgataactgatgagcaacaacacagtaacaatgaagccaagaggaagaatggtgtcttgtgagagggcttatgcctgtaccagagtaaagaaaaatgctgaagaggaacaaatgaaagctagtaattctgaactagcagtggcccatcgcctcattattccatacaaaactatgtcgggaagatgttgaaataaacatttcaagcatgtctcaaatcaagcaaaatggaacaaaactctgaagaaagctggatccgtaggataagatgtagatacctatgagcacaagatggcagcaatcctaacacatgacatgggtttcaaactgtgaatccgaacttgtattgatctatatatttccaatgtgttccctctgaaaatgttataataactaataaactaaatgttaattccccagccaatcacttataaaactcaaacatccaggtaaagaagaaactttctcagaagccaataagatagaactaactcaggcagtacagcttatcaacctagatacagtaacttgctcaggacatcaacaaagaaggctgaaacaacagtacaattattgttatcaccaaacacgttagaggtacggttattagctcacctcatttcttaactcaatcagtctcaagtggtagagcaaaaatgagtcaatgcagctacttatccatcaatagattaaacaacagaaaatgtgaccaatgcacaagattataattttcctggaatcaacatcataatagaggaggaatagtcaaatagaggagccaattagacaacaacagtcacaaagtaccaatcaacctacgcttgcaagaattgtccaagaagaaagctaatccagtatctaccagttaacacattcccacagcacccagttggttttcttatcagcaaacaaaaatgatagaacatacgaacttcagtatcctatatgtgaatcaaattgtcccctcaagaattaacacattcgtaaatccatgaaaacatcagagatcagagttaacgaattcgtcaaatcagcacaataacaactagaaatgtcatagcatatctgaatatgcttaacaagaacaggcacaaattggggttaacatggttccacggtcaagaagaaattaagtatatgtcca

SEQ ID NO: 45101 - DNA, 16879 bp, Oryza sativa
  unsure (1)..(16879): unsure at all n locations
atccttcgatccgatcagatcaaggaaggccaagtgaggaggcgcaaaccaggccaactcagatggcggaggatgcagcaccggcggcctcggcctcgagataccggcagatccgctcgacgacctccctccccttggcgctgttctgcaggaatctctcggcgcagcgggtctcgaccttctccgcgacggcggcgagggccgagagcggtcggcaccggatcgtggtctcctgcctgaactgcgtccactcctcgggccgctccgggtgcggccggtaggtggaccgctcctcgacctcgatgaggccgcggagggagacgttgcggacgacgacgtccatggcgcggcgcggcgcgtcgacgagcgaggtctcgacgcagtggcagagcgccgcgccggacggggacgacgccgcggcggggaggaggcggcggaggatgaaggggagcggcggggagcgcaccgtgatggagcgcgcagcctgcagccgccccgcctccgggtcgacgcggcggtggagggtgtggacgtcggcgacgtgggagagcgccgtgcgcgacgccgggtcggtgaacttccgccacgccgccgccgtgacgcggtcccacgggtgccggtacacgtgctcctgcgtgtacaccaccatggctggcttcgcttggggcggcgagcagcgagggttttttctctcgatttgtttttctttcttgcggcgagggtttgagtttgctcggtgcgggcggcgaggcgaggtaggaaaagggagaaatggaaagggaagaagacggaagaagagaaaggcggttttctgtaaaccgctctctggtttggaaaggaaggcaaatccgaaccaggcggcagccgctgaacggtgtggccggcatgtgctccgtcccccgtctccctagcgtttttcccttgctccgccacgtgtccagccgcaggatcctatgttaacccgcttccggtcctggaaaacggaaagattggagaccgtgacattatgtggaaagcggattataggattacgccttcggcttgaccggaggaggagacgacttctcttgcgccgccgcacactccgcagcagagttgctctcccatggcgatctcccacctctcccgccgcctcctgagccccgccgccgagacggccaggcttctccctaagccgcatcccctcctcttcctccacccgcaccgccacttctccgctccctcgcaacccgatggcggcggcggccccgctccggtgtccccggagtcgatgaagcaccaggagatcgaggggcccacggtggagcgcgacacctcgccgctcgcggacgagacgcggagggagctcgacgcgctccgcgccgccgtgcagcggatcagcggctccctcgcgctcctcggcggggcgcacctcgccgcgggcgcgtggatcgcatcgggcgcggcgcccgtcggcgtggggtcggccgcggccgtgcagggggtggtggcgttcgcgttccccttcacggccgccctggtgctgcgccgcgccatcaagcccatcgccttcttccagaagatggaggccaacgggcggctgcaggtgctcacgctgtgcctccaggccacgaagaatgtgaacctcatgctgctccgaacgcgggtggtcgccatctcgtgcgctctcggggtgtctgtcgggtcagtagctacgatcttgatgcggtgaaactctctaggaaggatggttagtttcattgttcggataataaaagtgcactggtggtaggcatgagagtctgaactatgaaatttgggtgcttttggatgtcgatcattgctagagtaatttttttttgtgtatgcttacactatcaaggaaatcgtaatgttactgtctcgacttttacctgcaaatgtagagattactcttcctatgaccactatgttaatggaagtcaaagcaatgttacaaaataccttgcagagctaaaccgcaaaaggttttaaatgttgctaagtgcagtgactttatgttgtatcgaagtgcttctggcatcttcttatttcctgtggatttttgacaaaccagctctgtgttacttgttagcaacttagcatggttgctgtgcctgtggtgagcagtgagcttgtaaaaacattttactagataccatttgcctgctgactcgtttatggctgaactgtgttttgaaaccatcatgttttgtcaagttatcatcttgcactagacagctattggtacctagtgaggtgagaatgcatttggaaagctctttgtctgtttatgttttcagttcacagctcatttttatcagtaatttgagtctttttaggttgatttgtgagctgttgaagtttacattgagtttcacaagagatcaatatattttcaaaagtcacaagaatttatcaataaatggctttgaattgatgtgatttcgtctactgaaattctcagcattgctctatgtattgacacgtttctatttgtgtaaatttaaaatggtttgttattcaatgtccaaatgatagtaaattaatttgtttgttttctatttggacaactgtttttctataaagattagataggttctcctattttacatcttattggtcacattgtcatatctatttttgtagcttgcatactgaatctctctcctatttccaaatagcaaacagtattgggattaaatataatccaatcaccccctcactgagctgattttgtttctttgcaagatgattagtgatgtcttgattagtgatggaaatgtatgcagatactttctttatgagaccttgtaagtactgttgtaggtagaacttgaattatcaataagtttttaataagttctccctatctgcagcactaacttgaaggtagtctttagcaatgttgacatgacctaaaaggttggtttttattttaaaaggttgttgcttttaataaaccgtgagctgtataattggaactttcccactgtccagacttgccttatgaatacaatgaggtttagctttgcataatttatacaatctaaaagtttgattcttatcccttaaataaaaatatgcttttgtagcaatatattcaacaaatggtatggccatataggccttgcaaatcctgctaggggaaagtaagatatcgcagactacagtcctggatgagatttttacaggtatcctgatacctgagaagtttgataattttctgacaagatttccatgataaactagaaataatctggagtagtagttctattgatgggaaggcatcatatatactgatcatttctgtagagcaaaactgatgaaggcatggagtttatcattattaataaatatatacagtacgctgcactgtgcttaacttgtaggtttggtctaagtggcaaactggtaatgctgtatacagaatatgcgtcagacatcctctatcagctaggttagccttcctctgataaatagaattctgtagggtgcagtggaatagcctgtcactttccttttggatgtgacaaagtgtcactttccttttggatgtgacaaagattcaccggcaatattatctgctaattggtaagctcttaacagttggcctagttaaaatagctctttctgaacaagtagataaccattgccattattggtgcctttctattactataaattggcattttggctgaaaggaggatacacattgatcaccttcagcttcccagttcctaaactttcaggtctcgtttcatctttggttatgtcagactgttagcattccatgtagtacatcatctttagtttaggtatcctccttgggctgagatcaagcctatgccaccattatcattttcctcttgcacaagggtgggaaaatccttatgttattggttataatgttcttgaccttgcaaggccaaggtaccagctacatgctgggggatgggtgaccttggcacctgcctatgatgaagtgtggctctttgctttagttgtctgctcttctgtaatctgtactctgcattatttcaagatgaattgtatcctctagattaatcttctgtttccttgatgagttgcgagtttgcgacattcctgtcaagctgatacatttgtcatggttaacgagaaagaacatatatggtgtatttgtttctgaatcctgcgcatggcagcatgcttctttgtctattgttatcattgatatgacttatgaatcaattgtggtggtcattctgaatcacatgctctacactctcactaagtaacatgactcgaaagcaagttttttttttggccactaagggatacagcatcgcagagactttgtcggaaccttttttttttccgattagtttcattctttctggtgcgtgcaaataagccaatggcaaagtggactgatggtctgatgtcaatgttgtagtgagatgtttctccttgtctttggcaacagagtatcctgtgttttatttcctttccgctgctggagtagttgaatctgaattgccaatgcttatttttggccgctcagttctgtacttgtgcagatcgtgtgccccctttacaacttttgttcagagttttatttacttaggcattgtttcaggagagctagcaataatgcttagtaagatttttgtgattttcttgatctaatgaactggggcctattttgatctgtcagttcgacaaaaaaaaaaaaaaagaggaggaacatacttgtggaatttagttgtctcgggtgatattaagccaccacatatcccttatgtatgttttaacggaatttgtaagtcttttgccaactgcaaagcggactaaaattacattctgttcgaaggaactagaatgatttatattggcatgattacagcgcaatttgatgtcactggccttctgaaaatcattcccttccaggctgttccatttggtcctgcttaattgtttgtttctgagtgttatggcaataattaatctactgcgttatggaaaaactgaaaagaaatttagcagttatatatacctttcagtaatccaattactgaagtacgaaatgaactcgattttattcagatacaggcaataatacgaatgccaatacggcaatgccattgccaaattaacatgccagtcatgattgatgcgcgtctcctagaagatgaacgtcagaacgtgtgtaaccgaatgatggtgaaatcaaacgaaaatgcgtagccagtaattccaatatcttaatttaatccaaacaaatggtgaataatagtacaatatccattcccttcaaatagggtggacgaaatatgagaaatcaaagcaccgaaatcaaaccggtgcatcaaaaatacaacccattataaaaagagaagaaagaagacgaggcatcaaagttggcacaaatcaaagcacccacattatcgcgcgtgtttggatcggtttagtagccatggccatgcatccatctcctcctcttcctctcttcctcctccggctgggctcactgcaggtagtaggcgaagaacgagaccacggtggcgccgagcgccgcgccgatggccggcgcgacggccgcgggagcggcgctggtgggcgcaggagccggggcctcggcggcgaacgccacggtggcggccgaggcggcgacgacgaggacggcgcaggcgatcttcttcatctccatccccttcctctcgaggttgctccctcgcgcgcgcgcacggtctcagctggaaccgagcaggcgacggcggaaacggaggcgagaggaagaagagatggctactgctgctgctgctgctgctgcgctttgcctgaggagggagatgagccgcggggacggggacaatttatagcgggattagtggggggctaattcggggatgcgagtggccgccatgtggaggctcgcgtacgtgcctgcatgtgtgcatggtgaacgggcggcttcgcgcggtgatctctcccgtttcgtgcagccagaggcgtccacgttgtgtgtgtgctttggtttggtttacctctcatctctgaactttgaactggtcacggttgattaagttgcaggctttgcagctaacgcgcgcatgtgttgttctagaacgagattttttccacgagtcattcacttggccgagtcttcggcgaccaataacttgggcaatttgggcgtgatttgcagtgcactattcaccgtttcctttgtgttttccggcccctactcaaactaaaagcgatagcgagttcgttcgttatcaggaggtgttgcggagatttttattagattagagaaatgaagtgttaaaaggctggtnnnnnnnnnnnnnnnnnnnngtgtttgaaaattcatcggtccacttcatgtgatcctctttagtctttaggatttaaaagtgatatttacactgtagcaaaccccatgtttgaaggcttgaagctggcaaaaagatctttaacaactttgttcaacttttttttttgcgaggaacaactttgttcaacttgatgctatgataggaggaagcttggtttggcgctgtgcaagccttgcaaaatacacaaaagccagttcaagcccatggcgcatcaacggtgtcatgggacccatgaactagctatctacctagcatgcgtgccagctcgccaatcaacaatgttccatcttgatgggtccagcaacacgttctcgccaatgattttgcgattttaatctaacgtggaacaaaaatcctgtccccttgagtatctgaatcattttcttttcattcgttttgcctttttttttttgccccttggataattcagagcacaggacccagctctccgggcgcttctgatgatctgcagaagtgcagagtaacgggataaaaatcccccaaaacttttcgatccggccatccaccactttcgcgtgatcagggctccggggcacaaaccaacggcccagggtctcatcgtttggcttttttcgtaacaagccaaaacggcttattagagaataaaaatgtatttataggtaaaattttatatatgtgttctcggtgacttaaaagccaatgctgaaaaagaaactatgttgaaaatatctcaaatcaatataaaaattgtgtttgaaaattcaaacattggctttttctttgactgaataggccatcctatggaagccctaattttccaatcaacacggctagccctgtagtccatgcctccttgggttgtgttcttccccccattttcccaacgcaactatctcgttttccacgcgcacgcttttcaaaccgttaaacggtataatttatgcaaaaattttctatatctaagttattttaaaaaatcatattaatttttttaaaaaaataataataaatacttaattaatcatgcgataaaacgaacttcgttttgcgtgccagagaggaggggttcctaaccccctcctccgaacacatccttggtgggtcgggggccttgcctcgtgccaagctgcaggcatcgaatgtgaggcggctcagccaggaggagttgaggcctagggtagataagaattaataagagcatatccaacaacatctctaaatacaactttctaaatacctatttggccagtttgccaaagagttggagagtcaaatttgcatttcactccaacgatctctctattaccttctccaattttaatagtgggtcccacatgtcaatctctaccattcttcatttctcttcacgtcattccctttccccaccctcccgccggtggatgcgcaggtgatggcacagcggctgctgctgctcgaggcaagagggctcgcggcgatgcttggcggcggcaggggcggtgatgcagatggcgccgcaccgctctaggaggcccctggcccatgtggcgcctgcgtggaaccccttggccgcgccaacaacagcctccacgtcgcaggcgacgtccggcgggagcttctggaggtccgtgaacaagggttcatcctcctcgccatcaccaccgccaccggcatggcaggaattgattgggacttgcgattcgttttcctcactgtgcgtgtcgtggtttcgccttttgcggtggcgacggctctacgtgaccgtggcgcagcgacaatgacaatgactgccgcggcgaacggtggcccagacgacgatagtcgcggcggatggtggcccagacgccggcggcacgctcgtggccggcgtgtcctccggttcggccccggccgatgcgctcaagttgctgccttgctggtgggtagacagaaagagaggaaggatcagactaggagtggtggtgggacctacctttggccagtggaggaggctggctacatttggtctgtcggaggagcaatttggtcatccgaatgaagaatctgttggagctcattttttctctgtgttggtcaaatttctgttggagatgctcttattttgtctaaaaataaatggagtaacaacttagacataatcaattattacgaatatcggtatggttcgtagtatcaagttatatctaatttagttgtagattattttaacacagaaaggtaatggttgcggttattggtcgatcggcggggcacaccgccacagtcaggttgaagcagctcgatccatgcgtggcggcgagatgctgccgaccgaaacgttagggtctgtctaagaagggcgacgaatcggtatggaagagactgatttgcataaatatcggagatttaaatgcataagttaggaccgctcccgcttgtaccgaattacccgatcctaggggttctatttgcgtacgattgatagcgattcgaattagggattcgtttgcacgaattcatattcatgtggtcctctgtatgggtaatcctactggaagccgtcggatcagcacgacagtcgacagcacctgtgagtcctgtgacccttcggcggcggtggaagaatcatcaatcatccgcgaggatccctggggcggagctcgatcaacccgactctccgcccatatggtctcatgcattcatggtgccgcacggccgcgcgtgaatgaatgtaggggacaccgggacagcggccaacagctgcctcccggtcactaatcatcgtttgttcagatttgaaatcaagtctattgttaatttcgaagtgctgggagttcacagttcagtcgggaagacaggacctctcgtgagcaaactagcaaattgaggtgtaatctactaatcttgtattagttatgtactacttgctcctttccaaaatgtaagtcattctaatatttttcatattcatattaatattaatgaatctaaatagatatatatgtctagattcattaacattaatatgaatgtgggaaatgctagaatgacttacattgtgaaacggatggagtaccttcctcttaaaaatagttatttttctagtatttaaaatgagaaaaatggacatttggccacgttcaaaaaacggtttcgttggaatgccattccgaaaacgcgtttcgctaaaatgccaacatggaacgcctgaccacaaccactttgccattttctcctttttggtcattttcaattccattttttttgctggaatgcagcttgatgagaccaaattgccgctcaccggctgaaaggggatcgacatgagcggcgacttgctcgcggcggagctcctcatcgaggcgagagcgtcaagaaccacgcagcgtctagccccctgagcaggacttccacctcggcggtggaggtgaacacaacggtgtcgagcgcggcggcgtccggggaggccaccaacgcctccgtgtagcgcggccctgcccagcacgtgacgtatgccggcgcgcgcacggtgatccacccagtcgcctctagcccagcaaggaatccggcacgagcggcggctcgcgtaggccgatgatgtccgagataaggcagagtacgcatgcgcctgctggacgcgctccccagcgcctccatgaggctggccgtggtggggacgaggaccgacacgctcccggtcgcgtctccgtagaggctggagaggaacgcggcgtcaaggaggtccagactcttgaaaacgcggtgccggagcacctactcctgctcgtcgaggacatggacgatgtcaagaggttggacgacatggagcaagacctgctcctgcgcattgaggacggcgtggtcgccgccgccgccggcgacgaggcctgggtggatgacctagaggaaaggaccgctggtctcggtgagcagggggcaatttggtctcatcaagccatattccaacgaaaatggaattgaaaatgacaaaaatggagaaaataacaaagtggctgtgatcacgcgctccatattggcattttagcgaaacgtgttttcgggatggcattccatcgaaaccatttttggaacgtgaccaaatgcccattttctcatttaaagtgtctctcaaaatacttatcactcatctatcaccttccattcaaatccctctccccccaataaataaataaataaataaatagtggatttactcctccctctttccccaaatatgtgcaactcctaaatggtagcttgcatcgatgtcgattttatgcgacaccaatccattccttgccaaaaatccaatcacccatgggatccaaggccgcctcttgttaaataccacgatgtagaacacttgatttttcgttgtttttgctcgccaaagttgttgtttggccgatgtcatggaaaacaactacatctatctcctctcctctcttttccacgtcaacgattttgttttgctggtaactgagagatagcaaatagaaacctttgtatgtgtccttgtaccctcctaacaatatactatcattagtattatagtttttttttaaaaaaaacttaatatatgctaaagtatttagaatgagtagtatagccggaagaaattttatgacagaaaacctaacttctgttagataataataacttgcccgtcagatttgcctccctatcactattgttcacacaatcacactgaagtaggagtaggacgtgactccggctcgggcgcatgatgggaggaggttaaaatcggtgctaacgtcattatccgatttacgtgtaaaactattttaaattgatttttctcttaaattacttatccaaatcatgatccgattacaccattaaatttgttgcaattaaatcttcaaaataagactacacatggatatattccgatgaaaaaaattagcttattattgaattatttttaaatattgcacgatattccaccaggtatatcggaattgtttcactaagtagatcgaaaatgtttcacttgcttaaatcgggtattgtttcaccttatataaaacaatgtttcagcaaatagctaaagaatgtttcagttcactgcaacatttgatccatatatagtgaaacattataagtacactaggtgaaacattttttggtggaacaaaaaatgaaacgaattctcttaatagggagtttccaaaatatgtgagttttttttttgttgcaatagaatattttagtttactgcaatattagatttatacatagagaaatattgtgagtacactaggtgaaacattttttgtggaacaaaaaataaaccaaattatcttaatagagggtttccaaaatatatgggtgatttgttaaaaaataatattttaattcattgcaacattagatctatatatagtgaaacattataagtacactaccagaaataatatttttcgtgtaacaagggcagtaccagaaactcgtgtattgtcctggttattcgcactgtcgtcttgctggtttggtgtgtatttgtacgaatcaactacttttcaagctaacttgcaatggcgacaagttatctgtaattctgtagacgatcttaactgtttacctcggctgaagtcttgtgctaccgacaagtgtacgcaaaaatcaacgacccatccatcgacgctggcgatcacggcaaaacgagggacagaacagattcagaatgtcttaagtccaattactaactcctgatctaccggccggcttggcgatgatatgcatatatacccgagtgataaaaatcccctaaagatcgttccagtattgtcgatcgagacatgccatcgtgttacaagatcgaatcgatggagcgcatccacggccacaagctgagaatcgcgagccgactactgagacggacgtgctctctacctgcagctgagccctccctttcgccctggcaacttccgccgtgcgaccgatcgatcgattcgacgacggcgccgaccggcttccgccgcacgttcagttcagacacttcgagtttttttttcttttttgcggctcttgcattattcagacccagttcagaaaactcagcacgaaactgaatggacttttaggtgtaccaacacttttttttttatcttctctttgtagccaatgtagcgtacagctcttgcgaaggaaggaccgatgaaatggatgcaggtgctaggcacatttcacggtcacaacctcacacgtccggtcgatcgcctcctgtctctatcgcgaaaaaaatacgtgacatcttctgcgggacaggggcgcatgtaccgtgattgaccccaacacacactacgctacgttttttactagtcggctcggctgctcgttggaacgttcgttgcggacgcacgcgctacgagccaacgagaggaatcgtggcagtaaagcgtcagcgtacgcatccgcgcgcgacgactttggaggtagacaccgtgcgatcgatcgatcgatcgatacggcaggtggccctgtgcatcgcccgtagccgggcttgtacgtctccctacacatcatgtgcacagcttttaatttttttttgtgtgcgtcatggtgtggtgtgtgtcactgcgtggcgcacgaacgtacgtgtacatgtacgacaacgacccttgacccccgagcaaaaaagcgtgggagacacgcctcgtactcgacgttaaattaccattctactgctagtcatcgcaaattacaagtggtatatagtactacaaacgtatcgttcgtcgactagtattgctgtaaattttagccgggattaatacgtgtttgtgcttggcgtagcatggcggctgatgaatggtatggtgtcggttttagccggggtcgtcgagtcgtgcaggggactcgttgcggttggggcctcgccaatcagagggcctccggtcggttgggttgtgggcgtcagtcgtcagacccgacgagtggtggggtggggagtcgcgtgcccgcgccgagaccgcctcgcgtcgcgccacctgcgccaccctcgagcccaacgtgtcgcggagaggcccaccacgcgtcgcgcctacggcgccaagcgccccgcgcgcccggggcggcagcctccgatcgcgtcatcgcgcgccacctcgatatataccccactacccatgccgctaccgtttcaccgctctctctatctctctctctctccctgccaggtgcttctgcgtcgcttgccgtgctcggtcattcctgcgatggcatctagaggcgccgtgttggtcgccgtggccgcggcggtggccgtgatgttcgcgtcggtggcgtcggcgcaggtggacgggggcgtgccaccggcgccggcgccggtcacgggcgcggccgcggggggcgcggcgtcggcggcgctggccgtggcgtgctctgccgtgctgtccatcctcgtcgcgggtgggatcatgcactaggcaggcgcgcgaggtggtgatggatggaattggttcgttgatgatctccgatttggacacggctcgtttcgagtcgtttccggctatagagtagtactagtagcagtggttgggttgggtgcgtttccgagtgaggcatgttgtgtttatttcttattcatttgtatcatacattggtctgtgtgtgtttgtatctctcttgttgctgtggattctatgaataaagatggatgatgtgtcttcgtctcattcgtcactaatttcctctatctctgttcatttacatttcagatctttcctgcaacatcgaccctgttctcttttatgattttgtacaactatgcaatgggtcaattttgtacgctaatcaattttctctatactactctgcacacagcacagtcgtccacctcccatcgcccgccggcacttaaaaaaccagcgaaccgggaaaagaagttttggcccctttcacctcgtcattgtgcaacttcgagcacgattaacctgggcgaagcttcagtgttaatctgaccttttcagcgcacaccgaaggctcttgtagcccaggatttagtgatcgttcttgtcaattgtcataactgcaagcctgcaataaccttatagggcccggtttctgcgtggggcgtttttcggtgggcttggatgtgtgctactccctccggttgataacgaaacggccttaaaagaacaactgtaactttttattttctactacagtataaatataaaaaatcaatagcctttattttctactatagtataaataaaaataacaatagatatatgattttatggatgttgaagtacttcttaaaactaatttatacaaaactaattttacgtatggtcttcgtattttagaaacaaaagttataaagtttgattattttattttcaaaacataaggccttgtttggtttggagggggttaaagcggattggaggggtttgagggggagtaattccacaccataataggtgtgaaataaatcccttttaatctttctctcgggactaaccgaacatagtctaaagtattactactatatgactagagggagcatatatactgcaagacgagagagttgcgaacggttatactaaccttgtattatgagtaatatgtttgtatttggtcttaggtactactccctccgtcccacaatataagggattttgaatttttacttgcaacgtttgaccactcgtcttattcaaattttttttgcaaatataaaaaacgaaaagttgtgcttaaagtactgtggataataaagtaagtcacaaataaaataaataataatttcaaaattttttgaataagacgagtgatcaaacgttgcaagcaaaaattcaaaatcccttatattatgggacggagggagtactccacaaggcaagagagttgcgagttactctctccatccaaaaaaaacttacatcccttaataggttaagttttttttttgggacggaggaagtacatcatgatgacaaggttgtaagtactgatgtataagggctaattaaaggattctatgcatgaatttcatagcattaaaatcatataggacttttttttatgtgcctatttgattcactgattgaaacttttcagatactatagaatttatatggaatggttcattttatatattttttgaagaaaacttagtaagagctctaatcttgtgggaaatttttagattcatgtgtttttctacggttcaattaaacattcattcatgtgtttttttaatattttgcaatcatttattttacatttatattcatgtcagaattttgtgttttgttatatttatccctatttttttaatattgcggctcaaaatattcctttgtatgactagatgtttgcagtgaaagcagatgtagaaccgtagaagtttattttattgttaaaatcaaccgttacagaatttataaagagaagagggtgctcattgcacactagtgaaatggatttaatcacctctcatatcttgtctccaaattaatcttgttgaacgcgtacaactcagaagacacgcacacacgcccacttgacccaaattagttcccagttattcctcctctgcataatactcattatgacgatcatccggcttaacaggaggttgcttttgcagattgcaatgttacaaagacaagcgaaatagtaaaaaccactgctaaaatgaagttacaaggaccttggtgtgcctgtatagagtaaaaaaggaccctgatatggatttgtttcagatgcaatctgcgaaggacatgcggatacagttaaaagtttttaatgaagtttctaataactcgcttgaaaaaggaaaggttcaatacaaacagaacgttatctccgcgatacaatctacggcagcaggtaggagacgggtggaaatcaagcgagagatcgaaatcatgaaaacagttgacgaaaaggaataagttcaccggaggtccctcaacttaacaataagatttttttggatccattaaccacaaaaaaccattcactcaaagtccctaggcagtatacatgggtggtttcgctgacgtggcatcctagtcagcaaaaataattaatattaatatgtggggcctacatgtaagtgagacaatggtgtgggtcccacatttctcttttttttttttcctttttctcttatcttctctccgggttctctcgagcgggcgcggcgacatagggggagagagaggtggccagcggcggagcggggacgacggcagcgggagagggagagagaggcggtccgcgatggcggcgggagaggaggagaggtggcggtctacacgatggcgagctcggcggcggagatgttcgaacgcgccgggtgctcgacctcgggccccgccgccggcgagcggcgcactctccctgtcgaccctctctccctcccttgcctactcgtcctacactgccatcctctccgcgcactcttgccacggccgcccctgggaggccctctccctcttctccaccttcacgggcgcccgccccgacgtcgcctcttttctctcctctcctctcctctcttcttcttcagtgaggga

SEQ ID NO: 45102 - DNA, 27676 bp, Oryza sativa
tgccaccctcccatcgccgctccgcttgccaaccgtcggcctccctcacggaagaagagaagagaagagaagagaaaggaggaggaggaggagaagaaaagagaagggaaggaatgtgcagctgacatgtgggccccacgtactttttttattattttttttgctgactaggatgtcatgtgggccccacatactgcctagggaccttaagtgaatggttccgtatagtttaggggtggagaatttctagttttgtggttaagggacgtcaaataaatctcgatgttaagttgagggacttccggtgaacttattcctaacaaaaatatccaattttgttgggccaaattgggataggccggaatccaatccttcagacgtgaaagattgcagctcatctaaataaggcccatccttcctagtcatcgcggctaacgtttcatgcaaataatgtcttccttcatcctgtaatcacatttgcttgtgttgggagacttggagccggagggcgacggtcgctgaatattatttgggcatcagaataatttagggatcatgcatgggacaggtaaaactcaacaacaaagttcaacctgtatggtgttacgatttttctaaatctatgacaagcatgacgtccagtctatactttattgaatagaaataacttatctagattaagagctgtgatgccattagtcatggaaaacctacaacttgtctggccaaagatcataagagagcctattctatatcatcgagtttactctaattcaatgatttgtcatcgattttgcctctctctattatataccatgactctgtcagttttttctacaatatgcattgggggtgaatacttaaaaaaaaacttcaaatatccttcaaatcatagaagggttgacaatttataaacccactataagttccaaaaaatgcgaaagtttttacatagcctttttatacaatatatgtaggaaccaaagatagatgcatatgaaaaataattgtgtattgcatagcacgtgaaagatggtttacataaaagaacatcaacaaaagatacttatattagcataaaacataaacaatattttcgaaaaatgtcagtgtaaattgaaaaccttgaaatgtgcaacacacttctatattttattagaaaggcatgtgaaagctttcatattttatcgatcttctagtcgatcaatcaactatcaacccttctacatctcgaagggcatttagggcctgtttggcagggctcagctcccagattcaacttacctggagctggagtccaaccaaacggtccaaatatgttcaaagctggagcggagcgcatggaatcgctctgagaaattgaactggcgggttggagcggcattttggtcgctcctgaactccaactccaaccgcgttatagaattgcccatatattttcgatgaaattacccgcaaatgccatcgccctaccccccatccctctctcccgtaccgcttcaccccgtcttccccgacctccagctcgcgggagcgaggaggcgaagcagcagacggcgcacggtggaggaggaagcggccggcggtaacgacgcaccggctggaaatagccggcgcatgggcttcccctttcactgtcgctcccctccttcccatcccggcgcacaacggctgagggcgagcacggcggcgcatggcggctaatggggaacacgggggcgcacggtggctgagggcaagcacggtagcacaaggtggatggagacggcgcacgacgaccccaaatagcggcacggtattttctcccaaaccctagaaatttccctcacctcttcccttcagatttggttgagtagttgttatcatgcaatgagcaaatggggaagtttcagatctgaagacttgtctagtgatgaatggtaaaaatgcaatgagcgattgggatgtgtgaaatttcagagcagtgatgaactatatagtaactttttttttgtttagtgttgtaccttgtgtttacaattatatacacacttggttggaattgagcaaatcagcaaatggttatatacacacttggtttataattctttagtataaaacctagcagtggaaagaatgtccttttataggaggataattggattgggggcatacccctggctgagcaattgggagaaaaagaatagggaattcactatgaaatctttctatgatgccatgagaatacatggactgagggcctgtttagatccatttggaatggcaatttgcaaaagttttgatgacaaaagttttggcattgcaaaagtactagttggtgtttagatgcatgttaaagttttgccatttctagcactaaagtgagagagagaaagagagagggagtggtcccaaagcactttttggcacaatttgctactatggactagcaaatgctaaatgccaaattgccaacttttgctactagtgtttagatccaaattggcaaaaagtgctacaaaatggcaaaacttttgccattttgaaggatctaaacagggcctgaacttcccacacaaaagaatctagaggccctaaggcacccctgaaagtggaagtgtccatgtggctattaaaaacacagcatactaacaaaagatggtccaaaaaatggggttggaggaaaggaagctatgactttcaattctgtgatagatttgaagctatacaatatctttttatagattgtccttaattgattcatggggtgttttgctgacctcaatggaaagacaagtcacaagtgagattttcaaatcaagatttggttagagggcacccctacgaaggattcaagattgaactaccagaagtccctttttttttgccgtcatcactgttgtccttgctttcacttgttagtttttcagatatgtgataccgagatgtttcgcaaaggttcagttggatgtaaagtagcagcacaaaacttcagtgggttatgagatgtcggtatgactgagagactaatactattgttggtttttttgcttggagctgacctggacccttgcttgcaagcaaggccttgaacttattcatcgatggatgcattttaccttgtatacgcagcacggcgacagcggcggggtcagagcacggcaacgacggtggtgtgcaaggtttccagatctgtgtggaaggtatctgcactgcaacgacaggttatagcatttcattttgcaggttagcagctggtgaactgcaatctatcaagatttcacgcctgccttcagttttatctgttagctaatgacagctagtgcacctttgtgttttttctgctctgtgtattctgctggtttgtgaatagattactatgaatctcttggaaagtcattgaaaattgtctggacctttattgaaaattgtctgaacctttatcaaaaattgttgtaaattcagttcatcagtcatgttttccaagtgattatctgtgttgtgattctgcatgtggcagctgcacatattgcgatttggtttgatatcttgcaagagagaggccaatactttcaggatgagataacataaagcattcatgatgatctagctggtcatactgcacgatgatagaccatattactatatgttattttgtggtcttttgctctatcttttgatgataatgatgctacaagttgttaaacatttatattactaaggaaaaacagcatattaatccttcatgaagtaaacggcaagaatcacaagggtggtattgtccatctcctccctatcctctctttcagaattttaggagctgaccaaatgaggcaaacacttttacatcatcttcggctcttacaagaggtagctccagctggagttagagtttggagttaggatctgagagttggagctttaccaaacatgcccttaataaattgtttagaagtatcgacccaatgacatcttattaaaaaaatagcaaagttagtggtatattataaagggagataaagtcggcggtaatttgttaagacagagttaactcagtggcacgaaattaaattattttgaagaccattctcaacttatacatccattcaattactactcaatccattttccaatctcccgatggatcatcaaagttgatgttctcaacctagcattagccaacacttgattatcatataacaatcaccgttcatgcacatgttaattgccctttgaatcgaagaatggacggccggaactcgaaatcgaaagaaaattattcctccttccgtgcataaacaaactagcattattgggcaacaaatcgcaacagcctagctgaccatccagaaaggcgacccgcacattgcaaccaacttgcacgttccgcaccgcaccatcccatgttccgtgtccaccattcacaccctcgctccaacgcccccaagccccttcgcgtagcgctcgccgatctgaccgatccacgcatgcaacgcacggtggcatgttcacaaacgaggcgcgcccatccgccgtgcagccaccaacacgccacacgctgatacgcatggccgagaaaactaacgcaccaaacaagcccacgacgcgtcagcggctcaccgcccgggtgagcccacccggcgccgttcggtgcgcgtctccacgcagcggatcgggaggatatcgcggggaacccggcatggaacgaaccagccactccaccaccagcccaccacccacatggccccacccccgcggccccgcgcgcgggcgcagccaagccgccgatccaccaaccccgacccgcaccgacggcccagatcgcttacccacgccgctgcacgcgtacgcgagggttggagccgcaaaattccagcgtggaatagcagcacggcatttcctccctctctctctctccacgggaggcggagataaaaaggcacgcagccgctccaagaaaccctcgcccccacgacgctcgctctctcctctctctccctcttccgccgccgcgcttggggaaggaaggagaaagcaagccatcggcccccgcctccgcctccgaagggtgagctgctcccgtcgtttgcctctcctcctccctcctctcctccttttttgggttgtgctcggtggagacggtgatgtatatatagatccgtggatctggctgtggctcgcgcagatctgcttgtttcttccaagtagacttgttacgcctgttggtgttcgagtggtaggagcccttgggcttttccaggttcagatcgacgcctccttcctctggtatgggaggatctcctgttcatctgttgactgggtggtcggttgcttagatctgttctatttctgctttattttgtgcatgtattgtgtggtttgtagggttatggctcccctgtgcgcggatcatgtgggtttgggtttcgtttcgttcgtagaatctttggatgttcgggttggctccgaatctgtagatcggaaggtcattggtcaggtggggatggtggggcagccaaaagggttgcgtttttttactggttttctttattttcactgacgtcgactagatctggtcgtctcatgtgcctcagatgcgtgatctgaacgcacacaacccctccaaacatgactctgtttctcgatttgatctgaccgtgaccgtattacagtaacgatccatccttgtttataaacttgtacagatttactagtataatcctgtgtttcatgcatgctagttttatacttctcattacctgttggtagaatttaataatgtgctctggaattgcgattccttttgctctgcacaaaaaggaacggccctgcttggacagggaccatccttttctgcgacctatttaaagttctcatggtgcgtcgtgatggtgatgtgcactactgtgtagaacaccttatactgtttgtcatcaggagttccactgcaatttttaatacattctggatgcatttttgtagagactgtacaattgtgtaattacatgcttatatatagttttttgggcttttgttcttggtaaatatcagtttattagctctttccgtttagtttcttaagcactacctctgtttgtacaccatgatttcttctaatgaatgaaatatctcaacaataaatctttcttctgcactgtctgttcgtatgctatgatttcttttgagtgaaatatctgaactacaaatattttgagtgaaatattttgcctgtgatcctggatttctaaaccagtactgttgccttttatgatgcaggacattgttgctagttggtgatggctgagcaggctaatcaaccgactgtccttcagaagttcggtggccagttccaccttggctccagcttttctgaaggtgtacgggctcgcaacatctgcccatctgtctcatcctatgacaggcgctttaccacaaggagctacatgacccagggccttgtcaatggtggcatcaacgtcccaatgatgtcgtcctctccaatttttgctaatgctccagctgagaaaggtggcaaaaacttcatgattgatttcctcatgggtggagtgtcagccgcagtttcaaagactgctgctgctccgattgagcgtgtgaagctgcttatccagaaccaggatgaaatgatcaaggctggtaggctctcagagccatacaagggtattggggactgcttcggacgcactatcaaggatgagggttttgcttcattgtggagaggaaacactgccaatgtgatccgttacttccccacccaggtaacctgcaattttcatgatggtagccaaatttatgttttgtatattacactttggaacatctatgtaaaacacctgaacaaagcactacgttttgatgttcagtagcctgtgtagtgattctatttaccttacatgtttatcacttattaagaagtttgaatcaatcaaaatttattaagaaagaagagttcaggtgtgtttacattctgtttgctttgttgctattgcactatagttcttttcttattctgatgacttttgattttgtctcctaggctttgaactttgctttcaaggattacttcaagaggctgttcaacttcaagaaagacaaggatggttactggaagtggtttggtggcaaccttgcctctggtggtgctgctggtgcttcatctctgttttttgtgtactcccttgactatgctaggacaaggttggccaatgatgcgaaggctgccaagggaggaggtgaaaggcagttcaatggccttgtggatgtttaccgcaagactctcaagtcagatggcattgctgggttgtaccgtggatttaacatctcatgtgttggaatcattgtctaccgtggtctgtactttggaatgtatgattctctgaagccagttgtactcactgggtctctccaggtttgttcttatttctgtctcaatattagttgttttttgcccatctatggaactattctttaacatcttcattggtttgcaggacaatttctttgcaagctttgcccttgggtggctgatcaccaacggtgcaggtcttgcctcttaccccattgataccgtccgcagaaggatgatgatgacctctggagaggctgtcaagtacaagagctccatggatgctttctcccagatcctgaagaacgagggtgccaagtcactgttcaagggtgctggtgccaacatcctacgtgccattgctggtgctggtgtgctctcaggctatgaccagctgcagatcctcttctttggaaagaagtacggctcgggcggtgcctaaactggcagaaaatgatgacgaacaagtgtttattcctggtcctgcactaacgggatctggtgaattttgcctttttaacattgaaaacaataataattcttgtaggggagaacactccccgacattcgttttttggtggaagcgtttatctccaaacattgtcataggcggaggcgttaatcgcaaacagtttaccatcatagggttgagtttgagttgagtctggccggctctgttatgtctggcgattttcctaccatacattaccctcggtgaaatatcgaaagattattgagttgctgtcttttgttggtgttactattttgcaatgcttcattatttctactgtttcatcctgttatattcctgatagcattttgcattgcgtttctctacatgcatgcaatttattgctctatgaatttcacatactatacaggagcatttcatgtttgtctctgttcatgtgaaactttttgtctgttaatgtgaagtacgaagattcatttgcgtgattgaattccatcttcatgaatagattgaattacatctaggtgccagttgagctgaactgccgagaacgtatataccgatccgaacataggcaagatgcagaggacacactagctctctttccaccgctgcagcgtctaagataccctttccactgcacctcctgacgaaggctcccacgcaccgcggcgcgttcggccttgttctttttgcatctggtccatggttttttggggtgtgcacagtagaccagattcgttagggaacctccatttcattcaacaaattcctgttcttgtcttttgttctaattatgctagtaaatgttttgttatttaattaattgtgtggtagatatttttttaccttcttggcaacaactttgttccacatttgcagttgcaatagtgtaacaatgttttttttttctgaactggaatccaagatgattttgtgctgaggtgccgctcattgactatagtggttgttactaacgaagttcaatccagcacccctgaatatcaggtccatcaaactaaattaccagtcgtatttcagcaactgaatcattgaactctatttctgtccttggctgtttttgagatttcacataatatacttccatgcactaaattgctgcttgaggtcacataaaatttatgaattgcaggaacatataatttttttgttaatttcttatgtattcaaggttcaataaaaatataataagatgaattttgaaatctgtcaaacatattccaatattccattcctgcaggaacaagatgttagttatgttgatgcggactggggtcttcatagacaactctatacctcactctactttagttatcgaaggacagttcgcagtcagattcttctttcacagcagagcttatggctctcatctttggacatgttatatgcagcactttgcaacttgcaattgaacaatgccatttacttgtcagattacactactgttgtcaaggttttgcaggagaggaaggatatcatgcaagcaatcgaggacactggagcctccggccactctaccattttcagcaagttttgcagggacaggagtccaaattaggtggataccgtgatcggtgaacaaaatggcagacaaactggtgttgtgagctagagataggccagccagaagttctctttcctcagtttgtcatgatttgtaacactatacttcttctccagttagctctcagctatctgctctttcagggagatccacctccctaactcaggtccatatgtaacggggagattgttactcgcctatgaaggaattcagtaacagaatccagctttctttctgctacgaacaaatgttcaccactgtagccacttcagtatgcttagagcaattgagatactctgcacataaacgaaactagcaacttgaggtctgcaagagccaagagtgcaagtgggttacccgcgaatccacttataggttaaaataaacaaatgctgtgatcacacctccattgcgacgtttcttcaggtgacgaaaagcctgacgagtagtttaggcccccgacagggccctgtttatctgggctggttagatggctgaaataccggcaaattggcaaagtttgcctggtggacggtgtgtgcaaattgcaatgactccagccatatggtactgaaaatgagttggcatcactacatcactgcgcctcgccgcattgaaatgtggaaatgaatggagttgccctgcgcgcagatctatgattgggccgtgatggacgggcccgattcaacgggacaagccgacatcacctgggacaaaaacggactggctgggcaggtacccactcagatcttcacctacccgatcagtaacacacagaaagcagaagcaggtagtaaacccagaccattctcacatccatggctcagtagatgtggatctccattttgacttcgaacgctagctgctttgccagtttgccactgaagaattgagacagacagccagacaggatagttaataccactttttaaaaaaatggattaattactggaccaaccccaatgatcatccagacatcatctgtgcaaagcatatatgcaaagaaaagaagagaaattggtggtggcatactggcatcgccttaactaacgcgctacagttgtaccactgccgctgcgcgcaggtcgtgacgctcacgtcgtcgccactagtccactccctcgcttcgcatctcgcctctggtgatgagagcggacagagccgagctgagggaattaaaacccccttatcctctctctgcccccgggctgccattgctggatccaaccatctgcccccgccacgcctcgtctcgcgctagccgtctcgcgtgcgtgcgcgcgcgtcgcgccgcgccctcgttttggagccttgcgccccgctactttccccttgtcccgaacccggaatccgcctcggcgagcgtccttgctttgcttctttggtatctgtgctcccgtttgctttgccttgccacgctccttcctcctcctcattgtctcctcccgtggttcggctcattctgttcttgggttgacgcgggctgcgtgcgtgcgtgcgtgcgtgcggaggcgatgtcgtcggcggtggatgccatctcctgttccaagggcatcgcggccccgccgacggaggaggcgacgaaggagcgggtggcggtggtgggcaagaacggcggcgtggagcacggcggcgacgccgcgacgatgaacgggaagcagtgcggcgaggcgccgcattgccgcaaggagagcaacgaggaggaggaggatgacgaggagaaggcccccaaggccatcgacctcggcccgcgtgtcagcatcaaggaccagctcgagaaagacaaggtaccactactcattcccgccattgctcgaattcttgcaagcacccgccattttatacaacgcatccaattcttcatgcgtttctgcgtgttcttgcttaattgcaggacgacgagagcctgaggcggtggaaggagcagctgctcggcagcgtggatttgaactccgtaggaggtaaaaattcctcgaaccaaatccatttctactaaacgtttttagctgcgtcgtctcgtcgtcctcgcgatctcgtttaatggcgccggccggcacatgcaacagcgttgcatgtgagcctgagcaccgccttgtgcccttgtcaaagatggtcccgtgataatgcacctgtgtacctgtccgtgcttagcccccgttctatgggccacgactagattcatccatcgtctatagtattcatccatgcatgcaccgcccccgtgagctccgtgttgcattctactccgtacatttgtgatttgtacgtagaaaatacggtagaacagcaaaagaaaaagtgaaatatgttgggcttggctggacgggtccggcgttttcaatgcaccggttagatggtcctgttaataactcctgtactttgccgtgcatgttcggcttgtctgataatgaatctggtccgggctcctaattgaagcttgaactaatgctttcatctgatcatgacattgacaatgccttctgatcttaatactggggaacagtgcatttctgttgttagtttatatgctagggtgttggtgcttttaagatcaaatggattttgaatagtggcctaaaaagacacatttttgcatcgcataattctagcgaaccttggctttttgtctatgctttttagactagtgttgaataaaccatgattcatatggttgtggttgtttaaccaaataatccgaggatgatggctagctgcttcacggtcggttttaggatgatcattcattcggcatctgcttgtcttccattagaattttaaactcaaaactacggccaatcatttggcctacacgtcctggccattaggatgcaataatgtcccaaaaagaactgacccaataatgaggtctgaagtctgaacctgtcacgcttgattttatcggtgcagagacgttggagcctgacgtgaagatcatgagcctggccatcctctcgcccggccggccggacatcttcctgccgctgccggtggagcccaacgccaagggcgtctggttcaccctcaaggagggctccctctacaagctcaagttcaccttctccgtcagcaacaacatcgtctccggcctccgctacaccaatgccgtctggaagaccggcatcaaaggtatacccaaacacgaaaaacatttaattaggtctccaatagatgaacaattaattactactaaaattttataaaatccgatggatttagcgcgtttgaatttgtgcaaacgcactcatggttttggttcctcccgttggggcgtgcagttgacagccacaaggagatgctcggcacgttcagcccccagccggagccgtacacgtacgtgacgccggaggagaccacgccgtccggcatgtttgcgaggggatcctactcggccaggacgaaggtacgcatgacgcgaattttctttgtcagatatcagctgcttcaggaaacctgcaaggttcagtcgctcagcaatgtgttgttaatttattcttgcagttcctcgacgacgaccggaaatgttacctggagatcaactacaccttcgacatacgccgagagtggccggcgttgagctaatgatcagctgagccgtttttccggtggtggtcgccgagtagaagggtgaggcgccggccggccggcattcatgctgtgtgttactgtcgtcaccgttgggagcagaagtggacattttttttttcgtctcgtttgcgtcttatccactcatttttttttttggtttgattcaccctagggttcttttgtatattgttgccctgtctgtcccggttgtttgctgtgttaacgccgtgttagacgtacgctttgtcagttcaagttgatgttatgctatgtgttatgtcagtgtgcgtgtttgagcttctgtcactctgtcagggtcctgtttcgatcgaactgcctgtttgagttcagagcaacgcagctgcatttcttgtaaacactgggactgtatctgacgcttcccttacaaatttcccattctgtgtgcttctctctgcaattacacgaaagacatatacccataggccatagacatcactatacatacacaaatcaataaatatactccctaatacatactcaaagacagaaaccaatgagaattcctatactaaaatcccattaaaaacatagctgtgagtatataatattcgtggcaaccagagaccaagacttaaatagtgggtggtagtcatgcaccctccaccacgaacatcaccgatacttcctctccatgtataattgtctaaacttgttttaccagtgttatgccttgtatattagagtgggtaacttcgcggatcagaggtctgaggattcccgtataatttagggtgcaagcaagcaagcagtagctggactatttatcatgggtccccactccaactcctcggcggattcatcacgcaagatgcatgtggtcaaagctttacttacatatagttgcagcgattggctaagggatgcaaagttgcaaacatgtgggttccttccgttcacctgattaaagaggaattaatagcaacacaagttagcaactcgagtaagcgggccagaaagcaggctggagcggtgatttcaggcagcccacccaacgttccaaccaaacctaccgttcgtgtgggccacttttccggcccgcgcagaggacgatccagccggcaatgctggattggcccgtcaccttccccccttttcgcgcagcgcgcgtggcccatgttttggataggtagacttcgcggcccaagctggtgggtcaaattcagaagatatagtcggccctgctcctcggcgaccacgtccgagaggagcccgaggcaagcaaaagcaacaggatctggcggcttcacgtcatcacgtgaccagagtaaaactttcacgcttggaaagcggtgagcacgttcagaccccgtcgtctcgtcggtcgcatgtgaccggggcgagagacgagagaattcgcaagcaaaaccatcggggacgtctctctatcaacagcggtggatttcgccgttttcctgggcatgcgtgatcggtctcaactccgtgttttccttttttttttcccccgtacgccgtcacatcgccggcgatcggatccgcgccaaataacaagcaaccgatgtgcgcactggcgaaggattcgtccagctttccccccgcggcgcgctgtgtttgtcgtgctatcgctttggatgccgatggaaataacgtgcgtggaatttagccgtccttgttgagttattgtgtgttggcgcgctgcaagcctggcgatctggcgctttcggaaaacggcattaaccaggaagctggaacgacagtgcaggacagtggaggagctccggtgtcagctcggctccgtacgaactcgtcgatgcttcccagggtcttcgattcgatgcatcacgttgtcgaaccgttcggccagaaaatgccatacttcggatgtgtttagtttcaaagttttttttaaaacttctaacttttcatcacatcaaacctttcatacacacgtaactttttataacttttcagtcacatcgtctccaatttcaaccaaactctaaactttgggccaatctaaacacaacctgattaattcaatactggattactagtacttcggtttagagaatgagctcttctctgcattgaatcatcctggagacctgaatatttcgatagctttgcggataaatgcgcgctgtgtgcagtacgtgtgcccaaggtacgcgcacgcgtgtctgcgtgacgggttcacgttcggcgggagcacggattgggggggggggggggggggtatgtgttgtacaggtaagaggtgtttggtttgttctggctgtgaacagtggcacgtcggaacacgccaaagaagaggcccgtggcgacgacgctttcggcaggggataaaaaccccacgaaaaattatggcaagggcaacaagatttgtcggcatgagcagcaagatccgctcgagctccgggtaaacaggtgccggacaaattttggttttcttggttgctttttgagaacatgagcacacgaaagctggttgactcgaataagaaaattacacgagagagtttcttctcgaggaaaagttggaggatctttaattgtatttttagataatgtattcacaaaaggatctttaatttgtattcatatagctggtgctccattgctcctactttctagggagataggtgtgttcttttgagttcaatgtaatggaacatacaaacaataatttaactattattacaagattaaaaagaatggatttgaaatagcatcttataatgataactatatatgtaaaaagtttttaaaaaaatcctcctatttaggaactcgacctatgtgcatttttgttcaattttgagaaaagaaaaatacaccgataatatgtaaaacggacactcatattgttaaagtctcgcaatcgaaacctcttccaatgtaaagcattcaatgtcttctattacgtatcatctattttgcacaaccctttaaagtccaaataagttagaccttggttccaatcgtttaagatgtggtaagcccaaagaaaacaaacaataaaatgttttttttaaaaaaaaaactccatatctgtgttatttctttcattatagcccctcgtagagcccaggtgctatttccttttccttttctttttctttgaaaaaaaaacaacgaatgtgctaattcttaaccctgaggaaacctaaaatcggagacataccagcgaataaacaaacaaaacaaacaaacgaaaccgacccacctgacctcctgtcctcgtctccaccacttcccctcccctctcccgcccccacgaaatctgggaggagccacgacgccattgccaacccttcttctcttttccccccaccgcaaggaaagcacttccggcgagcgtcgacgacgacgaatcgtcgcgagaaattcggaaggtacccctaccctcgtccccccccccttccccccgtcgcctcgccgcgccgccacgcgcccatccacgcggcgtgcgcgagggcgcggacgatctccacgttcctgttttttttttctttgtttttcgaggggggtttggttgcggccgttttgatctgagatcttgttgcagtcgataggggaggtcggggaggaggggggagatgtcggggttcgtcggcgtcgtggtctccgacccgtcgctgcagggccagttcacgcaggtggagctccgatcgctcaaggccaaggtgacctaaaattatccccggtttcttcagttcgttgtataggaagccgcagttcgcctctcattcggggtggaattgatgggttttttttttttgtcggggtggcagtttctatctctgaagagagactccggaggacatgccacgacgaagaacctcccgggactgatgaagaagctgagggggctcaatgaggtgatctccgaggaggagatcgccgcccacttgtcccagtcttaccctgacgccgaccaggagattgagttcgagtcattcctacgggtacaactcggttattttctgaattcctgttggtactgacgagaggaatagagcgtcattgcattgttgatttgattggaatgggattatgtgtggtgtgtttgtaggaatacctgaatctgcagtcaagggtgagcgccaaagaaggcggaggtggtggtggcggcggtggcaagaccgcgtcatctttcctcaagtccagtaccactacattgctgcacaatctcaaccaggcggagaagtcgtcttatgtggcgcacatcaacacctaccttcgtgaagacccgtttctgaagaagtatttaccaatcgagcctaccgacaaccagctgttcgatcttgtcagggacggtgttctgctatggtgagagatggtctttacagctaaccaaagggtgcatatccatttactcgttgaacagaaactgcccttgagtcatagctgatatttgctcatttatggatcatttgctcagtaaattgatcaatttagctgtacctgggaccattgatgagagagcaataaataagaaaagagttcttaacccatgggagaggaatgaaaatcacaccctgtgcctcaactctgccaaggccattggatgtacagttgtaaacattggtacacaagatttggtggagggaagggtatgcaacgcattccctactttaaattctttttagtaattcatggtgcattgtagtctatgcaaattatttttaccactaattttcattcaggactacattgaaatactttaatgccctgtaggtgctaggtagtttgggtacaaagtatgctgtcaattagtcattgtcaccactaatttgctgcataccattttatccttcgctgtataacctgctaattggttccacctcatatttccttgctcatttgctgtatgtgttattctttgatatgcttgtccatgtgtcagatgttttcagccgccttccctttgtgacttcttctatttaattcaagaaattcactaaaagttaagttgtggttaacatgcttcttttttgcagcctcatttaattcttggattgatatctcaaatcataaaggtaaatgttgcactgagttttgcattttgatgtttgacatactatggttaaactcctgcctcatcatataaagatctttttgcacttatcatcagattcaacttttggctgatctgaatctcaagaagacaccccagctggtggaattgtttgatgacagcaaggtaaataaacattctgtccttctattaatttaattcacatgttcttagaacaaaattcattttactgattattatgcaggatatagatgaagtgttgagcttgtcaccagaaaagatgctacttcggtggatgaaccatcatctgaaaaaagctggctacaagaaaaccgtcagcaatttctctacagatgtgaaggtgcatatgacatagaacaaagtgacattataattaattgattatgtgcagtttgataaaagaagctgcccttgtgctaatccactgtttggcttgcaacatctttgcatttgggtttcattgactaagcaacagatggctttgaaaattatttatgactcactcttatgctgtaaatcccctttctaaatgcgtatgtgggaaaagtgaatcaaactacattcatttaattaatattacttcaatctccaatgttcacatacgttagttctgtacaggatggtgaagcatatgcttaccttctaaaagctcttgctccagagcattcccctgaaaccacattagagacaaaggatcctagtgagagggctaaattggtacttgaacaagcagagaagttggattgcaaaagatacttgactcctaaggatatcactgagggttctgccaatttgaatcttgcatttgtggcacaaatattccagcatcggtaagtagtatgtttcttgtttctccaaaggcattaacttttcttttttttatcataaagctagctaaggtattttccccatgttgcagtatattcactttaaaagtttcttagctagctgccaatgaattggtcatctgcttatcacttgaatgctattgttccatgatgcacaggaatggtctaactagtgacaccagacaagttactctcaatcagactgcatcacgtgatgatgttctattatcgagagaagaaaggtcctttcggatgtggatcaacagtcttggggttgactcttacgtgaacaatgtttttgaagatgttcgccatgggtatgagattatttgaatgagcatttgtgtctgtctccaaatgaattgggcacttacatcctttctcatgcagatgggtacttcttgaagtactggacaaagtttctccaggatctgtcaattggaagctggcctcgaaacctccaattaaactaccattcaggaaattggagaattgcaatcaagtggtaaaaatcggaaaggagttaaagttttccttagtaaatttagctgggaatgatattgttcagggtaacaagaaattgattgttggtgagtgtgactgaatcaagtctttttagtggtttctgattgatgttatctgtttagcacacaattgaagccatatctgttgtttttcagcacttctgtggcaattgatgagatttaatatgcttcaattgttgaatagactgagatcccactcccaaggatcccaaggaaaagaaattactgatgctgatatactaaaatgggcaaacagcaaagtgaaagcatcaggaagaacatctcaaatggaaagcttcaaggtgttattaatttctgtttaattagttttaatttgttgttagataactccagttaataaattttcttatcttctctcaggacaagagcttatcaaatggacggtttttccttgaacttcttagtgcagtacaaccgagggttgtcaactggaaagttgttacaaagggggaagatggtctgttcatatgcacgtttgaattactatttgatgataatttctgactgtttatatatgtatccttttggaaaaccgtagcattggctgattcactatttcctttcaattctgcagatgaggaaaagaagctaaatgctacatataccattagtgttgcaaggaaaatcggatgttccgtgtttctgctgccagaggacatcattgaggtaagggatgctaataagcatgaaattgagcgtgcaacttttaccatcacagatggaattaaatgctttaccttcagcaatttatctagcatctgggctaaatgctttactgtctacattatttgttgtctgtgatcctcttctcttttatcttgaaaaatgatggttattatctgttgactaatcgtactcttatgtttctgtttcaggtaaatcagaagatgatcctaacgcttacggctagcatcatgtattggagtctacagaagcaaccacagtcacaatctgaaacgtcagaacaatcagagccatctagtatggcttcggatgcagcttctgatattgcttcggaggacgctgcttcaataacagctgcatctgagggagaagaggtgaattcgctatctgatagtatgtccaatttgaccacatatgatgctatttcaaatgccccgccagcagaaaatggaaatggtgtggcaggatgatgatgattacacgggctgttcttctgtcctgatagcggttttattatggtggaactagtaccgtcatggtgtccaacgtttgctgccagaagtgatttttttcctgcttctgttccaagcctacttttgaggtagcatgatagatacagatacagatagatagagttgccgtttgttcatttaattttgctctatacatacgacagggaaaaaactatacataggtcactagttgggcatttcttgtactcttagtatactttgatttcaatgtcttcactttgtttcccggacctgtcaaaatgtactggcatcgtttgtaatctgctgctgctctggaccattcatgagctgtatataacataatattgtggagagatctggtttcccaagaatccctgttcattgtttacagtactcttttcaccaatctatctctatgctctactagcagatttgggccgtgtttagatccaaagtttttcttcaaactaccaactttttcatcacatcaaaactttcctacatacataaacttccaacttttccgtcacattgttccaatttgaacaaaactttcaattttagcgtgaactaaacacagttcgggtatgacacctgttttaatcacatcaaaactttcctacacacataaacttccaacttttccgtcacattgttccaatttgaaccaaactttcaattttagcgtgaactaaacacagttcgggtatgacacctgttttaatcagtctttgggtgtgtttagttgacgccaaaattggaagtttagttgaaattggaagatgtgatggaaaagttaaaagtttatgtgggtagaaaagttttgatgtgatggaaaagttttgaagtttgaagaaaaaatttggaactaaacaatgcctttgttccgttggagaatgctgaaagtgatcaaccatgaatatttcagttctcttttcacattggcgatgctgcctcatcatgcaacgaagagcaccagttccacgtttgaggttcatagaaccgacgaaaaccacttggttttcacgacatttcgtggttttgagctggcttgagttgacaaaccactctgttgactgttggagtatcaatttgaatcttaaaattttgacaatttatctgaattccatctcttttcaaacaattttcgccaaaactgacaaaaccaacactgagcgattttcggtcagcaaacggttttgtgaaccttatgcatctgagaactgagggagtggtagaatttgctgcgttttcgattattttttttaaagaaaaaattgctgctgctgttgctgctctctctatctcttatctctctctcaaataagagcagtgtgcagcgtacgtcttgcaaaaaatgagagcagtgtgcagtgtacgtcttgcgaaaagatgcctttagcccctacataaataaatacgcatacagggccagccatcagatgctttggagggctccatgccatttctgctctttcttaagacgacgcagctgccttgctgccggtgcctggacaccatcgcccacagctccctccctctatctctctctctctctctctctctctaacaccaccacacatctcctcctttcttcttctccatgcaaaccgacgcttcatcgaggagctcctcgccttcgccatggccgccttcctactccgatccatctcgcagaacggagatgatgagcagcagctgctggtggtggtggtgacacctgacacggcaatgcggcggcggtcgagggattaaaccggcctaaaacgtatccattccgcggcatacaagggcaggccaggcatctgatttcctacctacattactactactagtctactactgctactactacatattatcatttcctagctagctattagttcacttctcgatcgttttggtgttagcttaagctttcttgatttcttttgctgccttagctttttcttttttttcctttgcggcgacattgttgcagagggcgctgtgaaatgtgaataacctctcgcgttttggatgatgagtcgtcgctcgcgttggtcgattgatctctgtatcgtttttcctgtggtgagaattgaggttggtgatctgcaaaagctagaacagcgtgatgatttctatgtttcttttttcgtgcgccaattactcgatcttcttgcttagttatagctgtaaatattccatgacaggagtgtggtcagtggtgcacagtagctaactgaaatcctaatgcccgtctcgttcgcatgctgctgaaacagtacgcagcatcgcgtacaggctctcggcaagtaccacgagtcaaggcgggtacagtttgccctttggcatttgggtagcatagcaggacaacatatttacacaagagcttttcgagctcctttcgaaagaacaaaaagttttaaactgtgtggtgacatagtaagaacaaagaacacagcatctctgactctgcatgataccaaaatctacgatcaaattcttgtagcatgggttgggaatatcttgtctctgctgcggcatatatatctgctactctaaccatgcattccggatgctgtcctttgcccaaggggcaagaaatgcctctttcattcctaactagttgtgccatatccctgcatcgtcaacactttcatattccttcactggaattgcatattcatcctacatgcatgccacaatgctaccacaccaggaggaatcacactgccacttgcgatcatcatctgttcatttaattcttcccctgttcgtccttgaagccccgcgcgctagctagctcatcacacagcagcatgcatttagccatttactgccatcgcctggagaactctcaaaggcgttaatggcctgcctagctgcgtgtcagcgtctgtgtgtgcgtgccactgtggcactgtcactgtgcgagagcgatcactcccccagcctcgctgctgcctgcaagagcatttttctcaccggtactacgcgtcctacacatacatgcacaatatattctactagtacttgggctgtttgatagtttgatactacggtggatgggagtcctaccaaaaccaaaaaaacttagcgcacgatccgcacatgcagtcgtcgctgtctgattttcccataaattgtggtcggattattagtacttgcgcagacagggcagggaccagcctcatttgcctcgctctctctgcaatctgcattgccattgccattgccttgcactgcggctgcgctgctgcccagtcctcctcgagtccagccagcccaccaccgcatgcagacgctgcagcagcattaggagatgaccacacgggcttactagacgagcacaacctacgagctgcagtctgccggctgacgcgtggggcccggcccatttgtctggcgtgccacgccacagtgctgcctcccttctgactagtactgtggtgactactgatggatgatgtggtgagtaggagagtaatatactgtacctaaggagtgctcctccgtaaaaagttctagttataaatttggatatgtggctgtgtgttcaaatttatagctacagttcatcttttttagggtagagtagtactccgtaagagtagaggtggcaatgggtcggatcagacaatagacggaacattaacacgtccggcctaagacttgatatcccttgtctaggggtgaaaacggtttgagtatttttttatatccagacacatttgttttaaagtggttcggaaaattttctatatataagacgcatttgtgtttagattagttctatatatgttgagtatatataagtacatgttgagattagagaccaaatgaaataggaatgcgtcaaaatcagcaatagacacatatatcaggtctgacatgggttactcactggcataatataaaacccatatgcgctcaaaagaattttggatatcggatcaaacatgtccacgggtaacaaaataaacctacgctcatcgggtgggatacccgtgggtatcggactagaattgccatccctacccagtaaattgctaccactagttccttaattttggatgcgcggacacatgctggcctaaaacaatgcaactatgcaaggctagagcttagagtttagcaccctgcccatgttctttagcttttcaaaagctccccattggtgctcgagtttgtgctctccttgttttttccccttcaaaacggattcacgaacgctcatggttcagagttcagactagcagtaggcacaggactgtacattggatgatgccttttgagtagttgaggctgagagcggagatggtacccaatggcggccgatacgagtgatcgcggtaggggttgtcgtcgtcgtcgtcgtcgctggcgctccgctcgctcgcacgcccgcctgtcgttttgctcgcgtgcgtgcgtgcgtgcttgcctcgatcgatcggtcggtcggtcggtctgtcgcctcggcacgcaggcgcagccgcgcgcagcgaccgcgtcgtgcgttcccttgtttgggatctcgccaaccacccgcatcacaacgcggctcgcatcacgcccgagacacgcacacacgggcgagagacgccgcgcttgccgggttggttgcctggtttgactccgtttttttttcttttttttggtttgatcggcagcacagcgcctcccggcctcaaaattactgtagtaccacgagatcgatctcgacccgtctcgtcgtcgtcggctagaagtaaaaattctggatccatccatgccaaacaagtaaaaatctggatccatgcgaaacaagtagtcgaggttgaatcggatggatgtgctcagacagaggcattgccagattggctgcttgcctgctgcaaggtactcaacagtggcaggatggcagggagctacgctacgcatggtccaggtggtctggtcgcgaataggaatggtggaatgcgattatggctgtgtttagttcactgtgaagttggaagtttggttgaaaattgaaacgatgtgattgaaagtttgtgtgtttatgataggttgatgtgatgaaaaaagttggaagtttggatacaaactttggatctaaacacagcctagatcaaacgcggaccgccggtttgtttttctggttttgaaataggtgagccggagttctcatgagtcatgatccagccgaaccagggccgtgctgtcaaatttgtagaccctgtacaaggctctaagtgaggcctaaatcaagtaccaaatatagctaaaataatatatatactgcaaaacaaatgtgatatatcaagaatagtatattttttaactcttgttttgtataattagaaactgtcaaactgaaaacggagaatgtttgttgatgttgctggcttgctgcctagtgccttgcttgttggttgcttgctaagttgctattcgctagttgaatgaaaatgtgaaattggatgagccggctggcggcctggtgctcggaggagacgagacgtcgagactcgagacaaattgaataagtcacagatacgaaaacgaaagagaatacaaaacgttgtggggcctcggggctcgaagttgagaatacgaagcgccacgcacgcgaagtcgccacgcggagatacgcgcggactcgaacggggttctggcgctctagcctcatacaaatacatgtgccttctttggttgggctgattttttgaggccctagaaatttgcaggccctgtacggtcgcacgggccgcacacccctgtgcacggccctgagccaaacgttgagtgctccactccgttactacgatacgatgctcgtaaaaatatctagatgagatttcagtagcgcgaagtaaacataacttaactaaatatatttctttgtgatgaaaatataagtactcgcatttacgactaattattattttagtggtaagtgacataccatcgatagtgagatgttcgtgctgatttcgttaatctcaagctatgcctgagatgcgggtgtacgtatgtgtcatcatgaggtgagtgtgaacgtgttataacttataagcgtctgtatttgtagttttttttataagaaaaaaagatttcaatagtaaccagagtccacttagatgaactttctgctgctgggctgcgccgacgtgttcatgacttcaggggctatcccaccgaggaacggtgagcacgcgaaaagagagaaggaattatgttgctactaccgcgataacaccacacttatcacgataacggattggttatcaacaaatttcacagaaatttcatcaaaatctatcgaattatggcttgacttttacgctattcgtcgtcgtcgataaccggccaaccgggcaataactgggccggctaccattgacaacgcaaaccaaaggaaacaagccggccttatgcgatggtaagcccacacgagagaacagccaggtagggattatagcccaacgctcccatcacgacccactacctttggcccatgggagattgcgaatcgcggacgaaaaaagtgcaccgaagttccctcaatttgtcatcgagttacaaaatcgtcctccaaccgtaaaatcggatacaacgcatccctcaacttataaaaccagtgcaaactagaaccctcgatagttttgactctagttttgtctgacgtgacagctgacttagtatagtacccatgtgggccccatacgtcagggtgaccacgtcatcatcatctctttcctctcttctctcccttccttctctctctctctttcccagttttctcctcatacgggccaggcggtggggtgatgtgggaaagggcagctggcgacgggcggtgcggtggcgcgacatcggcaacactagagaaggggcaacgcggcggcgacggcgggtcgggagcaggcaggcgccgcggcggtgggcatggaggtggagtggttgcgggacggggtggaagaagaggaggtcatcgaggctctagcacacgcgcaggcggcgcacaccggggatgggagtgcgatggcgttgcggtagagcgagcat

SEQ ID NO: 45103 - DNA, 16264 bp, Oryza sativa
gtagccgtgcaccgccatcaccgacgacagcaatttgatggcggcgccgttgaatcgatcttggtgcaggcctttcatggcttcgggttcgaccgtcgaggtcctccagctcctccattgcttgtctgttgcctctaagaagctcaccaacggctaccgcggtgcctgtttccacctctgtgcccatcactgcggcgcccgcttgcgcccaacccgtcgccggccgccctttcctgcctcgcccctccagctgacccacacgaggggtgcggggaggccggcgagctcgtgccgctctgagcccgtgtgtcgccacctggggaagctaagatccccgggagccaccgtcgccagccgcaccaccctttagccgcgcgcgccaccgtgggcgccaaccctagtgccatgcctgtgtgaaagcagagagcgagagggaggaaggaaggagaaacatagaaagtgaagaggggaaagagagtaggtgctgacatggacacaccgacatgtggggtccacgtgggttccatgctggctcagctaccatatcggataaaaccgggatcaaacccatagaaggatctaaagttgacggttttgtaagttaagggatgtcgtatatctagttttgtggttaggacacaattttataactcgttgacaagttgagggacctttggtgcgtactttttccaatcgcggacgggaagtgatgcgtgcgcagccagtgtacggccggccaaggtcgcgtgggtgatggaacccaaggtcagcggtttcacgcgcatgaacgctaccatccggcgaagcgcacacgcacggcgggttccgcggccgcggccgcgcgcgctagctcgccgtggcttcgcgcggctgctacgcgggcgatttctacccccattcacaacagtcaacaaccgcatggcgcgcggtgagtccgaaactgacttgcactgttgcacaagcggcgcacgcgtccaggttggtcaacaacgcgtgcaaggcattgttgatttcaggctttcagctacagcatgttgacacacattggcctcgtggggatcaggcccgaacattctggcctctgttagagcagatacaatagcaggctataagctagctacaaatatattttaagaagataaatgaggagagagaagtgtagcgggctacagatttatagccagctgtaatacggactccaatacataatgtgtgtatgacaggtgggaccagttattgatagtgtagtatgtaactattgtatgaatatgtattagattggctatagatgaattggagccagtagttggctatactattgaacttgctcttatcatcaaggacgtgtgttttttttccacgaatgtgcagaaattttgcacgtcaatatattagaaaagagtagcatacaacggtaatacgcggagacggttgttggggataggaggtcatgtacagtatgacactaataagcaagtactccctccgttcccttttgatcatcgtattgcaaaaaaaataataattccattttgattgtcgcattacggtggggaggagatgaaaatcccgggaaggacgttaatgacacttcctaacgaacactacatgcatctgattggttaggctatacggcatgtagaactgattaggagccgctgcatgcatcgatttaatacgctcacaactgattggccagccacacggcatgtaaaattgatggcgttacattcacggatacgaaacgctaatgtatgtttttgatgctgattaagtgctccacatgattgtcttggtattgatgcacaaatcatatatgaagatcgattaggaatggagcgagtatgacactaataagcagactgcgacaagcgaaactaagcaaagttacgtgcctgcctcctgacaagataggcgtaagcatagtgagagaatttttcaccacgcatacaactcaagcgcaatttcaattcaacaagcaagcatatttcatttgccaggccgactggccgagtatttgggctgtacgggcggcggccgagcaagtcagcctaggacgatatgccaggaggctaggacgaaaggaaatggctgaaagatgcggggagccaaggacatgaaaggactgaaagatgggggcgtgtgatgtgactcgtgtgctcacgtttttctttcacaagctcaaagaaagctgaaccaaatagaccaaaagaccaaaagacgaacaaatctgtgactctcgcacagtatagagacaaggaactaagtaatatcttactaggtgacctatctgcttacgtctatttttctcccacatctatacccatgcaattgagatcctctgtggtactgcatgtgcagtactgcttactgacatctgggcccgaggggctgtggggcccacatgtcagtgagcagtactgcatgtactgcacatgcagtactgcagaggacctgcatccataccaatgctactaaattggagtagcactttgcgggagcttgcaccagtgttcacaatctttattaattccaaacgatttttgtgaattttgaacatctcgagcatgcttagatatcgaatgggggttttgttttgactttttaaaattcatttggaaactgtgaaaatcaacgtatcgatacagctcgaaattcgctaaccaatcaagattataaatcatagcttccatattaaccagaaagatcattgttgattggattgatcgagcttatattctacgaagtatgtcatattaaataaaacatgtaattggaaatgtcatatactctttcttttttggttttttccaacatttgaaaattataaaatttaaaattagtaatgaagcaatacatgttatgtaatcagcaacccgataaacaaatattcctatgtctctggttagattcttgcaaacaaagtagacaacaacatagaaatagaaaataaaacaaaagactatgacaaaaaagagtcgcatagatagaactgaagccttcgcatcactcttgtgcgagtggctcgggagcgaaaccctagccgcccgtgccgccacctcccacccaaccttgacacctcgcctccgtcggagttcgccgtcggaaagtcgagcgaccagctgggaaggcggagcagccagctgagaaggcggctgcagagacaagaagacctgacgaggcccgtcctcggcgtgggaggatgaagtggtgcacggcggtagccggaccctggcggccagacacggaaagggcaagtcggatctgatgcccctcaaggcagatgcatggacgactgtggagggcggccgcggaagcgaaggtggtggtaatggtgccagatctggtgctcccatatccaatttcggcagcgatgcaatgtctcagcgcggtaacgctgcatcgacgaagggcaattgccaatgtttggaggaaggtggagacgacaacggggatggggagaagcaggcagcgactgctgggtgtggggctcccaaaggaagactggcttagtacgaggcgcatggccggcggtgggtggccaacgaggcgcatgcagagcatggcacagaggcttgtggtggagctcccgaggggaagttgtcgtggcacggaggagcacgaccggcagcgagaggccagcaaggcacgaggagagtgcgctgcggaggcggtgaggctgacgcggaggctggagcggtgtggcggcgagcctgtcggggtgggagcatgccaggcctagggtgatgcggcggcgaggctactgcggtatgaggacagacgcaacaacgatgcgatcaggcgactcgttggagagacatgggtagcttggtcgaggatgaagtggtccttgaaggctacggcgagctcctttccaagcgttagtacccttgcagtggcggcttgccgtcgcaagatggccacgttggacgggctagtacaggggagaggggatccattcttctctctcaccatcttcttctccaacccacccatgtggatggatctggagcgcaccggaggtcgagatcctactttatagccggccggcgacaaggcgtcggcgtggtggctgtgcgttgaagaggattagctagtggtgattgtcaaaactaacaggcactcaataacctgggagagtagggaaaatatgggcgaagatctagccttcaggatggctatggcgacgcctgcgggcgccgcgttctccttgggtccttgttgcgttttttttcctctcccagtggtttttttaggtgaaaaccatatcctgattctctaggatgggcagcggcggcattcttggcgccgtttccttcttggaggggtcgttagaagatccattccttaggggtgttgtgtgcgtgttttatttttttagcagcaagatcgatcagacgtagacgcgtggtttggttgtatttttctttttcttgactatagtcttctaggactatagacttgtattttatttctactatatcaatacaaacgttgcactatcttgtgcgggttgttttaacaaaaaaaaaagactatgaccaaccctaactccatgaaaaatcatggtagacaaacccttaaatgacttaatagatctaattgctaaagactttattcaacacaaaccttaagagcttattaaaattagacgagagacggatcccctccctcatcgcatctggtgaggatgatggaggcaaagaaggagggtgattggagtgatggagagaacccatgtagatcttaatgtgagacgttgaagtatggactcaggaagcactttctgcaacaactcatcttaatttctatgtaattccctatagtttataaacaagttcggaataaataagtagagtttaatctcatttaccttcgcaattattgtaaaagtacgttgtaatatccaacaactacgaaaattaggtaaattacacacctcaccttccattcaatccgtacatttatacccccccgctccccaattcatgtggttctttttttttttgaaactccaattcatgtggttctggtttggctatccaacatcgcacttccccgtggcgaatgacgtggtaacttaataaaatactcatctctttcttcctctctagctccatactctacacattcaaattatgaataaatgtgacagtgtagagtatatatttttcaggttttttacacattgagggggaaaagagataaatgtgagcgttaatatagtattagtgctgttcataagttggatttatcttttttcttttgttcatagtgagcgttagtgcgttacacattgatgagcagtgatgactgtcgactgatgaagcacatgttatgcatgagctagcgtgaaacaagacgacgcgcgtcgacgagaccacccggccccgaccaaggctgagagaaacaagtcacagaaattgtacgtacttgtaatggacttattaaccgccaacacaacctgctggccctataaattgacaagtactcgtgctcttcagctgcaaagagccacagcgaacaaaagccatatattgtaacgaattactacctagctagttaacctggtctctccagagcaagctacccgttagtcttgatcagctagctctagctagtagttagccatgaaggtagagcaggacctccacatgagccggggcgacggcgagaccagctacgccgccaactcaaggcttcaagtatgcagtccctttctactgtgaaatccgtgtgatcaaacaaatcacatgcatgcaattacttcctccgtttcacagtgtaagactttatagcattgctcacattcatatagattttaatgaatctagatatatatgtatgtctagatttattaacatttatatgaatgtaaataatactagaaagtcttacattatgaaataaaggaagtaaccaacacaactaatgttgcacacgtctggtataccgaatgaagctaatgcatgcttgattttgcttgacatgttgttcaggagaaggccatcctgaagacgaggccgctgcttcacaaggccgtcgaggaagctcacgcgtcgctctccggcctctcccgcgcgcctgcaggcggcaagatggtggtggccgacctcggctgctcgtcggggcccaacactctcctcgtcgtctccgaggtgctcagcgcggtggccaaccgctcatcatgcgaccacaagtcctcgctggtggcggacgtccagttcttcctcaacgacctccccggcaacgacttcaacctcgtgttccagtccctcgagctgttcaagaagctcgccgagatggagtttgggaaggctctgcctccctactacattgccggcttgccgggctctttctacaccaggctcttccccgaccgctccgtccacctcttccactcctcctactgcctcatgtggcgctccaaggtaattaaacacagtgcaaaaattaggaaaagaaaatgatgatcgagctagctatacgtaactcatttcccgtaacgagttgagagaaactcctgcgttcgattcttactgacatgagaacatacatccaggtgcctgacaagctagcgagcggtgaggtgctgaacgcgggcaacatgtacatctgggagaccacgccgccgtcggtggtcaagctgtaccagaggcagttccaggaggacttctcgcagttcctggcgctacgccacgacgagctcgtctccggcggccagatggtgctgacgttcctgggcaggaagaacagggacgtgctccgcggcgaagtgagctacatgtatgggcttcttgcccaagctctccagtccctagtccaagaggtatatatacaaacacattgaaccagtcactctatgtagtactgagacgaacacatttgattgatcttgttgctaatatgcagggacgtgtggaggaggagaagctggacagcttcaacctgccgttctactcgccatcggtggacgaagtgaaggcagtgatcaggcagagcgggctgttcgacataagccacatccagctcttcgaatccaactgggatccacaggacgacagtgacgacgacgacgtggcgacgctggacagcgttcggagcggcgtcaacgtcgccaggtgcatcagggccgtgctcgagcccctcatcgctcgtcatttcgggaggtgcatagtggacgacctgttcgacatgtacgcgcggaacgtagcacagcacctcgagcaggtgaagaccaagtaccctgtcattgtgctctccttgaaggcaagacgctgaacctatccgttcgtcggctcgtggtacacgatgttgcattttataagtagcgtgccagtgtgtgttgttggggaccgattgatcacccagctgctctgcaaattgggtctgccatagcctttgtctagctttgagtcgtttgtcgttgtaagttaaatgcgacgtgtgcgtgagtcagtaaaagtaaaatgaactagcccacgcgaatacgcgggcatgtatcttaagttgtgtttatatgggtagaaaattaatctaattatttctatcttgattgaaaagtatgatttctctaaaattttacttatcaatcacttggattttttttccaagctatatgttaactttatactttgtactctctccgtcttatattataaatcgtttgtttttttttctagtcaaacttctttaagtttgaccgctgacatgtagggagaggagaatgaagagttcgctgctaacatgtaggctccactcgtcatgttagcaaaaaccggccactataccatcgaaggactaaagttgacacggtattatgagttgagggatgagttatacttggtatttcggtttagagacaaattataacctggatgataaattgagggatctaaagtgaacttattcgaaagtaaaaaccagtgaagaaatttgagggctgccagatccttagatggaagcctgcgccggtgagccctggagccgtgggcttgaatgttgatggtgcattactttcccaaaaattgatgctgtgttttaacgttatttattagatatattaatggtttattagtgagagttcgaaaacaaatgcatggagaaaacgttagaaaccatgtgttagtcagtcactcaccgttgttgcagcaaacaaaaactaccagtggtggctcgagtcaacaacaacgcggcgaggacaaaacatttatcggctcctgaaacttcggccatggtggtgcgcagatcagcaggtatccagatgcaatgatctaaatgatgcatcgcgcgtgcgcccgcgcgcggttgattccgtcgcattcggtgggggctcgtctagatcacgtttctggagagctccagggtctctttcggtggattcgactgttggtgaattgtgtcggcgactcggcgtcacggccgcactgctttggctaataagcgcactcctccaactcaggccgaattcagttctaaacttttttttttaactttcaactttaacttttctatcacgttaaaacttttctatacatataaatttttaacttttccatcacattgttttaattccaatcaaacttttaattttaacgttaactaaacacgcccaacacgccctgatctacgaaaccatccatccgttccaaatcgcacaaaaaaagcaaagtcatgtggtgaagccgctgtacctgtacgcgaagcaatgaaagcacacgcccccgtcttttcccaaagacgcgagctcgccgctgcgcagcatccagattccagatagtactattggcaaagcacaggtttggggcgccatgggctcctaccactacacctccacctcccacttcttcttcgccggcggcggcgagggggagtactccagctacaagggtactggtagcaccgacacccacaggcccaccaccgtgcggatcccggttaccaccccgggcccggagcggccgccggacgacgcggcggcggccaggatccaggccgcgttccgggggcacctggtgaggaggcacgccgcggccgtccgcggcgccgacgacgaggcgacgcggctggagcggctgctccggaggcaggagacagtggacgccgtccgcggcgacgagcgcgagcgggcgcggttctcggaggcgctcatggccgtgctgctccgcctcgacgccgtcccggggtactacccggccgtgcgggaggcgcgccgcgccgtgacccgccgcgtggtggggctgcaggaggtgttcgacgccgtgctcgccgcgcccgacgccgccgacacgtgcggggtccccgccagcctggatcaggtcctcgaggggatctggggagagtcgccggctgcgccgccaccgccgccgccgccgccgccgccagcggcggtggaggtggaggaggaggtggtgaggagtccgtgctggaggagatttttcgggggagtgtagcaagtggtgtaaactgtcaaaagtgtatgcaaccgaatttgttgggaaatatgccggaaatatgttggtgtgtacctataaagtattaaagtggtgtagtataatgctatgaacaatcacgtaacatagtaaataacggattaacaacatgcttgttttgaatcttacatatctgaacatttgcaatctacttctatccagaagaactggctaattgggtaggtttatttgtccagtctgtagttctgacacatttgcaatctgaactcttctcttcagctctggaagaaaaagggaatcagctagggccgagtttagtttcaaactttttattcaaactttcaaattttccatcacatcaaaactttcccacacacaaatttccaacttcgtgtcacatcgttataattttatccaaatttccaactttgatgtgaactaaacacacccttatcctccctgctgagtgctggttctgtatttctgacaaaaattgttggatattattccactctcatcgtacatttcgttgatgttctggcgaagttcaaagttctcaaaaaaattgtccagtcagtagtgtaccgtatttgaatggtagtcaggaggtagggacgagtccattttcgaggatgggccttaatctcggcccacacctcacaactaccgtccgcgaggagcgagcccaagtaaagtccctgaactccttttccagttctctctctaagtctaacccaagtacccaactcatctttatgtgcctcaatgaaatgtacgattagagtggattgatgtccaacagattttgtcagaactacaaaccagcgagaaataaaccgagctgattccctttgttctatagctagctggaagagacaactacccaattggccagttcaacgggtaatttctccgttcttcagttaatccatatatcctggaattgtctcacgttcatcaacaaccacccagtacattcctttttccctgtcactatacccatccaggcaaccagctaccaccaaagtaatcttgggtatgttttctctcgttccctgaagttgttttgatccgcatcatttccagtgttccaccagtccacttgtgttgtgccatctctgtttctacggactttctccgttttacaatgtaagtcattctagcattttccatattcatattgatgtaaataaatttagatagatatatatgtctagattcattaacatcaatataaatatgagaaatggtagaatgatttacattgtgcaacggatggagtagttgttaatgtacttcccaaaaggaaaattcatcatcattgagaaagtatattcggaaaaaaattcatcatcattgagaaagcatattcagtgcaattgctttcctttctttttctatcgaatcaagaactgttgatccagcgtaggtaaatggagtaccaattatacatcatcttgcactgagcatcagtgctgtacagtactatataacaagagagaaaattgaagagtagtactagtgtttgtggtccgatgtgttcttacgtttcagatcgtgtggtcctttgccttttgagacgatgacactagcgtaaagatgtaccggaagctagagggagaatcaagcctgtggcgcagcaatggagccgcgaggcatcggtgacgcaacggagcgcgacttatcgccttttcgaagaaagcacaggaggaatgcgacgttcaactgcatatgtatggatggatagattgcagcttctttgataagcaaacgcttggaagcttgtcctggattcacatacaaatgcaggggcctgctgccgatgctgccgggtgaggacgtgaggtagagcagctgcacactgtaggcagattcagattcagattcagatgcgatagcagaagcgcagaactgaacatacgcacaagagtggtccagtccatgcagcttcagaccgtgcatcagtgcatcatgattgtgttcgttgttggggagattatctgccctgctaattggcgattagtggaggcattcgagacaagttggcctataaaattttcatccatgtcagtcagtaactcatcagggtaatcatcatggaatgaaatcagtagagtagatagatgaagggaatcaaacatctctggttaggctaggcatcagtttaatgcctagggtcaaacaaaccaaacagcacggcagagcaagctaaataaaagaaaatttttaaggagtgcttagagaagtaaccggagttgacacggtacagttggccctccaagtcgtagtagtttcgtatcatcaactgataagcacaggattagtcagtcagcgaagcaaccttgcatctatgcatggcttaattatgctagctcctctgccaactgatccaggactccctctactaggacatcaatcatcacatagatgtactgtacgtagttaaatataattagcaggagattgatgatgcatgtgtaacgtgttgattggataagggaggtcatcagccaatataatgcatgaaatcgatgatcaacatggcccggccggtcagaatgatgagctcatgcgcatacaagtaaatacgttatcctgctaaatttgttgctggtatccggctatccgcatctttgagaaattgtctacgttcgagattgataaacaattaagattaagggcctgtttagatctcttggcaaaattttacgctctgccacatcgaatgttgggacgcatgaatagagtattaaatataaacgaaaaaataataattacacagattgtgcataaattgcgagacggatcttttaagcctaaccgcgccatgatttgacaatgtagcgctacagtaaccatttcctaatgacggattaattaggcttaataaattcatctcgtggttttacaggcgaattctgtaatttattttgttattagactacgtttaatacttcaaatgtgtatatccgatgtgacacgctaaaactttacacccctccatctaaacacaacctaagtaacgatacggaaatagactatgattaattgagttttaattattatgaatttgaatataaatttatttgctattttagaacaacttctatatagaggtccttattgattgactatatttttctaacaaactaaaactgtttattaaggaataaaattaatttatggttaaaatttatatatgtgttcttagtgacttaaaagtcaatataaaaaaagaactacgttaaatgtatttaaaatcaacttcaatttttttttaaaaaaattaaatttaaatttaaattttggctctgagcaactaatgggacttagaaagtttgtagtttgaaaaacatgctaacaaaaaatcaatgtagaattacaacttaattaggcgtgtgttttgttacttgtatatgggtagtaacatacacgtccctcgtgtaattgataaagtattacatacgcagtattttacattgtactgtatatataatcgcattttaggggagacaatggaacacacaatgacacaacgtgacaaccagagggagcaaggaaagcaggatagctttacaaggaaaggaaaaggaaagcggccgcggacgccagccgccattccaatccaccctatagaagtgcctccaactgcagtgccaggtgggccccgagaaccgggcccacatgtcatcgaggttctgaggataaaaggcaggtagcaaaacgatggagccaatcatcatagctgtcgctttctttctaccactactgcaaaatcctaaaaaatcgtcccatatcggggaaagcctagcgggtgcagccttcgcccgtttgtccttttatagatatcgggtgaaaaactgaaaacccaactcatttagcactccagttatttttatccttatccactagattgatcccatcaactgtcatcgttttctcggccgtagaccatgttgagctctctgcccgtcctttttctacggtgctaattaagtttagactacaaaacatgattctaacaatttaatattatttaggagtaatatgaagtactctatcaatttcataatgtaagtcattctatcatttcccacattcacattgattgttaataaatctagacatataggatcccacattcatattaatatgaacgtagaaaatattagaatgacttacattgtgaaacggaggaagtagttttgaagtactaaagaaatttatttgcttttcttaacaacttaggagtataaaacaatttgtccattcgtactttttctaaaacactataattcatattgagttttagaatatgattttaaaattaattttaggggagggttttacttagcaactttcatcttattcatgataagaaaaaaaaaactcaagattccaggcttctattggatatgttgcatcacattggttgcaaacgaaaaattgtttgcgttactaatgaagcctacttaaacacggaaaataaaacacgtgattatagtaagattaattaagtaacgcaaacaattaatatgatttttaaattgaaaaatagattaatataatttttaaagcaactttcagatataaaacttttaaaaaagtacaccgtttaataggttaaacaactgaaagggttgagaaagagaagaaaagaacacagcctaaatatagcaggttaaggctaccggaagatttcaatctaaaaaaacattatcaatgcagtttagttttctcatgttcatcaatttaaatacctaacaatacataatttgcagtattatattgacaaatgggcccacttgtgcaacatatatgcttttttcccccgaaaccgcggttttcgcttggttaaggtctaacgggtcaatcaacaaccgtgtcttcttaacgggttggacaccctatccaattaacactcctccccacccatttctatccccattcaccaccgatccccaccaccaccaccaccccgacggctcgaccctacgaccgtggccgcagtctgcagcgagctccggcgccctccctcccctaggtatccccgtcgatcggcggccgcctcccccggctacgatcgccgccgctccgacgaccaccggcgtggtccggcgaccaactccggtgagctccctgctcctcctcagtctcatctaatctcatattcatatggtttccccaacctccgtggccgtcggggccaccatcggcgcggggccgccgacccgagtccaccaccggaagccgccgccgccgccgccgcgctctttctcgtagccgctcccctcaccgtaacttttcttcccgttgcacccggtcgccggccgtcttccgacccgtggccggcggcaccagcaccgcctcgccgccacggcgatcctctaaaccccgatctcccccgaccccaccccgaaaccctaatcctaacctcgccggaggcagggcaggagacatgtgtggtttccatttttggcacttcccaattctttgctagtcttcgctagacgctagtgatgcttcactgcatagcgagaattctgaatggaataatgaagctttaggttagaaatctagttgggacttcaaaagattgtgcgaataccaaacagggaaaaggtcaaatccttgtcctcgttctctgcctccaaacgcggttatgggcttggcgcttactagggattgccggggaagtgggctgttgaaacgatgctacgcgttagagaactgtgggcaagactggctgttggggagaaggggtggaggtgaggcgatgcaacgatatggcaacagatttaaatgaatgggggaattgaatcttttattggtggtactgatagcgtgtgattagatttgaatagttgcaagaactatgggcaagacttggctgttggggaaaaggggtggaggtgaggcgatgcaacgatgtggcaacggatttaaatgaattggggaattgaatcttttattggcggtactgatagcgtgtgattagatttgaatagttgcaatacaaactatggttgccatggtatggtcaatgtggctgggagtggaacagttttgatatcaacttgggggaagaaaagaaaaaaagaaggcatatatttctcttggggtgatgagaattgctataacaactgacaagtgaaagcaacaaacattaccccccatggaaggtatccgtgacacgattgatcaatctacaagtctgcaaatgtaagcatgttaacaaacctggtaatatcccaagacgacgacgaagatgacgactaaccaagtggagaagttaaagtgcttggatgaattagttgaggaaaaataggcaatcaatcaatcaactgcatattgaaccttaataaatggtcacaaaagccccagaagaggaaaacaaccgcaggggtagagaaggaatgagcagtcaaccagcaatagtggaagcgctaagtattgatttctattcactttctcctctagactattggtggttgagagtgatatgtgagggagggaagccaacaaggtgaacaaagaggaggaaggggaaagaaactagaggagaggcaattgaaatctttctttctcttttgcttgccctcttttgaatcaaagttcacagctttcacttgtcaactgcagcgcttctcgcttcatgatgaaatctattcccttcttcgtttctttttttgcccctcaagttaagataaaattttgcttcctttttgctctcaggcacattaaccatatgtgccatgtgttgtttgtacttcaactcttcaaatgtaaaaatgctctatcagttctgccaa

SEQ ID NO: 45104 - DNA, 8742 bp, Oryza sativa
taggtagggataatcctaatgctaaaattagctcatgataccctctgatatgcaggcatcccttcggcaaatgtggtgatggaccgaccacaagatcctttcaactcacgaggtatcatgacatgtactccaccttccaggtaaacggtgttttgctctggtaaactggatcttaatcgctgtccctatatgcatttgtcttgttccagggattgcagttccccctgcagtcaagatgaggaacatggctggaaacaacagtccatggatagaccctctgccaccaccgatgaatgcgcgcaatgggctggcaaatgccagcctcttctccacctctttgccagtccttcctcatgaaaaaagtatgccactttcactcataagacatgtcatgctctagtctgtgcatgtcatgctggaaatagcttgctgtccaaacaactgatgtgctcattggtgcagtagggtgtttattttttattttttggctatagtactgtagttacataggtatgactgagggattttaattgtgatgtgtgcaaagcaaagttggaagagggaatgacactagggaccgagatacgagggaaggctgcaaatggaattagttgtgtccaaatgccaaatatgtggtttcacaccaccatttattgtaaaaaattcccatctttaacatgccaaaaatcacatgaatccaaccttttcttctgtaatgtaatgtagcactggctcatatccatatattattatgaatatagcttgaaaagggggcaccacctttgctttggaggcctagaaattactacattaatatgagaaaaaaatctaagccgttagatcattgtgggaccaaattataaccatgtagattgatagcaatagtcgtataaaaagtaccattgtgtatatatagaatccgaagaaaagagttgtatattgaatccagacctacttttaatatctgctgtatataaagtataattacatacatgaaaataggagctaagagctctatagcaaatccaatttaactaccccgtgcaaaattgtgtagggaatttccctagtttgtattgatattcctgataatgtgtgtttccctctttcagtcaactttcttgattctgcacgtggcaccccattgatggatgatgcttctgcaaaactaaaagagctcgatgatgaccctgaagggaaggactacaagtttgactttgatctccgccaaatcgatgatttattgcctaatgaagatgatcttttcgcgggtatcacaaatgagattgagcctgctgggcagacaaattctatggaagaactggaggaatttgatgtatttggcagtggagggggcatggagctggacacagaccctgtggagagcatcacagctggtttggggaatacaagtatagctgatgggcttagaggcaatggggtcaaccattttggtccgtcaaatagtgccagcactgtggccggggagcatccatacggggagcacccttctagaacattgtttgtgaggaacatcaatagcaatgttgacgacacagaattgcgctcactttttgaggtaataactgcaatgtttgttagctttatataattattgccatctgagattgatttgttagtgttacttatcagtaggtataccttgcaactgaacaactttatgtgctgtctaatcaactcatagtcagtgttatgtctgcacttctcttataatgtatctcagttgatctttacaatatccattattgtatttcagcaatatggggatatccgaacactttatactgcaacgaaacatagaggttttgtgatgatatcttattttgatatccgagctgcacgtggtgcgatgcgtggattgcagaacaagcctctgaggaggagaaagttggacattcatttctccatcccgaaggtttattatgttatggttcactttcaaatgcttagtccctttaccataaagtacttagcagtttgccatgttgattttgtaggagaatccatcagataaagatttaaaccagggaactctggttatttttaacttggatccctcagtttccaatgaagaagttcgccagatttttggaacatatggggaagtaaaggaggttaggatgttacttccaatttttccctttgaaatatgtttttgcttgaaaattgcatgttcttacgttcttcgtatactttgtttctgttttttggaattcaatctgatggtgttagtttctatccacagataagagagacaccaaataaaaagcatcataagtttattgagttctatgatgtaagagcagcagaagctgctcttcggtcactgaataaaagcgagatagctggaaaacgcataaagttggaaccaagtcgtcctggtggaacgcgcagaaagtatgattatgcgttttctttccctatccatttatctgtcatagtcttgagttgttgtttgcactttgcagtagaaccctactgaatttatacaccaattttgggatgatctattgatgctgcagttatgttgatttatctgctgtatgcaaatattttaatgtatcaaattgcactatttaactgaccaaggcatgcctgttaaggcttttcgttacatcctcgtgatgctattagcaatctgattgttttaatccagttttatcatttcatcagcagtagaatacctcagattcatcctcagttgattggctttcatttatttcaacgaaatacttgcagttttgaaagtaattagcttgttgtacaccctgtctccctgatttatttaatgggcagtgcactatttcctgaaggtatattttcaagcttgtggatatgctcatttagtcctaggattaatttaagaaaaatgcttaatgacattgaaagttcacacgtaataccattgagagtttgcaccgtttctttttaataccatttccgtctacttaactaatgtttccattaactcagactaaaaataacccttgtgaaccacactcacctcaaccatggagaaagctccaactgcaccactgattgttgtcattggacaccgtttcccatcatctgattcccacagtgggccaccaattcagagattcactcagacacatgcatagtagtagtgatcacgatttcatgagagagggagagggagaggcagggcacatggtggtggccattggcgatgaaatgattgtagatagtggtgcggcaggcaagtgtgggttcagtggttaggaggtcacccagggtgctgtatatgccgcgcaaaacaaatcacgctcatcgccaagggagtggatggacaaacagacaggttgagcggacaggtcttgtctctttcgtggctagagctgctctgctttccgtctcttgcatttgatctagcatcgtcattttcaattgcctctcctgctaggaaaataaacaaaaacggaaaaaaacagaaaaaaggcaaatggaggacaaaaatggtataataaatgatcaaatggtacattgcaaattttcagcgctattaaagtttattatgagctttagtggtacaaatttgaacttgagaattgtttatgccatggaaccaatctttcctactgtttgagttttggaaggcatgttttttcagttatcgtgcaaaccaattatcattgacagaatgtttcactttgttaacactgatctgatttattctcattttcttctggtttagcttgatgcagcagcttggtcatgatatagaccaggatgaacccagaagctacaggattcctcatgttggttcacctattgccagctctcctccaggtactcggactggatctactttagggacatttaatatgcttctgtctatttgtttacaacttatgaatgttaaatcatctcctgtcaggggcatgggctcaatacagtagtccaactgataacaatttgttgcaagcattcaatgcgtcaccaactggaaatggcatgagtcctattgggatgcctccttccttgatatcgaatgctgtgaagattgctccaatcgggaaggatagcaactggtctaaatatgacaaagtattctcaaacaacaaccagccccacggtgctgcatttcagcattcccattcataccaagatcacaaaagtgaacatatgagttcaagtcctgggactttaacagggcctgagtttctatggggtagtccaaagccttattctgaacatgctcaatcccctatttggcgtccaccagcaattggtcatgcaataccatctaatacccgttctcaggggcagggattattgtatggtggccgtcaggcttcactttttgggtctcaagatcagcttcatcatcatcatgttggctctgccccttcaggtgctccatttgagagccactttggatttttacctgaatcaccagagacgtcttatatgaatcaagtcaggtttgggaacattgggaatattggtagtggccgaaacggaactggcctcatgctgaacatggctgctcgtgcttctgtaaaccctgtttctgctttgagtggaaacatgtcagacaataactctagtagctttagaccaatactatcacctagattgggacaatcattttacgggaatcccacatatcaagggcctggttcttttggacttgacaattccatcgaacgtggtcgtaaccgccgagttgacagcagtgtgtttcaagctgatagcaagaagcaataccagcttgatttggagaagatccgtaaaggcgatgatactcgaactacattgatgattaaaaatattccgaacaagtatgtatgtggcttgatattgcattttcttttctgatcttacattactacatagttgctcagctcctaaattgttaggtacacttctaagatgctgctggctgcaattgatgagtttcataaaggaacctatgactttttctacctgccaattgatttcaaggtactagatttgtattgtattgtactgctgtttgcagtgacttgttttgatgcccagcagaatttaattatattttccccacgcagaacaaatgcaatgttggctacgcgttcattaacatgatatcacctgtgcacattgtatcgttctaccaggtatgtccatttcttttattgactcttgcatgctacacagttctttaattgatatccatcaacatgaagttcgtggtttatgtttatgtaagtttctcctaaatatgtctagctgagttgcacaacaacctaagattactggtagacttattcggaacaatttgtaatgatctgtttctgaatatgtgctgtaatttgcaggcgttcaatggcaagaaatgggaaaaattcaacagtgagaaagtagcctccttggcctacgctaggatccagggaaggactgcactcatttcacatttccagaattcaagtttaatgaacgaggataagagatgccgccccattctttttcattctaatgggccagatgctggaaatcaggtaagcttgtttaaaatgtcgacacacatttgtccgcttgttcttatgttcaaacagtatatcgaacaaggtaatggtgatttaactagcaaactgcatcttaggttataagcgtgtttctaacaccatgcatgaataccaggaaccatttcccatcaacggcatatgtatccatatgccactggaagatggagcaattgcaacaggggatccctttggaaatgaagaggacaacaatcagaacgagaggacagcaggagaagagttatgaccattgctttggagtcgccgataaatcttaactgcctagagaagagttttccttcccaaagtgtatagaagtgagaaagattggttagctgcgaaagtttgtggtgtggcatggcgcatctactagttttttttgtggcaaacgatgtcgccccctgaagaacaaaaaagtgacttggagttgagagttgggagtctgctaggtctctctctccatgtcttcctttcaagtttcaaccccctctgtacagatagatgtcgggagttgataattggtcgcatttgatttggtgtaaaaagagagtggtaccggtcaaactgtacagttttaaacattttaatcctctatgttttaggagacttgttaactctatgttttatcctgtgtgaactgagactccaaacagggttccaccttcctgtctacaaaccaaaaatcttgttatgtgcctgctttctgatccttcttccctgtcttgtgaattgtgatactgtgcaagcagagaagcacaacccaggcaagaaaggaaagtgatggctcctttgaaactggaacgtagatattttaaagaattcatgccgaaaacgatttaaatctaagtacaattctttcacaaatcatggcgaaatgagtacacaaggcgatttgaagcgaaaaggaaattcagcccagcctccaaaagcccactagcccatcctgcactcctatctcccaatggcccacacagaagcccatccaaccatccaacggtatccataccgcctcctaacccgcagcccgcatccacgccgtccatccggtctccactactccacccccggacccaccaacccaactccgccacccaccaaccgaaaatccccccacccccgaaaaaaaaagaaaagaaaagaaaaggagaaaaaaaaaaactcccgtgctcggctgcgttctactactagcctacccctatctctctctctctctctctctctctctcttctcgctagtcttcccccaaaaactccacccttccgcggcctcgcccatctcaccgccaccatctatcggctccctcctttctcgtctccaaactcaactctaattgagcgcgaaaacgtggacgcgtttgaattgggcgtctccctcggcttccaggaccttctagaaccttctcgaggctcccccggcctcgcgcggtcgcggctctgcctcccgctctctctcctagggttttccccctcctggtcgcgcggcgggggcggcggccatgggggacgccgcggcggcgtcgcccccggcttccctggggaagcggcggcgcaggggaggagcgggcggaggggacggcgaggggctgcggcgggtggcggagatcgtgatggtgctggccgccgctggggaggtgaggggtgggagggagccgacggccgcggagcgggcgctcgccgcggaggcgagggagaggctggctgcggtcgtcacggagggggcggtgcggcccaaggatctgttccccggggaggccgtgcgcgccctcgtcgaggatctcggcctcaacagggccagggatcccgccgccatggggttccgcccgcccaaggcttccatcgccgacaggctgatgctcactaagcgcaaggtttggtaactctcattcttttttcgcttcattcagctttatagctttacgatgaactagcaccattgacgaaaactggaacgatttggtctatactctatgctgcgttggggagaatgctcgtgatattattgaattgttagcttagctatatcatgtgaatgctactctcttgatggtttatattgattgattttctagaaaacagctcatgtactggtaagcttctgttactcctgtttaactttggtctgatatggtttgtttgccttcctagtgttgctggcttgttgcccactaagataatttactttgcttccccgtgttttgagtatatattcgtgttaagtgatggaggaaatcctttatatgccaatcaaaattcatgagtttccttatgggaaaatcggttccataacaccggaagatcctgagttcacaaatataccatataaattcatcggtacacttcaatactatccaaagttttccatggttgggcatataccactctgttgcctcttttccgtttaatgatttttcttctgtcaataatccgacgaaaaagatggttttgtccttacaatggatatgtctatcctgtgctggattgacactacatagtgaagcagcccactggcctggcatccaccgtacttgcgttcgcctctgcagcatgctggaggggtggtagcaggggcagaccgactgcaacactgtgtgcccgtgccaggggagagcatgcgcgtgcttctacagccacattccagtattcctggtggccggtgttgtcccttctactgctagccatcggggctgctgtccagcacaccaatatgcagaagaatcctcctaggggtggccgccgcgggtatttcttgacccactttagttcaactaaaatgaactaagtttcacttttagagagtctaaagtgaaatttagttcatttagtaggactagaatgggccaaagaatacccatgggtcaacccacacccatccctaaatccttatgcgaagcttagtgagaagtgaaggggagagagagcgagggtagttttgccacagattacggtaaagtgcctccaactcaagaaatggtaaaaaaactaaacaacacaaactttggatggtattaaagtgcaccactaattttcagcgatatactatttctgaagtcaggttcttctgatgccgcgaaaccaattctttccttatatgccactgtaaatttgctatgaaattacccatgttccccctcctttccttcttcaacctcatgggagttgattgcatggtggggtcatccatcagcgagatgtt

SEQ ID NO: 45105 - DNA, 1650 bp, Oryza sativa
aatgctagaaagtcttacattatgaaacggaggaagtaactatgtttggaagtctgggtacaatccacaattgagcagacaagcactaggcctggcgcccctcttgtccctttgtcagtttcatatatattggtccttccctctgacaacccctttgcccaatcccagcacttcatttgagtctgcttgctctcttgccttttttcttggcctctacgatactatgagagagcaggactgtggagcacacaacacatggtgggtggtggggaagctgtgattgactgccagccttttgaggggcagctctacagtacatagcactctctggctccctctctggcaggagggcttcttcatcggcgatcttgcagccatgcagatgggaagcatgtgttgcaagtatgctgcttctcactatgagctttgattggcctggtgatgagttaatgcatgcatggcatgttgtggaagagcagagtggtgctggcctgtgccgatgggggcccatgcgaaagtggattgagaagaagagaagaaaggaggggatgaagacaaattgtagttttgccattattctgaaggcaaaaaatatcatatgccactctttagtttctcattctaggatttcccactcttctagatctaattgataatttgccactcacttgatgtggttgatctatgaatttccacttgatggcatataagtgaatctggtatgacaattttcaagtgccatataagggaactagtgaacttgattgccagattaagaattttctctaagtgatgcctttctattttcataattgtaggagcaacatgaatttgaacttagtgtcatcataggtttgttttggttacgcttactgtttctttgtatgggtttcttcgaattcactttattattggattgatgtgatcgtacttctcagcattgagtggtttcacttagcctttcagttatgaattatactcttttttttctgaattgagtctagttgccaatttatcatcgttagttaactattatactattattaattatgcaaaaataattttgttgtagtctggtgagttcaccctcattgcctggtctatgcattttatttgtacatctgccaagttatcaatttcttttcttcttttaccctaattccagatggaagaagtcaaggaatctccagtacagccaacgactagtacagctcaaacaatcacttcaagtggcacagctgatttccaaggttttcatggagctcccaagtttgctgtcggagttcctaggaatctaccagctgttgctgccttgcctgctactgccccagtgacttctgcttccctggttaccttgaaaccacctggatcatctcctgtaaaatcagttaacaacccttcagttgttacaatgccccatatggctccatcgcatcttaaatcggataaaggagttaatggtcctcctaatctagtacgcaccggaggtactgctccaccttatctacaccatcagttatgcatttattttttgagcattcacttttttttagagtaaatttcacaaaactacgtattttatggtccaagttgcagaaaaccacatacactttgacacttggcacttaagtacatatattttggtagtgt

SEQ ID NO: 45106 - DNA, 14275 bp, Oryza sativa
ataggacgaggacatgacatcctattaccagccatctcacgaaattaataggatataccacgtcatcatcctagatggagcaaccacgtcatctcacgggtgaatccattcatcgatagtgtggttttgtgaaactaaactaccaaaatatatgtacttaagtgtcaagtgtcaaaatatgtgtggttttctgcaacttgaaccataaaacatgtagttttgtgaaatttactcttttttttattaattcctcattccatctaattctaagtaagatgcttgctttggtcttggtcttctggaatattgtttagagcttttgggtaaagcctcatatgtaaatgttctactaccattcccttcagattccagaccaagagaagtatcccttttcctggacctggagttgattattcagaagcgcagaaacaaacctgaaattcaacagtttttatgatttcaactttggacatagaaactattaagctcttctttatgtatcatttatatctttcttaaacactcttgcctagaagaatttctttcttgtgtctcaaaagtactttacatttataattctgattatgaaaaagagattcactttgattctcctagctcagaaactaattaggtgtatttccccctgcagcaacctatggcaacttgaacaaatcatttcatgatacatgtgctaggtccaatctaacgctgtacagagttccaatccggtggcgaaaaatcaggacacaaagacagcatcaattgatgctacagcaggaaaccctcttacaggtcatcatgctacaccaagcgtggcacctgttcctccaaaacctacttttgctaaccacagtgaaatagcaaaaagtgttcaacgtgttctgcaccaaccagctaatcatcctagctggattccgccatcaactgagtacatgcgttctcgtttggactgtcaaatatgcaaagtagctatcatggatatggaaagtttgcttgtttgtgatgcttgtgagaagggagcacacttgaaatgccttcagcattatggtaataaaggtgttcctaaagctgagtggcattgtccaacatgcctgacaaagagtaagggcaagcctttgccaccaaaatatggcaaggttacaagaactgctgtcgaaccaaaggctactccaccaccagctggaacgcaggtttcttcgcaaggagcggcagaaaatattgctgtaaaggaaaatcaccaaaaagtggctgtaaatggtaatcttctgaatcaaaactccacgcaagctggcagtgttgctcagagcagtactgttttggctctaggtgttactgctgctgttgcacaatcacagccgctttctatatccagacttccagaaggaaatttaaataatgatgcagccttatctagtgaaaagacggggaatgtgggtccttgcagtagcattgcacatcgtaatgaaaagccccctgatgaactacagagcagtggactgcctgctaacagtaagactggaacccaatcagggaaatctcctaatgaagaagtgtccagtgtattagtttcaggcagtgcggattcaacaaatgataccttgcatgagcagaaatctcatgaaatttctggggaaaaatgctcagacaactcttctattgttgcttctgaagcaaatatcaagtcaaaagcagactctgagctcatttcgggcagagatgtggaaatggttgataatgatataccaccaaaggatcaaaccaacaacattgccactgaggacaaacccagtactcaagaaacctctgaagcacataaaatggaagttgtggaggtgagcgccaatactggaatacaaataagccagggtgacagtgctggcactgaagagaatctccacactgaagtaacttctgttccacacatgatcaatgatgtggcaatggctaccaatgctggaacaccaatatgtccaagcaacaacgttgccattgaagaaaagcccaagtctactgtaatttccgaggtatgtacaaccaaagatacggaaatgactactgatgccactttagatcaaaacaccaatgttgctacagaagaaattcctttgcctgaatcaatttctgcaactgaggatgctgacatgactactgatactggaataccaacaaatcaaagacaggaagtaaatggattggctgaaaatggcagaaaagaacatcccctgggagaaacagataaacacaaatctgaccatagtacgatgcctgatatgtctacagccccacagataacatcaaatggagttatgcattcaaaagatgaagctgcatgtggccatgaaggtgaaattgtggacatcagtgcagcagcaacagaggaaaacaattagattcagatatagtagattgcatccaattccatttgcaggtgtgttctaatctaaccagttatactttatggtgctagattgctagctgtattaataattctttttccagtattagtaaaggcttctttgaaacacaggattctgggatggaaggagtacttcactatgaattcctcgattccaaaatagccttatattggttgttccctgtttatttgacttagggtcgatgctatctttaaagcgatactccacatttgaatgctgttttatgcgtttcaacgatgtcatccgtaacatatttactgcctagtggacctgtcacctgttagcgaatattgtgctcgagaccttgagttatctaaccattatgcagtgctgctagtttttgctcaaattctaagagttaaaacctttgacaggcatatcagaaattcaacaatttgtacctgaccctatattcaattatttttacagacgcgatcgtgatgaagccacctgtagttcggttagtgcctagcgtagcttcagtgattaaccatgctgtcaacattcttttggaccagtcaccataagttcatcatgtgctgccggccatttcccatgaggtttgtgctacgcctctacatctcttaaaacctttcattcaaaattaaatgggcagctggtctcataatagaaactatgctcaccagacaaagcccacaatttaatcacttcaaccaacttatctttttttgcatttctgttgacatgtggtttcttttaactcgtgcagtgcctacttcctactggacttgctggaatcaatgtagcgcgcatgaaggatgttgttaccttaccgtagttccttcggctatcactcctagctatatttagtttctttacctgtcttgtcttcctctgcgctgatcttataaaggctgtaattacataggatttggttgagtgactcataggttctgtcgtaatgatatgattttttaccgtaaagttcatcaccatcggggccagtgcaaggtgcactggtgttctcgattgtttgatatacccgtgaatctctgagctgtcttacaaccgagtgtttcgcccagatttctcaagtattccagtttttggccggttctgaagtttacctgaaacgagcgacctgagaaggacggggacacgttcacttgggagttgtgatgtaaactggttgcgagttgcgacgcgcaacgtgccaggttagtgtcacaagatagctgcaattacacatctatcttatttgcatttctactcttccgagacttatgttgtgcaattgcaaatattatatcatcaatattacaccatatatgtcgccatatgagacatcacccataggatagccaaggtaactaacgttgttacggccggtctgactgtctcgctacgagcctaagatatcacccataggatggccaaggtaactaccgttgttacggccagcctgactgtctcgctacgagcctacgaactagtaagatcagaaagtcggtaaatttattctcgaaagtaggctaggcgaagatatacatggtagaatacaacaccacaattgacagatcagacgaaacacaccgtgctccactgctccatgttcatatggccaggaacaggaggcagcacagcataacgcacgtccgcgacgtggcgactccgcggccgccgctggacgccaacggcgcgggcgccggagcggcagctcggtcgcccttcctcgacgaccctggcggtggcgtcgtaccagccaccggagcccgcacgtcgacgcgcagcttcagcccgccgccgcacttgtccgggtcggcgctgacgaagtacctcgacccttcgccgccgaggtcgacgcggctgagcccctccgtgtacatcctgacggggctcccggcgtcgcacgactcgaactcctcctcgccgccgacctccgcgacgccgccgtcctccgccgagtacgcgaaccctgacaacaacagcaagttctctgaaactgaatactgaacagagatcgacgcatgcattcgtcatggacttacagagggtgtctccgacggtgaagagcctgtccgcggaccaggcgaggacgtcggaggccaccgcccaccccgggtcacctccgacgacgtggtgacgacgtgctccggcggccgctgctgctccagcggcgacaaccagaatgagaacgccagctgcggcggtggcagtcgtgacggagacgatggccatgtcgtcgaacgaatcgtacgcgcgcggcacgaccgagtggcgcaggagggaggagcggacgcgcggtatggtcgatggatgatgacacacggtcgtcacacgcatcgctgctttagattggatcaaatgtctcgaaccaaccagtcctctctcctctcgatcacgagaatggtaggttcaaaatccataaaaaagacggagagaatgttaggttaaaacctgctgttctgttctggtaatggccatctcctgctttctcctttctcccagtgatgcaaggcgcttgatttgctatgcagctaatgtgcagtatttgactaaccagcgaattccaatttgttcgatgctcacaacgctacatgaactagcagacaaacacctgaaaaagaacacgagtactagtactcttgagtattgaagtctcagagaggaatacaggggaaaaaatgcttgggagagatgccatgccgcgctatgttgttcaacttcaaacaagccattatagaacgaaccagaaaggtcattgggaatgcatccccgcttctggacgagtcaagtttggtcaacgtcggactgccaacaaggccatcggatgatcgcgtcgtcccatcggacggtcacgaagccgccacgtcgcgcttgtcaccacgctggccactccggactcgtggactccaccgcagcagcagcagcagcagcagcagcagcagtgaatgctactctcgctctgctactcactcctggcgccggtgacctctctgccactccaccggacggcgacggcgaggcgggtgagctctctcgccgcctccggctctcctgccaccgggcctccacattcggcgtcgcactccttcgtcttcgcgtgatccggtaagccgtcgccgctcgtggcaacggagatctggttattttggtgcttgatgtgtgtggatgagctgagagtttcgtggattagtggagtctaagagatggccttggcttgggtggtgggattggcgcgtcgcggcggcggaatgcgcttgtctgtctctcgacccctgatttggttagtctcgatggttccggtggttttgttcttaggaatttccgaagaacttcatccagttgtcgaccaatggcgttgtttgtagttctagatttggtccagttgcgtgctcggtggagatgatctcgatgcagagctatctccatatgaattatcgattttggttgcgtttcacggatggatttgtttaggtttgagataaatgttgttggcctgttgaaactcccaggtattgagctgttttgttgttgttgttgtgtgcggcagtaattaatgttttttcccttgggccatcagctgtttctgcgattggcatttaatagtatttctgtcaattggtgggggagatgtgatgctagaacgatttaaaatgctagtagttatatgtgtctcttataatcatatctgaccaattcaaatgctcagcctggcagatcgggatcgactaagcattggcctttgcaagttttgaagtgcatttcaccgttgcttttgtcttgagcaagagtttatagagccatacagctccgacaaaaggattcacctattccagaatgtctgctttgctccgtgaaacttcgtgtggatcattgctgcaaaaactgcaggtatgcgtgtgaactgctccatacttgttcatgtcataactcattagagatttttttttttgcttgtgtatttgtgttcaagtagaggttcttcttttctatttttgaattatcagtcggtatgggatgaagttggtgaaagcgaggaggaccgcgacaaggttctatttcagctggaccaggagtgtttggatgtctacaagcggaaagttgatcaggcaaccaaatcaagggatcttcttctccaggcactggattactcaaagacagagcttgctaggcttgcttctgcccttggtgaaaaatccatagatataagtgtaagtaaatatgcgcgtcttcttccagtacgcataggctaatttcagtctgaattaatactggaaagaatgaggcaggcacgattcactaaaattttcagtattcaaatatgagttgttgaaatactgactactgatccactttcgtgttgttctgtgtcattgtgtttcttgcatcttgacttaccagttctgccatgctagagtatgtttggtgttgattgctggcactattagtacttgcatagaagttcagtaaaaatgcagttggttttttagtaacggtgtgcaagtcctcttgaaactgatgattatggttaataggatctggcattgtagttcagaagtcagatggcacttcacatgtttgctaaattattatgcttaaatattagtggatgcaaaagtgacaattttttatctgtacagcctgagaaaacagcacggactatcaaggaacaactaactgctatagctccaacacttgaacaattgggcaagaagaaaaaggagagaataaaggaattagctaatatacagtcaagaattgagcaaatacgtggtgagattgctggtactctggagatgggacagcaagtggcactaccacagattaatgaggatgatttgacagttcggaagcttcgagagttccagttacagcttcaagagcttgagaaagagaaggtacaaactttgtctgtttcatttggttttcataagtaatttatattgcttggtgatctctgtgtttttggtttcatagagactataatatatgtttccatgaatatcacagagtcgtaggctggaaaaggttcttgagcatgttggtatggtacatgatctatgcaatgtgcttgggatggatttttttagaacaataactcaagtccatagcagtctagatgactctattggtaacgaacacaagaacataagcaatgaaaccctgtcaaaacttgataggaccattggtactcttaatgaggacaaaaggttgagacttgagaaggtaactcatattttctttctttcagttttatacttagcaaccaagagccattcttatcctggatctcatgtatgatttatactgtttattcagcttcaagagcttgccactcaactctatgatctatgggatcttatggacaccccggtggaagaaaggagcttgtttgatcatgtttcgtgcaatagaacagcaactgttgaggaggtcatggttcctggtgcacttgctgttgatgtgattgatcaagtgagtcacacaatatactaattggtcttttattggaccaccttcagcatcccttcatatatattttttacttctcgtttgattttgatcttcattacccaatatttcaggcacagactgaggttgaaaggttggatcagctaaaatacagcaagatgaaagaaatagcttttaagaagcaagccatactggaagatatttatgctagcactcatgttgtattagacacagcagttgcccatgagaaaatacaggcactgattgagtcagggaacatggaaccttcagaactgattgctgacatggatagtcagatactgaaagcaaaggaggaagctctgagcagaaaagaaatattagataaagttgagagatggatatcctcatgcgaggaggaaagctggcttgaagactatagcagagtatggttgttctgactactagtgaaacgtgttatcccacctatattctgaagctatgaagtactgagcatgaaattccttttgcaggatgacaacaggtataactcaggccgaggtgctcacctgaatctcaaacgtgcagaaaaggcccgtattctagtcagcaagattccaggtgcctactgtgatgcataagtaaatagttttggcagtaaatgataattctaagctttacacaatccaactcaagaagctctgcatttgggcataatgcaggataggctatatcttttctcctgtaaatattgtttttcctgttcgttgctaatgacagcaattttttttagcccttgttgaaactctggtggctaagacgagagcttgggaagaaaatcacgggctgccatttatgtatgacggtgtttctctgctagcaatgctggatgagtatgtcattcttaggcaagagagggaagaagagaagaaaagaatgcgggttagtgacacttcctttcttatactatcagaagctccttagtatcgactggatattgcatccaaatgcccttgtcaacaaggattctatggtggtgctacttatccacgcttcgatcaatcaaatgatgagtcagatgttgcaattggcatcaaaatcatctgttctatttctttcacattccaggaacaaaaacgccagacggaacagctactaaacatcgaccgtgaggggccattcggaacacgggtcaatccctacagagtgaccagtgcaaagaaggtggctggcacaaagccaaacggtggcgcatcaaacgggacaccgagtagaaggctatcaaccggcaatcagctgaacgagagcaagagtactggccggtctgctggtaaggatgacaagaaaggcgcgtcgaagaacacggcaacttcactgaacgaagcagctcctgcagacaaggaagctgcagactcatccaccgaaaacttcgacgctgatccggttcctggctcgacatgatctcgatgtggtacagatgaatggtgatttctgtcttttttgacaccctttattgtgttcgttgtagtatcttgttgttaggttttagacctgtcgtttctttctgttgactggtggttagtgcctgagtggtgttcaaacatatgggcggtttatattagctgtttagctctaatcttgccgtcagaagtaaaattagcctctcgtaagttttattggttttacaacatgtctgttcagtgcaacattgggtccggtttggtatgaccttggccctgttctctctctctctctcctctcctctctttctactctctccaccttttagccttgaattagcccatggatccaaacatgcacatgccaccctagactaatgtttagtctaccaattcatgactaaatattagctctcaaaattagccctgggctaatcttccaaacaggacccttatttaacctggcaggcgggcactaattcaaccctttcccaatgcagaaatcttaaattgatatttcttgaaaaaaattcttaatcgcccaacacctaaaactaaaataacacagtgtatattgttttatctaaaacttgtgtattatcccatagcaatgaaaaataaccagtacggagtactagcactatacttcatcaaaatgattagcttaagagtcatcagcccatacgcaatctcaccaaccttgtacgagtacgacaccgccataactgccgagacgatcccagccgtccaaatccacatcgacggctcagtcttccttttacccaaccaaatgccgaagttttttttaaaaaaaaattcccagaaagccgaaaagctttgcgttagaaagaaaaagaaaaaaaaaaagaaaaacccaactccgaaccctttcttttgctccaagcgcgcgcgccgccactggactaccgcaccaccaccaccggccgatcgagcgcggcggcggctgcggcgaggccggcggaggaggcgagatgaggaagcgggagagggagaacccctgcgagatctgcgggcactaccacaacagcgaggaaggggagcggtgcggggtctgcggccaccggtcggggccgatggccggggagcccccggcgacgctggacccggccttccccaccgaggtcctcaaggacttcctcttcctcggcagctacaacaacgcctcccgctccgaggtcctcaagacgctcagcatcacccacatcctcaacgtgcgtaatgtgttgcccccctttctcatgatcccaatcgctcctattttgacttgtttttctgcgtgatggagttgaggcgcgatgtcatgatctccccttctgcgggtgagaatattttttttttgtgaagtatctctagggtttggggactattggttgtaagtttatcttgttgtctcgaagaagttgtagagtgttggtaaggtttgatgttgacagggaaagggttatcatccattggtcaatacaatgtggtcgctcctatcgctggtagaaaagttgcaacaaggaagaaggatgggatgtgttgattgcattgtcacagattcctgtacatttgtttgatggtatatcatgccctcatagccagttctttttctcaactccaaacttcaacttccttgttatccgttagcacgctttttagactattaaatggtgcgtttggcaaaaagtttctatatagaagttgttaaaaaaatatttttcaattttataatagttaatacttaattaagcatgtgctaatgagttttcttgttttgcgtacgctgaaaatatccctccaaacaattgaatcagacggagccttacttatgacctgccttttcagtaccaaatgtatcaagcatatttttccccctgagtggttggccttttttaatgaatgattagccttttagaaacaaggaaaacaattagtgtaaagagtttcttcaaactagatatctgagacaaattggggtaggggacttgatcgaaagaaagtgtaaagataaacacacaatcacaactgggtagattgataattgggtcatgttagattgaagtagattctactcctttgtaattaattcgctcatattctaattatcttcctacttttggatgatatgcatcgtatgctcataatgtattctttcttgttggttgagtaatttctccttacaccctataggcctaaaagttgtagttctgctgcatatttctttttatcagggatgaccgtgccgctgtggtgccatgtttgtattttatgaactttacatatgtcttttcactaaacatgatttatcctacaagagaaacaaagagatttgacaaaatgcggagtaaagaaaagttggggacattttgtagcttagaaatgttggtaccatagccctcttcatttttaatacattattgtgataaactgatatcttagtattatactggtcctctattagttagttaatcatgtaagcatttttctcatatatcgcagactgtgccagattgtcagaatctctaccggaattctttcacttatcactgcattcaggatgagaggagcttggattttgatggtgcaaacaggtttttaggtaaaatccattctattctttgagcatttttgtttggaatggaatgaaatctctattttttccctgtgaaatttcaagtttttcttgaattcgtactccagtagatagtctctgtgcttgttttgacatttgaaccaatggaaatgcattcctgtagtaggaattatgctgtagtttgcttgggcagtgctaaactagaaacaaatggtggatgtttttgtttttatcatttgtttcgttatctgccattgcagaacagtgtgaaagggagacatcacgtgttcttgtccattgcatgtctggaaaaaacaggtgtgatagcagtgttgtgagcattcatgttgttagcattgttgtgaatgatcgattaatacttctctggtacaaaatttccaggtctgcagctattgtaataggctacttgatgaaatctaggggatggagactttcacagtcttaccaatgggtgaaagaccggcgaccacaggtgcaactgacagatggtatgatcccataccaaataatttatttcttctttcatgcctgaaaaatctttgccaacccctattcaaattaatataggtgcttggcgagatgttctttgcaaaataggatgtagcatcagtgcttgacggggaccttatacaggctcttaaatttacatagataagctttgaaagcttctgtggctcatttacctagcatagtagcgccctagtacttatgcatagctactactcaagcttttttgttcttatagatttcgccttttgtttttcaagtaacattatgaattgatggttaatccaaatgtttgatcatgagctaacagtaacctatttgttatatatacagcttcacagaatcagctcgttgagtatgaacagaagcttttcggacccaatgttggcgcacctgctcaatcgtcggttccaactgaatcatttcgtcctcttggatttggtttcccaaaaccggcaggtgacatccaagcgcccgtattcaaccagcagcccgtgccgtccatcttcgagcgagtcaacccaagtaatattcctagtaattttacttttggagcaatggaggccaacactcctatggacgacaatggcgcgcccgcaccaacttcaggtgataacccgatggacagctcataacaagtcataactcataagaggacctgacatgttcaatctcctctgtagtgattagtgaatggatattactgccaggcatatctgatatgcaaaatgggatgttatttagatggtctctagaattgatgaatggttctggcaaatgatggcaattgatcagggttatatgcactgactgccaatcatggcaaatggacctgtgggtttatatgcaatagactaagttaatcatgatggcacgctttttcagtcccatgaataaccttgaaacttctattacgtacgcatgtcatgcatagtgtatctggacgcagcatcggccaatagcgttaacatcagggcaccttcaaacaaaccatagtgttaacaccagcatcggcccatcgtttggcttattaatgaaactcttatatttgcaaacataaagtaatttgtgaatataatttatatgtactcgttcttaacgatataaaagcaaatgtttaatataaactttgatgaaaaaaaaacctcaaaatcagttttaaatttaagattacaaatttaaattttggttgctaagcataagcgaaaagatatgaccaatagtttattcttaggctagttctttttctcaactctaaactttaactttatcgtttttcgttagcacatgcttttcatataaaaagtttttatgtagaagttgtttaaaaaaccaagtaaaattatttattaattttgatagttagttacctccatatatatatgtatgttaaactagccaatgtcatataaaaaacctagagggagttaatcatatgctagtatatgtattctcgtttcgcgttctatgaaaatatccgtccaactgaaaaaccaacggggccttagtttctcacatgcttccgtacgcctcaaccaattctgattctgaaaccttatagcgagatgcatctggacatacagaacgtacaaaggttcattgcacctggacgtacaaggttcattgcacctggacgttgtaaaaaccaacgaacctagccgcgcaaacgccccggcgtccacacaccgaaacatatataaaaccgcctcgtatcgtacaagacgccaatccacccgaacctgcaacggaaaaggaaacggctttgccggcacacggcaacaaatcttgttcgcgccgccgcgtgcagtgctcgtttcgatcgaggcaacccggcgatc

SEQ ID NO: 45107 - DNA, 3381 bp, Oryza sativa
gcgagtcgtcgagcggctccgcgcccgagggttcgacgccggcgtgtgcaggtcgtcgtgggaaagaaccggcagcgtgccggcgggcagccacgagtacgtggacgtgacggcggcggcgtcggcgacggggcgtcgcgctcgctacatcgtcgaggtcaacgtcgccggcgagttcgagatcgcgaggccgagcgccgagtaccaggacctcctcctctcgctcccgccggtgctcgtcgcgactcccgaggccttcaggggggtcgccgcggcaatgtgcgccgcggcggcggagtccatccgcggcgcgggcatgcacctgccgccgtggaggcgggcgcggtacgtgcaggccaagtggtccgcaccgtacgagcgagtggcggcggcggcaccgccggagggagctaggacggcgccgtccggcggccggaagcgttgcggaatggagattgggcgcagggagatggccatcggaaaggagagattggtaccatttttcagagggttatgagttgtgagttgtgatgcagagtggttgcatcacaatcatcactgtgaaccgtcactcttctttgctttctgtagtgagttttttttttagtgtctgtacaatttgtatattttggatggcttatttggcggataaaacaagagtgggttatctgaaaattgtaaattcagatacctatgcctaccggattgagatcaaatacagttggtactaaaaaggactgtaagtaatcaaccgttcatattttgatttaacgattcacattcattgctacaaaatgtataaaatatatatttttgctacagtcacacaatgatccaggcccttactttctctatcatgtgccgccgaagcaactggctttttttttaagaactcccgaacaactgcttaagttgcaattatagggtctgtctggtagagttttaacttctctatcatgtgccgccgaagcaactggctttttttttaagaactcccgaacaactgcttaagttgcaattatagggtctgtctggtagagttttaacttcaggagttagatatagagtggagttgtggagctgcctaaatctagctccacctctccagttcattttgtgaaaaagcttcattcaactccgctcctattttacgtggagctagaactatttggctaagttccaatttcaagggagagctggaactgaagctgaagctataccaaacaggctcatgcttgcaactgcactggatcgtgatgcatggctgccaacctcctgtgaaagcgtgttgctactcctcacttgtgaaaaagactgtaccactcaaattctggcacacgcacttccgcctgaaagcctgttttaccggtcgaccatgaaactgccggttagtcatgcagtgcgactcctgtgatttttcagtcatcagggactcaagaagcaccaaacccgggtattgcctgctccactacgaaccaacattatctatccaaattcccagtagaccagaatgaagagaagtgctctgcatgtgaccaaggcactaccaagtaggagtaccaactacctaagtatgcatgctcagttgctcatcgttcaggacccacccaatccatgtcaaaccactcgtccaatgttcggcaatgcaccactacatatacatatgcagaccggccatccactgtacacgaattgcaggacaggactgacccggcggataatccgggcggttagaccagtaatctcaagagagccacgctgcgataagcaacgcgaagtcgtcagccttgcgatacaccagcatcagtgtgcaggctcgcagcatgtcggcgaaggagaagagaattttggggagacgcagggtgcaaacagtggcagggacgggagaagaaaacttgggtattttgctggcacatcagtcgtgtcgcgctcacggccatagatcccttacgccaccgatgaaaatagcggtagataaaggtctccgtcagggagacgaacagttagcgtaacagttgtgtgacacaactttgggactttgagcatccttttcatttcatgtaaaaggtactacttctaaaaggaatcgattgagaaactgtaaaggcactgaaagaaccatatgcaaactttagtagagttcattttcagatttcaaatttcagacaccaatttgacaggttatgagaattatatcatcaggaaaaaaaagttttaggattgggattagttcctagtaccagaactatactaagcttgagcctcaagcttgccggcgccgatacgctaaaccgtacgactacaaaaaagacgtgccattctccaatcatccatcgtccatcaacgcaataatacgttcgcatctgacgcgcgcagaaagcccaccttcgttggcgccgcaccaaaacgagactcgcaaagtcgcatcgcgtcgcgtcgcgtttcgcttcgcttcggttcggtgggagacgggaccccccccccccccccaacccaacacgaacgaagaattccaatcgcacagcgcaaccgcatcatatggtcatcgtcatgggttgggctcgcaccgcaccgccgccgccgccgccgacgcgccaactggtggtgctaccacgccttatttagccacaccgtccccttcccgctcggtgccaacgcgcgcgcgcgcggcgaagcgaagcgaagcatatggctctcctcttgacgctgatcctcctctccggcctcggattcttgccccgccatgccgacgccgcgaggggctacgtcaccgtctccacatccagcttcgcggtgagctccacctgcgccgacgaactccctggacgaggtacgtagttagtagtagtagacagcgagcgagcggggagatcgaactgttgcttctggtttttggggccggattgtgatgaaagattgggattcgttgcgagtttcagctgcctcgccgcggaacggcacgtcggcggtgctgcggctgacgcaccggcacgggccgtgcgccccggcggggaaggcgtcggcgctgggatcgccgccgtcgttcctcgacacgctgcgcgcggaccagcggcgggcggagtacatacagaggagggtgtcgggggccgccgccgccgcgccggggatgcagctggcgggatccaaggcggcgacggtgccggctaacctggggttctccatcggcacgctgcagtacgtggtgacggtgagcctcggcacgccggcggtggcgcagacgttggaggtggacaccggcagcgacgtgtcgtgggtgcagtgcaagccgtgcccctcgccgccgtgctacagccagagggacccgctcttcgacccgacgcggtcgtcgtcctactccgccgtgccgtgcgccgcggcgtc

SEQ ID NO: 45108 - DNA, 19809 bp, Oryza sativa
caggcgtcgagcacctacggcggcgtcttctcctactgcctaccgccgacgcagaactccgtgggttacatatcgctgggcgggccgagcagcaccgccggcttctccacgacgccgctgctgacggcgtcgaacgacccgacatactacatcgtgatgctcgccggcatcagcgtcggcgggcagccgctgagcatcgacgcgtccgtgttcgcgtcgggcgcggtggtcgacacgggcacggtggtcacgcggctgccgcccacggcgtactcggcgctgcggtccgcgttccgcgccgccatggccccctacggctacccgtcggcgccggcgacggggatcctggacacctgctacgacttcacccggtacggcaccgtgacgctgccgacgatctcgatcgcgttcggcggcggcgcggccatggacctcggcacgtcggggatcctcaccagcgggtgcctggcgttcgcgcccaccggcggcgacagccaggcgtccatcctcgggaacgtgcagcagcgctcgttcgaggtgcgcttcgacggcagcaccgtcggcttcatgcccgcctcctgctgatcgatccatcctaacaactcacccacgacagtattcttctttagtacgtacatggcgtataggtgtatagatatacgcgtacaatgtacgtacgtacacgaggatgataggcgcatatacataacataacactagtagtaggagagtacatagtacacaaatacacaaaggttgtaaggcatagtactttcgttagtggatatacgatttttgagagtaataataataaattagttaaacgggctaaccatgtgcacgtgttaggcgcttgacacgcttggtttgatttggtgcgtcgtggtcagtggcacggtgctcaactgatgtgctacgactaaaagtctaaaactagtggacagttagggggacgtgtgggactgtggggccacctcgttctgttgtgcattgtggctgctgtggcccaaggcccagagagaaaacgttatctttttttttaatctcgtagataatgctggatctgtattgttgatggttgttagccgaacattcacctgatatttgtgtgaaagtcaagggccatagagttatagtttgaacaatttagagcatatacaatttcaaatatgtttataccgaagatattcctctttggaatgcataactcttaatatatgcaggcataaaaaactaagaacaaaacatcacaaattatgaactcacatgatgataaagcacaagaatactagggtcatagcaaatacacaaaaaaaaattagtagggatacacgtggaccagcctataaactctgtttgatatacggctgacaagccatgataaaataaattttacaaaaaaaaagaaatactttcatgcatgtgttgtaacggtttaaagtcaatgcttaaaaaaattaaaacctcaaaattaacttttgaattaacattttcgttttgtagacataaaaaaataagaacaaaacattaacctataaggcaacaagtagactatgagatagcagaagaagaatccattagatgttttctaggagaataacatgattttctctttgaaatgccatgtgtactctactagggattctttggtggcacaattctgtatcagtttgacagctgctttccggtgctccaaaggaaaagaaaatagaattgatgtttcataccaaaatcccattattatccaagactattggccctcaagagtaagaaatagagagatggggtacatatgttctggtgaacagagtggacgatatcgaaatctccaccacaaaattaatatagtacatcccttttaatagataatgccgttaattttttttaataatgtttgatcatttatctccttaaaaaattagtgtaaatatgtaaagtataagtcatacttaaaattcctttaataataaaacatgccataacaaaataaaataatatttatattaattttttgaatatgatgaatggtagcatctcaaaaaaaacggaggagcatatggatcagttctcttaaatccattcgaaagaatcaaaccaaaacaaagaatagtacagaaaaacaaaataaaaattgcacaagtgccaccatacgcagttacgtgcaatctaacattctgttggtaaatcagtagggcaaactgtagtccattgggaatcaccaagaccattctcacacactaattattggccagacacttggatcactaatgatgcatccgtcgattgggaatcaaacgatcgaattaatcagtataaagtctttattattcataaaaaatcatgaaaagttcactcctaatataatatttttttagagctagggactaatataatattttggttgttggattacaattgcaatatatatcattatatcttgtcatcatcacacgtcacgactcttacctcgcaaccacaaacaagtagacgaccacatgagagcaacctactgctaccctcttggcctctacgtgtgtcgtgttgcccggcccgccaggcgccggcgtcgcgccgcccgccccggtcaacacgcgccggaccggaagccgagcgtgctgctgccgacgtcgtacaggacctcgaacgtccgctgctgcacgttcccgatgatgccggtggtcccgtcgtcgccggtggcggcgaacgcgaggcagttgccgtacatgatcccgttcgggtcgaggtcgatggcggcgccgccggagaacaccagcgcgacggtcggtatggagatctgggtctggccggcgaagtcgaagcacgtgtcgaggatgctcctggccggcgccgaccggtactgcttcatgccggccttgaacgccgacgacagcgccgagtacgccgtcggcggcagccgcgtgatgatcgtgccggagtccaccacggacccggcggcgaacaccgacggcgacagcccgagctgcttcccgcccacggcgatgtcctgcagcctcgcgccgtagaacgtcgggatttgcctgctcctgagcatccgcgtcgtcacgaaccccgacacgccgccgccgccgccgagcgtgaggaacccggacgagcccgatgtcggcgggaggcagtacgagaaggaattcccgtacgccgccgccgtctgcgacacgagcgactgcgcgccgccgccgaggcccatgagcccgtcggtctggtcgctgaatcccgactcgacgtggctgcacccgaactggaatcccttcacggcgtcggaggcgccggacagcgtcagcgtgtcgcggctgtacgtgccgttggtggtcgagccgtcgccgtactggacgccgtactggcactcgtagttggtggcgccgcagccgttaccttgctgctcgagctgcgcgcactcggcggcggcgcaggagaccgccctgtaggtgctcgactttggcggggtcgaacagcgcgcccgtctgcgcgtagcacggcgggttggggcacgggttgcactgcacccacgacacgtcgctgccggtgtcgatggtcaccgtctgcgtcacggccggcgtgccgagcccgacggagatgacgtactccagcgtgtccagggaggagcccagcttggtcggcacggacgacgacaccttcgactgctggagatcgccggcgccatcgacggcggcgttcatggcgaacttccgctggatgtgctcggctcggagctggtcgcgtttgagcagctcctcttcggtcggcctcttcttggacgacggcaccggcgagcatggcccgtgccggtggttcaacgccaccgtggttccactcaacgacgacgaaatcgctgcaaaatttgacgcaccaaaacgattacaatttcactgaaaaaccacacgaaaattgcagaaaaactatgcgcttgcatggacagtcaccatttcgctcggagcagacggcctcagaattcagctcaagaaccttgtaactctgtccatctcctgcatgagcaactacagagtggtagctgcacaagaggagaagcagtagcggcgaaacagaagccatggctaattccttgcttcctaggcaagctgatcagctagataattgcagctttaaattcctatcaacttatatatagagagaggatagactttcatgcgtgcatgcaaacgcacgaaatgccatagcacgcaaaccatgttactacctactaattgacggagactcgcagttgactcagtaaacaaagcttagatgatacttgttgatacaccacgacgaatagtttgatattcgatggtactcgttgatacgcaatgatattcgttgaaatactctttgatacatgatgatacttgagaaggagtgaggtcctctgtagcactggacatacagcccaaatgtcagtgagtagtaatgtatctgcaatactactacagtagatctgaattgcttgagaagatggattctcatccttgagaatatattctcacttttttacatatcatctaaatagtttctattagaattgttggcggaatctatttgatataacgctagttaataataatgtggagttgaggcccttgagggtttgtcccatcacctatcgtctcttttttatttgtgtgccttagcacagaagccagaaatataaatcattttcattattataaaactgcaagaaacgaggggatatcccttacatgatgaaaccacactttttgatacttgatactaaccgatgctaattgatacataataagaccccctttagaacgcatgataagaaaaatacagaaacaagaaaaagaacaaaaatttgaagtggtatgtttttacaaattctatctgaattgaaagcataagaaactagaagacaagccatttcattacatcacaggaaaaattgaacaaatctttactattataaaaattgaagatgtttttaccggtattttggtacgtcatccgcgtttgagtcggtttttaagttcattcacttttaaaaatacagatccgtgtttaagtcagattttaagttcgtttgcttttgaaaatacaaaaggagtcgtataagaaatctctttaaaaacacttgcatgctaacttatgaatttcagactcttaattgcagctcaagattttctagaaaaaaaatatccaagcgaattctcatagcgaatttcaccctagccaaaccgtataacaataacaagattaaaatagcattcacccactgcaacgtacagacatcttttctagttaaataaaaaatttaaataactctaacttcttgctttaatttcctatggtattgattggactggaccgtaagaatgtattcatatggatatttcctatcttttcatatgaatgaaaggcttcaataatgtgttcgcgaaaaaggcttcaataataaaaattccttaggaaatttaatcctctaaaaatcctttgcccatcctccatgatagtgatattcaatgataatgatgtttatggagtttcaagaaactacaatatgctagtattgttatgacaatattgattcttttcaaagtttcataacaccttaggattaataaatcctaatatctcgggggatctcgatcataatattgccgaggtatcatatacggagtagctagcactttccttcctcgatttgccttccagtccagtggaccatagctcacccagtaacgaggcctatgacggtataccgctctatgacggtataacgtgcggtcgtagttgtccgcgtaaacatagggcttaactgaaacagagaattttcaagttcgtacgagagaattgaacgtactgctcaagtgaaattcagcatcttaaaactatgaccatgcatatatattttttaatatggtatcccgtcattttcagatgtggtgttgctgccgttaatccgtgatcaccgcagaaaatgccagtatgccacttgtgaatcatgatacgatcgacagtctcagggctggcagcttatgatcatctctctgcaggactaaatttctgataactaatcagtgagaataatcaaggtacgttcacatttgcgtgcatgcgcatggacggctcgatcgtgaattcaagttcgtcagttagtgtagctacgaccaatattttgttgatggaagaccacggaccatatggcacatttttctctctgcccaatttgtggcatggcatactggcgccgtttacttctagtcgcacttcgtggaatggcatgcaggctgtactgtagatgtttggccaaacatcacatcaactgccaatatgccatagtagctagaatgccgtacgtacattatatagcccattgcaagtctctgaagaccccaagtaacctccacgctgacgcaacaaccacatccgaagaccacagctgtagctgacagcccggttccaggtcattagccgataaattaattaaattaatcattgtagattctaaagttaataaatactgtactagtttagacaaaagaaaatatatatctactagacaacatgtttttaaagaaattgtactttattaagcgtcacacggatagttcataccttcgttagcttaaaaagaacgaggttgttttagaaaaagagagactagatgacatgatcccgatagttatctctttctaatacagtcctcctccatcctaaaatgtactatagctatttatctaatgctagttatgaatttatatatatatatatatatatatatatagacacacagttgagaatgcattttgaatatatattactacatctattccaaatatagggtactttgattggatgtgacacatcttatctagattcgtaaatatactattaagatgtgtcacatccgacaaaagaccatatatttgaagatagaggaagtaataatgatgagtacatgcatgtgcaaaacatcgaaagtgctttaatttttgggcaataatgaacatgtcttgttcggcttgaatttttaatatgcgcactaatctatatacatttgacagtaaaaaaaaaagatagtaaatatttgacagcgacgagccaatgacaaggcataatatatacgcacgtaaatggaaaagaaaaatccaattcttttttctagttttgccgttttgtgccactagccccgtctgttgtgcgctcggcgacaccttccccgtcgcagaagccgccaaaggggagcaggcgcggatacaaaaccccggcttaattatctcccactcgtcaacgaatcagcgcgccgcgccgttctgttgctacgcacagtggcatgaaacgggttcgttcgggattcctcctgcctgggggatgtaaccgacaaacccgcgaacttatttatatacaaaattaatggataatctaataactcgtagattaacttgcgggttacttactaaatttgatatataaatagatttattaatcaacccacttgcattttttagttacggtaattaaatcgagccacaacgtagaaatccatagattattacttatttgacatataagtagattcgcaggtagtctctttttgcatcccctgtcccctgttcggttcgagaaaacgcgttgctaatccgtggaaaagttgggagtagtaaaatacacgtgcactgactgagctttcaccttgcccggctccgtctggctccttggcttgaggtgttcggttcgatagtttggtcttttgcacccgggctgggcggggacaacggtagctagtgagatggaccaccggtatgtgacacagtacagtaccatacaatagcgatgctgttgcctgatgtgaaaggccaaagccggatgcttctacgcagcagcgtatcgcgttgtcgcttgcggcgtttctgcgaagactgtgacgttgcgtgagatgagatgctagccttggaccttactccctccataaaaaaaaaaaaaaacaattctaacatctcaagataaaaatagaggaaatagagagtgactataataaccttaatcatttaaaaaaatagtgatagtgataggcaggtaaaaagtattgaagggataaaactttttattttttttttgggcggagaggagtagaaattttgtaaggtcgtctgcatagcatgcatgcgcaataggctacgtgtggcttggctcagagaactgcagtgtttcagcgcatcgtcaaaagacgtaccctccatcctaaaaaaaaagtccaattctacctacgaatctggacacatgcgtgtccacgttcatagccagggtttagctttttttgggacagactagtatgctagaccggtgccgggtgccgccttgccggagcacggctgaggcctgaggctagcttggggccgtgccattcccgaccgaccagtgcggtccatggaggtcgagacggtcaccgatagatttacgtggcacggtgcggttgctgtagagaagatgaggaaaagagtgcccaggttactccgtttcggggcaccccggaagaagctgcgactcctgtcctgactcctgactcctgagtcatgagcatgttgttcatcgctactgtcttcatcttaaaatatacatatactatcttaattttgatcggatataatatattttaggattataaatttgaacagaaaatctgttcatagtattgaaatgtataacatcatatcaaaataacttatacggagtactttgaaaacgaaggtagtagcaaactattacggatttaagtggaaatggacttctacctatattgtataattaagttgtgtataatttagtgctaagctgtatttaagacggcaggagtaacatataaggatgatgtgttctttccttttcccaacttctatccttattaacttatacccttattttccgagcgcatattttttaaattgctaaccagtgtgattttttttaaaaaaaaattctattgaaaagtttacaggaagagaaagcagcctccgtaaaaaaaacatgccacgacggcggtcgctgtaaacatgactccgactcaggacagcgatggtgataaagcaactttgctctgcaagctttatgtaactgcacggaaagggagaaattcagttcaagtgctgatataaagtgttacatacaatgtgacgctacaacctacaacatcggcttcttgacaaaattttctgctgcacactttattacactagtttctcgtgtgactgcacctctacaagctggcgcatatgatgcttcccagcaacaggatgttacacagttacaaatagtacaggtacaagatatacattacaatgccactttccaattctgaataactgaattcatacatacccatctcctcccgtgtgaagtagaagttgcttcgcaacaagaatggaccataacctctattgcaaaattggctagctagcctgaataatttcctcagatggcaatttaattctttgtagaggagcctcaaatctgtacaagttgaacttcgtgtatacctcctgtatccccatttggcaaaaatgccttaaggatatcaaattgcatgcgattgatgtggtgtaatattggtcaatgtaatgctgttcaatgcccatttgctatgagatggaagtcctcttttatttgatatatggccttccagttctcaatttcctcccttcataaccaaatgaattgacatttcagtataattcaaatgaattaaacaagcggaaaaaaaattcaattatcttgagttaaagctgaataaacccaaaaaaatataaagtttgaaagaacacatataagcttatgactaaccgtaagcagtgaccaatagaatcataatgtagaagagcaataagcttgcgttttccttcagttctatggccgacaccacgcttcacgacaggcagctgctttattcctctggcctccataaggttttttgcagtggtcaaatcagtatcaggaaagcaggttagcaatccacgttcattcccctcgtactggaatcctcgagtaagacacaatgatatggttgaagaattttcctgcaacatctccattaattagtacacattccttgccagcctgtgtaaattgttttgtttttacctttcagagatagaaagcatgtacattcaatttagaattcattttaagctatcgcattaaatggcaatggtttaaacaaaatcagtgtccagcctagaccagaccaagtgaaatgatgcacaccaattcattacttatttacgtagaactattctaatggaaatacatattttcaccattcaaacgtacagcgggcttgagctggtctccacttgtgaaactgtccccatgtaattcaaatcccatacggcgaatatcccctaatgtaacaattccttcgagaaaatcttcacaatccacaacaaggccgcaattttgctgcttatcatgcaaaagcttgagagcttctgtcaccatggcagatgttggaattttaacatagctctttgacatggcctgggagacctggtaaaagagttcaaatgacaaattaggatagaattaacataataacatgtacttctattgaaaattgaacgcaccattgcatcagctagaccgttaacaataagaattagaggcctacaaaccttcaaatcatctagaagcatttcctcattataggtgtcatagttatcagtccgtaagctagtgagctcaagatcatttacactgtcacctcgcctccagcttttactatttctatcttctgaagaaagtgaagaataaccacgcctgggtgttctaaacctagatggttcaccatcctttgattggtttactacagaaggaacccagattgctaacccaactgctccctgttggacaataaaaaataagtgcattagttttgataatgcaatagtgaaacataaaatcacaacatttatgtcctcttctagacatcatgatgtgacaaaagagaaagactatatcaaaacaaaacaatgggcacactacataaacagtcatacttaccatgagaggaagcaaaatcctgtagtcctttgtcagttcaaagagaagcagcactgaggtcagtgggactgaacagactgaagctagtgtagcagccattccaacctggagttctgacaattagtttttgtatatacaaggatgtagaaataacagtattgcttcaagcaatatgaaaaaaaaaaaggaaaacagagcaacttactagagcataagcttgtggctgtgcaacagcagcattaccaggtacagcagaatttatcaaatatccagctgaccctccaaaaacagctccaacagcagccccaatcattaggcttggtgcatatagcccacccacaaggccagatcccttgcaaagggcagttgcaactacctttgcagctgcaagctgagttaacaaccatataccaggagcagaagcacttttcccagtatgtagtatttcttcaacatttgtgaaaccccagtatagaatgccaggatatttgagagctatgaggccagctcccagtccacccaaagcagggtatactacaataggaaaatcgtatctttcttttaagtatccaaaaaaattcgaaaaccatacaaccaaccggccaaataccacactgaccgctccacaaagcattcctaagatgagatataaaggtagctctgcagaacagaaaatgagacgacagaatatcctttagaacctatgctgttcatatacaacaatacaaaaggagagaattattcaaccaagaagccatgtcaagataatagaaaagttgggtttgtgtgaataacttataaaagtagggcaagtgctgctaaactttatgataacatcatctctgaaacatattactataggcctcaacaaaatggagatagcatattagggcttgatgaaccaagaattggtagtggtgcaagtggtgtatcataacatgataaaaattggtagtgtttgttactgtagttaatagatgaatcttcaatcttaaagataaaggtaaaaagaatcaggggagataccggcagcagattttagctcatacgctggcactataaaagctggcctttctccaagcagaacatttgacacagtagatgatataacagaagccaatattatcattgcagttgtaaaaggaggtgaattttctgctttcagtggcctcagtacagtttcaatggcaaagaaacacccagcaactgctgcattgaagcctgaaaacacacaacacaagaaacagtatattagcaagcgctaacaacaaaaaggccaaaagggtaggaacaaaatcaaaatgttaaattttagagttacatgggagtcgtgaaatacaatatttcaagttattttacaaagatatccgaaacaatacatgttaactataaatgctatccaatttacatggaattgccattacgtaatacatccttaaataataattgtaaggtgctagctatcgaagtcatgatattctactaaggaaacaggtacgtaatcatcaatgacatacctgaagcaattccagcagcagcaccagcagctacaagagcaatccgcctctccctgttattctccatcatttccgagcacccatttgcacatgatttgccaatatccacactaggaccttcaggccccagtgagcaaccagtacctagagttacagcagcctggacagcatttacagttggaaagattgccgcaaggaaattgattccttgtttctgaggcggtttcacgagtttgagctgatcaaatatctcaagcaacccatgcatcattcctacaacaacgcctcctgtcacagggatcagcagtattctgtgccaagtatcagctagcctctgaaggcggagccaagctgcaccttcatttggggtacctgcccaagcccattcatggatgacatgaacctaaaaataccataacaggagctgtctatagaatcagtcatgcaaggcagaactgaaaaatctcaaccttaacttacattggaatcacttggaaggttttaaattttaacaaaatttatcgcgttttgggcaaccgcagatatgatgtgacataaggcttttcatttactgctttcagtgctctgttaagttgctttgaatttgcgcacttaaatgaaactgattttgcatcatttgggtgaatttatttgcactagtttagtttgcacaaataaacggatcaaaatcacatttgcaaagtcccttgggttcacatttgctagcatccatgaactacgtttagatcctataaatgatgagcctcactccggtgctttctacttgcagaggatagtcaagtttccagtctgtgagcagaaccagtgaaatgctcaccccacggttaaacgcggcgacgcaaatgccggtggcgagcccgaggaggcagccgatgagcagcagcgcccactccggcggcgccccatccccgagctcctccccgaccctctccctctgctgcggcgacgacgtcggggacggctcggggcgatcgagctgctgcggcggctgctggcttcgacgccccccggatccgcgcgcggagaggcggcggtcgaggtgccgcaggaggccacgcacgccgccgctccgcctcggggaggcggtgacggtggcctcccccaccgcctcgacgtccgcgtgctggttgtggtggtggccaccgacagcccgcggagatgggcacggcgacgatgagccggacccggcgccggcgccggccgcggggtgggatctgaggagcgaggcgtggtcgtcgtcctcgccgccgcgggacgacatgtcggcgggcggcggcggagtcagcggagatctgaggggcgcggaggaatgcggcaaagcggagaagttgacgcgcgcgggaccgagaggaagaggaggaagggggagagacgagagagccgacagtgcgagacagtcgtcgcggccgcgcgagatcgatggcgagcaaagcagtgcaaacggctgggtgaatcttgtgcggtgcgtggcggtgccggtggtggtggtgccagattcgtgcagtgagacccggatcttccgccctggggcctgggggcgagtagtgcacgtgccggtgccacatgctaacaagccagctattgtgttcttaaaacggaagggaccatgacttcacccattagagcatctcctgtgtgtaggagtaaaatagaactaattactcccttcatcccaaaaaaaaagacaaatattggttttcgtgtccaacgtctaaccatccgtcttatttaaaaaaattatgaaaaaaaattaaaaagacaagtcacacataaaatattaatcatgttttatcatctaacaataatgaaaatataaattataaaaaaatttcatataagacggacaatcaaagttggacacggaaactcagagtttgtctttttttagacggagggagtatacatgaaaaaaaaatggagaaaaccacactgtaacaaccgattgttactcgtcagataaaaatcgatcacaaagaaagaatagaactcagcgacgaaaaaggtggtatgcagccgttgtgactgacggtgcaagggacgatggatgcatctgattagagattcattttctaagtgggtctcatgatcgatttcaaatgttgcagctaacaaactaaacttttgttcgacccagtaatcgaaccaggagtgcaggtccctttagtgtttaaattcaaatcctcatagatatttttccccaaagaaaacctctgaaaagagatggatttttcttttcattataaaagaaaagagttaacttgtttattaaaaatccctagaactttataactgcataattaattggagcaaaattgactaaaacgcctccatagagaacacaacaaaaattgcattagacaataccccctccatcctaaaaaaaaaaaaagaccaatcctacatacgaacttggacacatatatgtctgtttcgtagctagaaattcgtttttctctgggacggagtagtacaacataacctaatgacctataactaaagagagcagtcagaagtaggggtgggcattcggtctgaccgaaaatttcggtctcggttttcggtcatttcggtttttgaaaagtgaagaccgaatttcaacgcaaaaatatcaggactgacaaattcggacttggtctcggtcctgaccgaaattcaacaacatttttatatatgcaaagaaataatagaaattttcaacacaaaaatcacaaaaaaaaattccgtaagcacgtctcttattaggttgcatgcctagaaaaagtagggatgtgaaaactatagtttaattctattgaatttagtaaattgtaggttatatttagactttttttttgttaattcagtcttttcggtctattcggttaaccgaggaaactaaccgaattgaccgaacaaaattcggtctttcactgcctaggaacgaatttctcggtctcggtctcggtcttttagttcggtctttttctgcctactcttagacacaaatcatcgttgctaagcttaaagttaatcaaagagatatgggtgtgtttggatcctagactagcaacattctttccttgttaagctaggttaggtatttggtaaattacttttaaaattagctttgcttatcaaactagtctactttggctagaaaatccttatccatctaggagagttaaattggatatccatcatcaagctcctgaacgagcagccttgctttggtgggatatatagcttggtagctccctccgccgcctctcttctccctccggtggcggtggtggcgtcggcagccgccgattttttttttttacaatttttttcatggctattgctaactgaatcggattgtgtatggacgaaaaacggacgaaaattagatgtgacgaccggaaaaatacgaatatttatattagttatagaagtagagggaaatactatacaagccttggaccagataaacttgggctctgatatgcttgcatttaggcaactggcaagggaaacagcccaacaaacaattgtgtctctttaagtgcaactaatgggctataaacctgtgggctagccggatatgcattgtagcccatctaataattttctgacgtcgccccgtcgtctcctcctcctcctcctcctcttcgcggcaccaaaccaacgcaaagacgctgcatgtggtggcgtgccgccgcccgttgcgggacgaagcctaagctatgtcaagctctcaactcgcgacaaggggttaattaggactgttcactttgatgaaaaaaaaaccttaccaaatttcttttatagttaccaaattttgacagtaaactaaatatagccatttttttctgacaactttactaaaatttagtatggttgaaaatggcatcaaagtgaacagaccctaacacaataagtagccgcgccatcatattagcggcgtatacacgcactataccagctacacctaatactatactacttgtacgagtatacgtacctgctgccaatggacgccatggatgattctttctggtggtaactaactaactacttcgataatgtgggcatgatttcttggtgcccgagcgcgctttagcttcgggacatctcacgtggttggtaagatggtcatttcctttgctggtgacggtcgtctcgccggttggtactacgagcctgatcgacgagagattatattcttagacagtctctcatggttttcagctaggatatgtgcataaggccattgtctttataatttgcccccatcgccggaggaggcttagtgctgaagcttcggagaaaaagatggtatattcatcgatcgatcgactaaatcacgcatgggaatctctttctctctctcaatctgatcaatcactctctctgataactgaatttccaccaacgaacatgatagcattatgctttccttgatgagtactatatcgatgggtaggttccctttcttctttctctatgatttggactgagactatgtatgagtagtagttagtacgtactagttcagattaaaaattctgttattttggtcgggcctgttctaacttgattattttggatggttgctcaagctagcttactattagcagtcactaaccactgcagtctacagattgtgaaagcggtactactatttttcaacttttagtcatttttaaaagcttattttataaatagacccgtaaaaaaacttattttcaaaacggatccttttctcggtgccatggttgttggcaccgaggtccaacatctcggtggtgccaacgttagcattgacgcttcaccccgtcgaagctaagtcaccaatacgaagggggacgacgacaatgacaacaccaaggacctgttgttttttcttttattggaaagggatacaatgtaaatattttttttcttataaataggtcttgatgtcattttaagtagtgtagataggtcctcaatgccaatgtcatttgcgtcattccccttcatattagtgagttagcttccataggggtgtaagggtgttggcactaatatcattggtgtcgagattgttaacgaccaaatttggtaatatcagcattggaaaaggagattagatcaaggtggagtcgaaggcggagattgatccgagaacagagcaagaatcggctgaagtccagatcggctacgattaggatcggctggatctgagtcggactaggtgagccgatgcagccgattctgacagtataatttgtcgtatgacatcgggttgaattgaggtgcttcaagatgattgccgcacatggatagagtcctgagaaggcaattgtatctattaattaggatgttttatgtaacttccttagagttatgtttgggcaaaagtctgccgcaaagacttatggtatcttagagtttgttagagatagtgatcgtgtccggtatggacatatcttgtaattctcgggtataaatagaccccgagccctatgtaattttgaacacacacgttcaatacaatttcggcgtatcgccacctttttgttttaattttgtttcgacgagttcttgctttcgggttgagctgcatcggttttgatcttcaacaagaggtaaaacttgttatgacgacttgtgttctcgagattagtgcttccatctttatgacactctaatcttgtctatataattcgtcgagttatcatatatcttacataatctttggtaatatcgtcatctaacctacaatcggctaaaatcttgtgccgcatcactattctgattaagatttcccccttgcaactcctgagcaccatcaccttgaactccatgcgctccatcgccttgaactccatggaccccttgagagttgtaaccttgacttcctagagaaccgtcggtagcacctttgtccaaagctccaatgcaggtccaaagctcgtcttcgaatgtatgagcgtgccaattgatttgatcctgtaatcaacaagaaatagagacaaagaattcgtggttaaatctataaatgatagccgatcggctaggtgccgatgacatatcatttatctttgagccgatgtcatatatgaatcgattggcggttataaatagatagtgaggaactaaatctattcgatcggctgtagatattaacgatatatagttcttatattaatatatacttaaatcaagtgattgggatagatcggtcaccatgccgagacagtataaatcacttagatcgaaatatatattaataacaggattatatatgtttatagcatagccgatcagatagatctaacatgtatcggctaatactctgatactactttatataaagatatcaaaacaaatataatataccaaacaaaagcttaatatacttaaatgcaataagatcctgacataaagggcggatttaacatgtcattgaagcatatagatcgaatatggttaaatcatataagatcggttgaaactccgatactaccctaatcggcaaccagaggacatgctagagattgatattctaagcacgacttaatagatcaaactcaactgatgtagcattaagtatgaaaagaagaacaatatctagacaatcaagccgctgggtgtttcataaagtggtagatatcttacataatctaggacaacgtcgctatttaacctaatcggctgccttctattaacagatgttagccgattgtaggttagatgacgatattgccaaagattatgtaagatatatgataactcgacgaattatatagacaagattagagtgtcataaagatggaagcactaatctcgagaacacaagtcgtcataacaagttttacctcttgttgaagattgaaaccgatgcagctcaacccgaaagcaagaactcgtcgaaacaaaactaaagcaaaaaggtggcgatgcgccgaaattgtattgaacgtgtgtgttaaaaattacatagggctcggggtctatttatacccgagaattacaagatatgtccataccggacacgaccactatctctaacaaactctaagataccataagtctttgcggcagacttttgcccaaacatatctctaataaagttacataaaaaatcctaattaatagatacaattgtcttctcaggactctatccatgtgcggcaataatcttgaagcacctcaattcaacccgatatcacacaccaaattataatgttaaaatcggctgcatcggctcaccttgtccgactcagacccagctgatcct

SEQ ID NO: 45109 - DNA, 7232 bp, Oryza sativa
gcactagctactatgtctataggtgtggatgctaattttttttagataatggaatagagcatcccagcctttgctcaaagagctacagccaattattataacctcacactcaaaatgagtgaagttcaaagaaacttaaaaagacgaaaccaatcatcaaaaacaaacaaactaaagactgctaacctaagataaagagtacaaaattattgaattctgtttgtgaacctctgtccaaaattgacaaaaagttggataacctgtctcaagaatatggcatgcagcctttaaaagctcgtcatctttctcacacttttgtagttgtgtctaataccggagtcaatgtggtgccctgaaaactaccttagtgtcgacgctaatactgatcgatgttgcttgatggacagatgtgttcatcagtagagggctcatactgcatttttgctagataggtgcgcttaactgccagcttaattgagcctgattagccgaatccataattgtgtgcacctaaccttacttactttgagccgtaggaacaaaagcagctaagcagcttttgcatcaccgtcccattacagcatgattaactaaagattcttgttattgagggcaacgatacagtagcagcacaagcgacatcagaagcttccgaattagaaccaaaagaaggcaaaaatatgaaacaggaaataaactgagaaagactatactacttgaactgttgatttatgccatcataattatgtcgataacgaggactttcaattgaaatatatatatatatatatatatatatatatatatatctacggtgatcatccacgtcaaaaaagatctttgatgattttgatcacggaggtactagtcgtagtactgaaacgtacgttagttatttcagtaaccaggtggttggaagctagcttggaacgccatggataaaaagattacttcagcaactgaactgaaagctactcgtgagattcccacgaagcccgaagagctagcgcgcgctatagctcactcggaatctctataaaaaggctgagcttgtagtcataaactcatacgcaccactgaaccacctgcaagacggaggtggtttcagagtttagagataagatggcgctgcatcttcttcacctgcttgccttctccctgctcttcgcagtggcgacccctatcagggacatcaccgatgtgtgctcgtcacagatcaagggtatcaataatcctccttgtcttaattagttagctttctcttgattcatgctgttaattatgtctggtttctgcaagtagatgaaagatatgtgctttgttgacatatccataacagtacagcttactactgagtttacatagcgctagccaattgagtagaaagactgaaagagcaagagtaccaattaaagcacctataagtaggatttgaagaaccaatttcagtttgcagtcaaaatagcatcacatcagcttgaggcaccacttccttttttctagcctggagtctttgcttgttttagcacctcggttaaactagtacaactagaatcaacatggtgaatggacgtaaatatggtggtagtgtaaccacaaatttgtattggtcatgtagtatccttcccctgaaaacattttcaggggaagtctgaattttctttgtcgatactataactaacttaagaaaaaaatgaagaaatgacagcgagggtgggagccaaatgacaaccaaaatcgaatcttttcggctcgatcatttctcttcttttccaactcttttcgccgccttgaattaaaatatacaggacagtcaatgatccgtcgccaccagaagaaaagagttttgttaggtacacacttttgtcgacggctaattgttgccgggcggcacgcaggtgcagcgatcgatcttatcaccacacaagcgtttttccaatgctttgtcctgaccgacaattttttttgtacaaatccattattagcggcaaaaactccgtccaagatggcatattttcctaagaaaaaaaaaactcttcctattgagtcctctcgatagcatcctgttctgactttaagtagatataatatgtggacttcacattcagcgagtttatatgtcagtgatgaccaataccagagaacaatactttggagagacttgtctctttccaatacgaccaaagccagccttcaatcgaaggccgtacacggtacactgttcactgagccatcgcaatttatatatggtctcagtcgaaattgatggccggttagtggttcgattgactgctgtcatggaaggccatgatgtgaagctctaacggtagccatacttcgcctctcccccgtgaaaccaccgatgccaaaccaccatatctatcagcctatcatgcgccgcgcgcgaccacaaatgcgccggacaggatggccgccgagatgggcaccggatcgatcggctagaaaacgtcaccgatacgtggggtttttcaatgccattgcaaatggcttcctttttggcaactttttcttttgccatgacttgaatcatccagcaccgatcgatgatattacggctgcatgtaggcacgctcaacagaaactcggtgctgctgtaaatagtttgcctagttagctgggccacctctggattgtactctcaccgtatcaaaataagtataacagcttaatatatgatgagacactaggatacgttacattgctatattttgatatggaagtagtactactgttgtacgtgatggtccagtccaacgccccctggcttcttcagaagtggttagttctccagtcatccaaagcagcagtacaatcctggttgttcccacttgagaaaaaatatctttggttgctcgtcataatagaggggggaaggcaaggtaccatatgctttgtaggtgttctgtacttaggcaccaagactgggtgttgtgttaatttgtggtcctcgttatagacatcagacaatcactccattatcttgtgtatcatgttaactaccaaccaaatgcatcaacttcagtccctttttgacgtgtttcctctcttgttggactaatgttagcacgtccaagctcttagattgtctaagcaatgccaaagtagaatcttccattttgcactagttcacaaacactggaaattaactgagactactattccatgcgtgggccttctaccgagaatatttcactcaatttcacaatgactatgctggttaactagctagcctatctaccacctacagcgatccagcgttgtcttgggatttaatatggttatgaccagataatgccaactgcaaatcctaccatcaataagagcttgaatgcttgatcgatacgtgaccgcaatcttgggtacgtgcccgggttgtacgctgttcgtacatttatatattccccagtagcacgcaacacagctgcaagtcatatatatgatcgacactccttatctgtaacataaataaatgaattattgttgcatgattgtttggacaattggatcatgtgatgacatatccacactcgattgggaacggaaatcatatgagctgggacatttatacaatctgatgcccagtacttctccctagttgtataatgtccgtacgtctcgttatacgtcactgtccagtcacaagacggctactactgtaaaaaattgacgacaagatggcgcaacggaactgatggccatgtttaacgagctactccctccggttctatataataattaatgttttggataagattgatgtcaaacttttataactttgactatcaacaactttaaaaatatttagtttaaagaacatacgtagatttgtctttcaaaacactataataaaagtaaacatgcatttatttattgtgtatattataatagaaaatataaggtcaaatatatattttgtaaaccgtgtcattgtccaaaccgtcaaataaaatgaaaccggagggagtatagtgtattttcaatcatcaattaaatgcattgttgtttatgtggcttatttgaaaacataaaaatgacacctcccattaattgcaaatggccttatagccgcggcagaatttgtttagaatctctaattttaaagtagtttttttttgtcatggttgcggtaaaaattggatgaattgacgcgggcgaattaaggacgtgccggtgaattttgtgcagatttccagtacctgaacagcacgggcctgcaccttgagctgcaccacccgcggagcccctgctcgccggcgccggtcccggccgacctcccgttcacggcggtgctcacccacgacgatgcgcgcatctcgtcgctggcggcgcgcctcgccaagacgccgtcggcgcgcgccacctccctggacgccgacgccgacgccggcctcgccggctccctcgcgtccgtgccgctcagccccggcgcgtccgtgggcgtgggcaactacgtgacgcgcatgggcctcggcacgccggcgacgcagtacgtgatggtcgtggacacgggctcctcgctcacctggctgcagtgctcgccgtgcctcgtgtcgtgccaccggcagtccggcccggtgttcaaccccaagtcgtcgagcacctacgcctccgtggggtgctccgcgcagcagtgcagcgacctcccctccgccacgctcaacccgtcggcttgctcctcctccaacgtctgcatctaccaggccagctacggcgacagctccttctccgtcggctacctcagcaaggacaccgtctcgttcggctcgacgtcgctgccaaacttctactacggctgtggccaggacaacgaggggttgttcggccgatccgccgggctcatcggcctcgcccgcaacaagctctcgctcctgtaccagctcgcgccaagccttggctactccttcacctactgcctcccgtcgtcgtcgtcatcggggtacctgtcgctcgggtcgtacaacccggggcaatactcgtacacgccgatggtgtccagctcgctcgacgactcgctctacttcatcaagctgtccgggatgacggtcgccgggaatccgctgtccgtgtcgtcgtcggcgtactccagcctgccgacgatcatcgactccggcacggtgatcacgcgcctgccgacgagcgtgtactcggcgctgagcaaggcggtggcggcggccatgaaggggacgtcccgcgcgtcggcgtactccatcctcgacacgtgcttcaagggccaggcctcgcgggtgagcgcgccggcggtcaccatgtccttcgccggcggcgcggcgctcaagctgtcggcgcagaacctcctcgtcgacgtcgacgactccaccacgtgcctggcgttcgcgccggccaggagcgccgccatcatcgggaacacgcagcagcagacgttcagcgtcgtctacgacgtcaagagcagcaggatcgggttcgccgccggcggctgcagctgagaacgccgagagcgccgccgaacgcgcacccaggcatggtccgcatggatacttgggtaaattaatgggcaatccatttgctattggctatactagctagcacgccattcatcaattcaaccacacaagctgttacataagcatggggatgaacatatcacaaggtagataaaaacgaattggtaaaggtgtttgctctagcgcttagataagaaaacacaactcaaaaacaatattagcgtaatgttaattaatttatgttgtcgaggccagggggtacagagtatttgaaagtggaacagcagaactccaaatatgatacactacacaaatccagtagaggtgacatatatagcttgtcatgtagtaattctttggcaagtactggccgaaatgtttactctgtaaatgtaaattaatgggtgtgtgtgtgctgcgtttgtagcttcttctttagtaagtacaagagctccaaaactgtaagcctgtattcgtgtgtgagtactttggacaatgaaatcaagttggtttatatactccaaagaaatatatatattcctgctatctgaattttcagatacttttgcaaatgtatgattggacatccataagccgaacaagttgcactggttgttacgacgagaataaagagagtgagagaggctttagtcgctggagtgttgcactctcttcagtcttcaataatggcaacacagaaagcgcaaccgcacaacggcacaagtatagtcaagtacgtataccgcgcgttatgacgatgggcgaaaagatacgggatgggctaagacgcccggcgacgatggcgaggcatgcatgccaatgcaaaccattttgttcttacgtcgaagcatggttctactcctccctagctggtctgattctctctacattaatttctactttttgacgaacacgaatggatgccaaatggagtattttgacacgttctgaaagcaggcaagtactgcaagacattcatcggtatactcggagttgtaagagcaactttaatagtatagccaactactaactttaaattatgtataaccaatgtaatagccaattcatataatagttgtttactacactattaatatctggtcccacttatcatacacacgttatatcttgaagtccatgctgcagctggctacaaatctatagcctgctgctattctctcttttcttttatctctttaaaatatatttataactggcttatagtctgctattgtatctgctctaatggtcagttactcagcaacagtttttgaacgttggctaaaagaaacaaacctggtgctgatcgaccgccggccgggcgacggctaataacttggacttcattaaagcacgtacaccggctggtactctgcatcgatccgagcatgttggatcgattgataatctgatccttttccggctacgtatccatcacccgagtcgtcgtcgtcgtccaccggtaacacgtcgccatccacccgacgcggcacgccatggcacgcatgcatatgcatacattttccggtgcgagtggccgtcgtgccagcctccatccaaccaggtgtgtgtgtgtgcgggctatctgggaaaaaaaaagccgagaggcgccaatcgaattcgatcgcgcgtacaaggagggtgggggtgcgccgtgctgcgtgtcctatcgaagcgccaaagagggagacgcagacgcggacgcgcttgttgacaagaagcttgagtatt

SEQ ID NO: 45110 - DNA, 22362 bp, Oryza sativa
  unsure (1)..(22362): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgcaagttttccaattcatctataagaagtttgttgtggtattgcgagaactcattcatccacctaagacaacctatctctggctcataatcttccttcttatcactctcaaattgcatgaggtatgttggaatacatccaattgggaggttaccaggaacaactagtgtcttggctccaagtccgatcaattcctgcgaactcaactttattgcattacaagctatataatattatattgcttcgtgaaacaggagctcaaggtatataaaaagatgcaggcacattactcacggtgattgtagaagaaattttggcaataacactaggagtgaagctgcgaatcttttcaatgggcacgccgctcataagaggatagttgtaatcattgcctccgatttctccgaccaaaaagagagattgattcatcatgcccttgcaacctgtgccataaacatcgtttagtaatagctgaaagggaactttaactatcaaaattgctgctttatatggtagttaaactaaactatcttcacctactacttctagcatgttcgtttattatcctattataaactagacagatttgtagcaaacccacaatcattgacctggcatatttattttttttattttattctatgcaaccaattcaagggttaagcaattattcacgtggaaatcatatcatgttgaccaaatatttggcagtggcatggtgtgcattattgtatagtagcagtagtagtatactccaaactagcatggtggctcgcgcagattacgcggctagtaccattatattttctcttatataatagcatatatattttctcactatattattaaaatatattacaatgacaatataattttaaattttacaataactttacgaaactactcatgcgtaatatttatattgtattttatatacgtgttagttattaattatttttaatatcaaactttagttatttgtaaattatatatattcctatatggactctggacttgtcttttaatatatttttttaattctgaacttttattatttttaattgtatttctatgtggattctaaattcatctttcaaaattctttaatttttaatttcaaatttcagttacttctaaattgtattcctatattgactttaaactcttcttcccatgtttttcttaatttctaattttagttatttgtaaattgtatttttatacggactctacacactacttttcattttattatgtttattctaaattttagttagttttaaattcctatatggactctatactctacttctaatattccttatttttaattcctaatttctattttttttttcttaattgtatttctatatggactctatactctacttctaatattccttattttttaattccaagtttctattattttctaattgtatttccgtatggactctatactctacttctaatattccttatttttaattccaaatttcagttatttcctaattgtatttttatatggattctagtctactcttctaatattccttatttttttaattccgaatttcaactatttctaaattgtatttctatatggactctagtctcctcttctattattccttattttttaattccgaatttcagctatttctaaattgtatttctatataaattcatctttcagtattctttaattttaatttcaaatttcagttacttctaaattgtattcctatattaatttaaactcttcttcccatatttttcttaattttgaattttagttatttagaaattgtatttttatacggactctaaactctacttttaattttattatgtttattctgaattttagttagttttaaattcctatatggactctattctctacttctaacattccttattttttaattctgaattttttttcttaattgtatttctatatggactctatactctacttctaatattccttatttttaattccgaatttctattatttcctaattgtatttctatatgtactctatactctacttctaatattccttttttttattccgaatttcagttattttctaattgtatttctatatggactctagtctcctcttctaatattctttattttttaatttcgaatttcaactatttctaaattgtatttctaatatggactctgattttccatatggactctatactctacttctaatattccttatttttaattctgaatttctattatttcctaattgtatttctatatggactctatactctacttctaatattccttatttttaattcagaatttcagttattttctaattgtatttctatatgtactctagtctcctcttctaatattccttattttttaattccgaatttcaactatttctaaattgtatttctatatggactttgtttttttctttttctccgattaatgcgagaatttctaagccatgagagcgaacgtggaggctcctttttctaatcctttaataatataataggtagatagataatagatagatagatagatagatagatagatagatattgttaatgattgtggtatctctagacacgcacctttctagacaataaagccccaccaactaatagcaaactgctatgactagtgcttagaaaatgagaactgccacgatctcgttccaaacgtcattgtcgaagcctcaaaggttggtggtgcaaggcgaaagccgaaagccgaaagccgaaaggtgttggttgattcaaacataccgtccatgtcgccggcgcagagcatgtcgagcagatcgcggaaccaccccatctccatctcgaggtgcacgacaccgtcgtccgtgggcacccctctctcccggaagaagtccgggccgagcgccgtggcgccgcccaccgcgaagttggccccgctggcgaagtcctccgcggtctgccctccccagtacggccgcaggaacggcagccccattgcttcagctgcggcgcggcgtacccacacgcgcgcgcgcgaattacacgtctcatattagcaaacggatcgagcgatcaatcgatgcagacgaggcctgcaggatggatggatgatgaggcgtaccgatgaagtcgatgatgaggcggccgtcggagcaccggccggtggcgcggtggaagaaggtctcgccgtagggtggccacagctgcgaggtcgttgccggagaggaaagcgacgttgcccgtgtccgccagcgagtccccgaagctgaacacgcgcaggtagcacggcgccgccagcgcctgtgccgccgccgccgccgccgacagcacaactgccaccgccagcactaccgccggcggcgagaggaggcctgctcctcctccggaagtggaggagaccattcttcctacactttcgtttgcttctgctcgacgtcgggcccgaaggcgaagcggccactgggattggctctgcggtgttttttcgcgttggcccaaaaaaggcaaatactccaagaaacgtaagcgtggctcgttaatgttaagtgggctcgagtgacgaatgcccacaggtcagtagggcctctggtcgctgttagcctattacacatgagacggtgacaggtacgctccatcctccactaaatgcactgtgaaaacgtagtataaatgctaagcgctcatgatacgtacacattgatccctatatatatcactcatcgctaaaataataattacccgtaaatgcaaatgctcatgtcaagtataggatttgaatcaaggggacttcgttctaccacgagaaagctaaccagttgagttgcgtttacaagtacgtttatttcgtaagtcgtaaggtaacacttttagatacacagattgttgtatatcattactttggaccaaaagatttgatacatccatatattgattttttttcggcgatgtatatttaaccaagcgtaagtgaaaatatttttccccgtcgttcgcattctgccatggtgaaacaacttatcgaacgataatgaggcttgcagcaacaaatcacaaaatggttcaggtgataagactcgaggagatagaaatgggaaaataagtgtagtccaacgacaatgacaatattttttttacttcctctataaaatatactcaaccttgtatgaaataggataatctagtacaattatccatatattcgttgtactagattattttattccttactagcttacgttttttgtgacggagggagtattaagtaaataatcgcttctcttaagagtgttaggtgcaaggagagtaggtagtgaattaatgatgttgcaacataattgacctgattgatatatactggtagttgtgctttttatattatctaatatttgaagtgttttcgttatttcgatttctttaaacaatatcccgtacatgtttgacactgacagtttttttatttaagctatatggcacttctgatgattgtggatacaaataagagtcatggaactcactaaaaattagataaagcgatcggattgcatgatctttatacaatatcgctcataagaaatgcctctacgagaagcgacatcacggccacatcagccacgcagccaaggtgaccaaagaatgtagttgtctccctgtaacccctaaccctttcactatacacagaagaaaaacaatggagctaaattataataatactacacataccctataagaaataataaatcttaaaaatttacgaagaatcaaacgatccacaaataaaaccttgtggtcgtgactaaaaacagagaaggaataacaagagccagccaatcacttgggcaacagccattctgtgtagaacagttctgcagttctgtaatgaggcaaaaataccacaatcgttacatcttttaatcacacgtattgtctatataataaaaaaaatatagttacagaattacaaatcgtagaggaccttgtattcaacagaagaactgagctcagtaatttgcgggcacgaattagtggtggtagcaaatgaaggttgtgtatatgaacctcgtagcagtccaattgcaatggccttgtatgcagcttctgatggatggaagccatcccatgacccaaacttttgtgggtcatcgcaaaccttgtattcaccatatccacatcttgcagttccagatacaccatacggtcctcctccaccacaacaagctgtcaaaggatctttgattcctgaaccgaggttagggaaatgttaaacaagctatactcagaagaaaaaaatgatctttttcttgataatatgcgctttcctccatattaaggcttctagacagtttttctagtgtaaccgactagttagttcagtcttaaactcggtacaagtgatgtcatgttaatttgtaatacacataatgtatctataccatggtaagaatgcaataatttgtaatacacataatatatctataccatgataagaatgcagatatctgaacagaggtctggcgtgggggtgcattacgtgacatgatgaaaataaacttctgaaccttacaaacatatgaaggatacagacagatttgcttcgtttgagaagcactaaggtaatcaaatttaagagaacacatatagagtatttttcttgtaacctaaaaactaaaattagtagtgttaagctttcgaaaagaaatcatagtagaaacagtaatgaattaactgaactcaccaaattgttcaggggaaaggaaaacttccatggcagctccatagtaatcagcatagatgatggccacatcaggatgaagcttgcgtaacttttccaattcatctataagaagtttgttgtggtattgcgagaactcgttcatccacctgaggcaacctgtctctggctcataatcttccttcttaccactcttgaatatcatgaggtaatttggaacacatccaatggggaggttaccaggaacaaccagcgtcttggctccaagcccaatcaattcctgcaaactcaacgctgttgcattacaagccatgtaattttgtattgcttcttgatacagggtctcaaggtacacagaaaagatgtaacataggcacgttactcacggtgattgtagaagaaattttggcaatgacactcggagtgaagctgcgaatctttgtaatggacaccccgctgagaagaggtaggttgtaatcattgcccccaatttctccgaccaggaaaagagattgattcatcatgcctgtgcaacctgtgcaataactagtgtttagaatcagtatgtaaatatgatattatagctgaaaatggaattttaagcatatcacaattgcttatttattatatcatagttaaacatttaaaggatcacaggaagcttactacttgtcatttctactaaaaaccagatttgtagcagcatgatcttccccttggcgtattaattgatttctgatttatgttgtatgccatcaattcaagggcaaagttcatatgtagcagtgacatggtgtccatttataaaatattttttataatttttaatttcaactaatgatgatgtattctttggaaaacaatgtgttatggattcgcggtgtgattttatatatatatatatatatatatatatatatatatatatatatatataaactgcagaaagttttaggactccttttacaatatttcctttttatagaaaatacagtatcagttatggacttaaggtgtttgacaatgacggttatggattttgaaatggaccatctgcctagcagcaatcaacaaaagctgtcaatcttcaagccacaaataaaccccactatttctggtaatgatgaattgcttttcttattttccttgtgctgttattttctttggatgcacatttttttgtgtctaaaccaagtaaccacaggtgacatataatatgtgaaaatgacattagtagtgtatcgtggaaaatacttcgatgcagttatattctttagaaaccatgtcaacgtcctaaagcacaagtaaaaactaaaaaggaatcaaggaatatatattgtataccattgcaccaattctgaaatggcatagaaggtactaggataagttccacaccataaggaaaatgctatagcatacttttcctttttttttttctcttcaactttctagccaactcccaccttccatgtcttctgagagccacaaaaggttgagacagtgccttagtacctgtcagtctgcgtgcttatactctactaatcagtttgtggcatgtttgggatttgcttctccaatctccatgtgtcacattcagaccattctatttatcaccagatgcgcatcatcatcaagacattaacccccaccaaactactagtctactgctacgatttcatatcgctagttgaaaatgtcatcgtcaaaggtgggtagagagagaggagggattatatcaacataccggccaggtcgccggggcagagcagtttcagcagatcacgaaaccacttcatctccatgtcgaggtgcacgatgtcagccatgggcacccctctcgcccggaagaaggccgggctgagcgccgtggcgccgcccaccgcgaagttggccccgcatgcgaagtcccccgcggtccgcccgctcaagtacggccgcacgaacggcagccccagcgcgtccgctgcggcgcggtgcacccaaatttcaaatctcaggttagtcgggtcgttcgatcggtcgaccaatcgatgcaggggaggagggggctgaaaatcgccgcgagcagagtaccgatgaaatcgacgacgaggcggccgtcggagaatcttccggtggcgcggtggaagaaggtctcgccgtagggcgggcggagcgccggctcgcgggagtcgttgccgtagatgaaggcgaagttgcccgtgtccgtcagcgagtccccaaagctgaacagccgcgggtagcacggctcctccgtcgccgcctctgccgccgacaggagcaccgccaccgccacaactaccgccgccggcggcggcgagaggaggagtcctcctcccttcctcccggaggtggaggaggaatccattcctctcctctgctcgagatgaacggagaaaaggagagaaagtcgtcgcggcgatgctttgcgttggtccaagtctaacgtggcttttataaacgctgcggtagtcactgacatgtggggtcgcggtgacagaggcccacgggtcagtggggccagtggtcgctctcacgtgtgacaagtgtgctttctaaccttcgagaatgatgagatgtgctcagttaagaggccctctttgaagtacacgtcgaatccattattttttgcacacaaacatatgttctttttagtattacttccgtcccaaaataaatgcattcgtggatatccgtgccccacgtttgaccgtccatcttatttgaaaaatttaaaaatatttagtcacacataaagtaatattcatgttttatcatctaatagcaataaaaatattaatcataaaaaaattttaaataagacgaatggtcaaacgttgaacgtgaatagtacaaaactatatttattttaggacgaaggaagtattaattaaggcaaaggttttggatactctacgtctacgtgacctggtgaaaccggtaaaacgcaacaaggacgtacgaaaattacgtattccgaatggtgaggcacttccgtatgatgaaaaccgtgtgtgagtgaaaatatgttttcgtcatctcgcttctcccatgggcaaacggcccaaagaacaataatacgaagctcagcacgcagaacggctcggaggggcaatccttataaaccaaaattaaaatcttacaactttaatctagcgttgtttctttgaatctttggttttctcatcgtagtttattttacaacattattttaaaaagttcaaaatttgaaatatactcctaacttttaagaataacaaacttagagcatgtcaatggattgtctatactacttctaatataaatattttgcaggttttttcaaaaaaattaacctcccacaatagccctaaacaagctgaaaacatcatccccatcaccataaatgtctctccataagtcgagggagggcctcaccccggatagccatcaccgaccgattcacacgcttaggagtcaaccgtgggagtacaagaaaataggtctagttttgtctgaagtttttttatgtagacacatttttattttgagaagttaaattgggctatctcttagagggaaaggatatttttatcccttaaattccattagagattaaaaaaagatttaaggagattgaattttggcaaaaatgttagtcatgctctttagcataataactcactaggttaaattacttgtaataaaacctattcacatgggttcaaaccgtacacttgacatcacacggatgcttgtatttaggtttattattctttatgtgacatggtgctcgtatttaggttatgatgactttgtcaatccacattcatatataatatgtggactgcttctaagtttaataaattcctggttctcaaaaaaaaatccacattcataatgtgacaaaagtgggggaacacatgttagaagaaacgacaagtatagttcaacgagaaatgtgtttttttatatgagtaatagtttgtcatatactcctatatatgtaagaaaagtataaaatgttgtaaagttgatgttgcaatgatttgacttaattgattgatataatttgctcgtgactgtactatttatccaacacttccaaaattttgaagtgttctaatctttttcatttcttaaaacaacattctcgtgcattctttgagaggatattatttatgggctatgccacttgtcaggattttgtggatacaaacaagagcagtcatactcacccaaaaaggagaaagcaaatttgcatgaccatggtttaattttttcaatctcatatatacacaagaaatatcggcttctcataaaatctctaaagcgttaccacgcagtgcggtgatatcatactaccaacgtctaaacgtgcactcaaatgtacacaaaaatatgaaaaagatttaaggcgtacggagctcaacgatatgtacactactcctaagtactaacacagcaggactagcaggatccttgccaagcaatgtgttcttggaggtagagagttcacgaaagtatatatatgcggtgttgaggcacaaggtaacaagttagcaagtactagcaacaactatggtgttattttgtgtactaatctcctctttgtcttactcgctccgtcccactaaataaaacacttaaatttatcagtctccaaaactaatttttcatatatattttttgtcaaaaaaatttactatgtttataagaataaaatcataatcatatgaaagtaaatttaaatatcaatctagtaatattatttttaacaaataaaattttatttataataaaatagttactgatcaaatatttaaaaagttgaatctttaaaatatgtgtgtgccttattcttcagtgggacgaagggagtattagttttggtcggcagatcgccaccatgagacggaaaaaaagatctgtaccaacaaaaaaatcaactcaaaattatgtatacacggtaaaaaaggacaaattcaaggaccaaacagtacacaaataatacgtcccatcattattggtagttacagaatgcactgtttttcatactcatatccccatgtataaaacattttttttgttatttttgcatataaattatcatgttgcacatcttgatttttttttctttacacattagacacacatgcacatatcatcacatacgcaagaccgcaagaccgcaattacacacccacaaatgcatccactgacacacttttgaaaagaaaaaagaaatagtaacttgttcctgatcttagtatattcttgtagagtgatgcatttttagtgtactttggtgtaccagacatccagcttctaaatttagtttcaggagtttattttgtgagagaggtttacctagctccgctctcagtttaattagatggagctgaaactgtttggctgagttccagcttacgagagatggaggtggagctgaagctatgccaaacaggctagtagtacataaagattctcttctccatcgcaccaaacattgtgaaagagaaaagagcaccattttgagattcgtttatgcactattactattttgaatattgcgattcaatcttcacaagtcaggtgcaagaactgaatgaaaaaaaaaggaagaaaattggaacgcgcgctaatcttttgcttttatagaggaccgtatcagatacggtcaaaagaaaaaaaaactcccatgaacataagtaatttgctttacctcatcagcattaaaagcttttaagtgtccccttcagaatttacgaatcacccagggatttgacacttgcaagccacattgaattgttcaccgacgggttgccgctcaccgagaatattccatcgctggaaatctcctatctaaatttgctttcaacttgagtagatgaacaattattccaagtgggaaccacgaatcgcatatactagtctccacatttgatggctggtgagtggtgtgacttgttaacagcaatagtctctcttttcactcgtcaaattcaaatgagtagtttgtatttccagaaattatagttttaaaactggctaaagcagaacattaggccagtgtcaacaaatgctaaggcaaaaggtgcataatccaatgtttgtccaatgtaacaactcaaaacttgacacaaatagttcctctcgtacaagttttgttctgtttggcattaggccgccggattcttattgtaaagctcaaatcctcggtatcccaacacaaggggtagaaaaaagcataaatcaaatcaagagaagcctcatctacaggtatgagttgctagtctgcaaaatggcctaactacgcatttgcaaatttgatacccttctcaattgaagccttgagctcgcccttaagattctccagtccttccttctcaaagtctgacagctggcccaacccaagaacttcctcaactccattcttcccaagcttcacctgtaacatcagtgaaggaacataaatatttcagcagcttgaccataaagtttactgattgaagatttctaaagcaaaaaccagttttgaaatgaccagatgatagaatcacattcacgttaggctaagcacccactacgtctatgtaatatgtaaataatgtcaccatgagcacaacataaagcaaagcagcaaaccacaggaaatcttactgcaatttgcatacatgatttgctatgagatttggcatggcatatttgagggcatttgtatgaccttttgtacaaaaaaaaaatgcttcttttgcaacagccttacagtaaccagcctataatataggaaaccagatgaaccgtaacttcttttgcagcagtacacggatgccgtgcacaatatctaaatttgcatggatggtctcaggttcatagaatcagagcaccaaaatgcacacttccacagttcatagtaatagatgagccaataaaatgaacacattctgaaagtatataataaggtagcaattccataaatgaggtataaccattaattgcaaagtaaaaaaagaaagaaagtatctaaccacacaatcattcaggatacaggaatctaaccagagacaagaaccactattatataggatttagtatattaatatatatctttctatgcaataaaaaatttgcatggttcgatcctgtccatcttctaacatttttggacagcaagaggaggacgcaaataaaacaatatgcatacaaaactagagccgcacattagaaaaaggaggaatagaataaaagagatatcattaagatgagaaggaatgtcaaatactctagatttactccaccaaatgatatagatcacaactgcaacagacaaagaaagttgtgaaaagaaaatgtaccttggaggcaaagaatggcagctctgttacagttgattgcacaaaagagcattcaacaacgtccggcactccattcagaccctttaagcaagcatttgcgaaaacagcaccagcatacctgtcccccaatagaatcaaatgagtaaggataaaagcactaccattagccataaaagcactaattcctcactctgcacagctgttatgtttattttaacttacgccatggacaaggttgcagagccctttccagcctttgcttcaacaacttcagtcccaccatcctgtgttctcttggtaagagccttgatgtcttcatcagacaacgcattagttgcaggagttgcctacccaaataaagagttccttcagttggattgttaagttatgagctcataaaagcatcatctgcttcatatttttgaacagccaaaataacacagttatatcttatatattggtcatgtttgtgttcttatttgtaatccaaaaaatgattgtacacttcatattagactatgttagcgatgattctataaagataaaagattcctatacagaaactatgtcaaccttgagcgagaaaatataacaaacttggttattaacttttttatcataataaacatgtgcagtttactacaagaataagagaacacatgaacagtaattcttaagttagcatgttttaaccatagcatgcatgatatgattatggtgccataacaaaaaatatatatattgtaggcatactccctccgtcccaaaataaaccaacctcgtactaggatgtgacatgtcctacgaggtttggttatttcgggacggagggagtaccaatctgataatcttatttttatgatatgtaaatatggatcctactggtatgacattctgagttatgttaatcaaaagtcaaaatccatacctgtgagaacagtggcaggatggtgatacccgcatgaccaccaacaactgggacattcacatctgccaaaaagggagaaacaaatccaacagaagataagagagaaaaaacaccaaaaccctactatatcaattctcagtactcaagtgactctcaggtcattaccagtaactggtacattggcctttccagcatagaaagtcttagcacgaacaacatcaagagtagtcacaccaaacaacttcttctcatcgtaagtcccagccttcttgaaaacctcggcagcaattgggaccgttgaattcactgggttgctgatcatgttgacaagagcctaatatacatgaacgaatttaatgaacgtgttggtaattaagcatgtaataccaatgaacatgcatgagtttcaaagatacgaagactgaaaacaaaattgatagaacttatcaaagataagcagataacaagaagcaataagtcagggtaaacaatgatattcttctgatttgtccaggttaataaatgacccgtggggataaaaataattgctgcaccaaattatcagcattcagccagggaaccagattattcaacaagagatatacaatgagtgctggatgctgatacacgcgtgctggggaaaagtttggcgccttttcagtaatctagtacagcttttttcacacctctaatcaaatcatgtttacgattccgttactagacctaattgcagcgagcaatacccacaagcgaccacaagagctacaggcacaagagctgcagatccagagtgctgcgagtgagggagagatcttacattcgggcagtacttggcaatggcggtgcagnnnnnnnnnnnnnnnnnnnnnnnnnnnnnnnnnnnnnnnnnnnnnnnnnnnnntccctggtcatgccgggcttcctcggcacgccggccgggatgatcacgatgtccgacccctccaacgcctccccgagctggtcatcccccatgaaccccttcacctgcgagaaaccgaaacccccaaaacccaagcgcccgcagcgttagacagatcccggcggaacgggaagaggggacggcgagcgatgagagcgcgggggaggtacctgggccggggcgttgatgtgggagacgtcggcggcgacgccgggggtgccggcgatatcgtagagggagagggaggagacgagcgggttcagcttcatgaggagggagagcggctgcccgatgccgccggccgcgccgaggatggcgaccttccgctccggctggccggaggcggaggagtagccgcggcggcggcggaggacctgcgaggcggatctcatcagcgacggcctcattgctgctctcctctgcggcgctcgagatctgactcggtggaggaggcgaagggcggagagagagaggaaaatgcaaagcggtgtgactttgtagtcgagcaaaggggatgtggatgggattgggatctactccaaaaggttgttagcgaaatggtactactaacttgtgcggttttcttgctcgtgtcaatttgatttttctctctttgatttcatctctctttttctctgtgcgcctcgttaatactatcatttctgatttgattaatcttaatactattatttctgatttaatcaatctgtttttccgtccgtctggtttggttaataaaggtgtcatggtttaaaaactagtcacactcaaaactgttctaagattgagacgagtatatgacaattgaaatttactgaaagtcagctacacgaagcgctcggaggatacggaagggcggaaggcttaaggtgcttacaggcaaacaattgtagttcatgtgtaaattagcaagaaacgaactaaataaatactcccttcgtttcacaatgtatttattttagcatttcccacattcatattaatgttaatgaatctagacataatatcaatatatatgtgagaaatgttagaatgacttacattgtgaaacgaggaagtaccaaacatagccttctaagttctaacaaccaacaattattagacaagcctatcatttcttccataaactgcactcgccatttttctcaactgagacgttaactcctcatagaaaaacaaagctgaaacagcttgcagtaatatgcagttatgcactcgccagatacaaaatttgacgaggaggttaaagttatatgttatgctattgatacaagctggcttgacttacatcaagatctgatcctaacactaaggcaatcatattgggagcgaatcggagcttctaccaagtgaagagcaacaactaattccaggcacagcactacaacaggagcaaccatgatttgtccaacttcgcgagctcctaccttgtcaggctgatcatgaactaaattaaagaagagcgcaagtaaatcagtcggtcatgatatcactcccatctgaatgctcagaggcatcagtaacgtctcccagctcttggctctcctcgtcagtttccatagcatcaacttcagattcttcatcgtctgtgtccttgtcctcgtatattatcggtggaacagcgtcctcctcatcagtttcaccgtcagaaacctggaaaagttttgagttactgcagtgattaaaaagaccgcgccatttggaggaaagaaacttaccccgctgaaaagatagtctagggtagttgaaagttgaagtgctgacttgaaggttgatgttcttgcatcaataagctgcaaaattggcagatagtaacattagtattcagaactcaacctgactcacaattgccattcctgtctgtgcttgtgccctaaaaatttgataatcaaggaagtcaaaacttcaaaaaattcctgacacatgacatctaaatgcagcattgttcaggaacgatgcaaactagtaatctaataatcttaatcagaaaaagcataatccagtatagatgatgccatgccacttactgttactgcaactgcagcagaagatggtactaacctgatagagtgagtttagcaacagtagagaagattcctgagacactatgctgctcatgtgccgacaaagtaaagcctgaagccatgggagcatacaaaccagttttgcacccctgtggagaggaaaaacatatcatgtgcaacctttccaccaaattgtaatggaaatattagagatttacactaacagaaaacctacctggattgtattagcaatacaaagaacttgagaagcttaacgacgtctgccggtgttaggagtgatactgactttacaatgacctggatgtaacccagccaacaatacaattatcagacaagaggaaatgttccatgaaattgcaacaggaaaattcatatcaatgcattggaagactgctgctaggaatgaatactattagattggttatggcctcatggagaaaaggaggccagtttttagtttagtaaattaggctaaccaagtttaattgcaacttacaaagcagtccaacaagactggattaagaggttcagactactttgtcttttctttcattctgggctacccttctttttattttcaattttacttgctatgtgaaatatcattaaaaatggcaataataagaaataagaatccaagtaaccatagcctaagtttgacatagccaagcgtaatcatgtcttgttctacatgttttcctaatcatgtacataaccatcatagcccagtaaaacaaacatccaaaatcaaattattgtaacgtcaactaccttgtctgagccaaataaaaatgatgaattatacggaaaaattgaaagcagaataagattctaagtgagactgttttcaaaatatgaaaaatgattgagtgaagataaggggcgacagaagtctcaaccacacagtgcacaggaaaaaacggagccataccttttcatctctattgtacaagcattttagcaattcagtgtgatcatcagcacgcaaagcttgcttcagcaaaacatggactgaatctgcacttggtggcgctaaagagggtggttgctcttcagtaatttcagacttgtttagcaaattcagacttgcaagtttttcctccatggtcggttcatcaagattgtactctggattcacttccttggttgtgtctaaacatcccaaataaaaacaaaaattagtgatgtggtaataaaaaaaacaatatagagggcacccttaattctgtcctttcactatttagaggtagaaaaggtaaaagaaaatgttagtgtaaggttttggaggtaatgtaacaagcaatgtctcaccattagtggaatccaaaacggatgatgtccttttctttgcttttccttgaacaggttctgcatccttgctatttgctgggcaaagaaataatcaatgtcaggcatctagacaaagtatataatttgcaacttgattatcataccatatagtggagggtaattatggagagcaattccaatagattttttatcagttcgaaaggtgcacgatatgaagttagcattaaactagtggatggctgaaatgaaactacatacatgccattagtgcttggtggagtgcaccactaggcactagtcataaataacatctacattacttcgatctcttggctagttgattaatccaaatcattatccattagttaagagcagacaagctgctgtctggattggaattcatctgaacaggaagaaacaacagttcttgtcattgcagagaaaactaaaacaaggttcaagcagagcgatctggaaaaattgtgaaaaagaacaacgcggatcaagtagatcagtcctaaatctaaccgtgttttgactaactaaagctcaatgttctgtttaacaattgagaacatttttgaaataagaacttattgcagatatataggaaccagcaacagtacaaagcagctcaagaatgatggcatgccttttccattatgcaaaccgggttatttataccaggataattctaacacacttaactattcaatttactgcactgataatgattataagagcagcaggcagatacaacaacaaacctttagcttcttgctccaaattcctttcctgcggagacaccatatcttgtttagctagttcatcatactctgcaaccaagttgatgtccttgcaagtatcatccaattctacaaccttgaactgtaaaaagtttggtgatccaaatacaacatgaaccttaacagtattgtcttcattggtgtcacataatttagctgaaattattgggatacggccttttttatcgagtgaatttttgactgagatttttgtgggcagtacttcattttgggagagggtctgtaaatgccagacatgagcaacacctttcttcgatactgcgagaacaatgcccccatctccatatgatgtgctccttgtacactctactatctttggctgattttgcattgtaagggaggctgtagaaacgatggtacaactattctgatcgcaagaccacacttgcacttccttattattgtcaacatgagaaaccaaaaaacgtccatcatctgatacagacatcagctggacaggaccctgcatttgacaatagcatcaataagagttgaaagcctctattgagtacatgacatattacaaattcatctcgtggggtgtatcaacagggagagaggagcgcaagtttgagataatgacatacaacatcagaaggaatcctcaagatctcttttttctcactcacactaaataatcttgttatcttacttgatacacccataaacttctcatctgcaaaatacaatgccaaaagtttagttgagatacacaaagaaatgacaaagaaagaaattggcaataataacataagatgtcatatcaaagaaagagttcacattcaactcattttgctgaaaccctgggttatgtaaactaaatttcatttgaactacccgattggcaattaataatcgaaagatgcgaaagagattaaaagaattagtgttctgccagctccgtatgttcttgatatcccatataaaataattggtacatgaaaaattgtttttttttacctggcaattgcatatgtgttgtcatgctctatcactatcagctactacactactacatgttaagatcaacaaataattagaaatgaattttccacttcatgatacatcaaaaacaagccatccatttttggtaaaaaccttctattaacataataaacatccggaagactggattttaataaaggttttttcaagcatgcatcaggtgaacagatgaaattaaagttgcgctcaccatgagaaagtgtaaaagaattaattggtttcttcgtagctttaatagtgtctttggattccccggtgcgagaattcaattcacatataattccatccatgccagcagtataaagaacacgcccatgtcttgcaaaatgaagagaaacaaccttgctagtagaaaaaggaaagcatgttaaggtaggcatggaattttcacaataaagttacaccagagacatattgatctaacttgttttgttctgcagcacagactatgactcttttcttcagaggcaagttggctcataacataaatcatcagaatggcttgtcaaaaatttggtttacaggccatgggatgcttgtaataatccaattaagctcatgttgcctgcttaagtgtgttccaatatgaatatctcgttatttagttaaacaggaaaaattacaactcttccatttaggtgataaattgaagcttgagcttcaagcacagaaggaaagaaagaaactgagtcttgagctacaacaaatacgccaaaagaagtttttttttcccggcagagagcagcatatccatgcagaaccagccatttagattaaaaaaaatacttgtaagttcaaatattgttttaacttttaagcaatgactaagatatagcatagtacacgtgataagcctacagcgcagttaagtaggggaacaaagtactgaatgttatgtatgtttatatcgaagggagaaatggccaaactccttgtttcaaaatgccaaacattctagtttgaattagaagtactaaacgaaattcagaacattgcagaagaacccctatcagtcaagttaaaggtcaagaacatcaagctcatagatcataataagattgcacctaccaagtatgaggagcattcttccatatgacaccagtagaatcgagaactaaaacttgaccatttgtagtaccaacagcaacaagaataaggtttccatcctttttatgctacaaaaaaaatacccaatcaaaaacagcaaattgtaagacagaaatgagacagagcctaatttcaatcctaaaaaattacctttttctgaacagagcaacatgcaatacaactgtatgaatcatctggggctgaaattggatcagtccatccttctattatttctcctcctcctgtacgccataccttctcaattagaaaagcacaagcagaaaaaatggataggttagcatacatcaaagctacaatctcacaatttggattgatgttttgagcgaaggaaagattttaatgctaaacacatatccatccgaatttcctccatcatgtaaagctcaacttttcaccctctttttgttagtagtagtagactttcacctctccgaagtaccatttctaaaatagataggctatctaccattcacagatctcagcttttaacttctatcactctctacaaacagcttataagcaaaattatatactcttgagtcttgaggtagacgcccaacgtatttaaatagtgatacatcatgaaaactattgcctacaaccaagcagcacttcacccggaagaaacaaaaaccaacttcaccaaactcccctatttaatcgccgtgagagagcaagcgttcgaacctagttccccaaccatacagcaatcactcgcgagccacgagacatctcgaaaaccaaaagcacactactacatcgtagcgcagcgaccgtataacgctccagcagcggaagtattcccccctaatcaacaacgaccgaaggacgaggggaacagcgcgtaaggaaggggggattcaggtgacgggttccgagcgaggacctggactcgccgatcggagacggcagcgaagagct

SEQ ID NO: 45111 - DNA, 20436 bp, Oryza sativa
cccggcaagtaacgccggcgcggggcagctcggaaaggaaggacggggagaagcggcgagggttttcaggttttggttctggcgtcccgggtttttgctggtccgagctgctaaaatggaggcgaggccgttgggccgacagattgggccagaaaacttcggctgattgcagtgggcgtggcccggtgagcattgtaaagatgggagttcgcttttaaactctccttccagaccctcttaaaaccccacgtcttccagccaaacaataaatttaacaatccccaccctgcaactcctttctccctaataattcccccaaccaaacagctgttaggtctttgtaagagtggtaggtgaagatttagccgtggaggttgtatttctttggaattgtaagaaactgtcgtaagtttttttaaaataaaactttcaaacttatggtagttctttacatggtctcatttttttttcagaacaacgtccaccgtatggtttagcgagttagatttgattggaggttaagagtttggatctatggttaacgaggtagaattttggtgtacttagaatgcttatgaaatttgtagagcaattcgatgatttgaggcatgattagaaattctagtggatggaccatcagtatattcaggcactatatatgtcagattaactagtcaggtatatcaggtattccctcctgttgttaatatttgatgctgttgatttttcttttaacggatgccgatggaagtgacaacagtgaaggctcgggagaacgatgaggcctgtggcatgcagctctggtgctcgtctctgttgctcatcatcatccactcctcgttgcgtcgcacggcggcccgcagcatgctttggtgaccacctagtagatctgtcgctcgggaattcgacggccctgggacagttgcttgggctggatagaggttgctgtcgtgtgcttctcatctcactcaccggcatcccgctcctcatcactcctctcaccgtccctgcttccttctgggcatggacgcggacgtcggtaccagtgcagacttattgttcggctcgtcggtgccagacttgcggagaagagggaggctgagtgacggctccggcaacttgggccacttcgacggacaacggctgtagaaggacaagactatgggaaattttgtcaggatagtattttagggtgtaaacctggtaatttagcaaatcctaattaggccttattcggtttagaggggattaaagagaatcgaagagaattgagggggaataattccacaatacaataggtgtagaataaattctctctaatccctccctcatggggattaacgaaaaaggccttatggttagcgttttgaccaaacccctccctgacgatgacataatggcaattttctcttatgtttcatataaaaaactcaagaaatttcttatataccactaaaaatttaccagttttcttatatgacagtggaaattagctctttccttatatgacattacctcaaattttcatacccttttatgtcactactgtgttgattgtgtgttactgttatctccatagtaaaaagacgcatttgcccttatgggatttactgatgattataatatgagaactatttgaaaattacggagatagccagcatattaaaaatacatatattttttatatatccagcatatttaaaaaatatgtactggaaattcatgtggatagtatgtactgcaaatttgtatgatttctactgctttttatttatttggcatatacatctattgttggaggtatgtactgtttattttttacaattcggtatacactagatcacgtaatagttttcagaggtatatgtactgtttctttttttttctagtattcggtatattactagtggtggtttttgttttactacgtccatatatatatccacgctcgtcctcaccatgtagggatactaatttcattgatacttttagttagtactaaggttatttgggtcatttataaaaaagataacagtttgatcaaagactactgttagtcagagtgatggtaatggcataaaacagtgtgtaaatttgatctaacagcatatctcttatctactattataaaaattgaagatgtttttgtcatgaatttttgtatgtcgctcatacatataacttggctatgtttgactgctcttatttttactgtgatgtagccaacaaacacagtattttgtttcttttggctgtggcagcgcagcggcggtacaaagcagcgaacaggccacatatcgattctgatccatgcgtccatgtgttttatctgtcttgcgaacgattgcgttagggcgtggcctgaatcgttttctgtttcctattcgatccacgcgcacgattctcacacacaatcgccccattgtctcgtacaaggaaggaacaagatgccgatccctgattggtgtatatacgcacgagccggcgaggagagaaagaaaggcaaagcatgtcgtggacacatatcgataaattacatgcaaacattgattatggctgctcttcgattagccgcgacgcgagcaggcaaagctcgctttgatgtctctctcctatatgcctgtccagaattcaaatcatctgctaatcgcaaaccatcaagcagtagcagcaacaacaaggtaacgagaggctgcatacgtttatctaatccaaaggattaagtaaattaattacctttattatttaccaatctatgcttgcacaaaaatataatttttattatgactaggattgctggaagttgctcgacatgcttatatatatagagcatcatcgtgatatatatatatccagaacgacaaaaaatctcaatatttatagttgctgaatatttatttatatatattggacaaataaaaattgtaaactaggaacaaagtgtataacttaaagatcatccaattttaccaagaaaaaacatattatcatcttaaaaggctaaatagttcctcccattataacacactgacattttctcagtaagagaacaaccaattttaagtgatatatcagaaaaccaataaattttcagtggcatataaggaattctctcaaaaatctcgaacccaagatacagtcatacagctatacggtgccccgaatcaaaatactacctccgttttttaatagatgacgctgttatttttttctcacatgtttgaccattcgtcttattaaaaaaatacgcaattataatttattttgttacgagttgttttatcactcatagtactttaagtgtgatttatatcttatacatttgcataaaatttttgaataaaacgaatggttaaacatgtgaggaaaagtcaacagcgtcttctattaaaaaaacggagggagtgtgatacatgtatccgaaccaagctagtataaatactaagggcccctttgaatcgcagggtagaaaaaacggaggaataggaaaaacacaggattctgacaggaattgaaatgtaaaacagaggattgcaaaacataggaaaaacacaggaatggtcgtttgattggagcgcaggaaaaacgcaggaatcggatgagagagatagactcaaaggaaatttttcaagaggttggagctcttgctaaatttcctccaaaatccacatgcaatgtgccattccataggaatttcataggatttagaaagcttcaattctttgaatcaaagggccaaataggaaaattttctataggatttgaatcctataaaatttctaaataaatcctttcattgaaaggggcctaaaagaacaaattaaaggactagcgatgtctagacaaacctaccttccacggtaccgaagcgacgctgctactagatgggtgccgcgagcgagcgaaagtgcacggcgtgcggcggcaccggtggcgacgaagtgcagatcgacatcgatcggcgaagaagtgcgcagaccggacgacggcaatggcaaaatccctccacaagaaaacccatgtagtcccatgaccatgctcgccgtcgcctgcatagtgctgttcagcgtctcactggtgctcctcctggagtacatcatccgcccgcccgccccgaccccgttcctcgtcctcgcccgcgccgacgggctcgacgacaccaccggcgcccccggcgttccgcctcgagatgggcgtggtcggcctcgccgagaactaccacgcgtgcgtcggagggggcggctccgtgcttgaggtgtcgtaccacggcatggccgtcgccatgggccgcgtgccgcggttctgcgtccacgggaagcgggcgggcggcgagcgggccgacggcgtggccagcgcggaggcgacgtcggtgcgcgaggagctgcgcggcctgatccggagcgagcggcagatcgtgggggcggccgagttcagcgtggaaggggagatcaagggcttcggctatctccgctgcaaggcgctctggttccgggatgacaagcggaggagcccgatccctctgtgccaagtcgaagcctaaagtgtgtggcacgggctttttgtttttttgttttccttcgtatagcacgaatcttgaggctattggatggtccaaaaatcgacgaatcttgaggctactggatgatccaagaatcgacatgtttttccctaataacatgtcatcacttttttagcagcttccttttgtttttttttcttcgtgtagcacgaatcttaaggctattggatggtccaaaaatcgacatgtttttttcctagtgatatgtcgccacttttttctagcaacttcctttttctttttattaagtggtgataatcggggcacatgtgaatgatttagtgtttgggtacatcgaaacaaataaaactgattgtgggttagattttttttcccaactcagttttcaccgttgttatatcgtaaaatatcaggttgtaaagacatagagtcaaacaatcttactagatctgaatctaatttgagaaatatccataaacgacttaaaaaaactgtaaaacctcaaaatcttaaaaaaaaacttccaaatatatattttagataacttccaaccttgatagaaaaatgcttaagaaactgcttgatgacgtagtagcatccgatcccactatcaccgatgaattgagcggtgaagcagagcatgctgccgtatccacgtgactagattgcaggaagggaaggatacgttatatccacaaggggaaaggagatagacgacctatgttgagtttggaggtggttcttatatcgaagtatatctcatcatcattaaatacaattctactatctccgtttcaggttataagactttctaacatcgtccatattgattcgtctcacaaattaacctatatccgtgtaattaggtttataattagtttatatttaatactccaaattagtgtaattagatttataattttaaaacgggagtttggaggtgcttcttatatcgaagtatatcttatcatcattaaattcaattctattaaatattttaaaacgagatttagaaaatactagaattttaggtaacttttggtgtatagtttcacacttttcacagctgggccctggcaccgttcgccacgagaaattggacattttgccactgtcaaaagagggtttcgctatagtgccattccgccaattggattcattaaaatgccacctccaagtgatgccaaacatttcttttgccatattcaccattttactctattttcaccaatttttgtacccgggctgaccaaaatacccctttgggttgcttcttccagctcagcccttcttctagcacattggcgccgccgtcgccgcgacgcccgttgccatgttgatctcccagtcccagtggactatatcgcgcgttttttggcggggagcgaggcaggctagcttgctagctagccgcgagcggtgggtcgggaatggcgagccgccgccgcatggtggtgctggttggggtggtggtggtggcggcggcagtgttgttggtcgccgtggcctcggccggcgcgagcggcaagtcggcgcggttcgagctgctccggccgacctgacgcgcatgcaccgggagcggatggcattcatctcgtcgcgcgggaggcgccgcgtggcggagaccgcgtccgccttcgtgatgctgctctcctccggcgtgtacaccgggacgggccagtcgcatcccggtccgccgtcgcatccgccatcgtgctgagcacatcttcaatgtttctttctacacacgcgtacatgagttgtgatctggttgtgtatatattcttcatggacaagttcattcttttatctttctttttgagcggaggttcgttcttgttgttgcatgtatgttcatcatcatcatcataggatttaataaggcaacaagttaaatttcccaccggaggcggctggatcccctttcctcggcttgaaaatagagtgagctgagctagaagaagcagcagtcctaaaggggtattttggtcagtccgagggcaaaaattggtggaaatggagtgaatatggtgaatatggcaaaaaaaaaatgcttggcatagcttggggatggcattttaacgaatctaatgggcgaaatggcattatagcgaaaccctcttttgataggggcagaatgtccaatttctcgttggccgcgtgaaattgatccacgattgaatcccaaaagccccaaagccccacacactcctcgttctccagccacctccagccctactatgcctcgcccaaagcgccgccggtcgcccttgccgccgccggcgccgcctggcttccccacggagcggaaacaccatctgccggagctgcagcctccagcggtggccgcggcgtctcctggcgtcgctggagttcccgccgatcttggcgacgcgctcctgcgctgcggcaagctcctggacaagctcctggagcacgaggacgggtgggtcttcgccgagccggtggacgcgcgcgccctccgcctcgtcgactactacctgcgcatctccgaccccatggacctcggcaccgtccgccgccgcctcgagcgccgccgctacgcggacccgtgggcgttcgccgccgacgtccggctcaccttcaacaacgccatgtcctacaacagcgcgggcgaccccgtgtacgagagcgccgccgagctctccgaaatcttcgaggccgggtggccctccgttctcgcggcgccaccgcgcccgcccgacgccgagcgcaagcggaggctcagtggtttgctcccgcggctgccggtgggtgcacaggtgacggtggccgagatcatgaagaagcgggacgggtgcctgcgggaggtgaacgggatgatggaggtggacctggacagggcggactccgcgacgctggacgagctcgaccggatggtcgcggagcacggggccgccctcgccggcgtggttaaggtgaagcaggtaacatctggcagtgtgcttttgctcttaatcctgctctttagcatttcagtgaaccccctggaatctgtactcatcgcgtctgtttatagcgtagcaaaatctttgcattttctttgcaaaaaggcagtccttttcgaatgttaatagcaatgatggatattgccaagttcgggtgggatgtaggctgtgcccgcgacgtaatttcggtgtgtccgatttgcacaaaggaggatagtgactgtggaaaggggcgttttgtgttgaaatgttatttgtagggtgcgttggtgatcactgatcaggagcacaatgcaaatttcagtggatggactatcagtctattcacagttgggctcctaggatgatggggataagttgatggcaacattttcctgcttggttatttttgcacctggcaatgctcagaaaaaggatggtgtatgaaaatggcttgcgtgcactgctaattgtgctagtgactatgttgctctgttgctggtagaaacttttgaggctttttgttctggtcaatggtgattaaacctttccttctggcaacactgattcccctgatgggatggcgttaggtattgcgcattactgaatgtggtgtggtgtggtagaaacattgttatgcatttcttctaatggaaaggagaggggtttcctccctctagctcaaataaaaaaaataaaagaaatatcacaaattgaacatgcagatcaactatttgaacggatcggaaaattttatttatgggccctaagcctggccccattatgtaacgtggcattccacctgtacatacttagttcgagcaagctcaaaaagtgctcaatcgtcataagaggaacacaaaataatgtgttgaactgagtattcagtatatcatcagattattttcggatccagttgtatatctctgtgtactttagttcctctccattttatgtttccaacaatatgagttgaacttctgtcgttcagtaaaataccaggctccaagtactagtttgattcactgtttgctgttatcttgaactgtgctggtctctggtatctgtttttgacatttttgttcacttatctttactcctttcgaaagaaggcaatgatggtggtagtgaatctgtcaccccaccaactctattgtgtagagtactattttaccaaatactccatgtttttacctactcttctttcatatgctttaatattaaaaatagtccttctaactctatcttatttcatttctacagcacatgtttattatacaaagacacatatagggacaaaattctccccaaaccatcaaactaatctgttccaagcaatattagcacacatataatatattttaatccatagaaagcacgagtatttagctagtgttgtgtaaaaaaactgcatgtggatagtggaccaataaatagttgtcatgaattcaggcagacatatcatacagaacactgagtcaggagagtcattttgtcattaagacgctcctctttcattgcattgttaatctacctttttttgggaatacatatcactatatatgtctatgaataagatctgatgttgtgtgcattccccattcaagatagtaagtgccttcaatttaactaatggaagtgccatttccattgcacgggtacatttgaatttctttatagttgtctttgttatacactgtagcactatagtacttgtattgtatctacaccactatattcttgcccaatcaaaatgattatagtgcatctacgcaactataatcttgcccaatcaaaacgattgtagtcttatactacctccgtcctaaaatataagcgattttgattgggtgggacatagcctgtccagactcgtagtattaggatgtcttgtccagacttgtattattaggatatgtcccatccaatcaaaatcccttatattttgggacggatggagtacattctattctcttgattgatcagtcaattaatttgtcagaccgtaagatttctagcactcgaacaaagggctgtattaatcaaatgagttatttaacctacttatatcattacattttcaaaatcactcccccttcctcacctttcaatgtgtggctttgttctgctcgacatatagttaggttcactatggtcctgtactgatctgacagagaacattcagtaatgcgcttgtccatatgactgcaaactgaatgccttgtgagcttcttgttatgcatggcattcctcacttattattttatttgattttggtgtggggcttcgggctatcttttttatgaaaacagtttattctgacacctatcacttgaactattgcactgaagtaatcaattttttatctattcatgttaggagtatttaataggacaccatttgccaactaactaaacaatgataagttgttatgatttatcagctatacgttgttatgaggtttctttctattatatatagacaagggtaaacaatttcagcatttctaagtgtaaaattttcacttgataccatagaattggtctatgcacaaaaagacaagacaaccatacttcaccatgtgtgtattcacacatgtagttagtgaagtctggctgcttttaatacccgtgtttatacttcccagctcagatgcttaacagttgacagtaataacatatatatccagtaaagacgtgtttatggtcttatggtgcagatgtagatgaatatatgcaaatcttgacgtcacacattatacagatagctgctatgacactaagaatcatattgtacattttttagcatcgtcatagatgagtctattcttccttcgattttctgttctatgtttgatctttatgctatctttttttctgaactgtaggagccatgagtggtggataatcaaatttcagaaggtcctgcaagattctacctcagtgtcccttttttgtcgaggttcctgctctgtgaactgctgatatatctttgtttcagaatgctgttggcttcaacaggacttcgtgagaccatgagtccataacaccgtagttatcatatcctagatatgtcaactttgcattttgtcagatgtcataccgttgtgtttgtaagttggaacaagcgggggttgtatgttgggatcagggttttctgatactgaaacgtttggtgaactagaaggggaaaatatgcaaaaatatgcagtgcaaactcttatgtagtgtaaaactgaaaactattatatgatacataatatatgtctgaaatgtctatgttattatgagtaattctttctcagtgttgtatgcacacataatataggatacataatataactcttatctcgctgtttgtgtgtcactcaaataattatgaaaaaaaaatcaacaaaattagattaatatgtgataaatcaatcaacaaacatgcaagttaaaatttaacttctaaagttgcaacgaaaaaaataaattaaactatgtctagttaacgcatattcacagttataatttttttcgttgtaacttatagaagtaaaatttgatcttgtatgtttgtgaagtggtttatcatatattaatttatcttattgatttttttaatttttttctcaactatttagatgacatgtaaacaacgaaatgatgtccctcaaaagtataaaatagttttcccacagggagaaaatgaagcaataatattactaatctaggtgttagtttttttaaagtaaagtacaccgccgatctttaaaattgggcaaggagttatttaaatccacaatcttgttttaatgaatcatcatgggttcaaagcccatccgactgggctgatatgcatacatggttgtccagtgtggccataactttgcacttggccccctccgtacctagtcgatccgcttcttcctcaaatatcatctcttcttcattgtttcaatttatggttgcggtagcggtgacaaggatggtagcggagacccggttagggtggcaacgatgaaggaggcgggtaggacggtgctaacaagggaggcggctaggggtattcctaaagtgtgccggtaggagaggccatggctacttgaagcagcatgtcttctacaagtgccaagagaaaaaggcccgatctctcgttgattgtgcccttactgccgcaagaataacacagtgagctcattgcaatgatgtatgctaatcgggtcgtattttcttcactcgtcctcccacaaggttaggttcatctcccgcctcgacaccaccgattgcaccgccatcatcaacctatcgactgccgaccaaacgtgctacccaaatcgcatctccgtccaccacagagtgcccatgatcgctgacatcgcccttggagtcatcacaatagtgccgagcggagggggagggggagtgggagctattgctatggatagaggaaatattttgagaagtgggtcaactgggtgtggatgaggctaactacaaagttgctgccacactagacgactacgtcaacggtcaatggtcaacacagtcagacatgttttaaactcgtgatgatttattaaaacaagatcataaacctaaatgtctgatttacaagatagtgaagctaagtgacacctcattctagctttaaggatcgacattgtactttacttttttttttaccttttttactataagattgagtcaagaaatcattcggtttttcatctagtgtctcacgccagatggcagccatcaaaccgttcatattttgactgatatggggtaaaaaaaaaacattcgaatgatcattagacagtcctatcgtgaaaatattgataacataagtgtgtaaaagtactcagcgatcattcgtgctacaaatagcaatatagtcgcataccacaaaccactcatgcatatatcaccggctcatagctgtccgcgcgcagctgacgaggaaggtgtctccgagaaattcaggacgaacaggcggcggcgggatgggggcgcgcccttcgagcatgtccacgacgtccgtcatgccgggcctcatgtcccggctatgctgcgtgcaccacaacgccaccttcacgacgacctccacctcctcctcgtcgacgccagccgcgccgccgccgtcgccgcgcgccatggtggcgtccaccacctccatgagccggccttcctccatcctgtcccgcatgacgcacgggaggaattccttggtgaaatccggcggcgcccgcgcctgcgaggcgcccccgctgcccgcgagctcgaagttccggcgtccgccgacgagctcgaacagcatcatgccgtagctgtacacgtcggacttggcggacagcgcgttgaccagcatctccggcgccatgtaaccgagggtgcccctccagcgcgtgtcgacgctggtcaggtccctcccgatggacatggagatgccgaagtcggagacgtgcgcccggaagtcgccgtcgaggagtatgttcgccggcttgatgtccaggtgaaggatctggttcttgcactcgtggtgcaggtacgcgagccccttcgcgacgtcgacggcgacgtggcgcctccgctcctcgccggagaagagccagtagtcgagcgaccggttctcgtagaatgggtacagcaggtaccggccgccgccgggctggaggcagtatccgagcaagcctaccagcgcgtagtggtgcacgctggcgacgatggtgatctcgctcaggaagtcggcctcgccgacggactcatcacagacgatccgcttgacggcgaccgccgtgccgtcgtcgaggacgcccctgaagacggtggcggagccgcctcggcccaccacgcagccgaagttgtcggtcatggcctggatctcgccgtgcgagtactcccggagcagcccgtcgatgcgaaacgcggcgcgcagccgctccgcctgcacaaggggacgccccgcatcttctttcttctccggtggtagtggttccgccgcagtagccgccgccgccgccttgcggcggaggcgacgctcgatgcaggagagaagtgcttgataaggcttccagatgcagtacaccacgagagccacgatcgtgccgatcaaaatggcgacgccatggtcatttccagtggttgcttccacactcacgaccactacagtaactacagcaaggaatgttccggaaaccgtcttctccttccagcttgagaaggagcagaagtataagcaagcagtggcgacgtaggccactgattcaacagctaactttgccccgacgctatgacgagcaaagccaaaacggaccgcgaggaacaggataaccacagttgccgtgcgcagaaggaacttccctgtgttgcctcgcagacaggcacagcagcagcagcttcgtgcttgaggaggatcaacaactgagccggcctctacgtctggcataatgtctacgcaccacaggcaaaagcaaatgcagcaaagcttaagctattggaaacgaacgaaaaacagtagagtctgaaaaagaggacaggagcacgagaggtacttattggccttctagatatcgccatctccaaacagaatgatgtgatctagcaagagggacaagttgtggcctatagatgccgattttgaagtcaaatgagcagttgttggaaaagtagatgatttaacatacaaagaagcaggtgtcgttgtagactgagcgcgctggcatgaagtgagttatataggaccagttcgaatgagcatgcaatgatgcaaatatcaactagagttgacatctttccgcatcgcggcgatcagatcggtactagactacggccgtgtttagttcaccctcaactaccaccaaattttaacttttcatcacatcacatcgtatcacatccaaaactttcctacacacataaattttcaactttttttcaaacttctaatttttttcaggaactagtaccttccttcagttgtgtgggatagcggcatcggtgcgtgatggtggtgttatttttttcttttcctaactttaatctatcaggttatagtcttataattttttctactatattcaatgaaactttgcattaactaattaagtgtcggtttcttagaatatctttctcgttttcctttagcacacttttcaaacaattaaacggggtgttttgtgccaaaaaaatctcttagaaaatcaatatatatatatagttcaagtttataataattaatatttgactaatcatatattattttttgagggaacaagtaaggagctcctacaattcacggtttataaggaaaatcggatcaaaaaccttacgtcggcacggtcaatttataaataaccagcgaaaaccctcacattgacataatgaacccaagaacagcagtccaacaagggaaaaaaactcctaaaacgaagcattcaagaaggttacatcgacagaacggtgacaccgtccgatccaaacgaatctaaggttttcacccggagaattcccttaaaatagagttgaagctccaatagcaacacctataagaaggtgaacgacgttcgagggcatcgctgttgctagcactggcaagcagagcaaagcttttacctcggagtcccattcaaccatagcaaccatagcggaagccaccaaatgtcacctggctattcacatcacctgcacaatggcctgactccaacgagaggcggagccggactgacggcgccaacagtccggctccacctaacagccacacaggccgcccaaactccgtcgtctcgccgccaccatcgggggcccgacctcacccgaccccgactgaggacgcgtcgggtctggacctagaggagccaggtccggccatccccctcacaccaccaccaccggccgatgccataacgctgccacaacaccggatgcagggaggcaggccaccgaagccggaggtgactagagacaccccagatctggccggaggagaggaccaccggccatatccagctgtccccgtgctgccctcgccgtcgtcccgggacaaggaggccgctggtgccgagtggggaggagcagccgtcaccgccggaaaccccagatccggagaaaatgagggagggagagaagagaaaggaagaagaaggagagaggaaccgccgtcggcagcggcgacgcgagcggacgcggccgggaagcccccgcgcacacggccttttcgcctcccgtgtcgcctagagtgagtggcacgggagtcagggaatcccaaaagtgactaatcatatattagtgacttatctcgctttgcgtgctacaaaatttttagcagaacagctagctctaactcattcgatctttccattttttagtcacgttcctgtcacataaattctacttttgtcgccgataatctttccaatagtatgaaaaatgctacgtatatacgacattttgcctacgatcttcgtacagtcaacgtgtacgacacagggtaaataacgtcgagcgcgcacacgctgcaatccaagagcgccctgaagctcatatccatacttgaccttgcatggataaaacttgcttaatccaagccaggcccggtcacatgagaaatttaatgttaaacatctaagtacaattaccatataaaatcgactaaaaaaattactctaggctgtaccatgaggcttacgagatgacatgccaagacgtatgtaatgagtttgagctttggataagggctcccatttttacgtgggaccaaaagttgcaactgttacactaaggctgggagagggaaaagtgtttcattgtataatgaaaagattctagaatgttacttatcacacaataaaaagattctagaatattattatcacatcattcattcatcattcatttttttcatattacacccaactactttctcacccctaactatacctcatttaatgagacatcattgtcttttttttctttctccttattttccaaaacaatctaaaatctcataattatgggacacattacatcatccatacacacaccccacagtaccacacacacatcgatgcccataattgaatgttactcacttcatctacttttgatagttatatttcatcttggcacaattgaccgatgataagtaaccatttaaatatgctactagttattcctcgtaaacaaacgattcattaatatttacatttttcgatgcccatgtagccaatattgtgtggaagaatatatagtcacacattaaattcaagaaagtcattaagaggataggtggttggattgaaatatgcctatcaaaagtaaatttttcaaatttgaaaatatgtctatcaaaagtatatggatggagtacttctttcaataatatatttattgaaataaaataaaaggtatttataaaaaatctactaatatcaattttattatattatgagttaaaatttatcatgtttgattacccgcatgctgaaaatatttttatgggctaaacaaaccatattaaattaaataaaaatgattataaccctattttattagaggagacaagtgcatgccaacacaaacaaggggctccatatcatataaatggtgcgagagatataagcagacaagccttgttgtaatattagttgttctgacgcataggagtatatgaaatggtgcaaggatttgcgttggttgtgagttgtgatcttactgagttcattcctacgtacgcatgctctcgttaaccgtctaattttacaaacatcctagtataaaatgatgattaatacatgccgaacaatttaatgttcatatacctattcgtctttgtatttagttgtctttcatataaacctgacttaggtgccagaaacaagtctatatggtgaccagttcggtgcaaaggaccaatcagcgatgagctatagtagatttgtaggatattgaccacatcagatctgaggtctacgactttcatttctacagcattctccaacctgctacctctgctaaacaggatggagctgcaatcaactatttttgtttacttcggacgaattaactcgttccaaaaacttagaaacaatctgatacagaatctgcgtcactattgtgctatggccatcaccattcatggctacaaagagtaaagaaaatgtctgactgccctagctattctttcatccacgagcattgatatcgtttcatcttaaatctcatgtatcgcattaaattttacacgaatattgcaaaaccttaacagtgagcatgccctagttggtccggatattcattttctgatatagacttctgaactgctaagtcaattgggtgtgctcgggcaattggagcaggattatttactctactccacttgaattcatgggtcaacagactcatcagagtcactcctctctgcctcagcttcttcaccgtttgcagcgggtcgttgaacattacgcttggttgctggagcaggtgcagctttcttgccaccttctcccgctccaattacgctagcattctggtctatcaactgagtcaaggaatcttgcacatacagtgataggaatacatatagcaaaaattattttcatacgtaaacatggcatggaatggctcaacaagaaccagtcaattagtgaaccagaagcagtcagataactagtagcaggtattgttatttcaacataacagcctaccaagaaaatgatgcttgccttccaagttccaacaatacgagatgttgaagtttaggctcggcaccatgctcaaaaagttcatggtattaccattgtcatcaagataaggaactcattattatatatagtttattaacttctgattaaaaagcagtaacttcaagcaatggttgttcatgagccaattacaaactaaacgacaaaaaacctgtcaactaaagatatataaataaaaaacaattaaatttttactcaactgtaattaaggtaacatatgctataatttgataaaaccatcaaaaccaaaaggatactgacagatactccatgcataatattcatgagatgcttttcaactcggtgaaccagttctgcctgtaaacatgagtgaatggaacaataacagttatgattgacaaagtgcttccatgaggagctaaagggaaggcattgaatacatttaagtcaggctctctccggaaacgccgccttcgtgcatccctcattggaggagtaagaccatgtgtgtattcaattccttctggagcaggatcatcttcttctcttaccataatcatctgttacaaactcaatgtaagattcttaaaagcctacaattgataaaacagatcttaaacaaatcttatccttttacctgaccaatatcagctgttttaattagcactgaatcattgtatgtcttgtatgactccataacagttgggagatctaagagagatgctggaaagctttcatttccaatcataaatgtgccacttcttccatcctctgtagcacgaaaaaagaacaccaatccacaagtcaaaaaagattaactgaaaatttcagtgataacagtactagagtattacaatacaagttgtatccatcaaacagaaatagaccattgttttgaaccaaaattagaagtgagtagagaaactagacatgcacaaatagaatgctttagaaaatattagcacaaaccacatttccagaatctaaagagtagaacctgtcgagtaagaacattgcattacaccatgagaagatacaaattcttcaaagtataattactggactttagtcattttttatattgctaatagtgattaggcaattggacgtcttagaaagtaaccgtagcaaatattacatttgtggaaaaaggaaacgttaagagaatgatacaaggaaacaagatttccaaaatcgtaaagtgtgctattatctgcattcccttcataatgtattatttaaatatggcatctgctgctaaatggattactcaatatgtcatcattctcagatctctgcaggtaaagagtaaagagcacagagatcagatccccgcaactggtaacccgcatcagaaaccacaagcttgcaaagcattgccctttaatatatgtgtacaggaaagataattcttgctgcgttgaaaatacagtaccaataaaaaaaatctaccaacacgctatactgcggacttatgacctaacacctatatgacaacacaccagcatatgtccactcaagtgaggaacaacccatcggaagcgttccctggtgtacccgcacttccacaagcacagaacggaggttttccacttgcactcgcacagcataaacggtatgcgcatttcgccgaacagcgtagggtcacggtacctcgctagcgaattcccaacaaaaccatagcttttgacgcgcagctgttatacgacaggcctacgcgcatgcggaagctaaattctactgacagaaagaatcacctgagaaggagagatcgagggaggcgtcgtcggggttggaggatgacgcgccggcggcttggttcatgaggcgttcgatccgctccgccacggagggggcacacggaggatgaactgctgctccatctcaaattcccaattccgccgggagcacagcaccgcggcgccctccaagattgcaaattcgacgagcagccaatttacggtctcttccgccgttctctgaatttatcctggtggagagtagttgccgactatatattggtttagtcggtaaaattgagaggatcactagtgggccggaataactgaccacgggcccttcctgcggaggaataagttcatatgaggtcccttaacttgtcaaagaatccgatttacgtcctagactagaaaaccggacacaacatatccctcaactatcaaaaccggtgaaaccggtgcagattaggtccctcggcggttttgagggtggttttggctaac

SEQ ID NO: 45112 - DNA, 14084 bp, Oryza sativa
tgccgcgacgagctcgcttcctccctcgcggcgctcccatctgccgccctctccgccggtacggcgcgcaccgccgctcctctccctcccacccgccggatggagaaaatggtttggcggcggcacggagctcctggaagacgacgacggctcgatccaccaatctaactaatttgcatgtattttcctgatgttagtgaggtctctagagtggtacaggtgcaaggaatcaacgcgaggctcaccgaagcagcgggaatcgaaaattgatgccggcggccggagttgaagaagatggggtcgatctccctcttcggcgctccattcttctcggttcttgagggctattgattgcactgatgaggagaggttgttggcgcgaggatttgatctgcggtggtccacagcggtcgggacggcgacgatgtcactgcggcggccgccggatgccatcttctaaagcaaaagaagaaaaagaatgaaaaagaaaagaaaaggatagacaaagagaggaggggagcagtgaggatgacatgtgagggagcggtgcgcggcagtgccagcggggggaagctacgcgacgaccacaacgtcaccgagctcgaccgccgccgctcctcctctgctgtcccacttgagccgccgcaacaagggccacctcccgccaccgattcctcttccgcccacaaccgccggagccgtgcctccaccgctgcgcgccgctccctcctcttccgccggccgccgcgtgccgctgtctctccgtcgcctgggagaaaattgcatatctaccatcgcataagattggcttcgtagaaataccatcacttaaattggcttcgctagaataccactcccaactagaacggcttcgccaaaatgccattttggacaaaaatgaccctgcatccgtctcttccacctccggcacgagcaaacggcaatggtgcgcagtgcagtagtgacgggtgagatgaggaaaggtcgacggtggtcttctccgacgagttcgtccgcctcacctagctgcgcggcccccaacgccttcagtctccacgacgcgccgcctccgtcgccgacgagttcgacgaatcatccccattgccggcgagttcatctgctgcctcgacgcaccgccccatcctcaacgagttcttccgccgcacctcaacgcgttaccctcatcgccggtgagttcatccgctccgctttcgtcgccgatgagttcggccccatcaacgttgatggcatcggctacggcctcctcctagcgcggcgggcaggatgaaaaggtagggacgacgaggatggcagcgcccccatcgtcgccggcaaggtggcaccggtggctgccgacgagctcctccggcattggaggaagggagaagaaccagggtcatttttgtccaaaatggcattttggcgaagccgttctagttaggagtggtattctagcgaagccgatttaagtgatggtatttctgcgaagccaatcttatgcaatggtagatatgcaattttctcgtcgcgtggagagaggagagagagatgaagataggggagatggggagagagaaggaagaagagggggttgagttggactgacatgtggggcccacgtgggtcccaccattttttattattttctgtgagactgacatgtgggacccacgtgggtcccaccatttttttttattattttctgtgtgagactgacatgtggggcccacgtgggtcccaccattttttattattttctgtgtgagactgacatgtgggtctcacgggttttattatttttccagattgaattgccacgtaagcgccacgtcatgccacgtcagatgaagactgggtcaagtgagccacgtaggcaccacgtcagctaaaaccgccatcaaaaccgctgagggacctaatctgcaccgattttgatagttgaggggcctgttatgtctggttttttggtccagggacgtaaatcggattctttgacaagttgagggacctcagatgatcttattcctcctgcggaaacatgtggcttttctgggccgttcagttctccacatcaaccttgtctctcgtaggccgaggccctggagaagtccacatctcgcgttctcgtggacgcacgccatcgtggaaatggaggactaaaagcaaacctcggttggtggcccaggcccagctgaaacgtcctgaagtgagggcgaatccttcgccgtcacaccgcgtcagcgcgttgtctcgaggcaggtatatgcaagggtggaaggcaacgggtgctctttgatctgatgatgccgctagctagggctcgccctacgcgattacggatatatagaagtatggtctgcctctgtccatgcctacttattggtatgggctactttggcctatccggtcatcggctaataatgtatggagggggctagctacctccatggaatagaaacggtgtcatattccctgtaaccgctctggccatctcgtcaagtagcggctggccagattgacgataacagatacgttggcatcgtccctagttcatggaacctatacaaccgaacttaatcagctcaagtttggttcatagctcgaggggtgccaatcatttgtgcccaagtggaaactcgccgaagttgtaggcgtaacaattcgagctatggtataaattgcacaggacaatattgccacaacgcgaccagtgttcatatgatgtatgaaacctagttaaaactatgtttggcatgtgtgatattatacggggttagtacgaaaacggtactagctagtaccatttcgtagagataataacattccacgattccaaccatttctttgtgacccctattactccacccatgcacccctcgcaagtcgcaaaccgtccagacatcggcagcgccaacatggctgcaggcccctgattgcgccgccagagtcgacacgagaacccgtgcggcatcacgtcggtccgggcgaaacgggggtagcaatacaatgattgagccccccgccagcggcacagccaaaaaagtctagccgccgcatggccagcccagcgcgtccccgtccccgcaggtcgctcgccggaaaacgaccgcgcgaggaggaagggcgcgcgcggaccgaatcagcgaagaccaacgagcgcgcatcgacaagccccctcgtgacaatcaactgctctctcgatcgagacgcggaggcgctgttgcacgtccacgtacgcctcgctcgctctggtctccgcgcagaaacggcgacaccctctcgcaaaaatcttttcctcccgtcaggatcagatcgaccgtcgcggccagtctctgatatcgatcggttggtcgactacgacgtggctgatcgactgatgagataataagagaatccccctccgcgcgcgcgttacgcgagtgtgcgctcctacaccgaggaggcaacgagacgcggatgtggtatgggtggtgggtcggtctatcgacgactcggtgtatacgatcgttgatagaaggtttgacaaatgcggggcagaggatgaatgaaagccagggggcgagcacgcaacgaacgcaacgcaacgcagcggtgcgtgtgggccgcagcacaactaccacccagatgctaacatgatgcatccgttgcttggatcgggccttcgcttcgggttggctgccttttgataacgacccggttgaatcgagcgaatccactaaaattatcgcaaatggagatggtggctccattattggacgaaatcaattttagacaagcgtccaaacacatatgtggtgtttaatacaaaccaaatcgtacatgaacaaaagaggaccgagtggagtgaaaaaaaaaatatggaatacgcaacgcaggacgtacgttgccagcggaaagtagacagtaatgcgtttgtctgaaaacggatcacattttacgtgcacacaacgaatgatggtggtatatatgtagattaatctagcaaattaaatttaatacagcatcacaaatagaaagttacacaagaattataaacaccgtaaaaagttcgaaatgtgccactaaatcctttgggcggttcacagttctaacggccagagacggggacttgagccggcgtagctcatgtgccccctgttgttggccatgccctgcgtacgtatgcgtgtacctcaccattgtgattaaagaaattatgtggtggttaacgaaaggcctctgaaattcaacgccatatatttatgtacaaggctcctttgcaacatgtagcaagttgacagtgtatagtattaattactcccgttaatcatcttgcagtacgactgtaccctgaggtgtacgtacagtacacttgtggctgacaatcataccaacggctattcgggcaactagaatgccaaaactggataggtgtgtgagcttgactgccatgttataagttgacatttcccgttagtgaaggtgacctgcataaaaaaaaagtgaaaaagatataggtaaaaaatgccgctatgtttcctcaggcctcatcagctaccatgcgcaggacacgcctgcatgggtcggacaactatagtcaacgacagatcaggattaatctagacatgagtagcactcattggacgtgtttcattttttttatcctctagttatccaattttgattggagtcaactgagtaattaaccaattagttttaggccaatcatacaaaaaaaagtaaccggaaatcaaggtcagtgtcatatattttagctcctcttataggattactccctccgtactcgcgaaggaagtcgcttagaacaatatttaagtcaaatcttgagaatataaatcataaataactcttaatttgttgagtttgaaaatgtaaaaaatatatgaatagatttgtcttgaaaaatactttcataaaagtatacatatgtcacttttcaataaatatttttagagaaataaaaaaatcaaagttgtgttttggagaccgtgtcgctgtacaaaacgacttcctttacgagtagagagggagtactatttttgcttggcctagctttaatttgctgatgtgtttgcacaagtgaggtcacaaggttggacagcagggacgtgtatgtagctaacaaactaacactccctccgtccccctaatataaaggattttgatattttattggtactgtttgaccattcgtcttatttaaaaaatttttaaaattattatttattttatttgtggcttactttattatccaagatactttaagcacaaattttcattttttatatttgcataaattttttgaataaaacgagtggttaaacagtgtaagtaaaatattaaaatcccttgtattaggggacagagggagtagtacgatactgtaatcctatttacaatggaaattacaaaactctaatcagtgccggttagtaaggggttgtttagattgaagacaaaataaatcttactaaattttggcaatgccaaaattttgataagttgacaatattaccaaaattttaacatgatttcttatgtatttatcaaagtttggcaaaaaaaacactaaatgtatgcacatctttggcaatcttatgaggagaatcatcggtagaaccgacacttatgggcctccttggctcaaaagaaaaagaagccagctcatcaagcccatgctccgagcagcccgaaccctcatctacctgttgacgactaaatttggtaagatgtgaaccgggtttgacattgagatcgaggcggattcgataaagagatcgattcaaagaacagagtatgcattggctgtgaaggcattggctgaagtgtgcatcggctgggatggatcggacagaggatagccgatacagccgatggaggtgatgcagccgattccaatgaaggtggtttcagggctgtttctagactcgttcaaagtatttcatagagattgccacgatggggataaagctcttggattaggcaattgtacctattaattaggatatttcgtgtaatttccttagagatatgtttgggcaaaagtttgccgcaaagacttatggtatcttagagtttgttagagatgagtgtcgtgtccggcaaggacatatcttgtatctcgggtataaataaaacccgaacccatgtaatcaataaacaatcgttcaatacaatctcggtgcatcgccacccttttttactttcgtttatttcgacgagttcttactttcgggttgagctgcatcgattcgattttcaactagaggtaaaacttgttatggcggcttgcgttatcggggttaatgcttccatctttatgacactttaaccctgtttatgtaattcgtcgagttatcatatacacgttgtaatctatgttggtcgcgctatataacttgttatcggttggttcttattgtaggaaagcaatcaatagagttatgttttgttattgatctagattgcattgtgtatctaccatctcttgtaggttttcatcatctcgcttagatatcatatttgtctttatgcttaatgctgcatcggttgagttcgatctattaagtaatatctacaactatgatatctggattgttttatgatcatcgagagagatagtatcggggtttcagccgatattacctgatttagctttatgttttatatgcttaattgatatgctgaatctgcctgttatattaagatcttatcgcaataaagtatattaggcttctgtttgatatattctatccgttttaatatcttaacataaagtggtattggagtactagccgatacatgctagatctatctgatcagctatgctatgagcgtttataatcttcacgttaatgtatatttcgatctaagtgatttatactgtctcagcatgatgaccgatctatcccaatcacttggtttgaatatacattgacagaaagattataaagcgttaatatctatagccgataaagtagatttagttttactttgcttatttataactgccgatcgattcacatatgacatcggcttgaaaataaatgacatgtcatcggcgactggccgatcggctatcgtttatggatttaaccgcggtttcttttgtctttatttcttgttgattgtaggatcaaatcaactggcacgctaacaaacctaaaggcaagattttggacctgcactgaagttaagcagatcttccaggccagtgtgtatttttcgcatcaacactacccccgatccccaactttagatcaagaatccacattcatttccctgatccccaatatcagatcaagaacatacaaaataaaaaatccccccaattcacaaataaggatcaacttcatagtaatctcctaatctatcctgaataaaaaatgtcacatatcaaaagaacatatggtgagttgagaagtccgtccatgcgtagatctggctgcacccaagggaggaagacacaacaaccagcagcccaagtctcccatgccatctcccaccgtacacccaacctcatccatcgtcgcgcttgagcccttaattgccaccaacttggtgatctccttctccttcgccacattggctagatccgggatcaacaacatgaacacaaaccaaataacgttgtcgaccccattggataagaaaatagcaacgaaggttctgaccagccaaccggatccatcggcggggaggccggggtcgccagatccggtgtccccggcctcctcgctggacgattcggtggcggcgatggcgcagctcttgtgaggatgcatagggagagaggacaccgacgctttgtgtcgaagcttgtgcttctctagctggaaggagtggcaccacccttttgggattcaggtagggagcgggtgcgaggaaacatggcaattggcgtcgcgcgcggataaacgagggctgcaaaagactatggtttagatagatttaagccactcgaaagtgtaacaccctactcctatcttcttgtttggattccttgttgccatgtatttaagatgttggtgtacttctgttctgaggctctgaagctgatttctctttgtgtggaggctagtggcattggtcctccccttataactataaggggataccatagtccccaactctttacacatgggtcccataggagttggtatgtttggtcttgttgcacggcagttggcgaagcccactatcgactccgaactagcatatcggtcgtgttggcaaggcatagagtggcttctctccacccctttgctccttcctttgacgtgtggcttagggtaggtgatgtggacaccttggtggttgccgagcctacttgagcattagaggctaggtggggctgtactacagtgggctggaactggcaacaagtcaaacgaccatgtcgtctgatagcccccatgctcagtgcctttttagggtgatgatggcttgtcccaaggtcggcatacgccatcttgtcgtccatcgtcccggacgcacgtcaggttggtatagattgttgctatcctgagcacgtggggaaggtggcagatgtgccccgagtacagtgcatgaggggccgcactcatgggcgaacgtgcccggagcataacccacagtagggatgaaaacggatcggaaacggacggaaactagctttatcatattcgtttttatattttttttcggaatcgaaatcggaatcgaaaactcggatacggaaattaaatagaatattattgaatacagatacggagcgaatacgagatggaacgaatacgatagcgaatatttaccggcatataaaaagcccctcaaattaagtttcttgatcaaggaagagatatcacttattattttagttcaacatctctaacatttatatcgtcaattttgtagacggtctcacaaccgcatgtgaatatcgattttcatggttgttcctctaagagatccatatgcaaatatgattatcattttctattctcaagaccttttactagatgcataacttacttgccattgtataaattggagatgttatttattttacttcacattttcaaaatttgtaatatttgttttatactttaaattctttcgaatacaaatgttataaactacaaagtggtagatcctgttgagctctacatctttgatatggaacacatctccatcagatgtcgtttgaattgtagatctgagattttgtaaaaattaatatggtatattataatgaatatttagacccttaaatgacctcaaataataaaatagtcaataagaaagttgtagatctcatcgagctctacaattttgatataaagtgtgtcttcatctgattccgtatgaaaaagttatgtatatatacgtgtttttttctaaaatttgctcaatgtctgcggatatccgaaaaaaattccggatagtttccgaccgttttccgattctgatggatagtacccttactgtattcgtttttgtttctgagaaaaaaatccgaattcgtttccgaatacgagaatttccagatagttcagaccgaaactatccgaatccgaaaaatggtctggacggacagaaactatccgaaccagtttcatccctaacccacagaggccgcactcagaggtggacatgtcgcgagcagaacccctagggtgttgcacccgagggccaatgtgcttgagcacaactcatggaggaccacacctaggggtggatgtgctcccaagcacaatccatatgaggggtcacgcttaggagcaggtagcaggtacgtttcgacttttgagaaactagtaatggggatcttggttcccgtttctccgacactttgaatgggagagtcaggactcaggagttatactcagctcaatatgagaggaagggagagcgaggaagtcttgggctggatcgatatgagaagcggaccaagtatggacttacattaaaaagaggggtttggagttagtgaggcacacgactcggttcatgagtccagttttctggctggtctggataaaaccagtacaaatagtttgttttttgggttaatcaacaaaaccgagactaaaaacataagtgtcgatttatatttaaaaaacagtacataggtaggattattagtaccggttttaaatttaggtgttacgtaagggcttgaaaggcatgaaaagtttcatatgtatcaattttagatgaatcggtgtatatgagagcatcccctattagatgcttcatagtagtggctaacgcaagaaatgaagttgactgctcccttgtaagaagcaagttcacatggcttataccggcgatgattgagttagccgtacgtacatgcgtttgctttattgatcgagcccggacgaatcgaccgatcgactcgattcttgcagcatttgaccatgcgtcccacgcgcgccagcagagagacgttttggctcattgcaaagtactatctttatttcgatcgttctccaagagtacgcgtcctgaattcctgatttaacacgccaaaaaaaaatctccttggttaatcgataaagtccttgggttatccaaaatagagacgctattattattacattattatgcgggatgtaaccggtatgaattgatcttctgaaaggaaaaggctcggctttacggaattgtgatctattactctttggatttcactgtctacgctcgctgttgttctttttatgtgcacttaaaaagtgcgatgcgtacatatcaccgacgattcaccggtatcaacaagtgatcctgcatgccgctcgtatcgcttgttgctcgtattgatattcctttatgttagaagaaaaaatcgcttgttgctcgtatatatgctaatcggatatgatatgataagcccgtaattaaggggaggcatcagcagtctacttcttatagtggagaggtagcaacttgactgaccggaaagagattcttattcatgttgacaaattctcaataagggtggttttcaccgtgggtccgtggcccatacacaagtcggattcttagtacagtaaagaatgataattgtaggatcgtaaagggccttttccaccccaaaagctagccattaaggtgagtgacttccctacttatatcttagttcctttgcccttccacaactaatgtgggactattcaacaatctcccctttcacacattggtgtctctcagcccttcactaccctttcaccgtatctgggcccccaccggcccacggtccatcaggtatacgggccccgcaggcactcacggtccatcaggccttcacacgtgtccgtcgggccagagatgttaacctagcctggctctgataccacttttaggatcgaatcacaagaactaagccaaccagagggggtgaatggttggtatatccaaaaaccgaaaacttttagcggaaataaaagttaccctcgaagtcgatggattgcggtctgaccgaaggtattgcgccggtctaatcacttgatgaacgtcggtctgaccgatgtagatcgatcggtcgaaccgccgagacgcctgccacgcctgtcgccgccgccggtctgaccgcccgtatgccgccggtctgaccgccgcttgccgccggtctgaccgctggtagatcgccggttagaccgccgaaacccggtgaaacacaaattgaagaactcttaaagtagatgacgactttattgattctctctgtgtttacaaagtgcaccaacagcactccttacaaaaatttcgactaaactcgaaactctaactcaaaagctcaactcaattgctcttaaaagtaataccgggaagcctcacgctccccctctatttatacccgaggtaggtagcctaaagccacgaaccaaactcatactaagagtcctaaacaccttaggaaaccctctagtataagaaagaaactttacataaccaatcgtaccaaatttggactccttccaaattcgactccgcatcccatacgcacacaataactccatcgtatgccatatggaatctccatcaaccacgtgcatcaactctagcctaagtatcccgcatgatctctgactaccacggacgtcgtcttatccccaagccgactcccggtccgtcaccgcaaatactctcccgaggcatcgattcacctacacacgaaataaacaaagaaaccatattccgagaccaagctatctccaacttgactcattagtagcaaacaacagtattacatacgtatagtattcatctagaagtcataatcatgaaataatcacggatatccaaacaaacaacccgaaaccgaaactgacacagtgtcggccggtctgaccggcatacacagcccggtctgaccggtcacatgaaataatgaatcctgtgatcacctgtgaaatccaatcatctccaaaaccacttcgtgaataaattccaaataacaaaaccaataatctccgatgcccaattgttcatcacataataataaccaaaaacacctttgattttacaatctcccccttgatgaacacattggcaaacctatcaaaaatgttttggtgtttggaaaaataaaaacaaaagtggtaaaaagcacacttcgtacaaacgtacacatcgtgctcaaaaatccaaaagaaaacttctcccccttttgaaaagaaagaaattcccaattgaaccaaaaacatactcttctcaacaactcaccaaaattcaccttgcttctcccaaaaatccaaaaattttcacatacttctcccccttttgacaatgatttcatcaagcataggaattatgttcattaatgttcaagagcttaacatacatatagtatatcaagtcatgtgttgcaataaaaagaagataaacccatctataatataacaagcatgcattaaagtataaccatgaaccaaagattttacaattaatcttgaatcaacaatcaaaattcatgatttcatacaatttataatgcaacatcttaacaagcacataggttgaagaataaacactaaacacacatacctattgcatttattactctttctcaaataacctttagcacaaaataactaagagaatttttttttcaatttttttctttgcttgagcctttttgctcatatttttctcttttattccgggtatgtccctgtcgtcaagactgtttctagggattcggcacccattattttgctcacatcgaatacgtcgttgtcgacaagactgtttccaaggattcagtattctttttttcatattttttattctctttttcacaatgagcaattaaagctatttgaggaataacaagtcaataaagcatatatatatatatatatatatatatatatatatatatatatatagcatttatagatcaaaccatatgctagcatcaacattgcatatttacttaattcaagtagaatttaagtgtcatgcatcatctcccttaaaagtaaaatctaaatctcatgaaaagactagaataaatacaagctgtgctagagacaaataaactttcaaagtattgctagcatgcacaagaaaataccatatgtataaacaaagctatcttttatcaatttttctcattgtcatattattgcttgataaaagcatgaggtacaaactccccctcaaaccatgccaaaaggatgaattattcccaattcaccacgaagaaaagcaaatcggttagaatccaaaggtttagtgaaaatatcagcaatttgcaacttggtgtccaaaaactgcaattcaacatctcccttctcaacatgatccctcaaaaagtgaaaacgaatatcaatgtgctttgtgcgtgagtgttgaacaggattcttagcaatgttaatagcactagtattatcacaaaagagaggtactttctcaaaagtaagaccataatctttcaaagtaaataaaagccaaagaatatgtgaacaacaactagcagcagcaacatattcagattcagcagttgattgagcaacactagattgtttcctagaagaccatgcaatcaatgatgtaccaagaaaatgacatgttccactagtatttttcctatcaat

SEQ ID NO: 45113 - DNA, 842 bp, Oryza sativa
ggttccaataatattatgtccagaaggtggttcaaccaaagtccaaactttgtttctctcaaaattttcaagttcttcatgcatggtgttaatccacgattcattagttaatgcatgtgacacatctttgggttcaaaagaagcaacaaatgcagaatttgcacaacatcatgagtcgttaccttagaccttgttgtccgctcacctatattaccaataatttgttccggcggatgtcgtcgttgaatgtgcaaaggagcagcaacttctgcagttgatccacgttctgtaccagtactggtcgaagtagtaatctccggaggaccatctcgaacagcatcaacagaaccctcagccgacgaccctggccggtctaaccgcacctcctgtgccggtctgaccggaggtgtgccagtggtctaaccggcctagcgcccggtctgaccagccgagccgacctcgtcgtcatcgttgttgtcgctctcgtcttcaaaaatacgaccatcctcccgctgaacctgtgacagtgtacctgcaatatcgggtctagtacctggactagcctcatcaaaagaaacttcgcaagtctcaacgattttgttagtctgcaaaataagtacacgatagccacgagtgtgtgcgtggtaaccaagaaacaatccatcggtagaacgtgcctcaaacttatccaaatttccagatttcaagacaaagcacttgcaaccaaaaacacacaaatgtgaaactttgagttgatgtccaaatcgaagttcataagaagtttttccaagttttgatctcaagaaaacccgatttgaaatataacaagcagtgttaatcgc

SEQ ID NO: 45114 - DNA, 29975 bp, Oryza sativa
  unsure (1)..(29975): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacctaagaagaacccctcaatcgaattaatacaagaattaatggtatgaatttcatggaaaaatagttgttggggcacttcttttcatatttatcatgtcacatagcaacaatggtgccaaatgtcctccttcaaacaattgataccaaaggtcatcctcttaatttactctatgttcttacatcaatttttttttaattctagatgacacctcatttagtcccattgacactagttgcctaccttggggcttgccgaacaccccatagcatcgaagcacccccaacagaattgaggccagccagacgaccgagcaaagctccctcaccgttcaatcgctgttggtttgcatcatgccggtcggcctgtccagctgcacgctcacgtacgggcacttgttcccattggtccaacgttacgatggtcgatgatggctacattgcccccgcgatatgtcgagcagaggcgtgcagcgcgtcgcagattgagacgtgcggacgaatctgtggcgcgccgcgcgcttacgtgcacgagtgtacggcacggggcggcggccctgctccccgttactgtgcatctgtaaccggtacgatcgagctactcaccgtgctggcagcatgcgtacagcgtaccatatccctcccatccccgggcggctcgtggatcagcagcgtttccgtggcctcattgaccctgcatgcatcatgggctctctgatggcttaagccgtactgcttctactactactactaccacttggtgtcacggtattgggcatgcttaagtattggtaatgacgatgacgaccaccattggatccagttttttttttctttttttgaatgtttttggaaccggggcggaacgatcgatctggatctcatgcctgattgaccggtctttgtatctccatgtgcgagcaacggtcctgctggtggcgcgctcagccgtacgtggaatctaagatatggagcacagtacaaatttgcgtggtttcagggtgcggcgttgcgtgcgcggtgcgcccacacttgagtctcgaccgcgaagggcacatgccaccgatgcaggcactcgctttttggcccgtatggccgtatcagttttaccctttgacgcaacggcaatagaacttttactacgagaaatacgcaagtctgcaatgtagattactaccacggaaatgcactggcaaataggagtacgatgtgtaactgttttttgaggcaaagtggtggctgcaaatctgcaatgctcgagtaaatcggtaaagcaaagcgagtaaaaaaaaactagtactgtgcatattgtgggcctcctttcgcctttgggtgaggatccctatgtgcaaattgacagaggacctgacactgtcagtgagggcacctgtctttctctctttctctgttcggcggaagtttttttttcactttctttccacgcgcgctgccgaactcgtgactgccgttctctctcgtcgtatcttcactcaatggcaggtaggccccactgtaggtggacctacatgtcatgcacgtctagagtgagaggcgagtgaatcacccccctgtcatgccctgtccttcaaggttcccgtgtgcaacggcctgtacagccgggcatcgttagatttctccacgggtgacttgacttgtgcggcgggacctgcaaaccgggggcccacatgtcagctgcagcgctggcccctgggtgggcctcggggttgcagcgctggccccgtgcttttggccgttaccgttacctcgaacgcgccccgaggaggagcgcctttcggccgcgtccccacctctacctttccaggggcacgcggttgaagcctttgctcttcgtcgatgacttgtgggcccggaagctataaggccccacgttgtcagttcgatgccgctctacgggctagtgggcaatgcgtatatgaaaagacgagctttttccttcgggctccggtccgaccgcgattcgactcgaccagcccacccacccaccggccggcgcatactgtagtcgcacggtcgtttcgccgtccaaactcccggatgtacccttggcctattcttttcttgtactagtgcgagggtttcctaaaccaccgggccggagttactgagccccggcggtaagcacggtaaccgcggtaaccgtaaaaaaccgtatgaagccgtgtaaaatttattaaaaatttaaattatttttaaatttatttgaatttaaggaggttaccgcggtatttatattaccgtacccccgcggtaagcccggtaaccgcgcagagtcgaaccatgactagtgtaccggtgaggacaaatgcgctgatgagcctctcctaagtcctaatcgacaactctcctaattactctgcatttttcgtgctggtactaccacagagtcatacagacacgtagtgactattggcaaagcattggcaaagcataatgagcctgatgatcatgttaccgacggtaagtcgaaccatgactattgtaccggtgaggacaaatgaaatcgacaactctcctaattactctgcatttttcgtgctggtactatcacagagtcatacagacacatagtgaccattggcaaagtataatgagcctgatgatcatttagggggaaaaatggacatttttaatctgaaaatgtttcttactgaaccagctgctactactggacatggcattggatccgtgattagtggaggtactgctgcgactgaaaggtgctacagttcaatagttgatgctgaacagtcaccgctgggtacttccttttaggtggaaattagcaagagcaagctccgcgtgtgtggtacatctgttgatagctgtacatattttaagtaattcgagatttaaagttgtaaatgctaagtttctttaatgtgagaacatgaaaacaaatagaaataagacaataatacacatgcaaaataaatgactagtaaacatagaaaaaaataattataagaatgatcgtttggataaccgacaaggaaaaaaatgtacgagatgttaataattgagtcgagatttgaaaagatagacgtccctctaaactttttttaagcaaaattataagcgtgttgaggatcgaatatggaaccttaaattgaaaccatgtatctcttgtcactgcactatgcactatcaagtgcatctctaaaaaaaaccacagagccaagaattgtttatttaatagatgcaccctaagcccaagcatacagaacatttgcgctttgcttcaaacccaaacaccgaatagaaaaaaaagagctcaagatggatgctagttttccttcgaatttccctaattcatgccaaaagaaaatttcccacgcttttcttgtgctccaaccctacaaaaccaccggatgaacagtagcacttcacataggattttgttcatacgtatttccttcattaaatttcctcctacaactaactcacccagagctacaactaattaagcattttcaaaggagaaaaatgcatcaagctagaagcatcgcacaagcctgagtttgaatcccattaaacacatattttcttattaatgattgaaaaaaaaagaacctgttcactttgatgaaaaaaaaaaccttaccaaaatttggcaagatgccaaaatttagtaacttgccaaaattttggcaggatttcttatatagttactaaaatttgacagcaaactaaggctgagtttgagagaggggagatagagaagattggggagatacgcaaaatgaggtaaatagagaagattggggagatacgcaaaatgaggtaagtcattagcgcataattaattgagtattaactattttaaatttcaaaaatggactaaaatgattttttaaagcaactttactatagaaatttttttgcaaaaaacgtaccgtttagtagtttaggaagcgtacgtgcggaaaacgagtcacaatctccccaatctctccccgatgtccttcgaaagaacgcaacctaaatgtagccactcttttttggcaactttaccaaaatttggtaaggttgaaaacggtatcaaagtgaacagggctgaagattatgagagtgccaagctataagttcgcaaacctttgtatcttgctttggaatcgactttcagagctataattggactggatgaggtaatcatgaaagaaaattgtgacacttaattatcaagatcggtagtactaatttagtattttccaatgagcattaccatcgatgatctaaaactccaaggtgccaagctatcctgattctcgtacaattagtccattgctttaattaagattcctgcttcataccaatcatgcaatctcacttaaaatactaacctccggataaataacaagaaccattattcaaactaagaaattttctcaatccaaatcatgctttgccaaccaatctctgttgaagcctcagacataaactatcacccggaagaattattgttaatcatgaggggcagcctccagcttagctgtcctggaacagtggttatgcatccaatccgaaacattatggagaccagcggtgtcagtctacacactgacaccacggatcaggattaaacaaaacctgttcaaacgcatcaaaaatacacatcgaaaagcatcgaaaacgagacgaaaaaaaaaagccctactggctccaacattatgaacagaatacggcgatacactaaaccatacagtacgtgatacgccacgggagcaggggggaaatgggggcccaacgcgtgaatcacaccacgctggatgcggggcccgctcctctggggtagccggggtaggcgcatgttgtaccgagcgatgctggagccctggcccgcgccgtatctccagtggagccgtgtggagcggggctggccgagttggccggccatggcaagaaggaagagcagtggatcgatcgccgagacacgagcagcggacggccgcgatcgcgtcgcgtgcagcgtgctctgctttgccgcgatcggcatcggcttgcgtggccccccgtcccgtgctgccgcgtgaggcggcgaccgtgcgggccggcggggcactacgctgttgctgccgcgctgcggttgccggccggccggggtccgtgtagtggtggcagcatcggatgaccataggcacagtaggcgataggaccgcctccttttgccgcacaaaggcgggaaatcctctatcttcttctgataagttcggtaaaaaaaaaaacttctggccagtttactaccacttcgctagctctggaatctcgctggagaagagggaggaggagtttcaccgaagaggaaatagtagtgggcacgtgggaaaatctcgatagacaacggtggaaatgccactaggattagatttggaacttgggaattaaaacagagggaatgttgtgcattaatatgatatgaaatcatttacttcccgtgtatttttgtcaataatggtatctgtagagttcatttttttatctggtatttccttgcacaaaatggagtttataaattataaggggagccaggccaaggtatgccttctagacatagtatttccttgtttcattgtttgtattttaccaaagtacaagtatagtagtacgaatattatgtacaactctgaaggctgaacttgttgcaagcagggcttttctgcctacagagctactacgtgtatttttcttgttaaatctacacacatgacacacctacaaagcaacattctgttgtaactgaaaacccctatctgtccaaatgcaaaagcctgagcctgctgctgtgaatgacagcaggatggacagaaaaaaaaaaggaacccaagcaacaacacaaggaggaaaccagaacatgcagacaacacaagcaactggctcctctcctctcctcctaccgttcagttagcagagttaacaatgtgattagctgcgtactggaggactactactagcggacacaaagccccactaaagtattcattcgttcacaattcacaagccgtcaagcactgtgccattatccccaataagtagtactccaccacgccttctctcttcttcctctcctctcctctcctccgcttcacctccgtttctttcatcgtctatctctttctccccaacacagcgggcgaaccaaatccgtcgtctcgccggggtccgggaccacctcgtcgcatgcgcgctgggtcgtagacttggccgccggcgatcgccggagttggggagcgcggcggcggcggttccgctctcgccggagcgaggggtgggtggaggatggcggcgggagggaaggggtgggtggagagggcgcggcgcggggtgaagacggcgtggttcatggtggccatggtggcgtcgctgctgatggcgtcggcgccggcgctggtggccgccggcgacgtggccgtcgcgctgtggctcgaggtgcggctcgggtgcctccgctgccacggcctgcgcggccacctcgagcgttacggcttccggagctcgctcgtggacataccgcttgtctccatcgctcgatccgtcgtcattacctgtaagcagcgactagctccccctcattgctgttctaatgcgctcgcaggatattggggaatctgttcgtatgagttggatttcttttcatcttctgagaatttttgtattggttatgtgtgttatttttttaaatattctaatttcattatattttgggatatgggatttccctcaagattctttatttttttcccttttcgtatggggatttgtccatctgaaagctacagttcttgctacgtccgtgcttgtcttcattcgtagacgaaaggatgaaaactttcgtgaaaaaaaccgtgtctatttctaaagctattaatctgatttcgtatctgttgcctgctattcttttcactttccgtatttgaattcagttaaatcccgtcatttgattcgctgaattagtaatagatttgctgaatctgttgcctactatttcccggcagtttgaagtgcgcgccaacaaatttccgcactcggatttggggagaaaaactacgagatgcgactaacagatccgatgtttgctcgtgcaggtgtatacctcatgtctgatgcttctgggctctcccatggcccgtaccttggaacagcaacttgctgttccctggcttctctgctcatcttgttgattaaggccagcgtttacagtccggcgcaggagattgggcctgagctctcgccgtcattggcggatcacaagctcagtctcaagaagctatcgggaatgccggtgcttttcctgtcctccttggtctttgctcttggccatgttgttgtcgcttacaggacaagctgcagggctcggcggaagctgcttatccatggcattgaccctgaatctgtatgacttacatccgtttgccttctaaatctcactaagtgatcaattgtagaaacagggccatgtatgctagtattttcttgcatccgttgtgcttttcttttgcaatgtttgatgttttcgtgggttgtgctgctttcagattctggcatacaagaatgcatatcctggatgctacaagactcctcgatctcccacaccatacagtggaaaattttattctaggagtgacagtgagacgaagagaaaatctgttgctcacgacgatagggatattccaatcagtttccttgcagacggtgatagcatgttcattgcttgccaggggatcactgtgcattacaaactttccgatccatcgagttgcatatcttcagctacagacacttttccagaaatccatcatgatgttatttcagcaagcatttctcctagaagacagagacatgatagcccaccatcagcctccactaatacccgtcgtcttttgaataggagcttcagccatcaataccatcagacatcgctatatgcaccattgttggtagagccagtgacctctccaactttgtcggatgacacccctgttcttagtgttgatgatggcagtgctgatgtatgtttgaaacctatgggatttgatcttgaggctggagaacaggggaaatttgctgttgttttggtgcatgggtttggaggtggggtgttctcatggagacacgttacaaatttgctttctcgtcaagtgggttgcactgtgctggccttcgatcgccctggatgggggttaacatctcgacctcgcagaaaggattgggaagacaaaaatctaccaaatccatatgagcttggatctcaggtgattcttcttaccatatactagattgcgcactgcccaatagcagcaagtgcttgcagcacttgccctaatgttctttgcactagctactagatatgttgcaatatcccatactcattccatggaatttgttataagcatgactgactgaatgtaaatatgttactgcatgtgttttctcttagaactatacttatctttgggattatgtcttctatgtaccataattctgtgtgacaacagcttttccattacaaatagttgagtacaatcttctgaagttcttttttttccttaggtacatcctatcttacaaatattcatctaagggaatgctcttctactgtaacaactattaatcttttaattaatattactatatccagttatgtttgcaacatattttccggcagcattaacgctatatttcttcgctgtacttggaaaactcagaactttaagaacaacgctttgtatgccttctgcaggttgatcttcttatttcattttgctcggacatgggcttacgctctgtggttttagttggtcatgatgatgggggcctgcttgccctaaaagctgcagaaaagttgcgagcatctggagattcaagaaaggtaactgccttgtgaccttctgttcatttttcttttgtgaactttagtagcttatcagactgtttgcttgatgaaagtctatccttctggtaataatcattttaaatgcctccttgttttttcttaggttgaagtgaagggagttgtgcttataggtgtaagcttatcaagagaagtcattcctgcatttgctcgtatactcctgcatacccctctaaggaaaaagcacatggtacggccactgttacgtactgaaatcactcaggtgatcaatagacgtgcatggtttgatgctaccaagttaacaacagatgttctgaacctctacaaggtacacacttttaataattttcattcccttcagtgtgttgtcaaaccattagtacgcaatctatctctggaagagtttggtcactaaaagcacatagggagcgttatatcatttgcaaataatctatttatcattccaccacatattgtctgaatgcaaggaaagtggaacttttcttgcatgttgttagttatttattgtcttcctgttccttgatgctaaattaaatgttttaacatgcatcctttcacttattctgtgaacatgaactacgaactgacttgaaatgggtttttacatttaggctccactatttgttgaaggctgggatgaagctctccatgaagtaggacgtctttctttctcgactgtcctatcatcaaaaagagcagcagatttactaagatcagtggaagacctccctgttctggttgtagcaggctctgaggatgctcttgtttcttcgaagtcaacgcaagtaatggcttcaaggcttgtaaattctgtaagtaatcttgagtccctttgcctcagtatagtgaatctgcttctgaagaggactcttgcatgatactctatattacttccctgttagggttactccatacattgtgccaatgagttcttgttattttgcagaggctggtaacgatatcaaattgtgggcatttgccacatgaggagtgtcccaaggcattgctttcggctctttctccattcatatcaggactggtgtcatcagatgattcattgcaaagattgtagcatactagttcttttcgttttgccttttgccctgtctttctgtcctctacactgagtagatctctctagttggtgtgagtttgtgtgagccaatgtagtgcagtagtggagcctgacccaaaatctcaagggttcctagagctcctctaattttttgccccatataatgatacctccgaatgatttcaattaagcaagttgaatctgtacagcacaggcttgctgtgttcagttcatgtctactccagctccagctgtcatatatcagctaactactgactactagtaatatgcccgtgctaaacgctacggtgcaactctatttgtctttaataatttttaaaattttcatgtttagcaaaaaaatattattatatgaactgtgcatttgagctttaattcaatttatatcatacatcaaatatgttgcaagtaaaatattagaataggatataccaatatatttgtgccccatgtcataatgcataataatatgatattaaagatatatgataatgcatatatctgtgccttaagatgtatgataacgtgacagatcaaaggcacttaggttgagtattgcatataagtatttatcatgggtattttagttgttaatgggccattacaggatttggaccatacacataagtttgacatctagcagtcctttactcctttatcatgactgaataggcaacataatagcaaattagcaatactggtttcttatgttaattatatttgctttttttatacgctttcatgttcataaatcaatattcatgtgattggtcagctctttaaattaatggagccctgaagcaaataaaatgtgtttgatctaaagcaaagaattacatgtgtttgatctaaagcaaaagaattacagaaatcaatagtgctacacaacgtcagaaaattggccgacttaatttatttatgtgagatctaaaccacaactggtgtgtgatgtgtctccttatataagaagacatggaaaacaaatataaaggaacattgctatgcatccaaccgtgccaaacaaatacatagtagttcaacaggaggtagagcacatttgtataggtcccagaaatcaactcaatcacaaacaatactgaataggcatcataacaacaaagtttcatcgaatttggttgtgcatttcacaagcaatactgaataggcccgaacgacattgtttactgaattttcttgtgtaattcacaagaaatgttattttattctaaagccaaaacacagtagtgataatactaaatcatggttccttctcggttgcttcatcggagacgtcgtcattgcagatcttcattgttatctcgatgggagaagaccagcgaggatcatacccttctcccaccttccttttttcaccgtatcctttttctaccttcttgcacgtgtagtcttccatggaactctcaacacgtcggcaaccatcacgtatgtattgaaacatcatcatgatggcattcgcgtggcccatgtaataattccccttgtttggtgtttgccctgacgaaggctgcaccttcgcatcatccttggagttcattgactccttaggtgtggcttgatgtggtgaaaaatccacatcatccatggatgccatgccttactacaatacagaagaagtaggagatcaataggtgcaaactaaagtatataataatttccaacacataagagatagtttggagaacgataccaagaaaaagattggtcaatccctcaaaagaaaatatggttggcacagtaatcagggcaatttttttttcttgatttgtaaaccggatgcaggcaattttaaacatcagattctacaacagtgcgaagattgacccacgaagtatacatttgcactatttgcaaggggtaatcattatggaagaaattacctataccaaatagaaatttagtagaatcagccaaaaatttcgttgattgtgcagcaaacaatagtagttgacatggtgtcctgtcagcctgaatttttcttcggcaatctgaattttcgtcctatagattaaatcatttgaaatgaaaggttaagtcaggttgctagatataagcaatcacatagaaaaattgacacaatagaattatctgaggtaggccatttcttccccacaattttacaatgaaagattgacgataaatgttaacaagatgtgaagtatctcatccaatgacaacaatgaaaccccccaaaaaaaaaaaatcctaccacacgaatgagattaacacatgaaatttagttgaaatgcaaaacaggctttgaattagagttttgcatcacagatatccatgcacagtgaacaatgtttgataatgaacaatgggggtttagtcaacaaaggggattcctaaagccattatgcatctctatgaacagcggtggaggacggaaaaaaaatttaggtgtggccaataaactaccacacgcgagagttaacacagaacaagaattaagaaaaaaaaaattcaatgcacaatattgtacaatgtaacattatatcagcaagtcatagtaacaagcacttaatcacaagttcacaattcatcatccatttgcaaataagtgtaaatataaaggtaggtactcaaaaatacctcaagattcactgattcaagctttcagccgtacatcacatatataaactaatgaggatagatacatatgtagaatctgaaaaacaaatagcaaagattgattagtttgataagataaaaagcaatgagtgaaacaaaatgtacaagcatcctaaaaataaaatatttaattgcaatttcagtaataaatttgtacactttgaaattgcaatgttctgaaattgtcaaataaaaaaaagtacaacctctttgtgatgccagtgccttcccttttctctttctgtccattttctgctgatgggagattgggcgtgatggcctgatggctgctactacttctgcttgccttgcttgctgcttggtgctgctgcgccatccgccctgcccctgccctgcttggcgcctgtgctgcacgcctgcgcggctgcgccccgccacgcgaggaaggtctcggcagctaccaggcgaggaaggcgtcggcggcgacgagaatcggtggcggtgagacgacggatgcgatgacggcggagcggcggcagtcgagggcggcggcgacggcggtggcgcggggatcggtggcggagatgacggatgcgaagacggcggagcggcgacagtcgagggcggtggctccgcgtgagtcggggttggggaggggcggcggcgcgtgagagcgatagagagggggcgaagaggagcgcgcaatcgagggaggtgggaggtgggagcgatctcaatcgttgagatttcaccgagacaatctggaccgttgagtgatgaatgaaagaatgagtgaaagtatttgttgaactatagggtagatgactacacatttcgacggagcaaatttcggatgaaatctgaacagctgtggcgagttggtgttttaattctttaatttactgaagtcctactatctggtagtagttcatttaccgaaaataacatgcccgtcctttgtgttactgtgtatctctgagactctgacagcattgggctacagagaatgtgttttttaggaaaaaaatacggttggtaccgtaggagtatgtatttgtgccagttggcagcagtatctgttttctatctttggaagaacttgttgtttttgggtctataacttgtgttaaattgtcattgctctttttgatgttacattaccatgtgaagttgtcagcattaaacatttcatacatgagcatgatatacaatgatgttccacagatgcacagacaggccacctcaatttttttttaatatagaactgttttaattcagccaaattttgttcaaataaaaaggtttgatttttaacccccttttttttgaacttttcattcatttgcccctgtcaaatgtttatgattctcgcaatttgtaagatttgaatttaggatttttaaaaattcagccaaaatttgttaaaattttaatttatttaattaaatatttttaatcaaaattttccactactagtcacgtgcccatgcgttgcaacgggaaaaataactttttaagaaattttatgatttatcgttgataaacactcgattctataacgccttagcaaaagcaagtaatatatgattattatgttttctttctttttgcgttgttatcggttgaactccggtagagcctgaaaagatcatgttcctcataaaatatggcatgtactaagcaagccaagacatagtgcactgaaataactacagattagcacaaatcaactctttgcaatttagctctctcaatcttttccaatgtcttatagggaaatttccaatgtcttgtatggaaacaaaataaacacgatatttatgtatatacatatataaattacagtatcatattccaaatggtcagttgactgtcaagtagcacaaggaacaagaatggtaactttagagttccatcatccctaaataatacgtacattgcctgcagagagttcagaagtgagtccaggagggaaaattatttcccgcatcaactaattagctctcccagtaaagaaattcaacatatggatttaccctggagtaatttctaaacttagatacaaaaatgaatagaagggccagccattgctgatttgcaggggataaagatggagagtgaagaacatggcattttcatcagagttagaggatagtgattactctgtaccttcagggcttggctagctaagatgataaagctaatgttgatcgtgaaaagatttaacatattgatgagcccatgtaagtgatttttttttacctgtagtcaccaaaataaaggttactcaaactgcaaaaacaaaattagcatattttatgaataaaagaaatccacaagaagtaaatttcatatccaattgaaatagtatgaattatcaaaaatatgatgtagctatcttgattcttgactctccatattgatctccgaagagaatgaattttgccttatcaaatttaaattccatattgatatcagattgcccagtacagtaaagtggtcaacaagcagcagtcccaaatgcaatgttaatagaaggtcaggtcatattatccttgtaaaggcctttgaaatttcatggcaaaaaaaagccattgaaattgtcactatgcgaaggaatagcaacagatggtataagttcagtacagtgaaaaggaaaatgcagagcagaacattctctgactaataatgccaaaaggagccccatcccccgtccagttctgcagaatgtggactatcaataaccatttcttaactgctaaatgatcactatgttccaaaaaatatagtcagtactattcgatattcgatgtgtgcataatatagagtgaattatggcagatgacaattagaaaatagagtttactatgcaaaggttgatacctatctggttttcatttaattcaaaaccaagggaaatagatgatcatacctggtgttataatttcattgagaagctagaaaagcatttgaaccctgtacatgtatcaagagtttagattaactaatgtatcaagagtttagattaactaatgtatcaagagtttagattaactaaagacagtttccaggattatacatgaccactaaggttcattcttttagacgtgtggaagacaacttcacatccagccaaatgatcaagaatcatcagactgaaaggctgaaacagacatcgcaggagacatcacaaatggtgtttatgaagctgtatagttgattaattattagttcagaagtcagaacaattattagttcataatgtgaccatactaaaataattattagcctgtcagttctatcatcagttagaaaattatatgtgaatatacatgttggttctacagtaagagaaaaaccatccagaataatcctgattaaccagatactattgtcctttggagatgtttagacacgtgcaggcagttatgcgttgttcatagacatgaatactttagttattactcctattatctaactaaatgaattcttcagtgatactaccacataacataccactaacacagaatgcattaccaaaatgttgtttttggttattttcttttggttgaatctcgtctgatcaaatcaacggcggctgataggggagagatgaagcatagtactgatggtggataaaaaaaaggaatgatcttgtacctttcggtgaatcagatcgaagcggggcgacattgttctggcagcgctgaggagatcagcaaggcgagggacgaggcgtttcgtgctgatgctattccggcggcagagattggtggcggcggagaaggaggcggacgaggaagaggaagatattgggacggcgctgaggagatcagcttggtgggcgacgcagacccaggcgactccgggcgatggtgatctagcggcgcggattggggagagtgagccaagaggcaaaagcagcgagcatcggtctcctggcgaaatggaggagatcggcaaaatagccaacggcaagcgtcggtcacccgacggcgtagtcgtggttgctctggcggtgcagagcagatcaacgaagcagccgagtaattagggttgggtagagagagaagggggaggttggggtgatgcaggaggggacctgtacggctgtacctatagagggagacggtggcgtcgaggacgaaggcggaggcagaggcgacggatcgacctccgtggcggtcatgaccggcggaggtgtcggcggcctagacacacataaaattagacacttagcgcaaatgctaaatgaatagctcagcacaaaatagcaaggttatgactacgagaaatagtaatacttgtgaaaagcattataattctttcccagtggtttaaacaggcagaagaaaaatactttatgccatcacatgataattcccagtggtttaaacatgcatgcacattagtctcctgccaaatcctgctgaacatagtacacaaattcatctaatgggatgccatttgacagaaaatatctccccagcaatcagctcagcagaaaaatctgagtttgatttgctagtaaactgcacaacattgaatgaaaatacactatcgacttacttataacaactgtgcacttaaattacaatgtgccaatcagaagagttgtttgctgtctcacacaaaatcacaccatttcaattcagttttcaaaattactctgaaatatgcaaatggaagaaaccctttatcaatctctgagcaggagtcaggagcaaacaaacggacaggggcagaacatcaagactgaaatcgaaacatggtaaaagcatgaaaggcatacataaaccatttctttctccattttttctaatgtttagagaaagacagactcaccgtatcaatgccaaaaaaaattcagcagatgccaagtgcatgtccctgaactcccgcttgattcctcctggatctaggtttcctgggattgaaaagtggcatttacatctcgtgatcaacaatatacagtacctagttgggggctttgaactgctgacgggggagcagtagtcccggtgacctaggctagggatgaggcagcaatggccagttggggatctggcagcggcgacggtgacctagcagcggggattcggtggcgatgttgtgagttgtgcaggctgcgatggctggttggggattgggcagcggcgacggagatggtaacctagacctagcaaccggggattcgcagcagcgtggtgtggcgtgcgggcggcgatggccggtttgcaggtcggggatggtatggcgtgcggctattgcggcggcggcggttgacagaagtggtggggtaggaggggatacataccttcagatgaaggcgatcatgaccggcagaggtggcggcagtcgagggcggcgcgggtcgtcgcgacgtcggcgaggaagcggctcctcggcggtgttgacgcggcgtgacctcctgctcccgcgtcggcggtcgagggcggcgcgggacgtgggactcggggcacggcgacggcagcgaggagacggcgcgggtcgcagcgtcggcggtcgagggcggcgcggacgcgcgcgcgggacgcgcgcgcgtggcacggggctgctgaggaggcgatgcggcggcgaggtgagaaggtgaggaggcgaggagatgacgcagggaggagggcgaaggtggatgatcgatccgatgcgaggtggaggcgcgttggagagggcggcggcgatcgcggaggaggccggcgggcgtggctggcgaggaggcgatgcggcggcggggcgagcgtcgcccagggaggagggcgaaggacgcggcgtgggaggaggaggagtgggcgtggggaggagatcgattcaagagaggagcgagcgcgtgatggggaggagattgacaccattggatatggcaatcggatggttgagattacgcgtgtctgtcagatgcgtctgctatgtcaggaatcaagaccaccactacgaattttttaagtagtagagatatcgttccccaaaattgtttcctacttaatataatcggttatgcagcttggtatggtggtaaaatcatcatttccaaaaattcatttctctagaggcaaagatgctaaaactacctccgccccaaaattcgagttatatttcaggataggggagtaaaacattccgtcagtacgtaactgttctgttccaaccgaaggttgattccatgagttaaaatcacccaaatcaataagtgaaggtgagaataataatgaagcactggtacattctttggacttttccttcaaaaattagaaaagcgtaaaactgtacatgccagcagatcaacttgccaactaaaacaaaaacaggctaacatcacaacacgctataacaaaatcaaattcttacgcttctctacttacgaacaccggacgtaacccatcaatttcaccatctcttcatggtggaataactataccaatgatttccagttattccttagctaaccgttggactccggggtaaattctatctcccctttcttggaaatcaacagtaaacaaccaaaaaagaaaaagaaaaaaaaacacacaactcctttactagctcttgcctttcatcttctctgcatcccattcattactgacgagcacaagatgatcgccgtctctgatgagctccacctcgtcaacctcggcgccctccacggtgagaaccttggttggcgcgaagtcgaacttcttggcgccgagctcgaggagcatgtccagcgtctgaggcaggagcacgagcttcccggcggtgttccctttctcggggcagctgatcgtcaccctgatgacggcgttgcggctgccgctgctcgggttcggggagcccgtcgccgcgaggccacccctcgagagcgggtggtcggtctcccgctgcgcctgcgacgacgagatgaccccgaagagggagttctggaaggtgacccgcttcctccggagcttctcggggagaacccggctgggcaggtcggcgtcttcgtggatcatgttcttcatcatgggctcgctgttgaacctcccgatcagtgatgccgccgccgccgccggcgccaccctggtggtggtggagcttgggacgtgatggtggccactcgccgtcgccgccttgcgcgaccggaacaggagctggatgtcgtcgtggccctgctgctcggcgagggctctcggggtccagccgttgccgtcctgcttgtcgatgtcggctccgtgttccagcaagagctcggccatctggacgttgccgtcgcagacggcgcggtgcagggcggtggtcccgtcccggcgagccctgttcacgtcgcctccgtagtgaatgatgtcgttgagcagctcggtgtcgctctcctccacggcgatgcaagcgtataagcccgtgtcacccgacgacagatccgcgccgccttcgactaatagttgcacgacggcggcgtgcttctcacacagcgcttcccacagtggaacttttccttctgagtctggaaaatggaaaagaaaatcgtggcatgtcagatggtgtattgaacatctgtatataagactcatcactcatggagttaattacatcgacgcacaaaacttttgcgtcttcgcaaaaactcatggagcaaattctattaagtaaatcagtaagttctagatgttagattggtagaaaattcaacaggaattttgcaagcaagtttagcctcgtaagatttacaggtgacgtgaggccatgacatattgcagggtttggatataacatccagctgttcataccatttaactcttacagttaaattgtacactatatgctgtcaaaattttccagttttcggcatacctctggcatttggatcagctccatattctaatagaagcctgacgcattgctcgtttcctttggaagcagctatatgctgttaatcatgaacatttgaaagtggtaactttcttggtcagcataagtccatagaaaaataaacaacacagatacgtatagttgactaaactgaccagtgcggtatgcccgtcattatctgactcatttggatccataccacgcttaagaagttgatgcaacaaaaaatcatctcctctagttactgcaaaacagagtgtaattggcaaatccagatttccccgagctagcatactctctatctcctttacgacaccagccattacactgttctccttctgctctttaaggaactgcatcagaaaaaaaaagagtggatctcagtactgctcaaaatactgcacgacataaagcatgataaatgtcaatgaagcaaaaacaaaataaacagcccttatccagatcacaacagacaacagtgaacatcaagtctgatagtcgcagaacagtcgacatattttttagataatggcagaacagtcgacatgaataaacaatttctgtgttcaagataatctagtggctatatgagggaatactagtttaacttcacatattgttaaacaagatgatgcaggttccagggtggttcgatttaggagttactacagagctagtttcagtggtcaggttaccactctgaatatgaaaaatctttctacaaatgcaaacatatgcgataaatgttacagagaagagaccaacaaataaatggtagacctgaataaggttgttcattatgatagttccatccccaacattggattgaacaatgctgagaaaagctgtacgattcaaacgcaacaactggcacaaggatcttgttcgaactgtgaatagctgaggtctgtagcaaagaaccccaatttctccaacaacctctcctgacgtagccacttgtatcacctgcagaattccaagttatcatatttaggaccaattgatgcacgagttcacttggaattaagtctcaaagcaacagaagtcttgcctggtctgcaccattttgctgctctactaactcctgcaaaagtgactcgaatttcagaatgaccatttatataactaaaactgatatcagtactgatagctcaattactcctactttttcaactgcactctctgaagcttagtattatatcaacttggaaataacaaagtagttattaaagagtattcttaccacactaccagaaactaagatgtagaagtcagtgggtgcttcattctgcaaaatcacatcctccctaggtggaaaatattcagctttcatctccgaaacctcaaaaacgaaatcaagtaaaagaaccagataagcatattctgtaacagtacgcaactacaaaaacacagctacagaaagaactctatccttaccagttgaaaaatcagatcatttgagactccttgaaacaggtaaacattttgaaccagatggaagaacagatattgagaaatgctagatttaatagctttaggcagtgaatcaaggatctcttgttgttgaagaccttctgaatctgtcctgtattttaagctaatatgtgaaatcatctgatcttgcagccgaggtggtagctgatttcttactccaaagcttgttgctgcttggattgtatccctcttttagtacaaaacataacaaacactacttgttagaatcaaactttaaaagagcagttagatgcaagtatcaaccaaaggttgaacaaaaagaactcacatagtttcgagtacgactagtgccatggacaaccaaattggtcatgttaccgatcaaataagcggtcaaaccaaggttaaagagcatgtagaaaatgttgaagatcatctcccttgtattttctgcatgtagatccccatagcccacggtggtaagagtggtgattgaccaatagactgatgttacgtagcgaatccataagctccgttcatggaaatctgccatgtaattgccaatccacgtagaagttgggacggggtacctatcagcaagaagatagtagaagcatgccgcacagtgcacagcaaaaagtgtgacctgcaatatcaaaggatgagaaaatgggatgttccacaaaaatgttaaaacttcacaggaaaataacataaatacagtcacttacacaaatgagctttgcacatcgaacccagaagtaattgaagtgtctatccttctccaacctagaaaaagtgaaaagtgttaagtttactacacaaattgaaaaggcaaaaatggcagtggctctagcctaattaatactatgttttaaccgagttcagtcaggttcagattgaaatgttggaccccaaaacagaatgtatatcatagaattttctatatgtgcacgataaaaacatacctagaaaacagagagctgactctgcggagacgccacagacgaagcatgttgaaaaatccatatgacctaagctttgaaggtagtatcctgcgagcaaattctgatgggatggtggaggccacgtcaagaacaagccatgtggtactataacgccatgcgatcttctttggatcatcttcaagcatatagctcattttatccaaataagccacaaagaaggtcagaatgatgtcaaccgcgaagaatgcattcaccacattgtcggctgtagctagagcccccgtaggcttcggaatgaagccaaattcaaatggtgagacccacgcagagtagactacaagaactatgaggaaagtctcccagattctgcatagtattaacaattaaatgttagaattactcattcttctgatttcaatattacaaagtttctatttgcttttcatactagcaaaaacaccatgcttacaaaggaaaaaacaatatattcctgtaggaagaagtccatataccccctaaaccatgaatggaagatatttatattgtgaaatccatacactagcattatatgcataacatcataatataatataacttgcggccaaggaatgacgaaatacaaatatgtcatcttagtcattataagcatccaaatacacgaaaccactgttcaaaaatcgaaaccactgcaggggttgcaaactttagggagttagatgttcggttttaaagtttagggtattagatggactttcgttcaaagttccgtgatttcttattcctgtacaagtaatctctgtttattcaacggtactgtatatgtactggccgtaactcggtggcaagtggcaactagaagtaccacagaaactaccgtactacttactgtatactgtgtatacaagattatctccgaaagagtgatccgaagaaaaatggagattaatgtaatgcgattttatgatactatcaaataataaatggacaacagaactctcactagacaaaaaaatatattaattgaatgatagcacagaataacttcaaattgcagaagactgtcattgaggccgacaaaaaaggtaatctgaacaattcgtaaaaccaccaagtccataactaaaatacaaggttattaatcctcgtccgtccaacggcaaataattgcagtaaacaaatcagaaaaaaagttttccatgcgagttccgtgagagagctctttcgacaacgaagcattgcgtaaagaagcgcaaaacgggagtactagaaatccaggaacgtcagcatcaaaatcacgcttttcttgtcgttcctcaaggaaaagaaaatcgaataactaaataaagcactcacaagccatagaattagccatattaaaacggagataatgagtactataaaaagcaagaaatagacaaatcaattattcagtcgaggtcaaaccaggaacagtaaaaacaaaaacctctacttctcacttccgcgaaaacacattaaagacaatttgctgacaattgcggcagcaaagcagccattaaaacagagggagaaaaaacaaaatttcatgagcaacccatctatttcgtgacaacatataataactcattggaattaacaagaggcagaacgaaccaattcagtgccaactatgaatacaaaaataaagcacttctgcgctgaccatcaccaaaattaaagctgtaatgcagccagtatagcaggactgtacacaagagactgcgcaagaaaaaaaaaatctgaaacaaagcagcggcgagagttgtgatggcgatagggaagagagagacagagaaggttgcgaactaacctgtatcggcggtcgtagggggagatgatgaagcggcggagcttgatgcggcggttgctccgcgcgccgagcgacgggaggatggcgctggagatgctgtagtggctgccgtcccgcgacagctccctctcgagcgccgggtccccgccgccatggcccgccccccacggcccgcacgcgggcatcatcctgctgcgcccgtcccgcctcacctcgctggcctcgaacgcgtcgccggcgccgaccctccggttgcggccccacggcccgcacgccgccatccgagcggcgccccacctcgccattgcgctgcccctcggcgggcgcgcgtgcctcccctctctcgggtttaatggagcgcccacccccacaaggcccacaaatctggcggcctgcaagggaatcgcggggtgggaatctctcgccttgaatactagagagagaagttctcggtgattcggttttctggtaagtggaggagagccgacgcccgacggcggctgcggcggcggcgaagacgtgtcgcggaagaagagaagagaagagaggagaggtgagagcttcgatcgagcttggtcggggccacgcgcggctcggggctgcttttatggatgcgaggggagggggagagacctggggggtgggggcctctggggcggacggactgctgggcggcgacgaatcgggaggagagtctgaaggacggttttgcccctgcgggactggacgcgacgcggccgagccgcgaaccgggggtgacacgttttctggggaggacggcagaagtagtggggatgtcagatggctcggatccgccgggtcttgccgtaaccgtgccggtgcatgactctaagcagtacgaagggcaaatctggtaatcacctaaatgggaggcacctacccctacctgtcttacagaggatttgcctcatgaatatttattcgaggtttaagattaaaattagctgtctgggtttgtcttaaatcaaatattatttgatcatcaatttctatatgagtaaactcatactttaacatcatacgatttatatttttagatttaacatgagaaatatgattgtgatatataatttacattttgttggactatatggatttctagaagttaatggtcaaatacaaacgtaaaacaacatgtaatttgaaacgaagggactataatttgatcgaaacttctaaaattatagtcatcaataaatttaattttcaattgcttactttaaaagaaacaaaaattatatgcgtaaatttatcctggagagtattattgtactccctccatttcatcttataggtcgttttgtctcttttttagtcaaacttatttagatttgacaaagattatagaaaaaatatagtagcattacaaacaaaaaacaaatatattataaaaaaatattcaatgttaaatttaatgaaactaatttgatgtcactaagttattctatgaacttggccaaactaaacaaagtttgactagtgaaaaaaaaatcaaaaccacttataatatgaaatagagggagtaaaattgtaaacccatcaggtcttataaagtattattttaatatagacctgatggtcaaaatcctactgcctccatctcgtaatatatgcaattctaaagtttttcacgtgtattaaatagagggatggaattaaatgagggatgtttgtaattggttgggatgagtaagtagatgaaataaataaataaatgagatatggttgtgattggttaggatgagaaaatatgtgaaaaaaaattaaatggggaatggttgtgattgtttgagatgagagagcaaatagaaaagtagctatatttttaacagttctataacaatagaagtaattatattttagtacagatagagtaaaagagagtagatagtctttttaagcgagtttaaatgcaataggggaccatccaaatatcccatacaagttgtttgggtttctatttcctcccaacaactcaatttcataacaaaaaccccatcaatttcttttctaaactgcccccacatcctattttcattgatttatccttattgtttaagtttattgtttcaatttttgtgcctcatatgtctttggcatggtgtgtttttggaaacctcaatcctcgcttccagcttctgcctttcccaaatcccacatgagcaagatgatgatagcagaacaccatggtaaatttataggacaattacaaatttaccactgttttgaatcgttattgtaaaactgccactagaaaattgcaaaaataccactggaactgtcattcgagtggcatccttacaaaattgaaaaaaccggtgacaaatttgcaaatgcccctaaatctattgagttgtgagttagctgtattttctatgatcccaagctccggcccgaggtagcatgagttcctattatcctgtgatgctagaggtccatggtgcatgataaattgaaatgattaggcaaagatgaaaacaaaatgttggtgggaagttagaagagcagttgacttacagggattttgtgtacaaaattaagttgtaggaggaaatacagaaacaccagtgaattgtagtggcatttggattttacccaaagcaatatgaatattcatctagagaagttatcttaggtacgtaaaaaacacttttacgattaggtttagatccatcccgaatattaagataaagtgtgaataatatactttttaacatttatctttcggtgtgcatccttttagcgactaagcatatctcggttggtttactcctatggtaaaacctactcaccaagattcgagtatctgacttagaacaattcctaacatttataaataattattcttttagtggtaggcagcatgcttggtaacaacgagattaatcaatatatctcaatatactatttcagtgtattagagatgttcaaatagaataggatgtatatatgtgttcatagtggtgaatatgtgcggtataagtataaattaatagggattgtctatacatcatttgacagaaaacccccctaaaaatcttgtaaattatggaccacccgattactttaagatttgtgcaaagaaaccaaccctaaaaacctcctctcctctcctttctcctgatatcgcgccgccgctcccagtttcacaccgcgcctccgcctccgcctccgccgccaccgccccaacgtgccgccccctggcctcaccggctggccggaaggcctcaacggcgccggggaggcccccccggcagacgtcctccccctccctctcccctctcctccctcctcggcgagatgcccccgccgccaatgccgcccaccgccatcctccatccccgcggctccggcgccgccgccggcgcctcgccacccgcccgatccgccgcccactgccgggccgccgcctcccatggcaatccctctaagcccggccacctcccccttcttcccccctcccaccccaaccccaccccgccccgggaccctaattcgccggcgccggagaagaagaggaggtcgccggagttagagaagaagcacctggagcacgaatcgtgaagcacatccggtgattcaaaatttgcaagatttgggtatgtattttctgtcgacagatgcttagcaattccgaaattaatatatgcgagtgaatataagcttttgtatttctgtgtttcatagaaagaacacacgcattgcggcatgtctttctagtgggagagtccatattaaagttagaatttccgcctaacacataatatgttggtgccacctaaagtggtgtgaatatgtccataaagtgtattagtatattttgactgtgggtaaagtaccccgtctcaaaatataacaatttttacaaattatccaccaacattctcttcccaaccaattacaattctccaccattcacttttctcatatacctctacttctcatccaatcgcaacactgcaccatttatttctacctactttcttaataattatgtctaattctaaatttttttatattctagaacagaggagtactacatttcttgatggtaattaatgttcctctccacgttcaattcacttcgcaagattgatcgatagcgcgcgcctactaaaatgcactagcacgtataaaattaatcatattccagactaatgtaacacgtgtgtgtgtgtgtatatatatatatatatatatatatatatatatatatatatatatatatatatatatatatatatatatatatatatatatatatatatatagtaaatttgtttggtgctccatggtgcccgggcaccataattgaaatttactatatacccaattcaaatgagtatgaaactttttcaaatatttaggtattaacgttaactactttactaactagttcaaagcaagtttgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggtgaatttgtgtatttcataccatggtgccccatatgagtgtcctatatatatatatatatatatatatatatatatatatatatatatatatatatatatatatatatatatatatatatatatataatttgaaaatttttaaaaatttaagagaatttgtgtgttttataccttggagcccgggcaccatagagtcccatataggtatcatatatatatatatatatatatacacatatacatacatatatatatatatatacatatgtatatacatatatacatatatacatatacatatacatatatacatatacatatacatatatacatatatatatatacata

SEQ ID NO: 45115 - DNA, 13184 bp, Oryza sativa
tgaactgaattcaaacttgcttttgttagattttgattctaggtatatagcatccaaacatataattagttaggtatgtaataatggattgtgaaataaagttaaatttgagttgttttgttgctaggtataggtatgaatcgaatacttataagtaggtatatactcacaatttgaaaattttgaaaaatttgggtgaatttgtgtatttcataccatggtgccccatatgagtgtcctatatatatatatatatatatatatatatatatatatatatatatatataatttgaaaatttttaaaaatttaagagaatttgtgtgttttataccttggagcccgggcaccatagagtcccatataggtatcatatatatatatatatatatatacacatatacatacatatacatatatatacatatatacatatatatatatatacatatatacatatatatatatacatatatatatacatatatacatatatacatacatatatatacatacatacatatatatacatacatatatatacatatatatatatatacatacatatacatacatatatatacatacatatatatacatatatatacatacatatatatacatatgtatatacatacatatatatacatatatatacatatatacatatgtatatacatatatacatgtatatatatacatatatacatatgtatatacatatatacatatatacatatacatatacatatatacatatacatatacatatatacatatacatatatacatatacatatatatacatatatatacatatacatatacatatatatacatatacatatatacatacatatacatatatatatatatacacatacatatatacatatatatatacatatatacatatatatacatatatatacatacatatatatacatatatatatatacatatatatacatatatatatatacatatatatacatatatatatatatatatacatatatatatatatatatatatacctaggtgtctatggcattaactacattgctatgtaggacttttagcttatgtggcactatattaattaagagagagagtgaagagaggaagaaactgggtctcatgcaagacacagcttcaacacgagaacatatgtactagacactatcaagttttgcattgggagaaaatagtgtctttataatagatgaagaataaatataattggtagaaaagagaaatgttgtatttattaatggcccactttaagaaaccataggttgtagagtgtagtttctattgtgatgtcttattaacatggcaccatagacactgcttatgggcactatggtttggactgccctaaaggaagtcgtttaggataatgtttaagtcaaaccttgagaatataaataataaataactctcaagttgttgagtttgaaaatgtaaaaattatatgaatagatttgtcttgaaaaatgctttcataaaagtatacacatataacttttcaataaatatttttatagaaataagaaggcaaagttgtgttttggagaccgtgttgctgtctaaaacgattttctttacgagtacggagagagaatgtaccaggaactatagtctatagtaggcaaagttgcggttttccatgtgaaaataaatgtttcatgtgtttctccgcatagaacgggccagttcttcaatcactacccacgtgtgtaattatccatttttattttgttattatactattaacatatctgatgatttatttatacatacacatgttgattgggacctctcacatggtggtacttctaaccacacaagaatgtgactaaaatacatttaaagatgaattccttatatatatatatatatatatatatatatatatatatgctgttgaaaatttacccaatcctttgttagtgagacatatcagcggcttagaaaagatttaggtgaatttccagtgacagagaaccagaaggaatgaaaatgatacgctgaactgacggtatcagaaaaggtagaattagtctaatttctccttttatgccatttgttttcctagtaaaactactgggctacatgctgtttcaccaagcaccttcacttaccaatgtttaaatcaagaagcctggaaattacgcacactcgatcgggtaaggtttcaatataatggaaattttaggagatttacttatttatgtattattggccctccatctaatcgagtatgaatttagggggcatacaagtagctagctatgtgtgtgcatatgttaatccaaaaagtaattttctaatattacacttttttcttttgtgcaaacttcttgtttgaatacggaataaaatctgtgaacaaaatatgaatgccgaaagcaacatagtactcctcttatggcctgtttgaaacattaatgcatgattaattaattgatcagtagcatattaatcgcatgtaaaactgattaactcattaatgcatgattaattaaatagtaactattgtaaattttaaaatagattttttttctatttttttaagagtactatagaatttctttacaaaatacactagttagagttgaagtcatgaagcacactgatgcatgtaccaaacagcaatatataatgccagcacgacagatatatatttggattcaccatcggatcacacatatcggtatcctcggaactgcaggaatgaatggagacatcatgcacaaatatactcataccagcagatttctaatcaaaagagccccggcaacccagcgaaatgagtaccccagctagctagctagccaccaaagttcagctaccatcgtcggcagagagaaaaaccacgccccagatcaatggtttcccagatgatgatgcatcaagcatagcagctagcagcctagcacatctcgtcggcgtagcgagtttggttacgttgcagctaccggtgtggctgtgtgctagctacgctggcctcaaatatcccccataacgagttgacgacatgagcgacagccacgacgatgctctggcgcgcgtagtggtggcggcgttttttctcagatgtacgagcacactgcacttgaatctgccggctggtccgaccccagtggaagctccatggacaccgtttctgaactcatctgaagccccacgtaaaggtccaataatgcaaaaagtctattcgtggacgtcctcttatttttatataacacgtaaaagttaataatttttttaaaaaataataataagataaattaatatgtgatatatcaatttaaaaaatatgactttaaattcaacttacataagtagaaaaaatgatttcgaatagaataggtaattcatagtaatatttttccttcaaatcatatggatcaaaattaataaaaatgatatatgtacaaccctaacattcgactcctctatacgagcagggctgagtcttattatcctcgtgttaaatatagcttatatcgtgatgaagcctgacatgcgcttgctagcgtggctcatgccattacgcagtcagataacaatcgtgcgataatgtcgtacatatatttaacaactttctaaatataaacttatatattcgtgaatggtataaatatatacaccatatattgatctatcttaccaattatatttaaaaaaaatgataactttttagatgatagaagacgtcccctcgtaataatgcataaattcatctcccaataatgcatctcggtcgatcagcttctctcaaccctctgcaataattcccttgctcagttatgcatgcagtagaaaccagaactctctgcgtcaattaggtgcctaatcacaatacacgggccgacagcgcagcacacacacatgcaattatgcgcattattgctagctaattgacgcaagaggagactttgagaggggagtgcaataatgcaccctgagcaacaaatcgatatctctcgggtcgtcgacggtcacgtcgatcgccacatgatctgttctcgtggggggggggagtcgtcgaagatcgagtggttactaccgctttccactacgggggagattcaggcggtgggtaggtggcgttgctcctcgtcttactcttgtccacggttggctaggccataggatttgcgacttttgacgggcagccaggagaagattgacacatgtgcgaactaattggaccagcgacgagcggcgttgcttggtagttagcgagtagctgctactgagctagtcttcgggcagaatcaagaggtcgactcctatttttgttgttccagtcggtagagtactaatgtatacaattcattagcatataatcctccattctaaaatactccatgcaattaattagtacctccccatcttttacttttttaaatcatccactgtcaaaatctctaatcccattaaatgcatacatagtatttattagagtatgattcattcttagttttgatgttaatggtatttacgtctaatattttagaatagataaagtactcacatgctctttctagcataggttgttttagctgtcgcacaactactctttaaatatgagttgtatcaaggctttttttttcgtatttttagctcttttatgtttgtacataatatttgttgtgttcaagtgtcgtatatatagtaccaatggctaagtggaggtgtttttttctttctaacataggagtataaattaagggcataactttggacaaccttttagccttttttttggacaacagtcgtatttggaatcaaagtgatgtagtcttgtaagcaaaagtatgctacttttatcatacaccttccggttgtccaaaatattcgccatcaatcttcccaaaagttttggtgtcatgaaaaacgtttgtaaattaaaattttgagaatttgtcaacccttatattatattactagcaaaaatccccgtgcgttgcaccgggtgattacagagtatgtatattgaccaaaaatgttgtttggtttagcaaaagtgcccgtgcgttgcaacgggaagcgtacatatcagaaaaatatgcaattaattaaaatacaaattcgctgaaatatttggtatttttaagtaggtatgtgtataattaaataaatttacaagtaaagcaagtgtgagaaataaaatgacatggttaaatttaattttttaattaagttctccatgattagttatgctctttgaaattttattggaattttcagagcttaattgctaattttaataatacaaacatcatttaacaattatttaattaaaaaaagcaagaaactacttccttttatgtttgcttcgaattaaacatattcaataactataattgttataatgcttcggaaaaatgaagtaccaaaaatgaacttcttctatttttcttcggcccgagggacctaaaatagacttatttctgtcccttccgattggcccacggccttttgaaaaccctaaccctaatcctcccccaccccctccccctctcccccagccgagccggtcgcctcttccactcctgacgccgcctctccccctctccctctccccaccggcgccgcttcctctcccctcccctccggcggcgctgctccctctccccatctcccgcctctccccctccccccagccggccgcctctcccaccaccggcaccgcttcccttcccttctccctcccttctcgccggcacggcgcagcgatggagggctgcggcggcggtggcggcgctgcccttcccccatgttagcagccgcggcttcgcccacggcgagcggcggcggctcccttcctcacgctagcggcggtgacggcggcggctctccttcccgtctcgccggcacggcgcagcgacggcggggtgcggcagagatggcggcgacggccgtccgtccctctctccctctccccgtcggcctcgacggtgacgatggcgtcggcttcgtccgagggaggatctgtcggcggtggtggccaccacaggcggatccggcagcagcgctccctccgccgcctctcttctcactctggtggcggtgttttttttttgcaatttttttccatggctattgctaaccgaatcggattgtgtatggacgaaaaacagacgaaaattagatgtgacgaccggaaaaatacgaatatttatattagttattgatatggtgtagcgcccgttccgtcatggcgcctagcgggaaaattatctcttaaaaactctatttgcgaaatctgtttccttgcttgttgtctagtgtccgtgccatctcagatgtcaaatcctcgatctatcgtcaagttcaatcccgaatccaaatccttcccaaatcaaatccctccgcaaaagtctattttgcctccctcgggttcgatgggccgaatccctctcggcccatctccctctctctctctctctctctctctccctctccgccgctctgcccgtgcgttgcacacgcgtgcacgtgagccgcgccgagccgagcgccctccgccctcgctgccgcttcccgccgacgccgccgaaatcgccgcgccgcccgttgcttcccacgcgcgcgcgcgccatggtggccgactgcctggtcgctgccgcgcctgcccgcgcctgccgcccgtgtcgccgctccgctccacaccgccccgccgtcatcgccgtcgtcacgacccggcccccgacactccacgcgctagcctccaagggacggaggcagagctcctcctccctctgccgcgtcgcccccgctccctcctccttttcccaaagtggcaaggggcaagctccctttctgccttcctttttccttttcccctccccgccggcgtcatccgcctctgtcaccgttttggccgcgagcgccgagcgccagctcgcgccttgaccgcccaaggtcggtttccaaaccgacatcgtcgtcctataaaccaaggcgccctcccatcgattcctcctcccgtttcgctcgccgccaccgcgccattgccgcccctctgtctcgcctccgccgttcatcgccaagcaccgggagagccggtgcgttcgtggacgcggaaggggactccgggagctcgtcttcctcctcttccccggcccgaggccggagagatcactcccgtgccgtcggcccatcgtcactgcgccccgtccgcacggtagtgcatctccccgttctccctcctcaatccatctcttccccttagtttttggtagtagcatgtgtagcctccccgtagctagccggcgccgccccgactgctgtcgtcgctcgccgtgtgctcgccgccgtcgccgctcgagctcggaagcgcctcttgtcgccggcctccctcgatgcgtttcctcctaatccggcgcaagggatgggttcccgtatccgagtagatgctctcgccgccgggaatcggcccctcgtgacctcatcgccgtttcccccttttctctccgccggttgccgccgccgcaatccaccgccgtcgagcatcccccggtgaatccgagccgttggctcgtctcccctcgtcccgtgcaacctcccggtgtgctcgctttcgcctgtatcgccatggttcgctccactgctcgccgccgtcgtccgccgtccgttccggccggtgtcgtcgtctacctcccgccggcccgcgtggcagccatgtaggcgccacgtcggcgccacctcggccgcgaccgggtcaagcagaccccggcccgccgcttccctccgcccctcgcgggcgcggtccaccgcgagccgtgaggctgcgcgtgggcacgccgcaccgcgtcctccgtgaaccgcgcgcctgcgccgcgcctccctccccaaaccctagctcgccccgcgtgcacctcgctcacggtgagccgagtcgccgacaagcgggtcccacccgggaccacgcgggatggacccggcccaccggctctctctctctcccctccccgcccgcgcgcgcgccttgggccgccttcttgggccggccggcccattaagctcggccgagccgccccattctctcgggccgcgccctagccgcccgtggaagtctaattttcctccctccttcttttcttttcttttctttttcaaaaaggatttaaataaatcctttttcctttagaccaaaaatccaataatcttagaaattcaatatcttcccaaccgtaagtctgtttgactccgttcaacttccaaaattcctcaaatctcgagatctatctaatggcacgcttagaggtcattaatagggctttattttcgccgtttgttgagttgtcccatttcgcgtgtagtttcggagcccgaagacccgcagtgcgaggatttcgaggatcaagctcaagatctcgagcaaggcaagccacctttgaacatcttgagcctatatttgaacttaattatgttgcttgaaaaatattatgcattgataggatcgcacttaatctgcttgtcccgtctgcaaggcagattggcggacctacctaatttgttgcatttgacccttccattgtaattgttataccatgttcccttgtacccacctagttgcgcctcggtaatcgtgcactctgcacgggtatcgacgatcaccttcaaacttaaaatctgagaaacatcttgggtaaaacttgggttttacaaaagacttggaaaacccgacacctgggtcggtgcttgcgaactaaatgaatttctaaaaccgcggaccggggaatgtaccgggtgtacggtttcccgctcttgcacttaaggaccgtttccttggaatttcatccgaacataagacaagtacgaccacatgggtggaatgggacacccctggctgagtaactagcttatcgggggagccatgatgctaagagacatgtggattcgccggggtggtgtcggggaggacccctgggcttcctggcacagtatggtctgggacctaatctggtgttggtctgggacccctctcgttggcatatggtgaacctgtgtcggctttcgaaatgccttgtcatgaaagccttaaggtctctagtcgtggccgttctgcacgggctggatgatccgggttagtaatgtcgtgtgggtaaagtgtaccccctctgcagaggttattaaaactgttcgaacagccgtgcccacggtcatgggcggatgtgaggtgattcctagcgtagttttgtttgactactgccttgtgaaatttgctgttgtggaatgggcttgatgtttggaaaatcggcggctgatgggatcagccaggcccgggtggccatttgaaagctgttggccgggtgccaatcttgatcaattcaaaagactgaaacattgcacatactccgaccggacgagacgcactgtctcatccgtgtcatttgagaagcactcccttagttgtttcggaaaagagtttaaataaaatcaatcgcaaaaaaaaacaatagcctttctttgaagcatgcattaaacacttatttcccatggcttgctgagtactcctgtactcacccttgctctatataaataatcccccccagttgctgaagaagatgaagcggatcccgctgacgaggagttcttccaggagcaagccggctacgatgagttttagggtttcggcctagttcccaagtcgcgcctgtgatgtgtggtccaagtcttggcttccgtttccctttcgtaatgcagttgtgagctcgggatctgtccgcagcccaacatgactgtactcctactctataataaagagacctctgttgctgtgatattttgtcttcctgtgataccagcactgtttcctgggactggtatcgattaacaggttaatttggagcgtcacgggctagttccactcgggactagttcggggcgtgacatatggtttggtatttcatatgtcaatgacatgtgaattatggtccatttcacaaacacacagaagtggcaaatcacttttatttcaactactgctggaagggcaaatctttaaatatccctttggaaatttgtcgctgaaaggaatttttataataccaaaatttaggtattatgtaaatctacaaaaatagaaggtcaaatgtctcatggttgaaccggttgtaatttatttttaatttttttagtaaaattatataactgtgggagcttccctacaatattttccttaaaataaatatgtcaatggatcattttccagatgcgtttgtggtaggcagaaagagaagaaaagatacttgtttttcatttgcatattttctgaactattaaacggtatgttgtatattaaaaaaattatatagaaaagttgctttaagaaaatcatattaaactttttttaactttaaaacagttaataattaatcatatgctaatgacgtaccttatttcacgtatcttttcaatcttttttctactccttgacacataacaggacaaagagagtaacttttgtttcttggcttattaaaaaggatatctatatagcatactccatccatttcgtaatatttgacaatttcaactaaccgttactctaatttgaccactaataaatcatttgatcacgatgaacatacacgctttatatatatattaaatagttttctaggttggcacgtgcgaattgaaccagcaagcagcgctgctgatctagtcttctggaagaatccagcgcggtagagtacaaatgtccaaattcattactccctctattttactagttaaaacatttttggttcccataaaaatatcctaatttttcatctactttctcttctaaaaaaaaattacgaaaatcatgctataaatcatttgaaatttaacattccacctcataagtctttttctttgcaaaaatacctcagtgtgcacgtgcttaaccaaatcagccgttaacacttagagaaaatcccctatgtacccatgaaagttcacctaatcccttctatatccctgaattttgttcaatcccctacatacccctgaattttagtttggatcccttccatgccctttccgctagttgaccgttagttgaccgttaaattcttttgaaaaagtccattttgccctttgctatgaagaaacataataaattaatgaagtaaattgttggaatataaaaatttatcggatgggattattatatttatgaatatgtgatgcaccatattatttgtgacaagtttattcttacatatgatataaaaagttaatactcatttattagttattaaaagttctattatgtagcatatgtggtttcatagtaatacaacaaatttgtttattactatcagaacacatatgctaacaaaaatcttttaataacttaataaataagttttaattttttatgtcatatatgcaagaatatttatcgtaaataatatggtgcataactatctcataaacataatagtctcatataacatatttctatgctgcacaatatactctattaatttatatatatgcttctttataccaaagggcaaaatagactttttcataagaatttaacggtcaactaacggtcaactagcggaaagggcatggaagggatccaaactaaaatttaggggtatataagggattgagcaaaattcaggggtacagaagggattaggtgaactttcagaggtacacaagagattttctctaacacttatgtagagtccactgtaggctgagctagctgagtcaatcttattaaagtgctcacattagatctattcttcatgtttcattgatttttttcctgcatatagcaaaactgagtgcaacaacatttaagctctcatcagcaatctatttatgcaatctctaaaaagtgtgttaagactatactcctaaatgtatttaattttggtaaaagccacgtaaatgcctcacaatttttaaaaacatatcgattcaggtaagcacgtgtgcacaataatgatttttgcaacgaaaccgagtagggagttggcatttgcaacaaaatgatttatggagtggaatgtcagatttcaagtgacttctggggtggttttgcaattttccctcagtcaatcataatcttcttctaattattttcacatattttctcaattctcattaaagccttcataaatgcttatattttaatattgatgggagtagctacctctaccccgacctcatgttgtacagagtattactctctccgtccctaaatatttgacgccgtttaactgttgtaaacatatttgaccgttcgtcttattaaaaaacttttgtgaaatatgtaaaactatatgtatacataaaagtatatttataatgaatcaaataataggaaaagaattaataaaagtatatttaataatgaactaaataataggaaaagaattaataattacttaaatttttttaataagacgaaccccactcccctccaaagttttgtagagtctgttacggtgattaagggagtatgttaaattaagagcaatgctacacgtactaaatttttcttactaaacttttactaacaatcatctcaaccgtttgatttaagtagatggaagttacaaaaaatctaatgcactcatagcatgacacatcagtgttagtaagaatttagtaagaaaaagttagtacgtatagccttttcattaaattaaataggatgtggttatggttatggagacgatagagcaggtgaaaaaaataaataaatgagaggggttggttgagatcagagaataactagagaagttgctattatgcgataaattttgcactaagctagctctgtgattgtcggtattagtccaagataatgtagagaggattggcttcttatttctctttgcattttctttgttttttttaaggaaccctattggctttgcttactattttgaattttataaataaaaagaaagtttttgttacaaaccagaaaagaaaagaattcaaaattttatatagccaatctatcgtttttttatcaatcgaaaaacgtgattctctttaaccttatttgcttctagattccatagctgcgtgattctccttctttgatgtaaagcagtaaaggcatacatacatacatacatacatacttacttatcagcgacacacgtgccagtttcatctttctctcatagactat

SEQ ID NO: 45116 - DNA, 713 bp, Oryza sativa
caagatccaaaccacttaacctagtgagatgatcaaaaccaacatgtccaagtctacgatgccaaaacatcacatctttatcaacttaacaaccaaacatgttatcacaggtgaaataggaatttcaaaattagctttaaacacacttccatagtgagaaatattcaacacagaatcaccacaataatcaaaaattttacttccagttttcttaaagtgaacctcaaaattttcatcaacaatttgtaaaactggaagcaaattgtactttaagtcctcaaccaaagctacattcttcaattcaaaattttcatttaccttaaccaaacatgtagcaagaacggcacttatagaagcatcaccaaagataatcgattcagtcttggatgccttctttagggaggagaactaatttttatcaccggtcatgtgccgcgaacaaccggaatccacgatccacacgttctccttccttgccaccaaagcctacacacaagcagaagtcgaagcctcagtactggggttagatgataataaaaatttaggaatccagtactgagatacacgaccagaagatccaataggcatatatccacgtgcaaaatcaattttataattttcagaaaaattcctccgaggccggtcttaccgaggtatagtggccggtctgaccgggggccggtctgaccgcttctgtaccgccggtctgaccg

SEQ ID NO: 45117 - DNA, 7662 bp, Oryza sativa
caaagtcccaggagactgaggattgtttgaagcaggggaacgtaagatggagccaccatgatggtatgatgacaatggagaagtcataggggtcctcctgagtccttgggaatggggcccattacttggagatatagttggtgataatgatttgcccagaggtagcatgtttattttaatcctgcaaaacaaagaaatgttagttctctcatcatttggaggttctgttaagagtaaaaagtaacagggttcaagccacttacttgttatgtacatcaacatattcatctgtttcatccaagatatcttcctgccaagagaagtttatgccagtttgcatgtataagcgaaaatattttacaaagaacgatacatctatgaaaaatttctagtttcttttctaactattggaaaacactagatgactctaaaaaaatgcaacatcatgctgaattaaacgtgttgctcccataggttggagaacactaaaatctttatacaacaaacaagagtataaatggagaaaaaataatggtgtcctcaaaaaagcatcaggatgtgaaaaatgcaagactttgttttcaaataaaaatataaattaagaacaagctgtatttaagaatatctccaacctgtagcaattgttccataacatcttccattgtgattatccccactgcttcttgatccaatgaatagcttggaagtggaccgctattaaaatcaagaatattgtcccgctttttttctgatttcttatataagcgcacctctccattcttttcaatgttacttcgacgacttccagcaatgctgacacgagagggtgacaaacctgagggtattttcaaatgatcagacagccaaacaaatatttattcctggaaaaacaagtgatcatcatggctaatggaaagtatgtaccatcagcatgggcatctctgtggttaattttgtaatctgatctgtcgctgttagttttgtaatctgatctgtcactataagtcttttcaatggatgctcctggttcttttatgcgtctgaccaccacagccatgtgactgtgacctttctgaaactcgtttagaatgtcgtagagaggaagatcatcagacaccctgatataccaaaaagcagcaacaccaaaggaaaattagaagatgacaaacgaacattttgtatggagatagatacacgcaaattacaaggcaacatggagtatagcttccttaaataagagattccaaatatctgagaatagttctcttgttatgaagagcatagaagcattaagtattcagaagtgcatatttgaatcaattccaaagcatatcacagtatgtagcaaccttgggtgccctcagtttaagccatggaaataatcttaacttgtcaactttagttatactagcaaaagtgcccgtgcgttgcaccgggtgattacggagtgtgtatattgaccaaaagtgttgtttggtctagcaaaagtgcctgtgtgttacaatgtgaagcgtacagattagaaaaatatgcaattaattaaaatacaaattcgctgaaatatttggtatttttaagtaggtatgtgtataattaaataaatttacaagtaaagcaagtgtgagaaataaaatgacatggttaaatttaattttttttaaattctccatgattagttacgctctttgaaattatatttgaatttttcagagcttaattgttaattttattaatacaaacgtcatttaacaattatttacttggaaaaagaaagaaaatacttccttttaggtttgcttcgaaataaacacattcaataacttataattgttgtaatgcttctgaaaaaatgagcactaaaaatgaacttattctctttttttgggcctgagggacctaaaatagacttatttccggcccttgccggtcggtccacggccttttgtgcacgcgcaagtgcacttcccctccccaggccacaacctgggcttgggccagaaaagtggcctcactctcgatccctcttgggctgattcggcctggacgacaccgatcgtccgatctttagggttttgatcggacggccgagcgtcgatatcggggaaacaaaacccctccttctcctcagccgccgaaaccctagcccatttccctccctcccatctcacatcgccgccctcccctccgcgcccccgagcggcggcgacggcgcccctcttcccgcgagcggcggcggcggcgccctcccccacaaccaacggcgcggcgccctctccccgaacaacggcggcgtggaggcggctgcggcccggcgggagcgggaggggcggcgggccggacctcgcctccgccagatctggcggcatggaagcggctgtggtccggcgagggcaggagaggcggcggcgtcgtctctttctctctctctctgtgcatggtggggaggtgcggcagtggtggtggtggcggacgtcatggaacgccggtcgggcctcgcctccgccagatccggcagtgtggaggcagctgcagcccggcgggggtgggaggggcggcgggccggacctcgcctccgccagattcggcggcatggaggcggctgcggtccgacgggggcgggagaggtggcggcgtcgtctctctctctctctgtgaatggtgtcggttctcctggtgatgctaaccgaataggacttggtataacagatgggagtttgtttcctatttttgtggaatcggacatattctttttttttcccgatttttcttttaccgcgttgatgaatcggattcgttccggttttttttcacccggtttttttgacggacgatggaagcacctcttattttttaagtagtagtagatatgcgtagccttgagctttcttgaagcatgcctaatgtatctgcacgagattttgacttccaactcagactcagagaaagttaatagtgggtacattttttaatcaagccaatgaaaacatagtagtagctttttagggaggaacagtaggggcctagggggcaaacagccaatttgataaagcaataaaagatcataccttgggatttttctgatagtaacatttcgaatgggcacttcatcctcaggttggcaagtaattaagtttttaacctgaaaatgagatggtctttgcttattggtcaaatagtaaataacaaacacatgaaagtaaagtggcaagattggctatttcattgggatataggatgtccaggaagtgacagtaatggaaggatcgggaaagttattgttgttatttttccaaaagtgaattacttataggcaattaaatcttttcccccacttaatgaaattggtcgaccaaatctttcggccgacccggcaaaaatataagcaatcataagggcatgtttagaaaggcttaaatttgtgaatgttgcctcaggttttgaataactaagggcagcttgagtggaagtacacaagactctgccaaattagtcactcatatctgtatttcgttagagtatgtgatcccacaatcaactgaaaacaattattttatgacaattttattaccgacgtgtcatggttgaatgactgctgcaaaggcttcctttaaccagagaactagaatatcattaatgaatttataaaatatatttcatcacaacaaaaacattcttctctaattcaagtatttatctattaaaactgaaatgggctagcagattcagtatcgaatatctgtaatgtgctatcttattcacaataaaaagtgtgactgacacagcagttagaaccggcaactcaagccacaaagattgatcattgacaacatgcatccaagagtaaataacatgaaagtcataagtttctagggaacaggatttttggcaccaaaaaagttaataatacataaagtttagcctaccaatataaggccaataatattgtttggagtcccagagtatattggaacacgactatgccctttggtcattatcatacccattgtgtgcctatcaagaagagaacagtagcatcaatagaatgtgtcattcaaaacacgtacaatagttggaatattcttacaggtccagcttagcgtttatatcaagtgagaaggtttcagatatgggagtcatggcatcttttgcagtcttttgagtcatctccaaagctcctgtaatgatagtggtttcatcatgagtcagctctccacctttgccagcctaagaacaagtgaaccagcagaagtttaatggtattcatatttgtctgaggaaagcaccaatagctattgcaaacacaagtagcccagagaatatatgtatattagagccagaagaaaatattcaaggcatgtagaaatgcccaatcatattgtccatatagcagcaaatattataaccggactcatttaaggtgctataacatgtcataaaaagttgtctagaatctatatagaacatggcctcttgagatcaactcttggacgccgcacacagctgttgcaaccaaaaaaaaccactattgatgcaaactacatagtgtaaagagctacaacttaccagaaatgcataagagaataagaataaaacctacctcattaccatgcatatcgactaaagtctttagctcagctctcctcataagtgcaacatggccctttccgagtacccaatccaacaactggaaagatggacatgaatcaaattaagacatggcattagtggaaaacacaagcatatctatgcatcctctaattatagctaattttgcattagaaacaaggaaatggttagttgaatgcaactcaaaacattcatctgcgacaataagtagttcgctgtgtttcagccccaattaaattctgttcttttttctttgtaaaatatgattcagaaaacaattagtttagcaggaaataattaaactaagaagcgaattgaattgcttcatctaaaattattcaggagcaatcaaacacgcttatgaaggcatttttcctagtctggcaaaggaaaaaagaacactaaaacagggttcttgcttcacggctatgattgcttattctggttcaatggggaatgggacagattacatttactaattaattagtcaccggctacaaagaattttgtagacagatgactaaatgagaatgggacaagtcccttgattggaaaattaattaatgaatcagtaagtaaccgatctgcgtcctagtcgcggtcagccacttgtagtgtcccatccaaatccaaattgtgagcacaccccggccaagtgaccaactacaaggttccaattcctcccccaaattctttgcaagcaaacaagagcaacgaaacaggctaagccagcaggcgcaccttgctgattgggtaggcgaccgggaagaagacgatgaggagtacccggacaacgggcgccgccttggccccgacgctgagcccgtagcgcgtgcagatggcctgcggcatgatctgcgaccacaggagaaaccgaatcagccagccaaaccccaagtgagcaacccatagtccatggacacgcgagatggatcaatgcctcacctcaccgaaggcgaggatgagcgtgacggagatgaggatggcgccgaaggacgggacgagcgagtccagaaatatcggcagcgcctgcgcacacgccgccgccacaaagccatcagctccaatctggatacgtgcatacaggggatcgaaaaacagcaggagagatttgtacctccatggcgagggagttgccgatgaggagggtgcagaggagcaagtgctggttcttgacgaccggcaggatcctggctgcgcgcgcgcgcgcacacgcagcgatcagcagcagcagtagagctagggggggcagagagagagagagagaggaggacgtaccggcgttgtccttgtccgtcggggtgccggccttggcgaggacctcgaggtcgacgaggctgagcgacatgaggccgagggtgagccccgacatgagcccggcgaacatcaccagccccacgcacgacatcaggtacacccagaacatcgccccgcagcacaccgcatgctgcgacatctcccccccgccgccgccgccggcgaatcctcctcggcaaccaccgagctcagatgctcagtacgacacgagtgtgtttgctgtgggagaggagggccagttaatagatctctctctttttaacccgcgcagcacagcagctgcagcagggtggtctcggctgcgtgcgtgcgtgcggcggggggctcgctttattacgggcggggcttgagttggctggttggttaagtggcacggcgtcgacggcgcgcggctcccttttcctcctctcttttcggttgcggtttctcgtatttttcccccgtgggataacgtaacggcctctccccagaggggctgtttggtttgatcctaattcctaaaggttactaaagattaccacaccagtagacaagattgattaagttagtctattgtttggtttatagccacacttatgacaagatttcttctcatctattatgacctcacatgtcattaactccctaaagtgtgacacttgtaagccacaacttaaacaaatgtgacgtaaaaagtatgatgaatgatgataaacttcgtataccatccaaacagcccgagtgcggcgcaaccggggagccgcgcgtctgggtgttgggtgccggtggtggtgactgcggttggtgcgcgcctcgctcgcttcactacacccgttttcccgtggatttacctcccccggtggagtggagcgtggtggaagggatcgatcgatcggtgaatctacgttgcagctaaaccgacgaggcgtttcgggttctcgcgatgcaattcacgcaaggggggttctgtgtgcgatgggggcaggaggatgacacattgttgggtcgatctgccacggcttcttttgctgtcaaaggcacgtactatcaggggtttgagggcaaaacgtgcgggcaaatctcgcctgcccgatctgctgaccgaccggcatcgtgggggcccacgtggcggttgctgtcccgctggtcgtcagcgtgacggtctctgttttttactactctcgacaggttcagtcaaaaggaaagttactttgattattgtggatggtgctacttgaatgagcgcgacaaaagctaaagcgtgaaccctcgttgtggtgaaagcaatatacttgggcacttggcattgcatgatgcatggttaattatatcggtctaataaaagaaaaggatgccccagattgtgtagttttttggtcgatcacgcccaatactctctaatcatgaagtactcctatggacaatgcacagctcctattccgaggaccaagaattgcacgctcatttaggcccatctgagctgggatcggacatgatcaccaccagcacacgtgaacatggatagaatacttctaacagcaggtacaatagcagactataaaccagctataaccacgtatcgagaagaaaagataagagagaaaagaaagcgggttagagcaaggctaagagcaacttcaatagtgtagctaactactgactccaaatcatctattactaatctaatagctcattcatacaatagttaactataaaaatatatcataccattaatacccg

SEQ ID NO: 45118 - DNA, 1972 bp, Oryza sativa
tttgtagccagctgcagcacggactccaatacgcaatgtgtgtatgacggataggaccaaatattaatagtgtagtatacatttctagataaccattgtatgaattgactattagattgactatagatgattttaagcttgcagtggactatactattaaatttgctctaatagcaggagctagcatatgactgtcgaaaagatgtctgaactctgaatgattctctcgttgttctcggcattaagaatagtttcatgatgcagcatattctcgagattgcatgggttgcaaggcggagaatccggtggctgctggtggtgaatcaccaggcgcacgcctgcaaaggaatattggccggtagatgctgcgcacaaaagacacccttttgttcatcatcccagccgtttcagaagctacccttggtgtgtaggactcagtctgaccttcgattttctcttaggacagcatgcctgatctttagtttggcctcttctgttggagtggaacgtgggtacttcatcatcgaacgaacaaactaaaaaaaacaagtgttttccttttggcttgttttttacttgatacactactttacctaaaatgagatttggaagggtttcacgaagaaattataagcgtgttgagaattaaatacgaaattttagggttgaaatcacattccacttatcggtgtattactgtattatcgagtgtatctaagatatactaccctactttacctaacttggtcaatatcagagttgagcttggtcagcgattgagtcacgattaacaaatcaggaaacatattaggccatgaaaacaacgtgcatggcccaattccacgttgaagcaggaaagaaatagagggataagtgggtatattaaggttatcacgcacagtgctggtaatggggcatgtcattttccatttgcatatgtgcaaccttttctgtagttagtggtgtctgttcagttatattatcttctcgtgtgttattagccccataacctagcagttagccggaagctttatcttcagctgccaaactaatttgaaaataaaaggcagatgccacttagatttgcactatgagtcaataagtcggtgaatcctttcaacgcgacgcgcgtaagcgtgtcgggaaagtcgtcttgtgtttaattttagactgaccctgttatacttacatatacatcaatacatcatccacattgacagagaagagaacgaatcaggacatgtacatcaagtattcataaatgggtttactgactgtctgcaagcagagaaaattattccctgaaaattcaatgaatgtacgttataggttagcaattaatccttgacaatacattttacaaaccttagcacgcatggttcagattaatcgattcgcatcttatcttctctggaagttgtttgatcgaccaactgtccaaacgttggcagttaagtttagagaaaattattccctggaaaatttctctgaaattttcaaatgtttgattcatcaattttagagacaaatttcccctgaaaattcaatgaatgtacgtcaatacactttacgaacgtttttgcactcatggttcagcttcatcgattcgcaccttatcttctctgtaagttgtttgatgacttgatcgaccaactgtccaacttacatagtatatgccaatctcaccatgttccatggcgattactctctgaataagatcttggctttcgtggagccaatttgcaccaggttttatttggtcccagatatatgccgccattcatccgatcactgaaaatgtcagcatgacggtgcgtatatggaagacttacagatccatggaaaaagacgatccccttttttcttcgcacgattcaaaagacctggaaaatagtagaggatgaaaatgctggcctctctcgtcagcttagccccatgtgctccattttggcaaactagctttttttcacac

SEQ ID NO: 45119 - DNA, 6674 bp, Oryza sativa
ttacataaaggaaataactttagctactctctctatctaaaatataacaacttctagcatttaaaatttaccttaaaatattgcaacatcttcacttatactctcttttacggtagcgctattccacgcgctacagcgcggaataataattcgagcgctgcacaccgccttctacttccggttttttcgttttttaccaccccacctttcctccgcatcccaccttttctcgggtcgttttttttcgttttttaacaccccaccttccgtgtttctttttttctcttttccatcttatatgtgcttcatcaatggtccaggtaaaatattaaccatccagatttttctgttattcattccttctctatagtttttctgttttcgcgttttagtaaaatatttaccgtctagtttttctttccgagttttccgtttttctagtatctccgcacgtttgaaaagtaacgaatttactccgtggaatttttcatttactcccagcctcccacatctgctcattctaaagtaacaaatttattctcatgaatgtctccacatcgtatgacgccatacctaaatggtcgtaaaagaattactacaagcttacaacgctagtaattcttttaccaatattatttagattttgtgctctgcgagtaaaacaatttccacattcctctcgatatagccatgatctcatagccaccatgtagtaatatgtttactgatgtgttcaatatacagtataagaataaaaactggtactaagagtattgttgatctgtatcacaaaatagttgtatgaatgaaaaaaattacaggctcaatcacacacaagcgataaaattactcacaggtgaatcaaactagaaaagaaaaaaaatgattcagccaaaaatccatcatggaatcatggaagaatgtagcggtgtggtatagagttgagcttgacgttgcacagtagcagccatccatcatctaacaagcacaaaaaaatgtaaaaatattctcgttcatgtcaatacagatgacgagcaaaagaaaaatagcaaacaatctccatcaccggtggactccaccttaacctctgcggccagctacatggagcacgatgtgcaaatgtaggacctgtgcagcctatcaattgagatcaggtaatattggagattacatgttaatttgatttgcaaaaaaaattagggcttcatgcgtgaagttgaaagagagtatgcagatgcaaattagagtgtcatttccttacttgcttgttctatcaatgtcgccgacgtggagtagccgctggttgttgctattggctcaggtgaacacctccttgctggttatggtgctgcctagcgtccagcagcgaggcctgaagtagtgccttcacctcaaccgccgccggccactgctcgccggccaccgccatcaaccaccacggtgtcgtcgtcgtccttcatggtgtgtcgccgatctgtgggctgggatggtggatcgattcagatccaaaaaaaaggaaaaaacggagtgggggcgagagtggttggttgggtacgggaaaaatagaatatataccggaagcagagaagttgtttttatcgtagtaaatcatttactccgataatggtgggtgcacgatgcgggacatggggtgagatcgaaagcatggaagttgtttttattatcgaagtaaattgtttactcaaataaaggtgggtggtagaggcacccgatcggagtaaacaatttactcggatcggtaggagtgggatgacgggacgtggggtggggtgggcctgggctaacgcatgtttggcgctatgaacaatattccacgctctagcgctcctaatagtagttctactctttttaaccaataataacatttcctaatttaatttctctacctacttcgttttctcaatgaatcacaactttctcttacttaattctacatactttcataatacatgtgctcaatcctaaagttcttatatttttggatgagatgataacttattattggtattctgcctactttcgtaatacatgtatttaatcctaatttttttatattttaggatagatgcagtaactcattgtcgggttgtcagcgggttaaaatttatatggataggcatgcatttatttaggtttattgtttcggcatagcttcatacatattaatttttcatggtgcttttttttaacaaatagcatttttgcacactgtcaagatcttcacatagtcctcatcgctccagtcgtgcaagatatacagcatgaaactgtataagttattcaggattaaaatgttattaaagttattgtgattggtatctctctcaaacaacatctgcttctaattaaggactaaacatggaggttttattgagccactactactccccctgttctcatgtatacatatcattttaactttcatactttgctcctacatacttgttctactacatttactagtgcaggtttgagttttttttttactttacttacatgtgctatacacttcacatttaactgtttatttgcatgtctgcatttattatcatatatactagtgcagtatgtgccatcaaataataatgagggtaactctatctacattaggagggaaaagcctcctgaaaattattacagattaatatgtaaatacattcttataagttaaaatttgtccaaacctcgcaagccccaaaaaagatctttttttaacctaatgccgaactttgttccactgttatacttagaaaaaaaaaattgacccagtttataaggaaaaccgggcccaaaaaccatacagctgcacggttaattacaggaaaaccagctaaaaccttccgctctacacaactaacaacgacggcggagcctaatcgtaggacgtcactgccaaactaaacacaaaagcgacacaacagctcccacattgcagaagaggtgttaccattgctaagctagccgcccaagcgacctagcagcgccgactccacaactgcagcaacactgaagccacgaaagtcaccaaagcgaaaagtagctccgacatccaacaatggacgtcagccaagccaccgaagagcaacttccttcacacggccagcaccagagctccttggaagagactgcaacatgtcatcattgccgagcgtcgccgcacccccatcagcaagcagcttcgacttcattagcagaaacaaccgaagagcgtgttgcccaccacaagaaagaagcggacccaagaaggcgaaggcctcaccgaacaaaaggtatgaaagcttttgaaccgaaaaagactatcgacagtcgtcgatgcgttagaacttctccgaagtgacgcccccaaggaggacacaacgtgtaacgccaccgccgctcgttcgaaagtcggaaggaggttttcacctagaaatttgtggggatatgaaagaatgccatgacaacgcctccaagaagggaaacggcgcccatgggcgccgtcgtcgtcgaaccggcccaagacccggcaaggctttcgccagcatcttcacatcactcacacaaacacccccacatcgatggccacagaatagtccatgatgtctcgcaagcagttataccttgaccgtaaccaacagcaaagacgggcccttggccaccctcgaaacgccatcaatccgccgaaaaagatcttagatttcgctgtttcacttagccaatttgctcaaggttttcgtacatagatgtcgtcatatatgtcaataattcagttttcagtctgcatctgcatcctcttgaaatgtcagcatgccggttcttgtatcacttatgggaggtcacagcctaatcgatactagaaagagaccgtctccttgtttctttgtacgattcgatacagcaggaaaaaaaacaatggatgatgaaacgccggcctctctcttcagcttaccttgatataccactccatttggacaaattgtggagaatccgaactctcccacgactggtaacagaaaggacaggctactgatcgctgtcggattagcggcaattgtcccttcttaatgatcgagactctgagctagccctgacttgatttagtatctgtctaaggatacggctcctgcacgaatcttatcttgcggtttacttgcaacaatagatcatggatctatcacccctatttacagaaacaaaactcattgcttttaaagaactcacattttcgggtaaccttgttgtcccttgtgggttgtggttgtggcaaggtcctttgaacccaccatctgaattcaagttgcaaacttagtacatatactattttagtgatagacaatctatacgttgataggaaaacgtcggtgatgattttatcaattttaaaatataccggtccaatcctcgaatgcgtttttacctgcacattcgatgagtgcgagaagcttgtggtgactttgtcattattaagacatacttttaaaggtggttatacggatagggtatgtatatatgtatgcatttggtaagtgggctcgtatgtaattgaacgtgcgtggttgtattgtgttttgtttttttcgaaaaaaagaacttatgaatcttgtactattgtctgtcttaattcattaattcattcgtttgacgacaattatgcatatatttgccaacttcgggtggcggttctctaatacaattcaatagttatggcatatttttcttctgttggtgtgtattagtttatgtttgcttagctttgtttgtgctatcgtgaactttctatgtgagttttgttctgtgtgagttctgtaataattggctgtaactctttgagtaaagactggaatgttacattccattatctaaaagaattaattcattcgtataatcgtggtattatctgataataacacaattacacaagacaacgctaagcacaaatgtataggtagaaaatgggccttaaagcccatttggccagtgaaatctaaggcccaaaagatagcaataatgggccgaaacccaaaagttaatgttgactctgtgtgctccattatagtcctccacgaatccatggtcgctggaaaagggtggagaaaccaagagggggcgtcgccggagtcggagtcggagacgtcacggcgagctccgcggcggcgatggagagctccctgggcggctggccgtcctacaacccgcaaaacttcagccaggtcgtccccgccgacccctccgcgcagcccttggtcggtcagcccctctgtgactctgtcccccctcactcgcgatcgatctctgtgcttagctgtcgtgatctcatgcctccgaccgccaagtacaattcagaattaggttgattgtgttgatgatgccatgaattgtgtgcctgatccctcacgccggagctttacctctagtcagtcctattgtgtgtcagagcgtgtgtctgaaattccagtgcgcatgattaacaaaaggtggttagtactatttgtttctaagtcccaatgccaaatagttggatcataatatctcatttgggaggtatttgtgaatcatggattatacatttaggatttggtttctctcatggccaacgccctttaaggtttcagttgtggtgatgaattactagtcggtttttgctccgaatgtcattccaggcagccacttgcattgtaatttgcaaagcatatattcagtttgtcatatttgtgtttctcgtcagagtatcaagctggtaacttattctctggagtccggacatgttgcattggtgcgaaactgccaatacttatccctattttttttgtgtttcagaatgtcgtaccagccacttacattgcaacacacaggacggatccacctcccggtcaaggtatcttgctcccttgtttcttttaccaatgctgatttccctgtgctgctcctcacttctgagtgtgtggttcctaaacgttcaaatgtgtatagttgaatgtgactgctcattcacattgcatcaaattccttttacagtagtactctacatggcatagcagatcctctgagttgtttggtctgagccaaaaagtgactatcttgcctttcatggctggcatatttaactccaatcatctatactgttttcagtaatgcagcctctttagtatcttctgagtgatagatccatgaatagattctgttggactgttagatatgtcttcaaagtcaatattttttgcattccctaggactgtagttttggcttcttgatatgtaactcacatacattatggctaatttgcccagcttactttcaagtagttcccttacgacctttgttctggtacattttttatagcttcaaagcaaacttttctcttggagtatgactttatgagggagagcagaaaaggttgagagtcagagagccagggcctagccggcaaactggaaagaccaactaaacctgatcttacaccttcatagttgagtccccttgaattgatttgataagttaaatgcttttataattttagcaatcaaattttggaataacacatgctagagcaacatctatttggactagaggttggagtttcctaatgatgaatcaacataatttagtattttcgcctcagagactttgctctgacccactatgtgtacctattacaattttgtatgagcattct

SEQ ID NO: 45120 - DNA, 17525 bp, Oryza sativa
ctcctagcctaatcttttggcaggccaggccgaaccaccaaacatcctggttgctttcaggcctgtccactgaactatctccagatttcaggtacaggtattcagtaaaaaattgattgcatgctgcttaccatctccacaaaagaaaaatgaaagaaaactataggcaagctgggcaatttattagtaaggagcaaatgaactggccaaccaaagcaacctctcatattagtcatcttcctctagtgctgccaacatagttttattgaagtgttctgtttatgccatattgccaatatgatttggatggttacatttatagaacacagtttttcttctcgactcattgcccgtgtgcctgttggcagaggccaaagatgtaaaccatttccattatctaaaaaaaaagaacattgtttttagatattctatgtaaacattgtacttcattggtccgttgcaggcatggagctagttccttagtttccagtttattcaggggctgttcagattgatgccattttcaaccatatcattttttggcaaagttgccaaaaatgtgcctacatttggtttgttgccaaattttggtaaatacataagaaatcctgccaaaattttggtaatattgtcaacttgctaaaattttaggtaaggtttattttggcaacaatctgaacagcccctccgtatttttgctgcctattccctcttgaatttcctgtgcatgggatattgcttctgatagtggtgaattcttgagtgctttagttcattagagcaagtttaatagtatagcccactgctaactccaattcatctatagccaatctaatagccaattcatacaatagttgcttactatactattaatatatggtcacacctgtcatacatacattgcgtcttagagtccgcgatgcagctggctacagatctatagcccgctgctcttctctctcatcctttctctcattaaaatatgtttacagctggctaatagcctgctattgtacctgctcttagatattttcgtagtcgatcagactcgatagttgctcgctctctttacctcgttttggttctttctgggctctcgtccattcctaccagaactaccccaactattccaagttttcttttttactgtacagaaatcacctcttttttttttgttgctattttcactatttccctgaccgtttgtgtctggaatcgcagtgataacaacagaccccaagaacatcctgttgaggcatttttatcaaaaatccgaggaaaaggtgcgctgctaagagcctaagactctcacaaaggttacataaatcagtatggaactctatttatcaacgctttatcttgactgtagttgaggccaaagagagctgcaccagacaacctgaccccacagaacaacggcaaacaaccaagaggccctctctctgatggtggtggtagccaggcaactgcaagtggtagaagctaaaacgcagctgttgttctctccggcatctcttgtgctgctgaactgacagcatgcatgtcatactacctgtatgtatgtgtgtgtgcttgttcaggcatatgcttactagtagtgtcatcatctctcttgtgtgattgatcaaaagagctccccatgcatgtacatacaccctcatcctcagtgtcagtgcggcacctttgatacggaactagcactattgcagtcttttatgccgacactagcacaacttgatgaaaccatttttccctacataattgcctcagcgtcagctttccaaaggctgaaagtgatcattgcctctcttatctcttagcattaccttcttttgtcagattatattagtatggtacatatcaatcatgcaagctcacgcgcgtcgccctttttgtttccctttttttccctatccatctgtgaacgaagacgagtagacgacggcgtcggcgtctcgtgagaaagaccgagttccagtggaacgccgtcgtccgcgcgcgcgtgaggctggcccggcgcgttgtgcgctcgtggcgccgtgctgcgcgacgcgagtcgctgtccatggcagcggagcgtgcacggctcggcgtttgctatccagctaagcagcagcggccgccgcagaggacgtgagagacaccgcgcgtgacgggagccgtaacaacggcagcggccaactgcggatgggctatgggcatatttgagagagtttctggtagctaaacttctcctaaaacaaaacctttcgaaacaattcagctttttatttgaaatttaagaagttgcaattgcataattaaaaaaaaactagtagattcatatttctataaactgactaccaaccgattgtctttttagaatgttaagcttcatcaaacatgatcgaaatcgatgtaattccggccgtctggtcactaatcggacggtgcatatcgatggctacacaacgtatcagtatagtagcactcacggtgaaggctgggctgctggcagaagaagaatcgaatcgaaccgcgaggtgaacacgacgagttaaaggctggaccagaggccatggggggcgagctagccgcaacagactggcgcccgtgccttcttctagtacgtcgggctggttctattccatgtggcgttgccgccgtcgactggcccaccgggaaaaccccaacggcggcaacccgacaacctggtgccttgtggatattgctcgcgtccatttcggaacagctcaggtgttcacgaggtcgctacgctacaggacggagatcgcctgaagctatgtggacgtagacctcgacaatgcgtgtacctgtaccatggcatatgattgtgcattatcagcttgatgaagcagcagcagctgttcacaagtcatcacaacggcagtggcaggcttagctgcgtctttcaggttgttgagagactttgtgcaataattagactaaggcattaagcttatcaagataggtgaatgtttattcaattattctatcgaataaagtggggaaagggtgaagaacgcgtcagatatcacccaaaaatgtctctgtccaacaagatttagtatttgcggcagcctgtgccggataacctttcgctgtgcttttttttcctcttgtttttttctgccatcggttcatgaatcctccaagccgtttttttggccactagtgtgctgtgtcctgcactactctctcaactcacaagtcataactcaacctttttctaatggaagaatccatctctgaacatttccagggcacagtagctccaagctaaccgttgaaaaatgaaagaaacttctctcatgctattccacttcagtagtacagactgtacagtgtcaaataaatgaatcagcatgatcaaactaatttgtggcatggtatcatgttagtacttgaccattcattgcatacatggtgattgcacagtagttgttcgatcacgtattcacgtgatggtaggatcatcacctgctaattaatcagtactgtcagcggtcaagtttattagcacaagatccagagctggttggctgtaaaaaagaactaatgaatatactagtacgaaaaagtcacagcaactgaacatggaaacgaagattagtatttagatcaagacaaggcgaagcgacaagaactggcgcaaatgctgtgcagctgatcaccagatgcagtatagtggacaaaagcatttgccagcagaatatacaagtcccaagctctgcagccaactactaatggcgatcataaacaaagggttagatgcaggatggaagtgtgagatgagatgagatgcagaaaatggtcatgtgacatcatgtgcaagcaggcaccaaccattaggctacaagaagaaagcattacttctcccagtgcagtaaagcaggcagctggtatcaggagtggactggtaaaagatgcattagagcagacaactgtacttgcattaggtagaatcacattaacactgtaagcattagctggggcatagtcagtctcagtcacaacaccaccctacacttgtgtagtttataagtgtcaagtgtcatagaatgatgctcgagtataatacagtcaaaagagcaaggagagctggttatgagatccaacgagaggggaaaaaattatgtaatgacaacatggttaatattggcaatccctaatggcaatccatacaaactcatgttcaactgtagtgctgggctgttgtcatctgtaccgttggttctcacgcttgctgaagttcccgccatcccttgagctgtgtctgtccgatgtctgaggcgcatctcttccgggtttcttatcctgtatgatgaacaattgcaatcagaaaatgagttaactatactgtttagtaaatggaagaaatcaaaaagttcataagtgagtagaacatacatcgcggcatagtagatcatccatttcgagcatgtgaattacatgtcccattttaggcctcttgtggccatcaggatcgacgcagcgaagggcgaccagaagtgcccgtttcagtgctttgggagaaggcttctcgggcagcttggggtctactacctcctctgctttcctctcagcaaccatggtcttcagccattcaaccaagttcacctgaaaagaagacaatttagctccatcagatgccaacgatcctggaagagattcatgaaagaataggtaggatactgacctctccaggtgccctggtgtaatctactggtgatctacccgttataatctccattataagtactccaaagctataaacatcgctcctctcatttaacatccccgtgctggcgtattcaggtgccacgtaactgcaacatagccaatttcagtcatgataagatgtactaacttttatgtacagtaaaggttgtgtgtggattgtcaatactaacccaaaggttcccataacacgggtagtaacataacttctctctgagcacaatagcttcgcaagaccaaaatctgacactttagcattccattgctggtcaagaaggatattgctagatttgatgtcacgatggacaaccttcggttccagcccctcatgaagataggccagcctagagagcagaagttgggtgtcagtattcatgtgtttccctatcaaacccatcttttaaaagaactgttgatgttgtttaagcaagccactgacaatattgctttcaggcaaagaatattatcggtagagtgcttatcaatgcacatgatgctttaatctagattttaactgtcaaacagggtcacaatgttctagtccgaacgcatgtgcaaggtaagtatttagttatttacatgcagtatcttaaatctctatagagcgaatcaaaacaatctcagactgggtgctttgattaaaataaagcaagctggcaacaggaaagcaattaaaggacgaatgcaagatgagcacatgcaatgtccaagaaattcgacacctttactttggcgtttgtactatttaaatgcacatgaaattctaattgttttctgaacaaccaaatgatgcctaatgctaacaaagaaaaaaacatgttttttttttcgtatctgctaaacatgggttagaatcagctgtctttgggaatatgtgcatgctaaggaacacaacctaacaaacttgagtaaagcacctgaattcctacgacaatcaatttcaccagaattagactctactatcctaactatgatgcatgtctcacaacaaaacaagcctcccatgccagctagcacctgtcttctaaaatctgaatgatcatgacctatatttgcccataatattcataatctttaatgtcgaagtattaaacagaatcaggcaaggcataccaatataacactgttcaaggtacccactttggcaaaattggcgtgcaacagtgagagaagcattaccctttagcagttccaagaattatgttcatcctgacttcccaagttagtgggctcacttcccctacatcaccatgaagccattgatcaagattgccgttgtctacatattcatacacgagcatcctgttcaaccaaaacggcaatgtgagtaaaacatccattaatcagagagggaataataatgcacaaaattgatgaagagatttcattgtacctataagcgccctctacacagtagccgagcaatctaacgagattcttatgccgaacacgcccgatcgcttcaacctccaccttgaactccttctcagcctggcccctggcaaagcaggaaaacaatttgattttttgttgtcataaaacagaacaagaaaatgtgtgagaaaatgaaacggtaatccagtccctagaaagccgtgtaggattaaattgcgtcacagatatcgaggcgaatggggaatggagatgggcgcacagaagaggtaaatgatgacagcaatttgaaacttcttgagccccacgacccaaccgttcaccagcagaccactgcttcatgaataaactgaaacaagttgcacctctatgcacaaaaaatccgatcaaatacactagaaaaaaaaaaggatctttcccttcttcaaatggaaattcacagtttttgacagctcacttcctggtccatcagactgatcatatccaagtccaacaacccattatcgcagaagaagataagattagagatctgcgtatcaattcgatgaacaagaatacaaccggagcaaacagccaaagaaaccgatgaacaagaacacaaacacggttaaacagacgaaatcagtggcatttttacgaacaaacgaaatcacacaccccagtttaaacagaaagggaaaattgatttctttaaaaaataaaaaataaaaacgggtattcctaactatattctccatcctttctactcacccaaggacgaattctaggctatacaaggatggaaaggctggagatgtccaaatcaaatcgaaaagctccaagagaaggcacaggattagtacctattattgagtagattcttgacggcgaccatggcggaattctgcagcgtgcccttgtaaacaatcccgtagccgccttccccgatcacattctcctccgcgagcccgtcggttgcctcctcgagctcccggagagtgaaccaatggccccacccgaggtgcgacacctccggcccagccgagccgctcgccgtgctcctcggcgtggcgccgtcccgctcgctcccgccgctcgtcgtggccgacatgccgctggccgccgtcgaccgcgtggatcccgccggtagcaccggcggctgcgtccgctgcggcggcggcggagtctctgctttggcgagctgcaccccatgttgcgccgccggtggaggcggctgcggcggcgtcggcgtcggcgtctgctgctgccgctgctgccggcgaacgatctcctgtatgtccttcggcggcgtgggctgctggagatgctgcttgagaatcttggtgtcggccgggtacagattggatgcgaggtcatcgcggcgccggcgccggcgggagaggcagacgaagacgaggaccaggacgagcacgatggcggcgccgacggcgatgccgatgagcacccagaggcggagcccgaacaccgccgtgcgctgcgacagccacccgttgaggtacccggcgctccacaccgacgacggcgcgccctgctggtgccgcgaggggtgcggctggtgcggaggtgcctcggcgagcagcctcctctgagccgccatcgccgccacggggagctgatgaagcagagagagagagagagagagagagagagagagcgctttggcctccttggattctttggtcgctctgctttacataggcatgcgacttgacgacgagagagcggcgtggggagcgttctgggtaacttttgagttttgaggtggtgaggctagcgagtttgttgttaccgatttgagacgctcgtatgacaggtgggcccagtttgtcatgtggacccaccgacagtgagctaagaaaggagtagtgctgtagtagggacgatggtaatttggatatggtgtgcaccacaggtctacagcaccactgaaattcaatctctgagcaagagtgcatgtaaaccatatctatcttttcttttttaaaaaaaaattatacagtacaacacagacactcacaacgcacatgcactcacctctataaacacacgcaaaccctacccctatgagcatctccgaagactgggccggcaaatccattaggattgacgaagtcaccacaggcgtctcgctgtcgacaggtacgtcgcctaccactgaaagcacaataccgttaaatcctgaaaaattcattcccgtggggaatcgaacccaggatctcaggtgttactgagacttatttgacctattgttttctatttaaatactccgtcccaaaatataagacctcatcgattgcacatatatcataataagccaaaaacaacttattagagaatgaaagttaatttataggtaacacttttatatatgtgttattagcgacttaaaacccaatataaaaaactacattgaaaatatcttaaattcaacttaaaaattcaagttctggctttggttttgatttattaggacaaccaatggggctcatagctaccaagttgtcctgatctatagttgtactcctggagtaatagatagctatattttgggattgaggaagtaacaaaattattatattgtaaaactacatataaataaaaatgttcccatatgattgttatgtgtttcaaactaactgtttttagagctattgacggttaaattttcaaagatataaccgaataatctcatatattcaaatatggatagagcaattgtcatgaaaaacataatgatgcaatttctaaaaactacaaaagcaatggtaagagggcaaattctttgcaaccaatattaaagacttttaaaggggtatagatgaattgaaacttatgattgacagtacacgagatacatgacaattgcgcaaccgcccttaatcttccacaacactgagttaaaatatagtaatgactatatcgcgcatcccacgcattgtaatgagattttataacttctttaccgatactcatcagtttaatggctaatacggaggaagtatgatctattggttgacatagttactagatggtatggccaaacgtgagagctcctttctactttctctgttctaaaatattctaaaatatagttatttttatctgaataatatatagctataattattttaacttcaaacgaagggagcagcaattaatacaatgaggagttgaatagaggataagactggaaattatgcgttttgttcaagccgtagctcttccttagtatccgaaagtgactagggagtgtttgaagagaaggggattgaggagattgggaagatacgcaaaacgaggtaagccattagctcatgattaattgagtattaactattttaaatttcaaaaatggattaatatgattttttaaagcaactttcctattgaaattttttgcaaaaaacgcaccgtttagtagtttgaaaagcgtgcgcgcggaaaacgatagacaatctctcctatctccacctaacgaacactcccaagggtatgtgtagttagggaaaagagaatttttgggtgttacatggaacatttgaccggatgtcggaaggggttttcggatacgaatgaaaaaactaatttcagaactcgcctggaaaccgcgagacgaatctcttgagactaattaagccgtcattagcacatgtggttactgtagcacttatggctaatcacggactaattaggcttaaaagattcgtctcgcgatttcctccataactgtgcaattagtttttctttttatatatatttaatgcttatgtatatgtccaaagattcgatgcgatgtttttgggaaaaaattttgggaactaaacggggcctaatatgtggagacaaatcaacaatcagaggataatttccccttgcattactaggacagacggtcaggagtgaggaccaccacctcgttgcaaacttgtgtgtgccggggccccttgtgatttggattctggagaggagttaggtgacgtgcgcttccaagattagcattggctgtcagctagctgcgtgacagctcggcggcacggcgacgtcgagccgtcagtcagtcggccgtccgctttcaaagttgagccgcgcgcaccgcactgcactgcaccaacggaatgtgggggtgtgtgtgctggtcgtgcgcgctctgacgcagacgcatgcagggccaagcaaaaaagagctccacccttttccttctccatttgacatggactcgtggagagatagagagagaaggcttcgaatatttggtagtatcaccttcacactgttctactattgtgttattaaatcatagtagtaattagcagtcgtacccatttgcagattttctcaattggcggccgggctccctgaggatacagtctggctggtgatgttcatgtggctgatagcgtcatcgcgatgagtgggtttctttaagatgtacgcaagctacggctcggaattgccattcaggcattcacacgatagtcatggcaagtctaataccaaaagaatggtacacgacacctggcagcgcctccgttgcgtatgtgcaattacgaggctgtgtactctaatcacgataataatcatggccttcttactagtactgttccagtgcgtcctgctactgtgctacgcagtaatcatcacgccgggccagccaaagcatatatgctccgatcaccattcaggcgatcactgattcgttcacacaatcagacccccggaccccggctcgctccggctgctcgatcggatgccttacgtgcaacgccaaccacggggtgtagcaacgcaacagaaggccattttgtccccatataccccgacgtacaagccgttcacgttccacgacccgacccacgagcgcgtgcgtaaattccttttgcttctcgcggacgacatgacatgaggacgagtaaaactcacgcccccacaacgtcgtacaggtccatgactcgtgtgctccgcccgatacgacgcgatgcgtccggtgatattttttttctttttagcatggcgtcgcgactcgcggcacgcagccacgggcacacgacgtgcgcgcgcgcgctgcaacctgcggctgcggcgttcgctcgattcggcgcaggcgcgcagcgagcgcgagagccgcacgagcacgaggagacgcaggaggatgcggggacggaacggtggctgcgtcgcgtgtttgccaatgttggccgagatgcgcgcggcgcgcggatgatccgagcaaaagagggcaattttttaactgttgacgcatcacatgggaaggacgtacggggaaaaaacggataccgtacctgtcacgacgtaggattattggattatgctttggacaagccttccttcctttttccagtttctaccattattttcgtcttctttgcccaggcggcagcggagaaggaacacactttcttttcacgctgttcatgaccaaagctgctgtaagtagtactaccttcgtctcgcgaccaactttgatcgttcgtcttatttaattttttttataattagcatttttgttgttatgagatgataaaacaagaatagtactttactcgtggcttatgttttcaaattttttcaaaaaattttcagataagacgaacggtcaaagttgggcgcggaaaaccatggctgtacttattttgggacggagcaagtactacctccgtcccaaaaaaagaaaaaccctggtttccgtgttcaacgtttgaccgtccgttttatttgaaagaaattatgaaaaaaattaaaaagacaagtcacacataaaatattaatcatgttttatcatctaacaacaatgaaaatacgaattataaaaaatttcatgtaagacggacagtcaaagttggacacggaaacccagggtttgtcttttttttttttttgacggagggagtacaagttttacaaggtcagaacgtataagtatgacgtcgtcatggtcaagcgacagggctacaggagaacatggcagattatgagaataaagtcaagtcatagacagggttaaagtctggtgccgcagcatcaggggacagggtactttctaggagtatctcaatggccatttaaattttcaagcaacagaaattattccttacgtatggaaggaacaaacagcaaatactctgcttgagaatcacttcacaagaaagaaattttaaatcgacttcataatcacaggtacggccgtgtaattgattagtactccccctaacaaaatactatacccattaaaaaataatagatgaaccaaacaaattaagagaagagtatattgtactccttcaatcccaaaatacaagaagttttagttggatgagacacatcctaatccgtaagactactgttaagattcgtagtattatgacatgtctcattcaaccaaaactctttacattttgggacggaggaattacatagcattgggtagagcatatctttgtttggctttgcaccagctttagtacatattttgacttccatgcaggtatattattctagattgcagcacataattgaaagaaaatcttataaaacacaagtggaatttatggacccattcaaatttagaacatgtttcacaaagttttattcaaattttatataagttagtgaattttctataggtttgatgatgtatcctaacataaagtgaaacttatttcaatattctctccgtcctaatataagtgcacctaagatcggatgtgacatttcatataagtgttctataaaatgtcacacccaatactaagtgcactttttattgagacggagggagtacaactgataaaaactgaaagtatgtgctaaaattagtacaaagcaaaaataggtgcgttttaccagtgtaaagtgcaatttactcttgagaaaacgttgggtggtgaattctagcagcatcagtctcatataggagtacatcgtgtgactgattcataaggtactatgagtaagaatagtaacttcgaagttggaagctgaaggtaaataaattttgtattgaaactgcagctaactatgtccttctgttgttgagcaaaaggcaaaagtataaattacacagggtacaagcctaaaagtcattgtgtcatttacattgatgccagtttggtccagtataattcaaacagttcatagtgcaccgtcaccaccaaatttttatggtagtttgattagcaaatgttgcatataattatagtcattacatggcgggtgacaacagattttatcccatgtattgccagaaaatgaatgtaactattcaattacgatatcacttcaaaataacacagctagttcaaagtacacgtagtgacttgacaaggattaagaaacctttgtatcccacaggaagaagcatactaatctagcagaagaaatcaactgcaccgggaagaactgaaaatttggttggaagaaaaccaaaatgctccccatcagattgcacaaagatgtcagcactaacttccttttctgctacttcaatcgactgaactctgcgacaaaaatattgtcacttagtgaccccaaatagaatacccagttaaacagcctaatagtgatgttagctattttgagaaggcttaacaaacattgaatcctgttttagaactaatgagacacatatcaggaggaaagcaatagaggcatagagctcgaataaatattcctcaacaattttgattgccatcatgtcattgcaaaactaccagtgatgatgctaacaagattaatctgtccggagatctgacctatatgccaaataacaactgaagggttattggatgaaaccaaccagaagtacaacccttaactcagcattgtttaaagtaagtagagcaacactaagattcattagcggagtccccttaccttatcgatgacacaccagtcactgatagatgagttcctccatacaatctatgaagcttgagcaggaaatcatgccatttgaaatcttgaagaataacgacctatgaaatgacacataaattaacaaaggctaacttttcttaatgcttactcaaaactataaagaaaaatgactttttaggcacctcaaggtcacccccgaaaggatcagctgttggagtgatcttcataccaccgccgaagtatttggcatttcctatgcatagtgcagtgactttacgaatggttttccattctccaccatttacctattatatgcactagtaaattcaagaggtgtgggactgataatgacgaaaaaaatcagtaagattgcaactaagcttccttctaaaaccagtgcgatgcaaacctttattctaagatctcgattactatgtccccaaaaggctctgagcgctccaaaaacatagcataagttgccaaatctcttgtacatagaagaaaaataacccgccttagcactcctgcaggtgcagagcaattttttccttttcaaaccatccattgaatttcacaggtcaaatgagccatgcttgacttacaaatggatatcagcaacattaacaaaataatgtgggtttccatctgggccttccatcatacctatatctagttttgatttgactcctgcaaaaatatgcacctgtgagcctcatatgttatgattgcgaattcgtagtagacataaatctagtttttgtatattttcatgaagatggccagtttataatagcaatttcattgttatgcttccaaaaactttatttcaaatcttttaagacaaacccaatcacctggctagtcatatgacaactggtactttaataatgttactgtgcattcatatacatataccaggagatgaatgaccactatgagaccacgagtatggactgacagcacacactataaaagaagaatcaaagaaggaacctctcacaattcgatcaatcgcctcatgaggatcatttgtcctggttgcacaaaagaaagaaacatcagtgaaagtagaggttatctaaacaccatatgtagattatgctggagaaatataccagccaaatgtccttgcaaagtctgaaccagttccaagtggaatgagctgtcagagaaaaacaatccgcttcactaccgaacaaattccagtgcataaacaaacatttcagttcagaatagtctaatgcttaatttaagaggctagaagggtgatctgattggatagaatagctagaaactaagtacactcacaccaagcgctgtggaatgatcaggtccttgatcaagagcatggacaggacttcccttacagaagaagccattgacgacctgcacattccatccacaaatattaccgtatttgaatatcaagtttctggacaaatttagtacaaaggttgtatccatattgcaaaagtcaacacaaataatacctcatgaagtgttccatcaccaccaacagcaatcacggcatcagccccatcctttacagcctacatcatcatcatcatacacacattgtaacaagaaaaccaaaaggggaaattaacaattggatactggcagctataggaagcccatacacacctccctcgtgatatctatggcgtcgaacggggccgaggtgatgcactcacaaatctgatcacgcaataccaacaaatcagaacattccgtagagcccccaaattagcatggggatctgatcccaaatatggtctcatacagcaattgcagcttccggttcaggatgctacgatccagggatctaagagaaatcgaaagtcttacatcgcattggtcagcgaagcgggtgcggaggtgcgggagcagctgcttccactggttgcccgtgcggccattggcgcctgcgacgacgtgaagggcgttgagagcgcgcataggatagggggtaagggtagcggggtggaggaggggggagtaccggaggggttgacgacgaagacgaagttgcggcggcggcgggaggagacggtggcggcggcggcgcggtcggacgcgaggccgacggcggccggctgggagtgggaggcgacgctcgcggcaggatccgcgacggcctcggcgtcgctggcgcgaccatgaatgacttcgctgcttatcccgaattcccccgaccaatgcgcatcgcctcaagacgccgggccgccgcctaccgctgtgaacgaagctgactatgcgaatgtaaagtgccacgtggcaggtcagtagaaatgtacaatcaccagggtttgtgtatatcttatctggtgaaattaaaacagtactactccctctattccataatataatacaaagctcgatcaaagttgatacggtcttcaaaactaatctttttccttctaacttctcatatattataaccttatgaaagtaaatttaaatatcaatacaacaatattttttttaacaaataaaatatatttttaactagcatgacgaattaatcaggcaaaatcatcagggggtggcaccggtttcagataataacaaaatcaatgtgcaaaaaacatgttctaaaagtagagcgcctctgaacgttggcacaaactagctccaatcatataccacacgctccaaacagaagtataataattgaagatacaccagctaatacaccagctaaggtacaatattgacgtgcattggtattcagaaccggctgccaaacatttgctgtagggaaatgaacgatgaaaatcaaatgtgctcaacagtgtacacacaattagcatctcagccgttcgtaagttttgcaaaatttgaccccccatgcgtgaggggtattacttcttacatctataccgcagagcatactgtgctccgtactttcgtacactcatcagaagcacgaatagcctaatatgaccacaatggcttcatgtcacacccgaacggcttcgtaatttacgatacaagctgaacccgtttgcccccccccaattttccagatatgtggagatgtttctgctctccttggagctgcaaaatagacagaaaaaggttacataaggctattacaccgctgcccagtagcaacatgtagctcaatagagcttctgttctaattcaatgaggtcacgctgatgatacaatggctatggtgaagatcccaacaagttacattgcaaccaaatctgctatctgtttttctttatgcaactacataccataccttctatagtaggtgctccctaattactccataacgaaagagagaaagatcgcaaagcctctgccaaatgaaaaagaaaacccgtaccttcctctttaagaacaatagagcttcacgcctacaagagaagttggagaacatagactctgaatgtgcttcaacagctaccttaagttccttcaatttcatagattgtgctggggcctgggaataatacaagtaaataaacgttgtgattacggcacaa

SEQ ID NO: 45121 - DNA, 9378 bp, Oryza sativa
tatgtgccaagagctgtatgttggtagcttgaacccggtgatgtgtcattgcaattgcggtggttgcttattgtaaggatgatcggcgatcgttataatcaagtaaatatacgtcgtgattccggcacaacacatgaagccacatacagagagtatgataattaaacaaccatacctgacgaagaattgttttgcaaagtttcttgaccttggttttatgtttttgtttaacatccacgcacatttctttcacagtattcacattggcgtctattagttcattatcgttagcagattcttcctcatcaccatcttcttccaactctgataattcattggattgggttgaattttcctcatcgctatcaccaaaagaagttttgttccctttccaacggtgtccggcaactttaattggcagacccttaatgccaagaccctgctttccagatgtggctttgtcctgcagcagttacaaagaccatttagatggaatggatattattgagaactcagctatatctatatgtttttaaatacatcagatttgttcgataatcaatcaacagaggtctaaattgactttgcaatttcaggccaaactgtaagaaaaatatagaattcaaaggcaagttgcttatatgtggttaaaaagtctctaaaagcacattaagaaatggacagtcttgttataggacattatgggagatctgatagactgttaataccaacctgaacaagattgtataggttttcttggtcttcttccccaaatgtctggcggacatttgaagtaccttttgtagcagaagatttgttcttgcgcgattttgctcctagaaagccgcctgacttgaatccaaatttatgcccccaccagttcacatcatcagcttgcgatactgaacagagagttgtcatgaactattagtaaaatctcaatgatattagtctatggtctcaaaagaagattacatatttagagtaacaaatttatcagaatcatttcaatccaaaccaagcatcagaccatgtgcagtacaaccaatcaggtagtcacaattcaaaccattagtgaagagagaaagattagagagcaaataaaatgtgctttactctggtaagcaattagcaacttagatgctacatggtagatctcgtctagtagagaaccaaaattaacagtatatgagtataatcagcagagctttaccatttagctgttcagtgacttgtatgcagtgtgtcacattctagttctaaaagtttggcacctcagtcctggctcagaccaagaagcaatgatggggaaactaaacatgcaaattacagacctgtatcttgacagatgatgggatcaggttcatcacagcatgttggttcaacttcctggtccactttgcaattgtcatcacttttgcgaacctgtgcaaacacaatatttcatgcatgtaataaagtaagttacacagtttacacaggtgcacaagaaaaaaattgctcatggatagtaactagattagctaagaaagaaataggcacacataagaataacaactcacaagtatgccttcaagatcttttgctgaataaccgctcacacttttccccctctctcttttcttatatctgaaataagtattgcgtaaactgtaaagagaagaaaaaatagatacagaaatacaaatactgaagctatgggagcaaaccaaccttccttggggtcgggtaactttggtaacttcattgtttgttggtttagcttcctttggtgtactatctggtgaattgcttacatcatcttcaaattctgctacaccaaaaatgttatcaaacaacacctaacaagatgaaaataagaactatacgcacaaacaccgtcaggtaccttttatagcaggagtagcggattgctgccaaagaagatgggagcaacgatcaaatgacaagaaaaagataataggaaacaattaggaactgaaataatgaccaatttatacatagagcaaacaaagtaattgttacacgccataccactttcagtttctttagtatattgtcaaattgggtggtgtcatatacccatttgttatgaggactgtctacaccaacacctgcagaaacgatcagattaggtttaagagagcccacgggtggttaacaaggatatatatccttacaaatagacttctaaagtagaagatctatatagaaacataccaagagtgtcctgcttgtttttcactctaacatgccccttaatgccttgcttatctttaccaaggccttcaccttcttcccacccctaaagcataatgaaaaaaaaaatgctaactacactttaaaatcagtaaaaagagaacaaatctaaattacagaaaaatcagtataatctgacgaaataaacttgtttatggagtgcaaaccaccattccattcacgttactcatttggttcgattagaaatattaactacactaaattcaatctatgtgcagccataactcgtgaagaatgtgaatttcaactcctttccaaaatccaagccaagttcactcgtttgcggcagttcccaaattccactccgtagcattaacaaacgttgctagttacaattcaacaggaacaacaacagcaactccttcagactccatatccgacaggatcaaccgatgttaaccaacataaacctacgtctagcaatagcatactgcatgccccaacgcatgaggaaaactttgaattaggtagtatcacgcaccatttgcttcatgaggcggaaggcggcggactgccgcgcgatcccaacgtagcaggagggtgcctccggggcggccatggcgcctgcgctgcgcggggtcgacgcggccttcgccgccgcctgaacggtgaggctgcgttgccggacggggagagaggggaggaggagagggaaaccctaggatgcacggctcaggggttttgaggcagccgatgattttgcctggagattcccgctcgggttggtgagcctcgataacgggccgtgccgtataggcccggagttgctatacggtgggctctggaaaggtcggtgattggttgcccaggctgggccttagtaatttgcagttgggtgggttttctttcacatgggccatccttgtgatggattgtcttgggccgttcggttcacttattgctaccttccagtatccttcctgattgaaggtgaaatctatagatcgctttctggaaaggaaaatctgtagaaattgttgctcctttgcctaccgatggggtcatggaacgatcagtgcttgagaattggaattcagattgaacttgaagaacacgacaatgacaatgggagggtggaggaaaattactgaagaagcgaatgtctattatcattcagacttagagtaacactgagatctgcccgacaaatgtatatcgcggtttcagcatgccaagctgcaaattttgccctgcgatcaataacaaacagatacggttagctaccggctgcccctgcgtgcaaaaaatgctctggaagtttgttcttgtgctttaaccatattttattcaatatatgatgactaattaaccttgtttaataaagtggctgtagtttagtggtgagaattccacgttgtggccgtggagacctgggctcgaatcccagcagccacacttataaatttttttaaacaagtctggttttgtcctagtattttttatatttaaatttgtcccactactttttaagtatggttttgtcctagtattttttatatttaaatttgtcccactactttttaagtatggttttgtcctagtattttttatattttaaacaagtctggttttgtcctagtatttttatatttaaatttgtcccactactttttaagtatggttttgtcctagtattttttaatttaaatttgtcccacaacatttgtcataatatagtattattaattgtctcatcaattacttatcatttaattttttttctattttacccttaacaaccattcaacttttacctttttttgctacatgtttggtattgtcctagtattactacctccatctcataataattatatttctatgatttaatttttcttacaacatttgtcataataaaatattcttaattgtcccatcatttacttatcattaaaattatttcctattattaatgcgaggcataataatctttcttcacaaatcttaatacatgctaaacaacctagacttatatttgttcggggcggagttagtatatactgcattcgttccaagataagtgtagccatggatattcgtatccaacgtttgtctgtctgtattatttgaaaaaattatgaaaaaaaagactcacgtataaagtactattcatattttatcatttaataataataaaaatactaataaaaaattcaagtaagatgaacagacattgaacatgaatagtgcaaaactatatttattttgagacggatggagtacttaggtggtattagttggcccatgttttattttatttttctactacaagtttaatcgctctgtcaaaaaaaattaattctagagataaatctggattgcatgtattcagaatccagatttgtccttagaattggacctttttttttttttgacagaggggtagttgctttgcattttttttacttgggacatgtattgattacatgtttgttagttattttatttagtagtacaacgtctagctgctttgtacttttttaacttaattagtacatgtttagttaccttgttcttttttatacttattagcacgtgtattaatttcatgcttattattttacttatacatgtttagtttatttctacttttttttctcagctagtacatgtttagttgcttctacttagggtgtgttcggacaccccttttccaacccctctctctcgttttccgcgcgtacgctttttaaactgttaaacggtgcgttttttgaaaaagtttttatacaaaagtttctttaaaaaaatcaaattaatcttttttttaaaaaaaaaaatagctaatacttaattaatcacgcgctaatggatcgctccgttttccgtacggagggttctggttgggaaccttaaatagcgaacacatgtggttcaggtttttttagtacatttattttatgaatgggtaaaagaaatgtgcttctacttcgtacctgttttacttagtgcatgtttagctttttgacttggtagttcatgtttttagcgtgtttagctttactttttttttttgctttgctatattgttttacttggcagtacatgttttagattgtttagctttcatgccaaacaaaaaagattgtttagctttacttagtacatgtttggttcttttatttaatttcatagcttgtttagcttcacttcggcctcgtttattttttcgtttagcaattacaactctttgtcttctataagcatgttttctaaacgactaaatgatttttctaaaaataacttttttatatagaaatttctttaaaagtcaaatgaagttatctttcaagctttgtaataattaatactcaattaattatgttaatggactttgtttcgtacttttattctgttaaaattatgtgttttttattcatctattttttttaatattatatacgtttcaaaggtgcccctagtttttcaaaggtgccgctaaaacatgtactgttggtactatacatgtttagcgtgttaagcatgagtttgagaacttgagtcgcttttttcttcttcttttactaaaaacatgctttagcgcttttagtactgctactctatctctttcaaaatatagcaactttgtactggataggatatattctaatacaataaatctgaacatacaagattgattgttgttatattttaagacggagagagtatatgttttgccgctcttcttttatttttcttgcacatgcttagcgtgtttagtggtatgagctgttgtcaattttcagagaacaatagatgcttcattccttttccttttactccatggagtagaaaccaattagttaactgctcgatcgactgcagctaagcagatagcaaagatatttgtcctcaaagccatcccgatccatcaatcaatccgtagtactccttccgtcctctaatataacgtattttaacttgcttgtactgttttgatcattcgtctcatttaaaaaaatttagaattattatttattttatttgtgacttactttattatctaaagtactttaaacacaattttttattttttatatttgtataatttttttaataaaataaatgattaaatagtacaaacaaaatattaaaatcaaagacggaggagtagtagtcgattgctgtcgtagacaggtgagactgtgagaaacgtggacgacgacccgcacacacacattcggtcatttgcatactccgtatgcgatattgccatattccattatccgtccatttcagggttcacacttcacgctatcaggctaccgcgaaaatggaataggtggcactgttacggcagcttggagatccaaatcatccaaaagtttcccccaattaaaaaactcaccgcgcgtttgaccaccacgtccacctccgaaaaccagttatcctaaatcccccgtcgggtacgtgtcgccgagcgcgagcaaccgcggcgcggccgcccccactacggcgaggctcccgtcgccgtcaggtggcctctcgtcgcgcgtcgccatcggcaccacgagagcactcgtatattccgtcgtgtttgtaccgaaccaccgatcaccaggtaagcaggtagcgaaacgatgagacttgactacaccagggcgaaggtaaaagatctagatgtctcttcttgcgagtataatcaagggggatagtagtagggcttcgtaaatagtcatatagcccagtggttatagtgatctgagtagcatctaaggttctgagtaaaagtagtagggttccccttaccgtttttaatacggttaccgaactcccgcggtaagatggttaccgcgcggtaaccgtaagacataccgtggttttaaaaactacaaaggttatcgtgcatggtaatcgtaataaccgtgtgttaatcgtgtggttttgtaaacccctaatagtagatcgttgaggttgaagcggtttggttctttttccatctttttcatggggtgcccaattcacgagtgggaggtgctgagctgctgaagcgtgactgcagcgggaggaaagcgtgggcgtcggcaagtgcggtgggtacatgccagtggccacgtagtggggcggcgagcagcagcattcgccgggcaaacgctcgcgtcgggacgctgccctgacacgtacacaccccttccatggcctacggcgttcgtagggcaggcagccacattcctattctggataagcgaacatgatcaggtggagttcgtactttagaaagatgttctatcctctccaattttttaacgacaaaggaaaggagctatgcctaaaagaagaagtgtggtggtaaaaattattgtgcccagcaagcattggccatggcatgcatggagcagaacgatgatgagctagaacatgaactacatacagatctcagttagggtttacgttttttcacgaaaaccgatagtaaatctcagaatttttgaggtttggatacttgatgaaagtatatgctgaaagagattttgaatagttttcaagaatttagatatataataaacagccaattcccgataagaaaatgatgaaaaatgtcgcacctttataagtcagaccagaatcgagcgctcaatcgaaaggtgaactccgacgcttgagatcaggggtcaggagtaactcgttgtgatggcgacgcagcggaggacggctcgccggcgcggtgtatagctgaccagaagctgcgtgcgcggatgcgttgagacggccacgtggcgaatcaggtgccctgaacctgcaatgtcattttccactgcccctgacgccgcggtagctcaggcaagcggcctcaacctggccaatcacccagcggcaacgagataaccccagcttcaggaaagaccttaatctccaatacaccaattgctgatgatctgagaataattccattccaaaatatgcatgactcagctcgcatccgcatcgtgcattcgtgcctactccctccagaaaaaaaaaacaacctaaaatagaatgtgacatattctaatacaacatatatagacagaggtatatccagatacattgtattataatttataccatcttaaacagagggagtaatgaggggctgtttagatgggactaaaaactttttagtccgtgtcacatcggatgtttggacactaatttggagtgttaaaaatatgctaataaaaaactaatttcataaattagagctaattcgtgagacgaattttttaagtctaattaatctataattataaaaaatttactgtagcatcacattgtcaaatcatgacataattaggctcaaaagatttgtctcgtgaattagtataaggttatataattggttttataattaatctatatttaatactctaaattagtgtcaacgtgaataagtcgctgtttccacatggcccctgatactcctatataaaagccaccgggtccgagccggcgttcctcacgaatttccatgctcacaatcacaagttgactcgtgacgacggcgactccatccgacccacttgtcttggacgacgcctctcgctccccgaggcggacgcggaccgcttcacccgcccaatcaaaaccgtccatccatccccgcgtccgcgttcgcgtaggctgcggctgcggcatccatggccgtcgcgaggctggtggccgcgcgggcccctctcctctcccccgccgcggtggcggcggcacaccgatcgcccccggcgctgctgcggctggcgttcgcgccgctcccggcgcggcggctggccgtccccttgcgcgtggcggtgggtgagccggagccggaggaggatgcgcggagggcggtggcggagcgcgcggcgcggaagcagtcggagcggcggacgtacctggtggcagcggtgatgtccagcctcgggatcacgtccatggccgccgccgccgtctactaccgcttcgcctggcaaatggaggtaggtaacacgccatcgccaaactcccgctcgcatcttaccattacccaattcggcaattccttcgccgcagcactaaaatttctccgcgtgctcgaccagggcagcggcgagatcccggtcacggaaatgttcggcaccttcgcgctatcggtgggcgccgcgg

SEQ ID NO: 45122 - DNA, 25400 bp, Oryza sativa
gtcgctgtggcacatgcacgagtcgcaccaccgcccgcgagacgggccgttcgagctcaacgacgtcttcgccatcaccaacgccgtcccggccatgtccctcctcgcctacggcttcttcacccgcggcctcgtccccggcctctgcttcggcgcggtgagtggtcgatcctcctccatttcaaccaaatccccatcacttctctcaaacacactgtaccaggatttgaccaagcgtgcttaacgtggccgtattaaaatgacaaaagtgcatgatgtagtactatgttcagttgattacattcacattccatggccgcctgccaaaaaaaaatgaatttatctgtcaagagaagccaaagcgtagagcgaactccaaaagatcttgatgtccttgctgcatcggataaacaataaaaaattgaacattcgagatcgagaaaatttagaaaaacggagtggcctggcctccatgagttcccagagaaacctataatggattctaatatctttgagggatgttatctcgtatatttttctctttcaaattcgatacaaatagttatgaatttttttttttaaaaagtaataatgtagagtatagtgagatctatcagtccaccaaaaattatgttcaacttccatatacacaacacgaataaaagaaaagataattcagatgtgaacattacgctactaatcatacattgaatttaattttttatatctcaacgtgtgagttgagtttgaatataagattttatgtagttgcacagatatgttatctgagtgttgtcaaaaaatttcataacctttggatattctgtaagcaaatgagagaacatccctcgaatgattaaatagttccccctataacgtagattgtactaaagcaataggtattgttgtcgcattgcgacggcgccatggtcacccatgcgaggtacccatcaacggtctcaccggaacaagtaaaatacaagcgctagcagcgtttctttttgttcaatttgattgccaaggttgaatttttgtgatctggggctctgggcagagatgatccaagtgctgacgtgtccgttcgccgcagggactcgggatcacgctgttcgggatggcgtacatgttcgtccacgacggcctggtccaccgccgcttcccggtggggcccatcgccaacgtgccctacttccggcgggtcgccgccgcccaccaggtccggcccggtcgctctccacctaactgcagccgaccacgcatccctgtctctgagcttctcttgccgtggttctgaatttatgtgagctgatccatccttgcctgccattcattcttgcagatacatcacatggacaagttcgaaggtgtgccatatgggctgttccttggtcccaaggtgaggagatgtgtctcatgctattcatgctttgcttcctcgtgccccatgctaccatggatgcttgttggcttactcctgctccaacggtgtccatttgtcgagtagtttgcatacttgcagtactcctttattgcaagcatgaatttgtgattgggaagctaatgtagaatttgaactgtgttgatataaaaggactggaaattttgaaatgttctaagatgtattacaaatatttgtgatcgtcggaaaaattgtctgaaatgttctaaaatgtctctgttttatgtggttgacaggagctggaggaggtgggtgggattgaggagctggagaaggagatcaagaggaggattaagaggaaagagaccttagatgcgatccaatgagagctacttatcacacatttttttctttttatttgctgtcatctcttattagtttttgcttcagtggcaattgtagccttgtaatatgcttttctgtcctgttaatagaagaataatttagatagatatttggaagctcatttggacggtggagcacacaggtattagaaatgatgtgctggggctgaatggctgatgcttttgctagtactgctggtaatgatatatattaatcagtaccattctgaatttattagtctggttgagtcgtgctgctgacagtgaggtgttcactgataaaatgtgtactttcttttatattctttatttgccgacattctgtatctcttgttcacgagatgtgccggatgtaaatatgaaagtgatgcatggctgattactttttgaccgtgaagaagaattaatgaagcttatgcacactaggcggttcctccatactgctgaatggctgttcattaaggccctgacaagtgacaaggtcacagactgacagttacttcttgaggtcaaggaggttaatgtagtttatcaggattaggttgcaaactgacaaggaagatattgtccgttgtgtttctactcttggtgtcaagtcgatcctcacaggatcacggtcgtggcattgctggtccttggtagaacaaggtagggcaagcgcaatgttgtgatctgggacctttcaaatcagatcctagtgattgtcccctggttataaagaactgcatgttacggttactgcatgattagttaggcataagcatgtgacgaggatcctcgtcgtgatattccgtccatttttcaatgttgatcaagcgtggcagatctcctgctgatctgccagcaactgttgctaggttcagagtttgcttgatcttgtttaagctcttcatcggcgttttttatgtttgaagtcatcgtttaatggcatactactactatactagtgatgtcctgtagtgcattagaaaatacagaatgggccacatactcaaacactgttaccggttgaccaaaacaaggcatatatcgaaattcacacactgcagacttgcagttgttgactcatgtaactttacccttctcttaggccgtgtttagttcacccccaactcaacggttttgatgggcctaaggcccaaatcaacggttttgatgggcctaaggcctgaaaccatgtcgaacagttcgatgggccgaaccatgacgagaaagcccacctgcgacactggacagcaacggcagccagccacagccaactcgccttatcccgtaatccatccatggcataaagctccctcctcagctcccacctccgtctccgcgcacgctccaatggcggccacggctgtgaccctgccgtcctcgccggcccccttccccgtcaccaccaccgcctcctcctcccgtaacgtccgcctcctcctccgctccccgcctcctcgccgagccctccgcgtcgccgcctccgccgcggccgacgcgccacccaagccggcgccgccgccgacctcgccttcgggcatcgtcctcgtcgaccccaccgaggcacagaaggtgcaccgcctcaaggctgtatacgaccagaaggtggtccccctcatcaccgaggagttcggctacaccaatgtccaccaggtgttcgacctctgtctcccttctcgcaattataggatagacatggccatttctttgcggaactcgggaaattcgattgttgttcaataattgagcttagaggagtgtgttttggattctcgattttattcaggtgcccaaggttgagaagattgtagtgaattgcgggttgggggctgaagccggtaactccaaggggctcgaatccgccatgaaggacctcgccatgatcaccggccagtggcccgtcaagacgaaggccaagaagtccgtcgccagtttcaagatccgcgaggggaacaccattggtattgccgttacgctccgcggcagggtgagtcctctgtacctctggctacttgcgatgcagacattgacaaattggggactgcaatgttgtatcaatttgggatttgcatgacagtataatagcctaaagtatgtgtgagaattgcaattactccatccagttccaaattattgtcaccgttggccgtcagtattttacattgaccacaaattttaaatggttggacgaacgaaagtttaatacctatctatgtggagtaacaacctttaataatatggcatatttttaggtatatgcattttattttctaaaaaatataagtgatcaaagttcaaatatgaatagtatccagtgacaagtatttgggaacctagggaatatgtttgatcgatgagcttattttggcttgctgcaggtaatgttcaacttcctggataggctcatcaaccttgggcttcctaggaccatggacttccttggtgtcaaccccaacagctttgatggccatggcaacttcaccataggccttcgtgatcagggcgtgttcccggagatcccgtacgaggtcggtgggaagaagaatggaatggacgtctgcatcgtcaccaccgcgaagaccgacaacgaggctctcaggctgctcaccctccttggcatgccgttcgcggagcacatcaagtcctccgtggtgatccggaagaagaggttgaagcgccaccacttcatgagcaagggcaggggaagacggtgattgcaaaccgctgcctaggcacgttgagctttgcttctcactttgtcaattgtcattgtttttgcaaagtttcgtttagaagtttgatgattttgttatcttgtcacgtgctgtatttactgtcagaagacaaaatgaaaaggctttgctttggtcaggtcattcgcagatgagcactcataaatgaattgggtgtaaagagattatccggcagcattttcaaactgcttaactttactcactaaaccacatcatatatatctctttggtcccaagcatctcatagcccaggccattacccacaccatactatcatcctatatcagtatttcagtagctacacgttggcaattcaggcggaccgatgacgagctcttcttcagggaaggcgcatggcttgcccgccgccccgagctccgggcacggcaccggcgagacgtcggaggcgacacccttgacatcggtgcagttccattgcagcttcttggcgtccggcgcgagctgcgcggtgacgttggacatgcagatgccagtgtaggggtcgttgggaatcccctccatcctgccggccatggtgacgttctccgcgaacacgtcgctgtagttgatgccggtgacctccggcagagcgttggggtcggaggagttgtccgggtgctggccgtagttgccggtcatccagaacacccacttcatggtgtggaggctgaggccgcggacgaacacgtccttgacgtagccgccgcgccccacgccggacttgatcctgacggccgactcggtgtcgatggcgacgttgtccacggcgcgcacgtcgcggatgccgccggacatctcgctgccgagcgcgatcatggcgctcgtcggggagatgcaggtgagcctcctgatgaggatgtgctggctcggcatgttgaacttgatgccgtactggtcccagccgctcttcacggcgatgcagtcgtcgccggacacgatgtagctgtcctcgatcttgacatgggaggaagaatctgcaccatggacaacaagagctcatcacatctagcacaaaccaatgctttcctcatggcagcattgatcaagtgcagtgtgacttgtatgtttatacctgggtcgattccatcggtgttgggcgagttgagaggtgctagaatggtgatgccgctgatggtcacattgctggcgcagcacggaacacaaagaaggtgagcatcatgatctatatctaaccgttcagaaactgaattctggttgcgagtactgatgattcttacgtgcagtaggtgggatggagattccatgacggcgagtcgacgaaggtgacattagagatgatgatattgttagagtagaggagctcgagcaggtaaccgcgagtgtaggtgagttccttggcgtggaacttgtcccaccagacttggccctggccgttgatcgttccattcctacctgaaatgttgctcaatttcagatatccacagctaaacatataccacaatcacagcagttacacgaaaaggttgagaaaatagcaatcttcatcacgcattcattcgtgtaccagtgatgatgacatctgtgagattggatccagcaatgaaattgctgtatcttgggcctggttcgtcccttcctcttccgtaggatggcagaggagctatcagaggccaatcttccaagttctgaagaacgaaatgaacagcttagactgtcaacacttcagataatgagagatgaaccagttacactagtaactgaaaacgggtgaacaaaaacagataagagtagcaggtccacaagttatgtgctgacaaaattcaaagcataaaagtggagcaaccatataacagtagaaatttctgaaatgacatggcagagcttttgtcctaacactcccaatccattctctttctctcagtacggcacggttagcaactgaaacggatcacattaacatcgattgaccttcaatggtccaaactaattaatcagctatctgatcaaaaccggttcatttacatgtattcaatagccaccagctcatccttacaataggcaaccaccgcaattgcaatgacacatcaccgggttcaagctcccaacatacagctcttggcacatatttaagcgccgccttaatacgttgtcctcccatttcttgagagcgacaatcagataaggttgattacgacaaaaaaaaaatacagcatgtaaccgtggcatttagcatgttaatgttcgtattaacagtttgccagtttgagattccatcaagaacagatgggagcctgggaggacagatatgggaccccagaccaaaaaaggcgtttttccctggcaaaaagcatcatctacgccaataaaacggaagtagctagtacccgccaactttagggcggtcgcgtgtgactgtttggtcacaagtgtgacggtaagagaagggacaatagcagactattagctagctacaatatattttaatgagataaaagatgagagagaaaaatagcagactattagctagctacaatatattttaatgagataaaagatgagagagaaaagcagtgagctacagatatgtagtcagctgcagcacggactcgactccaagatacaatgtgtgtatgacatgactatcatataaattggttattagattagctataggtgaattagagctagtagtaggaaccggacatttaacatgcgctactttcgcggcgaaacaccagccgagatagagatagagataatggcgcagttaatcatggtaaatggtaataagagagggggttgatgcatgcaaccgatgttgttggtggctcagatcacctgagacgcgaggatctcggcgccgtggtcgaggaagagggtgaagtggctggtgaggttgaagggccccgtcagccacttccccttcggcaccaccagcgccgcgccgccgtcgccggcgcgcagcgacaggtccgccaccgccttggcgaacgccgccgtgttggacctcctcccgtccccgacgccgccgtactccgtgatcctcgcgacgtgcttccggcaccccgctcccgccggcgacgacggtgacgccgcgacgccgcacgcgcacagcgccaccagcgccaccgcgcaaaccacctgcaaccaaccaaccaaccaaaattccctttcttgattctataagaaaataataatcctaagacgccacgaaaattgatcggattggacggagacggagagcgttacttacctgcagtattgtttttttggccattgcgaaactgtgatgagagagagctgcaggacgcaaatcaggacgagaaatgcaacaagaatcaggacgtgcttacgtatatatagatacagaaagtgcctagaccggtggaggatattacgggtgtgtcctgtatcaatccctgcctatgttaaccccccagtaaatgcgtgctatttattgattgctttctgcctgctatgccaaacttgccgagccaatagacgtggcaataactgcttgcgtgtgctgcgtccatggagcttttaaccggccgagacatctcgctttctgccaatgcccattgccatttgaggtggtgcattgcatggcggttaaggctgtggactcgttctgtccaagcgaaggtttgctgtgcaactcgtgatgtgttttgccttgcaaggtgaatacaacacgagcatgcgaatcttgagccgcagggcgtgatgaaggtgaagagtgcaaggcaacacgtactgtgccactgtggactaatggctggttgctttctttgtgtgagatgatatcttgccattctctgtttggataaggcatgattgccagaagaaaaatctgaccaaacacaacatctctagaaaggaaacagtgaagtactcgtaaattgtacggtctgatccacgagcaggcatgaattgccagaagaaaaatctgaccatatcctactcctaattaattaattgggctggaagcctgacaaaattcagcctgaaaatggtgaaaggaattgacagaagaaaattgctagcgtgggtggcgaatccttcgttttcttttcctcgtggttgcttcttcctcgatcttatgtccatccatgatgccgttgcggactggcgggcctgatggcttgtgtttgattgggagtatatgtttgccacaagggttggaatggtactatttttaagggtttggagggtgtgtcccggatgccaataagagagaaagtgagttagattgatccgtccttttatttaagggatggagccttttatttgaaggaaatattacttttcaggaatcatgatcatctcatctcacctatccctgatccaaacactttaaagaactagttttctccaacccaacccatcatatccctatgaccaaacacatgataaatgcatccttactagtgagtatttattataagagcatccacagtgtgaattttctatacattatagacatctttttagcagtcctaataaaagtattgggcattaagcatagaagctgactcttggggagagagaatatggcccacatgtctatggagttagacattgttcactttgaatgtactaaatttatagtatggtaacaaatttaaaatgatcttgccaatactatcctaacaaaattgagaagtttcaaaaattttatctcgaaaaaacattataaaattttagaagacatcaaattgaacatatccaacggtaccaaaaaatggtagcattaaaacataataaattttgataaaattgatttgacaacaaagtgaacaagctcttaaaaataattttattttgcttacaggtgtttagatgatttttttaattatattttttggatgaagaagagtagtgacttgtaacgaataccgaaagcttgtttggcatgaagtcataggtttggcacggatgacccaggccatcatgaattggagcatgggatgccttcgaaacggtggggaaaatgggtgtaattgtgattgagattgtctacattctgatctttgagccgaggacagaggagttatataaaaaaaaggaagaggaggatgaatagtgtaggctccattacatgggccgtaattgcaacccggtgtttgtttcagaaagcccactaaatgtggcacacccaagcaatccagtacgacttaccagacgggtctaaacgagaaaccccctctcctaccgccgccttccgttactgacttttactagtacgtcccgtcgttcccgttcgtcccccttcttctgcagccttgtggcgcggccctgctactcttgttggacgatgtggcgccgtggcggtgatcagaaattcaggatcctctgcagcaaattgtatcgtgcctgatatgtgaggccgatgatcagtcgactgcagtggatctaaatccccgtggtggatggctacgactacgagcctacaacacagacatccccggcgtgcggagttgctgcagtgttgtgcataccgagagagctcgttcccgccgttctacatgcgagtttgggagatgcggacacgcgccgtcccccgacgagtctgcgacatccccgttctccgccgcccgtgaggccgcgaaggcaattctcgaaactgaaggctgaggcggccattctctccaccggcagcgcaagaggaaggcaacgccggtgcggcggttcgcgtccctcaccatcatcaggcggaattggtagcagagaaaggcaatcgggtcggagtagcaagagcttgcttaatctttaaccacactgtgtgattgataataacaaaactagtgtacaaacaagatgcgaaacgagggagggagaaagaaatgtacatgagtacatccatctaggctatcactttctgaaccatgcttacacttgaaaaccagctgattccaggtacagccgaacaggtaactcgcctaatttcggtatactagctgatagctccatcagaaggggtttctgaccaggatgtggctgctgtggagggctttcaagagcaccgaggcgactgagtgcacggctgccgacacaatcctcgccttgatctgcccacgcctgggcatgtgtctcctgcttgctgctgatccgtgaccatctctgcacggagcagcggaggtggcgccatggttggtcatcttcctgcacttcactcactggatatgcacacgaacagcagctgcagactagtttggaactttggatgcgtgctctctctcagcttttgggctgtctgacgagcatgcgttgctgaccagtgccctatttatactgctactgcaagttgtgatagtggtttcagttgtttagttggagtgtgccactattaaactcggaccaaatattcgttggatgggaataatatcatcttttgagctcgtgctaatcacagtggtggtagctcaaagcctcacacactcacactgcttttctgccgatttgtattaaattgatgctatgcttagtgccggattattgttcacactaggcttagctgtgcggctccctgaagctttacttgctcgcctccatcccggcggcttcgttccctggaaggtagtatgcttgtattgtgctgccgttgtttctgttctgaggagaatgctgatccttcatcattgcctgcggcaagcacatgctccacgatccatttgtgatttttatgtctcgacgccgacggcggctctcaggaataggatcgatatgatgtcaaactattggcaccttttgctctgaagagaggagcttaattaaaacggattatgattgcattagactcgcttaatctctagctctgcattgtgactgggttttggatggagcctttggatttaacccctgattttgattttttgagcagcgttctagatggtctgtgagactgtgagatgacaataaaagctgtgagcttgtggtcacaaggttttggtttgttctggggaacttggccacttgagctggaggcaggacggcagatgtgctgtgtcaagaggtgtcaacacctgctacctgcatgtgcaatggattgacttgtgcttggtgttccgagcattgaccaattaaggggattcgtgagtacgagttcattgtaccgattcaattactagtactacgtgtgtatagtcggttcggcgctgattgtttggtgatagaccgggtgctgacgatgatacgctgccgcctagctggccaggtgcctgctgacagtttcggctggcgtgtacaagttgcccggggcccctgatcgagataacttcaaaaagtaggcgatgggcataggctctgttcagagttcacaccggctgctagctgcagccattcacaactagtgcagccgaacgcaaccataacctggaggattaagtccacttgtactctctcaaaatatactttcaatatgattcatatccctcaaccgtaatactagatatctttaccccttaactatgaaaactagctcaatttagctctctcaactgttttaagagtggttttcaccgacgtgacgtccacgtggcagtccagtcatcaaataaattaaaaaataaacatatgaccgacaagtgataagagggaaaaaatgtggggtccgcacgtcagaaaccatccttatctccctgtttttctttcttttgttgtttcacacgcggagcgaaggcaagctcgcatcggcggagacgcagtcgacgaggccggtgctgacgctatcttcccccgctctcatccccctttgctccgtgcatgaagggccactcggtggacgaggagcgagacggcaggcaacaacagaatgagggagaggggcgcggggatatctccagctcctcgacacattcgccggccaggccacgccaaccccgttgtgtcaccgccacccatgactccattgttgactggggagcacccccaacgccaccactagagggtggccatgcccgctgccggcaccatccttcgagcccccaagtcatcgccaacacgccaccatccatatcccgccttgacctcgccttaggcacagcgatgccctggatccagccctgacgacaagccaccgcttcctcggtgccagcgacatccgtttccccataccaccgccatcagggggacggggccctcctcgtcaccctggactactgccatcgggcagcccaccctgtgcgcccaccactataacagccgcagttggcaccccctccgtcgggcccttgccacatggatgtcattgcctctgggatggaaggagccgagaaccctcgggcttcacacgtcgtccccaccgcaacgtcctcgccgccagatgccgccgttgccgctccctgtcgttgtctcgccgcctgtgccgtcagccaccgtgcgccaagaagaaaaaaggagagagagagaggttattagagggatgagatgtcaagggggccccacattttaaaaaatttatttgatgactgggacgccatgtcagtaaaattatcctccgaaaccgccgagagagttaaattgcactggttttaatagtcgagggtgtcaaaatatctggtattatggtttaggaatacaaatcagattcgacccctagttaagaaaagcaaagtagacttattcctaacctggaagagatcatgacaggccaccacttacttgatctgccatgggcagatgggctcacggcccaactcctaatgtttcgatttctccgcgaggagaatggcccgggctgaaccatcttcccatgtttgttccagaaggacgggccgtgtaccgtgtacgtagtagatttcaagcgatacgaaacgctgccaaacacaatccatcatgccaaacctccaaatctcaatcaatctgaaaacgttaggaaaccacaggttttggctcgtccagataaagaaaagcagtgcaaaggagtcaggatcccagccggccgggagagcgacggacgcgggcagcgccaaggcgcgcattaaagccggcgttgtcccgtgcagctacagccccccgcaaccggagcggcgggtagcgcgacgcgagggcctctgatagctcgcttgtccgcttacccccttgccgctcatggcattcacgtgggattgacgtgaactagcgcgcaccggccgcgagcccgcgaccgaccggcacgagagcgatcgatccgtctctacgcgttacatacttacattctctcgcgttgctactagctgatcgctaccgtaggccgtagcgtattgcttcgccttactatttgggccgggagctgtgacggttttgatcaggcagatcgagtagttcgttgcatggtgacaaagacagtttttattttggctttcttctcttatactccatccgaaccaaataaactaatcttgtacgggatatgatacattgtaatagagaaaatctatacatcggtatcccatgaagacggggtactaatccggatcccctcctcctacctcactctccttccctaaatcagatggcacccgaggtgcagccctccccttcgtcgttgccccaccgctcaccggagccggccgccgccgccgccgccgctgccgtagggtaggcggcgaaggtggcgacagcgaggagctcagcggtgggcgcggtgagcgagagggagagcgggagcagggcgcggaggtcaaacacgcgagggaagaggcgaaggaagtggagtgcgcctcgtcggtggagcctgagcgggaggcggtgggcgaggcaggggagcgtgagtggctcggtgggcgacgccgccatgagcgggaggtgcgccgacgcgagcttctcgaaggtgtggtccaggtgccgtgccgccacgtgctgcggcgacgtctctctgcctcaagcgaagtcaagatgcccaggtaccaggcggccgacggtggtgtcttgttcgctctctctctgggtatgatgcctggtacccaggtaccaaggtctgatatctaggtaccagctcgataccagggtaccaggtaccagccggtactcgggtatcaggtatcaggaaaaagtcacttaaagtatcccatcctaatgagatttcattctctagtctctctcattgtaatactataaatttagacatagtcatattccatacgaggttaacttattttggagcagatgtggtaggcttatgactggaagtcatcagaaaccgttaaccaagtgtggcagtacgatgacgccgtcgtacgtcaagctttgagcttcctcgcgttgatcggctgatgagctgccgctgttcgtgggcttccaaacgtccaccgtctgcctgctgttaacgaggcaacgctaggtagcttgcgacaagggcaatgtacgtacgtagtacatccgcggtgggcaccgaatcgctgatcgatcgggcagggcaggcaggtgctagtgcagtgcggatcccctcgatcggtcgagccagccgatcgatccccctcatcacccggaccccccctcacgctcccatccacgcgtgcaccacctggtcccgccccgaacacccaactcccgtgcacgtaggcccagctcattccccttgccgccccgctgctcgcgcacgtctcgcctctcttccgcccgcctcgtgacaaaaactactactcatttcggccttactctgctcgaccgctcgttggctgctgttccaaacgcagctgagcgaaccagctcgcgtaggctgttttattaactaattacacaatttacgtgtaaattgctagaggaatcttttaagtctaattacgccatgatctgacaatgtgatgctacagtaaacatttgctaatgacgaattaattaagcttaataaatttgtctcgcagtttacatgcggattatgtaatttattttgttattagtctacgtttaatacttcaaatgtgtatccgtatccgtatacctgatgttagacccgacaatttttttttaccagtggaactaaacacagcctctatcataatatcactatcattatagttactgatacatgaatctcatccttctattatctcacatgttaataactgtaatgatactattattatgtggtaatggatgtgaaccggtccggtctgtgtacgttctgcctcgaaaactagtactatcatctgttgcggcaatacgacaactctgcgagcacgttaattatctgctaactggtactggtcccggccgattcgtatccatgtacggtgctcatcttatcgcatggaccgctacgtttaaattttaaaacgcgatcgatacgaccattttgagacgataaatccactggagtttgacgtatctacgtgcgtatacagatatatctgcatatacacggcatcgcctggaacgcccatggcgtgtacgtgtgcgactgcgtggctttggtacgcctgctgcaaccgtgcattcacgctgatgcaccaaacggctctgcactcactgattctgggtttagccagtcaattcaggtgtgcgtgtctagctagctatgctgatccatcgggaaacaaatgattctgctatattttggcgtgcaattgggcgtgcttgtttaatcatttagcctgtacgaatcacgcgtcgcaatccaatttgcatattgctgcgttcataattaaatcagtttgcattatattgggggttcctttcgtttacttcttcttgcatcctgtttcttaatttaagaaacaatatccctgttcatgaatatatattttacctgcgttgtcgttcaaagcaagcattttttttaagtctatgatactgttactgccctaatttagagttgctttcttgcagagatcatgcatgttgttgctgacgctggcttgtatacagagtctcttttttgagacattctcgtgtaattggacaaggacagcgtgcatgaatttaaattaacaattgtgttgaacatttctgtttctcttgggttggtgggaaaaacgaacaactcctgcccaatcgatcgactgatggtactaatcatatattcatcgacgacgtaatggcccatcctaatggcgcatttaggctttatatttggagatatttgttggtctggttgccgtgtgtacgggacctcaattgattttgcttcgaacaatttatgactctagttatatattattgttgctggtcaaattcgagcttggtaaacaaggatacggacatggaggcattacaaggtactaactgtctaaatcgttgcaatttttatatgtctaatcctatctgcaacacacagtttattatgacgaagttttgcgggttcaaacatgatagcgcgcaacaattaactatgttaggattttgccttttcaatattttgaaattaattaacttgaaaccacgaatttcaagacttcaaaattaaactgcaaattctaagggagattttgaagcaactaatttcaagtagaagattggaaggcctacttagaaaattaattttaaagcagcctgcaagttttgaattttaaatttgtgctaaaattgaacaaagttctgactaaaaatcacaaaattacaactgagtagtcaggatgattttcactaaaaatttgcactttccacacggagaaaaaaaaactcataaaagtgatgtttttgaactttcacatcgatatgatggaaaggataattcaattcatggggatcgaattgttacaaatgaatttcaaaataggcaccactggagcgtcaagttaacagaacgtgctaaatgagtaccagatcagcagtatagtattaccaggatttctttgctgagatctagtacaataatactcccgcggattatgttagagtagggacacgattatgctcggaaaaggcacatgattgagccaacaaatgatctagatgctttaatctaacttatgaatttcttgttagttcacttaattaataacaggaatggtcagaaatgctcaattgattcacatggccaaagacaaacgagaaagacaagaaagggagccatctattacaccctaaacgagctgtttacaaccgttaaacgtactcctcatgcagcttgtcacatgcatatacagtgtataacttatgtggatgtacaacaaaaataatggtggaaaaaacgagaggatcttgagttgagaggccacaagatcagctcatgctcttgcagattgtgaatcctttgttcctggctatatattttgtccctgaaagaaatatgacaagaaactatttgagcaagaactgccattaaatgctaatcaacatctgtgtgaatgtgcatggatgcttgcttgattgtgtttgatggtttcggtgcacttacactggatttcttccagtagaggatggcgtcatggacggccgtgtcggcaatgccgtggcaccagtcgatgctggacgtggacgcccttgctctcgcgctcgcggggctcgccggcgagaccctcgtcctcggagcacgcagcggcggcagcgccctgaccttccggtagagcggcatgaggaaccgcaggtacctgagcagtatcttccacggcgatgacccgccgccacgcctccccgcggcgagcagcggcggcgcgctggcgttcttgctggcgccgctcctcgcgctggacgacgagctcagcgaggccggcgtgctctgcgctgagtggaacagcggcgacgaggccgagagccggggctcgctcagcaagtgcgcgacgcgagcggcatcgccgtcttcttgggcaccgaagcggccgtcgtcgtcgagctcgtggggaagtagacggccatcgtggaagatctggctcgcgctgaccagcagcgggatcggagaggcggcatcgtcgtcgccgccgggcaggtcgaagtcgaagtcgaagtcggtgcccggagccgtccaccgcatggagaagaggtcggcggggtccatgtcgatgaagtacctggagcttccgccgacatcgtcgtcgacgaggcgcttgaacgacggcgcctgcgccgcgtgcttgagccaccggtaggagaagctgtcgccgaggtgctgcagcgagccgacctccatgagctcccagcgagtggcgtgcgcgcgcgagacagaagacgagacgaggaggctgtgtggtttggagtgcagtgcagcgtgctgagcaggcaagggactacacggcatggcacggcgcagatatagggggtcgtctcctctccttggccttggaccgttcggtgcaatgtccatgttgcccctgcagtgtctcttttctctcattgcaaaactctgttctttttctcttgaaatttttaatagaatgttgtttttttttcctgacgggctgctaattacttcctccgtttcacaatgtaagtcattcgagcatttcacacattcatattaatgttaatgaatctagatagatatatatgtctagattcattaacaccaatatgaatgtggcaaatgctagaatgacttacattgtgaaacagagggagtagttgctaaccagtcaattttgtggccgtcagatgttgtggagcacgaattaggagcgcatcttctccttattggcagcagtgacgtcatcgaagccaagaggtatgacattttagttttttagaaagcgattttgttagacatcactttgacatttttgtgggcaatatcactgaattcataacatcgcaatttttctctgagatttgtgtgttgtcttcatctctaatgaactttagctagtctccgattggttaggtttcagggtcaggatggcagaagagggtgggaggtgttcctaggatgaccgaggcagtagtgacccaacggtgggttagcggacatgacaatgcaaggaggagatggtggttctgcctcagtcacgggcaagaatgacggtaggaaaagccttatcatttgagtgattaggaaacaataaaaggtgacatcagatccgataataggagccatcgaaggaggacagtagcgttggcgtgagggtaactatagatggaggagtataagggggcaaagtggttcatcaagcctcatagagtagttaggaggcaatgggaggtgacgacgcggggtcatcggagtcaagaaagaaggaggcgactagcatcgccgaggttgtgaggaggaatgggtggcatggtacggcgggtcttactggcaccggatactacaccattgaggaggatggtaggaagaaaaatctattatattattaaaggaatagaaaaggcagagtccatatagaaatacaatttaaaaatagctgaaattcggaattaaaaaataaggaatattagaagagaagactagagtccatatagaaatacaatttaaaaatagttaaaattcggaattaaaaaataagaaatattagaagaggagactagagtccatatagaaatacaattaggaaataactgaaattcggaatttaaaataaggaatattagaagtagagtatagaatccatatagaaatacaattaggaaataatataaattcggaattaaaaataaggaatattagaagtagagtatagagtccatatagaaatacaattaagaaaaaaatagaaattcaggattaaaaataaggaatattagacgttcgctctcatagcctggaaattctcacattaatcggagaaaaagaaaaagcagagtctatatagaaatacaatttaaaaatagctgaaattcggaattaaaaaataagtaatattagaagagaagactagagtccatatagaaatacaatttagaaatagttaaaattcggaattaaaaaataagaaatattagaagaggagactagagtccatatagaaatacaattaggaaataactgaaattcagaatttaaaataaggaatattagaagtagagtatagaatccatatagaaatacaattaggaaataatataaattcggaattaaaaataaggaatattagaagtagagtatagagtccatatagaaatacaattaagaaaaaaatagaaattcgggattaaaaaatgaggaatattagaagtagagtatagagtccatataggaatttaaaactaactaaaattcagaataaacataataaaattaaaagtagagttttgagtccgtataaaaatacaatttacaaataactaaaattcaaaattaagaaaaaacatgggaaaaagagtttaaagtcaatataggaatacaagtaactgaaattcgaaattaaaaattaaagaatattgaaagatgagtttagagtccacatagaaatacaattagaaataataaaaattcagaaataaaaataaataatattagaagaagtgcctagagtctatatagaaatacaatttacagaaaattcagaattaaaaaaagaaatatgaaaagatgagtctagagtctatacaggaatatatataacttacaaataactaaaatttgatattaaaaataattaataactaacacgtatataaaatacaatatgaatattatacatttgtagtttcgtaaagttattgcaaaatttaaaattatgatgtcattttaatatatttgaataatataataagaaaacatatatgctattatatgagagaaaatataatgatgctagccgcgcaatctgcacgggccaccatgctagttcagtaataaagagagaggagataattcaggtgtatagcaaattactttagaaaatcttaaggtcccaacttttagcttacaacctcgaactattaattgaattattcgtgacatgcttctaaaactgcaattccttcggaaactttcttagtcagccttgcttagattttttttttcaaataatttgctcgcttaatagtatatattatttattttattcatacaagtagatctataagttttaattcttaaaaagaacatgctagactgacctttagacaatccattttttccctactcatcgctatgataaacatggagtaattcgagtcatttgacatgctgtaatgattgggttcactgtatacatatttgtcgacaaaaactagacatttaagcaagatttctttgtgactttcagttatcttcagttgtgggagtaggttttaaagtagcagtagtggtaacagctaaaaagcgatggagggagctagcaatggagcatttcttccctggaaaaagcaaggccaccaaattaagctaagagcaaccaagggtaaacggtaggtactcctgtttctcaatgaattaatctaatactgcatgtgatacatcatcgtagtaatgaattcatgttcataattactatgatatgctatatttagtataaaatttaacttattgtgagacaaagattaatagtattataatgtgtcaatgtgagacggagaaagtagtcatttcgttacaaagaaaatgacaaacacctcaacatactggccgtcaaactaagcttttctttaggactaaacatcctaaataatgcccagatggatcgtcaaagacaaaattatgctgctaagagaaaactcagagtaacacatgacgggattagttgggtggttgggataatcctgacaaaaaaacctgcgacaacgctgccgcacgggcgtccttccatccaggcctctggtcatgtcaccctgcgaaattccagctgccagctcaagaaatggcacatgaaatcagtaaaatgatctttgaatatttaatcctgggagaaagagctaagctaagctaaatccaagccaaggaatgtggtcctcacgttgtcaaatctccataagatgctgctaatgaagcatcggttatgctatcatcgtgtcacattgtccaatcttaaatgaagccaggcaacatggatcagtctgcaatattcaaatcatggaacaggacgcttgtcatgcagctggggaagcaggcttggatatcaagggcaataattaaaatacagttcaaggatcaagaacctggtcctggcaaaacaagttctgagacccttaaacatgggacaattgtctctgtaaacaatcaacaggacggcagtaacgacattcggacatactaattctctccgccctaggctcaggttccactcgtgtgctgctgccttggttcggttttgctgcgagcaacaggttcaatattgttgtcagcaaaacatggtgcaaatcctagacagcgttattattaatcaaggttaaaatgcaagcacttcatatagatagatatacgtatatgattttatttcatttttttgctgtcatagacgagagagatgtaccatgcatgttctggacaattagaaaaaaagaacacagaaaatgaaaactacagcattcagaaagcttcctatataaatagtcttcagaaagacatcagcagatgagagacagagggagagctgatgtgtgctaatacaaaagtaaacggataaaataaatgtgatctacacggataaaaatgagttgacaatgcatcgatgcatacttacatgtggcgtcctgaagctgtacatgtacattgcttgacgtttactgtattagtacgcaaattggtatgctggttttattttgcctgacgcaaaggatttgtcgctgttaagcatctaagctgttataaagatcaaagttgaggcattccatgggccacgcccactagaaaaaagaacctcagctgcaggtgaaagagaatcgatcaaaacttttgagcagaacaacctcttttttactaatggtcgggcatagtgattacagatagaaaaagggtgatatcaaaggttttattctcgctctcttatttgcagaaaaagaggcattttcattgaattttgaaaagcactttctgcacaagagcatctaacaaagacgaaagtgtagaatgattaaggataattccattttgtgctccagcatagtagagagcttttgtacgagaccatcagccaaaaaaaatgtgaggctcataacatgcaaccgtcacatgaacagcaaagatccagatgcaaaggtggaacaacttcgcaaatattggacacaagtggtaaaaataaagagtggcgatagcagcaaatattggacacaagtggtaaaaataaagagtggcgatagcagaccagcggttgtgtggctgtgccctacactggatttaaggttttactacagatcttgattccaacactaaaaacatcaggttaggcagaggaactaggcaccagcatgagccgaccataccttttaatgcaacatcttctggtaatccttttgtggaacattggagtacagtttgcccccactagattatagctttctatgagttgtgatatgcccaccctttactcaaagcactttacttcataattttgggaatacatagggcccagataaatgcatatatacattgaatgatgccaagatgcctttttttaatattgaaacatcatgaacatagtatccccaaatttaagaaattaaacacttaatatagagctgcacagaataaagagcatgcggtttagtaattaagtgggaaatcaaattcttgacattgtaagttaaatggttgaggtattggacagagagagatcatattatacgaaacagaaattctagtcaaattactttccaccaaataaatctctctatagatacctgacaggtgcaaatgaaatcagagcaccctaagaaggggcagggcactggcaggtaacagaaagagcttgatggtttgatgaatttcatagtgaaccagaggtgtttgacaatggtaatcaaatggtgtcacagtttctccagcttccattttgaaaaaaaaaatagttgaatccagaggtttttgacaatggtaatctaatggtgtcacagtttctccagcttccatttagttttcaaaagataagatttcagatgacatcaagcactaatcaatcagtatgccttgtcaaacggttgttagctggtcactacacattctaagggacatgcaagtgcagtttgctttgcacgtttttcttgaaataagcagtgccggtcatattctggcctagtagcttataaagccaagtcaaatgacatttattaactttcgaagacttatggctatgcataacagctactacaacattagtagaaaaaaacaatattaaccaaaccataaaaaccgagagaagactacaagattgttaatactgtctttcctttctataaggtactatgcaaaataatacttggatataatgtttctgcaacatggttatatgggctcagttcaatcgactcgtaagagacacatgcaccaactatcatgcagtgccgccatatggcagagtatttaacatgaaaaatctcttccctaagttattctttcttcaaactatggcatgtgaaacactatcacagcctagtagtcttctagtacaagaaccatgccaaatgaggcataatgtgttgggccagttaggtatgtcaggccattcatatttagatgggccgatccaatttacattgaggggcctaaaataagtagatgattctacaatcctcattaatttggttcaaagatgagagcaacccaacagaagatgctcagcatgcatttcaatgatgcagtaacagattcttcagaaggttctggagattttaacaagggaacgaatgctgctaaatttggggtatgaaaaataattcaaaacatagtccttttaaaatacactaaaaactgatagaaaaactacatttcgattgaaagagaatcaggaaaatgagggaaactgctagatccagagataccacatcactattgatcagaataattttcaggaacaaggagtttagaaaagcacacgacgtgtttaatacactatacagtaccgtgaaagcaaattcacaataaaagccagccacaaaatgatagat

SEQ ID NO: 45123 - DNA, 31620 bp, Oryza sativa
  unsure (1)..(31620): unsure at all n locations
caaagattctgtagaagttgggatctgaaaggaccaaagcagtattatccctcggtatgtctgaactccagaaaataatctggattgaatcaaccaagtttaagaaatttgtgtgattatgtcaaattttagcatgttatttacaagttctcagcagtcaaacaaagatgatctgcagacacttaattgttacagctagcccagattaccaaaagctcttagcgatgaggccatgagggccaaagtaggatgccagggcagccaaaactgtaactgaagtttcttttttcaaaaagaaaaaaaaagtagaaccaagggaaatactactacttcttaattggctttctacaagagcttcccccttgccttaccaagtagaataaagaatagtaaataacactaacattggaaggtagattctatttgccatgatttagccgctatcttcatatcaagaatatgaattatagtaatggcatataacaataaccagtactacaaaagcataaataaactagataaattgcaggcatattcattcaagcatcacaaactggatagagctattaaaagcagtactaatacaaacaaatatcttgagccagatacaacaccacgaccgttttctccattagccaagctcaaataaccgaaaacttaccattaagggagtaaaagtgtaaaactacaatacttacaactgaagtaatgcaatatgtcattacatacaataggtcaacagccacagtttaaagctcctcaaagattatcatctcatgatgttcaatagtctgtcttagcggacacaagttgatatgctctagccagcttcccgtcaccagaatcatttggctgccaagaccaagttgtaccattattcctcagctcagtcctcaacctcaccacaagcattaacaaaaccaacaacaatcccgcaaaaatgaaaccacacagcagtgagcgagtaaattctccgatccccttgctagccacatactccatgcccagagaaactgcaaaatccccatcaataccaccatttgttttgttcatcctcattatctctacagcattaagaataccgctcacttcgtctgatcggctattcttcgagccaccaatggccaatttcagggccccttcatcctcaacatccacaacaaagtcgatgtaatatggataggctaagaatccagtggcaccagagatatcgaaatcctttactgctagctgaccattgacatagatatcaaagtaaagctcatttagagccttgctcacgatgtcacagaagtgcatacgcactaggtacctgctggaagcaggcacgggaaatccccatgtcactttgccctgtgagctcactgacctcgccgagttgtacacgttgtcaggagcaacctcccgtgtcatcaatctgctacccttgggataagcaatccggccaccgaacgaccagaccccgctgttggatgattccgtgctgacgaggaagcgctcgtcgttgacccatgttcgccacagcgtgtcgttgaacggtgtgaccttgcggccggcgacgttgatccgatagagcatctcatagacctgagacgacaatccattggtctggtcagtgccgctgctcgtgacgagggtgccgatgtcgccgacgagctcatcgggggccgagacgagctcgatggcgttgacgaaggcgttagagcccgactcggggacgaaggtgaggacgaggacgtcggagtggacgggtaggatgaactccttcacgacggggggccgacgcggagaagttgtggaggaggaggaatccggcggcgccgacgtggaagcgcgcggacgcgagcgcgggctcgaaggggtagaagtggaggcgcaggacgtggtacccgcggcggcggacggcgaggtcgtaggacgcgcggcaggagaagacccgcgcggcggcgtggagaggggtcggctgcggggccgcgctggaggccgcggacgggagggtaggtgccggggagcggaggcgcgtggaggcgcagccggagtcggggacgaagcgtcggccgtcggggagcacggccggtgccgtcgcgccgcaggcgaggaggtggttgtccgccggggcgaagcgggcggcggaggcggaggcgagcaggcacagcaggagggggacggcgagaacactagccatggcggattggtgtgggggattcggcgaaggggaggaggaagaaatggaggccagctgtggattggcgagcggagttggggaggaatcggtcgatcaatcaattcaccgcgtcgcgtgcgacgagccgaggactcgctggatggtggggcccacgcgtcgtggccgtgccggttggtttaggtattttaatgctctgatcagcgtgggcttttatctttttcgtttgggccgtggatttggttgggcttgcggaggggagagcatctgtacacgttttggcccaagtaccatagccttttgccttgcagtttgggctgtctctttcgccgtggacatatcggttgccacctgaatagggcagtagtgatttctggttgcaacttggaattgtagtcaaaattaaacagtcaaaggataatagataaaaaaaatggtttagattagtcagcagggcagtgtgattacgacggcacggtcagcggtcagcacctgataattaaacgaaaaggaaatagcccaaagaatttggctttacctggttattactcttcctgggcgcatgcatgcgtgccgtccttccagtcaaagcagaagggagacaatcagggggattctgaagaatgcgtgcattgcagctatgcacgtcccagtttggctgagttctaaccacacaattcgtgtatgtcatgatcatcgtagtatgcaaaagcttcggcgagatcgaatttggaaaaaaaaaagttccttttatttttggtttctctaatggccttggcgggacggcggcttttctaggtcagcaatcgtgtgaaccatatattattatgctctaaagccagtagtttaggaatgatcccattaatgaatcttccactaacaagataatcattataatcatcattataatcaaagagttaggcggaacacggtaacgagaatttggcctcatcagggtgacgccagacatgcgtaggagtacaatacaactcaactgtacacaagtctctgtcaaggtcctgcagagaattgttgtttgtactataaaacggccgcccgtggccaattgggaagaaagaacaggcaaaggattttgttctcatctgaacatataaaatgatctgttcatcctgggtcaagtcatttcgtcacgcgctaacatatgaaatgaatccacgatgcagacagcaaggacagaaaaaattgcaacaccaattttgctgcagattacggtattccgttcgtgttcagcaaaatttctgaagacgtatcgttgctgcgacgtgcatgggttttggattcagagaatagatcagcataaaaaaaaagagaggaaaaattatggttacaaacttctctatctgagtctgaccgactgtcggttcactgaccagctgattgatcaacggccatcgccgctgctgagctgcgagaaggccttgctgttggcgatccccgagtcggtcacgctgtcatccatgaggaagctcgtggacgacggcacccagcgcggcacgaccacgtcggcggggaactgcgtggcgacggcgccgctgtcctcgaacgcgtccctgttgacgtgcgtctcctgcagctgaaggcagtactcgaggttccacagcacgtcgcccatggacggccggtccaggccgtagtccgccaggcacttctctgcggtctcggcgaacttgcgcagcgagttgccgttcacctgcccggcgatcctcgggtcggtgatcttggcgagctcccctttctgctgcaggctaaccgcccactcggcgaggttgatctcgtcgcgctcaaggctctggtcgatcaccgtccgcgcgcagagcacctcgaacagcacgacgccgaaggagtagacgtcggaccggtccgtcagctgctgcgtcttgaagtactccgggtcgaggtagccgaagctgcccttcaccgccgtgctcacgtgcgtctccccgaacgacggcccgatccgcgacagcccgaagtcggccaccttggcgatgaacgcgtcgccgaggaggatgttggtcgacttgacgtcgcggtggatgatgttctcggagtagccggtgtgcaggtagtgcaggcccctcgccgcgccgatgcagatctccagccgctgcttccacgacagcggcggctcctccgacccgtagaggtggctcctcagcgtgcccttctccatgtactcgtacaccagtatcatctccgactgctcgttgcagtagccgatgagggagaccaggtggcggtgccggatgcgggacagcacctcgatctccgtctggaactccggcagcccctgcttggaggcgcgcatggcgcgcttcaccgccacgcgggtgccgtcgcggagcacgccgctatacacgttcccgaacccgccgacgccgatgaggttgcgctcgttgaagttctccgtggccgccgtgatgtccgccagcgagatgttgagctgcatgctcatcctgtgcagcccgccggtcatgcccgcgcccgacgcgttcgacatgtcaacccagctggagccatcctgcgtgtgctgcgaccacggcagctgcgtgctctccttctcctccggcgccggagtcggcgcctgtctacgcctgcgcagcacggcgagcaagcagagcagcgcgcacgcaagaacagcgacgccgagcgccgccgagagcgtgccgatgagaatcttcttcctcctgccgtgcgatccggcggagttcaaattatcggcgcgccgcagcttcatgatctccagcccattgagcatgccgcctgcatcgcttttgtccgacttgccgatgctgatggtgaggttcccggtggtcggggccgtggccgcgtagtccaggtaaaaagcctcgttgggctgctccgccgcgtccgccgcgtttcggtcgaggtctttggaagcaagcctctgcgcgacgtagacgtcgaagacgatgcccgttgctacaacggagctcaccagcgagtagtcgcaccagtggaggcggacgaggtagtcggagtcggaccccggtgccggcggcggaagcgcgaaggtccacgttaagttgaaaggccccggagtgaggaacaactgctggctcgccatgttcatggcgcgctgcgtcttgtacacgctgtccggcgccacctccctcgtgtacccgatcgacgtgccgtagatgatcggggtcgaggtcgagttcacctgcgagagccccctggggctggagaagtaggggtcgtcggggagccacgtccgccacagcgtgtcgttcgccgcggtcaccttggatcccccgacgttgaggcggtacaccgtctccagcgcctgctgcggccacgcgttcacgtcgacgctgtcgaccagggcgcccaccggcttcaccgggcgtctccacagcagctccggcggagccgggaacagctcgatggcgctgacgaatgcggtggagccggcgtccggcgtgaacttgacgcggaactcgccggagccgtcccccgggacgaagtactccttgacgacgccgtcgcgcggcggcgagaaggaggagagtagggtgtaggcatcgcgaacagagacggagaagctcgcggacgagaggttcacagaggaggaactggtgaaagggaagaaatggaggcggaggacgcgggacacgttgaccgtggcggtgtccgggtcggcgaagctgtacgagaaccccgagccggccgcgcgcgcggcagcgtagagaggggggatcgtgttggagccggtgctcgtcactgccgggacacggccggcggacgagaggaagggagcgtccgggacgaaggtgcgcgctggggagtcgcctgggaaggagacgttggaggcggcgccgcaggcgaggaagtaggggaaggcggcgagggcggtggacgggagtaacgggaggaggaggaggatgacgatgacggtggccattgaggcggtagtggaggcgtggtcgtggcgccactgccgcgtccacgagagaatgagacggaagcggacgagtgtgcggacggtgcgggtggtggtgttggaagggagagggaaggacgagtgcgatgcggtggagtggtgtgtggagtcgggcacggggaagtggactcggaggaagatgggacaacgaccggagggcagcgcgtggtggaatactggaatagtggaatggacaatggagtggacgctgattgggtcatcacattttcctatgcccccccgcccactgactaccgatttgttcggctcaaaacaaagcatgctgcagattgcaaatttctgctctgttcttctacttgtatggtaggtatgccatcttctcgattttgtttgtgtctctcttttttcataggttgccacttcccagaacctgattgatagctttgctatccctttgctgtagctctataattttccaatttgcatacattattatcttcgcaacatgatttgtgttcactccgtgtgctcataaaccgcactctgccgccggtgcagccgacgaccagatcgccaccgtcggaccacgcgagtagtagaccgatgtttgtgtcgctatcgtttagctttttccctaataaaccgaaacggtttactaaggaataaaaataaaattgtagataaaatttttatatatgcgttattggtgaattaaaagtcaatgctgaaaaagaaactatgttataaatatcttaaaattaaatttaaaaatatgaaatttagttttttctttaactgattagtgcatccgatgggagccgtgagctcttctgccccgctcatttaacgctgtgagtcgtatatgccgcttctctagcaggctgaaaggaactattgggcttgcgcttctatcacttcggcccaagtaggattttgtcaggacatctcgggccgactcggaaaaagaacccaacagaggttgcacccctttcggttagtgtaataagttcactttaggttcctcaatttgtcatcgagtgtgaaattcctccctaaaccgaaagagatctgtaatatatctggtatttcggttcccattatatcccattgtaactcgatgaatttcatactctgcgacaaagtgaacttattcatcagttagttgatacatggcccatgagctttctttttttttttgaaaattgcccatgggctatttgaacactcgtagcctctggtcttcacctgtttgccagattatttgaacacctcgacagtcgacgggctcacaaacaaacaagcctgtcgccgttcgcagcagcactgcccgtacttgtacaacgcccacaagtgcgccacattctcgccggcacagtgttgtatcaaggtgagttcggttacttacatacacctattatctaaggttacagctatcattagccgaagcaagcagtaaccgagcgatccgccgtgcaccgccgcgaggtgggcgcgtcctgctccgataccgtccttgatgcttgatggttttcgccttctgctctcgttttgctgtcctagcaactgatcctagctagcttccctgcgcgaaccaaacgcaacgcgcgcgagctggtgatcagatcaataatgccatatcggaaaattgttaatggaggtggcctacctggctacctcaattctggcgaactcgccgcccctgcagacgccaacatcgatggtcatcttccggtccttcccttgcctgggtgacgacaacaccctgcagcaattcctcctcggagactgcacgcacgccggtttgagagcaccattacaaaaatcaagcttctttgttgtacaaatcaattcaggttttaactacggtgtgtgtttgattacccttttccagaggttggggtcgggcttcttgaggacgatgacgcggtcgagcagcgcggcagggtcagggatgcgccagccgcacttgacgggcgcgacgcggcggcgctcgtactcggtgacggtggtgttgcggcggcggtcgaggcgggactgccgcatgtagtacacctgcggcgtctggcacggctggcgcgccacgggccgcgtgttgaaggcgtacgccgtgtagtcggcgcggcggtaccagttgaggaacgtgcgcatgggcatctccatctcccgcggcgacagcaccccgcgcgtcaccaccaccgcgaacccccacgacaccgacaccgtccactgcttgtcgccgtcgtagcacaccgactgctgcgccacgccagccgagtccagccgcgcgggcccctcgaacagccgcctcagcgccgccgtccgcgacctcgtcgtcgggaacaccggctgcaggaagtccaggtggtgcagcgtcaccaggggcaccaccgggtgcgcgcccaggaggcccagcacgtcgccccacaggtcgcactggtggaaacccaggtggcgcgtcagcggcacgcccagctccgccacgcacgcgtggatgcggtcgtcgctgccgtagagcgccgggtaccggtcgatgcacccgtcctgcatgtgcgccagctgcgcggccagggcgcggctgatggcgaacccgccgccgccgaacgccatgccgtacgagaagatgaggttctggatgtggctctccgacggattcccgatgtagtacggctgcgtgtggtcgtaccgggacagaacgtccacgaggttgtccgggaagaacaccgtgtcgtcgtcgcccatcacgaaccaccgcgcgccggggaggcccagccggaagctctccgacacgatgcgggtgatccgcagcgccgaccggctgccgcggccgtgcgtgtacgggaacttggtcgtgttcccgctgatcttgattccgggaagccccgtggaagcgttcctcgagtagaactcgtacaccggcttgtccagccacacgaacccgctcatctgctccggccgccaccatgttctgatgtactccctccggctcttccagagctccgaagaggcggcaatgccgaacacaatgtgacccagcccggtcggcgcggcgtcatcagacggcggcgacgagtcgttacgcctgttgccagcatcgccggcggccgcgagatgtgcaacgtcgccactggcaaggctctcctccgggcacgagctacccgagtagaacggcgacacggcgagggcaacgacgtacagggcgagcaccgggaggagaaagtagaggaggaggctgcagaggaagaaggaagccttgcacttgggcgccttgccggcggcgtgcatgacaatggcgtccttgtgatgatgccgatcgccgcctcctcctttcatgccaaataaggcctggaaaaggagatgacgacgacagtggtggccaagatcgatgagcggccaaaagagcacagatcactaatggccacatggtcaaaaatagcgtagtagtggagtgcaccgtgttcgtctgttcgttcgttccagtctacgtgtttgagggcgagtcgctctgtggagcatatagggaacagaaattgtaggccccagttgcaacctggactgattaccccataaatagcatggtcagtggtcaatgatcaagtcgcgtttgtaggatcactggtttctcctctgggcctgacggccatgggctccagcacccagcccaatagcccatgcgttctcgaatgtttttcatttttatttttttaatatttacagaaatattatacagacgaaaatatttacataaatagaccacgcaaccctccttgagaacggtagggtgacgtgtgtgagcagacgccggagaccgctgagcgggtatgtgaattttgcgtgcggcgaaaattgcatttcacccggcaagggacctcaacgcaaaatgcgcacacgacgccgtgtgccacatcaccttgccgctctccacttgtgcggcaggatatatttttgtaaacatttttgccagtataatatttctataaatattaaaacaaaaaatttaaaaatgaaaaaagttcatgcgttctccgcatcctgttttttattttttttccgaaaaaaaaatcgcgcacacagacacgcagctagctgttagcaagagcaaaatcactatagtacgcggccaaaccatatactccctccgttttttaatagatgacgccgttgactttttctcacatgtttgaccattcttttattcaaaaattttatgcaaatgtataagatataaacnanacttcacgcactctgagtgataaaccaantcataacaacctaaattctaattatgtacattctctccgtccctcgaatccgctaaaccccgagaaaaagccacccgcgtcatctattaaaaaacggaggtagtatccaactctcctagctgagaatctcgcacatttggtgatggacacctcttcttcttagtgatgacagaaatttgctgatgatatgaaagtgacctcccacctgaccaaatcttcgaagttttacacaaatcgttaattatgatctcaactaacgtttcaagtcttgtaattagtatgcttaatgattgccttttgccgtgttatagcaagcaacactcgaatattattgagttgcacggcgatggcggtgcaagcgatttaagcccatattcaccgataagccaaaacggtttattagaaaataaaaattaatttatatgtaaaacttttatatatttgtttatagcaatttaaaaactaatgctaaaagggaattacgttaaaaaaaatcttgaaatcaacttcaaatacaagttcgaaaatttaattaaattttaccttttgcttttacttattagaccaactgatggcgctctaaatttttacgccgtcggattgctgcttaactaatttcccgtgcagttctttttattaaaagaaaaatcacgtatgctagtaccgtttacaaggatatcgacaactaatatgcttttctgcattatatatccacaattgatgcatggactggatttttcccactatttaaagaaatatgttcgaatatctttattttttaaggactcatttgaaactcttgaaaaagtatataaaatacctgattttaatatgaacgcaattgagaaatagaaaattgtctatttccaattaatcatcatataacgttttatagattgttatgaccatgttaaatctatttcctaagtctattcgtcatatgcgtatgagagtaaatagatattagtgcatgcatccatacacataactatgtatgactaacatgcaatgtcttgtgattttattattggttaagagcagagatggtgcatgtatcgagtttgttaccggagtaaatgtagtgtgcgagagttattgacttttcttagtcttagcatattcatgtaatatgataatcaattggaaacaaagagaacatatataagacaaggaaaatacatgaatgattgatcgttcgaatattacatgggagaacacgtgaattgaattagagaaataaacttagggaaaatttttcaagaggttaaaactcttgctaactttccttaaaatttttggattgtctatttcgttcgaatttcaagtgaaagtatagtgtctaacatttttgttttaaaaaaaactcattaggatttttctatagaaataaaatccataattttttatatttttcttacgaatcagagggggtgtaatttgttttgctgaatccaaattagataatttgggtcatgtggctagcatgcttacgggacatatctgtctctcagtttatggtctagcttacttgtgaatcgaaaattgtaaacctaaataaacagatagccccttttttttgtttttttaaacacaagtcattcttacaccgttaaatcattagttaggttggagtagtttgtggcttatttgaagcggacctgtcgcagcactgttgctgttgccgcatacaaatagcgtgcagtcccagttccagcgcagtcacggcggcctaagttgaaccatcaatcaaattccagatttccagtacaaataaaagctgtctccactacacaacacacgaccacacaacccccggcaaccgatgccgggccggtaggctaaaataaactgcccgcttccgaaccacacgaaagcgccatcgacgacgatctactgggctactcccctgctggtgtacgatcgatcgcgagagatatatacgaactgtacctataggtcggtaaaatcaaggaccaccaccaacaaaaacgcttaattcggttgcccaaccaatgcacgccgcagcgccggccgcgcgcgaggatccctacctagtcgccaccgccgcggccgctgccgctgcgacatccaaatcgtctgctagtacagtacacggaatgcatatatatgcgtacgtgcgatgaactgagtagttcgccgcatggatcatccggccaagtcgcggagcaggtggaagccggcgcttaggctccggtaccgctcttgcgcgtgcgaggcggcgtcgccgtccatggccacgccgaactgtccgccgacgacgtggtggccgtgccccggatgcatggcgtcaggcgccatctgctcgcccgggtacaagaacccggcgccgccgtgcgcggaccccggcgccccgaacgcgatgttcacgccgccaccgccgtgggagccgtgctgctgcagcccgagcgtcagcgacacgccgccgaacccgccgtgctgctgctggtggtggctgtcgtcgtacgcgtcgaagtcgaggtggtccatgatgccgaagttctccgcctggtgcagccgggccacgccgcccgcgccggccgcgacgtcgacgttgacgacggaggccagcgacccggcgtcgtggcgaagctgcgccctcgtcggcttctgttcgccgccgtcgccatcgccgacgaccagctgctggccgccgcgcgcctcggaggcgtggctgcaggtaggcttagggtttaggctcccctgtccaccgctgccgtcgccgccgtcctggcccttcatctcctcgacgtacatctcctccaccattggcttccacagccgaaccctcgcattgatgaaccagttggacacctgccatggatcgaattgtcagaagaaacgcgcgcgggcaacaacaacacatgtcgttgtaacgggaggtcgatggctaaacaagattcgtttccaaaaaacatttgcaagcacaagaggacatggtaggaccttgacatggcaaccgatcgatgaattgatgtatcatctacgagacggcgatcgaatcagtgggcgcaatatttagtactattcccaaaaatgaacaaactagctactcaaattaaacttgtatgattatttagaaattttatgatatttgaggaggtaacgactacgtacctcctcatatctaaggtattaatatttgatccaagtaacaaattttatactagaaactcccggtgaggaccatatataaaaacactcttaattatttcatggtagggtattagtggatgatttggttcaggctatactactccctcagtccctaaatatttgacgccgttgacgtttttgaacatgtttaaccgttcatcttattcaaaaaatttaagtaattattaattcttttttaatcatttaattcattgttaaatatacttttatgtatacatataattttatatattttataaaagttttggaataagacgaacggtcaaacatgattaaaaaaatcaacggcgtcaaatatttagaaacgggggaaatagtatatatgcatcaatacacgaagaacatgttacctggctacgtgagaggcccgtctgtcgagccaggatgtgcttatccacgtcgcttggatacctgaatgggattgaacatatgaacaccgatgcatatatgaatctgatcgaattgaatcaaaaaaattcaacaactcacgcaaatataatgagatctaaatcgattactggtcatcagtagtataatattccgacaaacaatccatccatgcatctattattaaaacaaggtgaaaatgaattctccaggcctactaattactatcatgctaatcagataaattcacataaccttgatgagtctgtttattcatattttagaacttattgaccgtgtgtttattaattggtagagggccaagatgtgaatcgtgtccattattaaaaaaatgttaatcagaaaataatcatgctaacctgagaaaaatagacgtgcttgaatcattgatcgatatggttcaagcttataataacgtagatatattgtttggatgtatatatattagcacattgcaacaactaatgcacgtgataaatagttgttaatacaaaacctgagagttcataggaaattcgattgcacaaaatatactactttctccgtttcataatataattcattctaacatttttcatatttatattgatgtcaataacttacattgtgaaacggagggagtataatctagctaaataataaatttggaaaaacaaacttaaaaaaaatcaaacatattaccactgacacagacgcaactttaatcatagctagctacttataatgttttgggagtaagtacgtacctacgttgtgcacaaaccacagtcacgagagtacttaaccgttatttttgtcgaaaaaaaaaaggagagcattatattagaccatatgcatggcaaaagaatagtgaggcacacacatgacattacgtgtacgcttaattaagcaggggcgcaatatggcaaaacggccacttgagcatttgatgccaagacaaatgtggtccgggagaacaatgctcgctgcagaataaatttatatatatatatatatatatatatatatatatatatatatatatatatatatataccgcgaaaaagctaattacgaacaaccgtccatagcaaattgtgtgtcacgcgcgataatattactgcaccggccctactaggctattacacctagtcactgacattcttacgttctgtacgtgattgcactaaccaaaagtcaccttaattctactaactagtgactgccacgtgaacagttgaacttagattgctatacattgtagcacactgtgtagtgttcttttctcttgaaaaagaagattaagttttttacgtaaagcgaggtggtattaacgtatgattgattaagttttaattattataaacttgaaaaatagattaatatgatattttagagcaacttttatataaaaatttttcatataaaacacagcatttagcagtttgaaaagcatgccacgaaaatattaatcttcatccaagttttgtcggagaaaagaacgggatctaattaagtatcagtcagctgcattactttaagtgtaatcgatcaagcaagaaatgcattgtgtggagatcgatcaagcatggatggatatgcaaagtagctagatgattgatgcatgcgtgtatatatgtatacgtaatacgtgtatgtacgtataaacaacaatgtaaagtggagtacttacgggtgcaggaagtgctcgaagagccaggcacggaggatggtgacggcgcggtcgggaaggccgcgctgggggcgccacgggtggctgtccatggcggcgacgccctgcagcgacttgtggtgcctgatgcactggtcgatcaccctgagccgcggcgtctgcccccgcgtcgtcccggccgcgctcacgtccttctccccgagcgccttcctcgccgcctgcagctgcgccacgatcccatccctcaggctccggaagtgcctcgatatcgtcctcgccgccaccgccgtgtacgcccccgccgccctctccccggccaccgcctcgaaccccccggccaccgccctcatctgctcgcagtacctcctgtacctcctgtccacctgcacaaatacacacgttcatcgatcaatttaattagctcaaattaagaaaccctttacttgatttttcactgtagccatctatctgcacgtctagctaggagtacacgtacagggcactgcaccaagcgtacgtgtatggacgtggtaaagatggagatagccaatgaaacagtgaaacggtaacaactgccagtgcccagtaccgtatcaagctatggctacaaggccacaactctgcaaacgtcgcagcacgcacagtagcaaaaaccggcatgagctagctagccgaggcattgaatgtgcatggcaagggggaaagtatgggcaaaggggtagaggccggtgtcgctgctagcaagcagaagccatggctgaccggccggctaggtacgtaggggaccatatacctaaggctaaagagaggcaagggggaatagaggtttccaaaagctaatggtgaggcccaagaatggggtcgcttccctgccctagtctcaggtgcacccttcgggcaaccatgattgatggaactcctagtactttcctgtgccatttttactactagctcctttccaaagctgcagattccatttgttagattaagagagtggattatattagctccatcgatcgatcgatcgctcatacctcttcgagcatgatgtagagcttgtccttgagcctctgcagctccagggcttccatggcctggatctgcggcgacggggtccacgaggccgacgacgacgacgacccgtcgccgcggccgtcttcttgctgcgtcgctgccttggcgccgttgccgcgcttggtgctgtccacggggaggctgcagaattcttggaggagctgctgcgtcgggaggaggaacctcgagctgcgcaggtgccacgcgccgtgcacttgcggcgccgacgacgacgcgtcgtggtgcgtcatccatggcgccgcgggcgccagttggtgctgcggccgcgccgcgccgccgaggtgcagcacgccgtccgggcggcacagcgacagcgacagcggcgcctggctcggctgttggtgctgctcgctgaggaagcgcatggtggagccgccgccgccgtcgtccccagcgtcggccaccagcgcggcgaccttgcctgccgcgccgggcatcatactcatacccagaccgcgcacgccgagaagctccatcccggcctgcaacccgaacagctccggcgccgcttcgtccatcgccggcatcagcgtcgtgaccgacgacgccgatgcatctgccgccgagaagtaatccgcgaaccccaggttcggatcatgcgccatatcggtgtttcaattcctccgatcgccaaaagcctagcaaaagcaaacacaaacacaaacaatcactaattaccaagctaaacacaataagttataagcagcaatgaaattgagagcgcaggagagctcactttaatttgtgtaaaatagatggagacagaagcgaaaattcagccagtaatcgagtaactagcgagctagctagctagtagcaccagtgatccatcgatgtagccagatgtgtgatgaagtgacaagacggtgggaaatacaacacgcacacaattaagtcgtcggagagtgaacacgacgatactattactatggtgatgcgtgttgcaagtcgtagcaatcggccgggcaggagaagagagcaggtaggccgaatccttcctcagctaagcctcagaaacacaggaatcttgctttgtcctgggagggcagggaaaagaaggaaaacaagatgaaaagccatggcgatttggacgcacgggtcttaaagaaaccaaccaaaccaaagatctcgtcaggaaagcaagcaagcaggaaacggaaaaaaggtgggatatggcgcaaaaagcatacacatacatgggatcaatggggagggagggagggagagagcgcgagcaggtcgatcgatggcgaggtctgagccgggcggggtggggggtgggtggtggttgccgcgtcaagctttcgcctcgcgccctgtacatgcgcgcgcaggagcagctgcgcgctacttcttaccagcaacttctccttctgccgctgccgctgcaactgctacatcccatccaaatatctgcaggagactagttccagtgcgtcttctcgagctgtagtctgtacatgcggcgtctgcagggcttattgcgtctactcacactctgtgctactcctatcttctaaggtgagggttaaaacccattccttcccgcacaaaaaaagaaacaatcaattaacaattaatgtgattaattaagtattagcttaaaataggttaatatggttttataaaatgttttcttttatgtttttttttaaaaaacacacactaacagtttaagaaatatgtatgcagaaaatagaaatcggtgaatctttgaccataaagaggtggcaacgagtttcctcctatcaaaaatcaaagaagaggctagcctttgggctttagcagaggctaagcggttgcgcgagttaatcccacactatgtatagtgtataactacagttcctcgattttttcttgttgcccctaggggttgtattttctcctgctctattcaatgaaaaggcactctagtgctatttttcgttcaaaaaaaattgtacgcagaaaatgtgagagtagaagatagggccttgtttggatccggagggctaatccctccgaaatcttgttatttaggaatattaaacgtaaattactgacaaaacacatttcataacccctaggctgatttgcgagatgaatctaacgagcctaattaatctatgattcactacagtgatgctacagtaatcattcgctaatcatgaattaatatacctcgttagattcgtcttgcgaattagcccataagttatgaaatgagttttgtcagtaatctacgtttaatatttctaaatagtaaaattttgaagggctaattattagtcctccggatccaaacaaggtctaggaaagagaagaaaacatcacaccttaagtctaactaatcattgccttctctctatagctgtagcttttcttcgtgtcactgcagcgagagcagctagagctagcctgttttacctgatggactgactaatggaagaagcaccatgatcatttcgcgtaggtttgtagaggtcaatatatgtagcacagttgggggtgcaatagtgacaagtgtgcctgtcatcgtctgcttatcagtcacagctagaaattgaattttgaaaaactagagttattggaggtattttcatcatagtttatttcgcaacatcacatatattttattttcacgaatatgtaaaaattttgcacctcattgtattaaaaaaatagtgcttgaatgcaatttaatgtgccggtcaccattgcctggattgcatggctatgtcctttgagtttgtaatcactcgttttttctttcttatgtgattgaattccagtgcaattttactgttcatcatgtacgtgaaggtggcttatggtacgtatatagagatgacaaaaagcatgcacgccacttgactagaaagttaattaaatagttgtgcaattgttctttatttcttttacaaaaggctgttgttgcaaaattttagctacctttcatatggctttgttagcacacaacgagttccactagctagcatctactccattcctccaatgtacgcagttagccataatattactccatgtgttttttgaaaaatatgattcgatcagctaagcttcggttcggacatcccttctttgcagaagtgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttaggatatagattatcttttgtaacacggactccttcccatatataaggggggtccgggtgcctctaggggcagagatgttgattttctccaaatcatacaatcaataatacactcggcggattcatccccggacaggagtagggtattacttcttgaataagaaggcctgaacctgtataaatcctttgtttccaaacccatacacttttccagcttgatagccacccacttttattattgccgaaatctagtttcgacagttggcgcgccaggtagggggagcgtcaagcttttcgccgatcagtgcaatgggttccgtctccggcatcgacgacctcgtcttcccacccgggcagacgtttcggttcggcagcctcgacttcgtcaccaacaacttcggcaagatctctctccttgactcggtgtcggcccagtcgggagagaaccggctttcagtcccgtttggactcccaaacgcggctgaaagttacttcaagaccatctcaatcgagttggcttcaaaccactcgggcgagatcgcatcttctccaacgacaccagatcaagatgatggggcttacccaccgatcctaatgaagctccccgacgattcggcggccgcctccatcacgacagcgtcttcatcccgtaggcctaggcggaagtcggcttcaacaccgatttcgcctagcttcagggaagtcggcgtcatcctccaaccactcggcacggtttcgacggatcagttggacggctactacagctctcccaccgtcgactcgcgccccaccgacatcgtggagtacgacgagtttagctctcgctacaacgaaccggatctcgacgacttcgacgaaagcctagatgacaactacacccctctctacttcggcgtcttcatggccgataacgagacggaggagcaacgccaagcccgggagaccgaagcacgtcgcgaggctgagcgtctccgactggaggaggagcgtcaagcacaagaacaagaacggttacggcgtgagcagcaggagcgtgagcggaccgcgaaggaggctgaagatcgacgacagcgagctttggaagcagggcgccgagcgcgtgatctcatcggccaacaagatgttgaagggacaccggttttccgcacccctcagcagaatgcggttgccgcgatcaccctcctcgacaccctcctcaaggaaaacgagctcaatcaatctgatcacgtcgtcaacatcttgaaccagacgaagaccatgattgcggcttcggtcccagttaactccgaaagcgtccacacgccgactggcagccgagttccccacttccgatctcatgactaccgtcatccaagcctcagcatcaccggcgcaggatccaatcgcaggagcaggggtcacgacgggcggttcactcacctcccgaccatcatggggagcgccgagtggaacggcctcgctcaccacctcgtcgccgccccgtcgatcttcgcgacacgatcatacagcgccgagcagctcgaggccatcatcattcgccggaccgccatgacgatgaccttgacggagtagcagccttcaccgacgatctgcgtcgagtggattggccagccggcttcaagccgactggaatagagaagtacgacggtaccactaacccagaatcgtggcttaccgtctacggtctcgcaatccgcgcagcaggaggagacagcaaggccatggcgaactatctaccagtggctttagcggattccgcccgatcttggctccatggattgccccgtggtacaatcggatcttgggccgaattacgcgaccacttcatcgccaacttccaaggcaccttcgagcgtcccggcacacaatacgacctctacaacgttattcagaagtccggagaatcccttagagattacatccggcgattttctgaacaacgtaataagatctccgacatcaccgacgacgttatcatcgccgctttcaccaaagggattcgccacgaagaattggtcggcaagttcgggcgtaaacctcccaggacagtcaagcttatgtttgaaaaagccaacgagtacgccaaagctgaagacgccgtcaccgcatcaaagcagtcgggtcctagttggaagccaaataagggtacgccagctacgggaggaggtggaagtaacaatcataaggaccgcaagcgtaagcctgcggaacttgttgcaaccgccagtcactcttctcgacagcgttcgcgcgtcaacacgttcgacaagatcatgaactcccaatgcccgcaccatcctaactccaaccacgtggccaaagattgtttcgtctacaagcaattcgcggatcaatacaccaagactacacggaagaactccgacgaagaacaaagcacgtcgaggaagaaggacgacggcgacgccccggcaggatttcaagaccaccgcaaggagctcaaccatatcttcggcggccccttggcttatgagtctaaacggaagcaaaagttgactgaacgggagatcaatgctgttcaacccgacacgccccagtatcttcgatggtcagaaatcgcaatcaagtttgaccgctcggatcatcctgaccgagtggtccacccggggcggtaccccctggtactagacccagtggtccgtaatgtcaagcttcgcagaaccctcatcgacggtggcagtgcgctcaatatcctcttcgccaagaccttggatgacatgcagatccctcgctccgagctaaaaccaagcaatgcgccttttcacggagtaattctaggattatccgcaactccactcggccagatcaccctcccggtcacctttggcactcgggaaaacttccgcacagagaatatcagctttgaagtcgccgattttgagacagcatatcatgccatactcggacgcccggcgttagccaagttcatggccgtcccgcactacacttacatgatgatgaagatgcccggtccccgaggagtcctatccctacggagcgacatcaagcaagccgtcacatgcgacaaggagagttgcgacatggcccaaacccgcgagatgacgtctgtccgagaggatatccgactggctgcagccacggcgagcgaaggagaagtgcccgccaccaagacttcaaaaagtggagaaagcgaagccaagactaagaagattcccctagatccttctgattctactaaaactgctgtaataggcgccgagttagattgtaaataggaaagcgcgctcatcacctttcttcagaacaataaagatatctttgcatggaaaccatctgatatgcccggtattcctagagaggtgattgagcactccttacatgtcaaagaagatgccaagcctatcaaacaacgactccgccgattcgcacaagacaggaaagacgcgatcaaggaggaattaaccaagctgttagcagcaggcttcatcaaagaagtccttcatcccgactggctggcaaacccggttctagttcggaagaaaacagggcaatggcgcatgtgtgttgattatactgacctcaacaaatcctgccctaaagatccttttgggttgcctcgcattgaccaggtagtcgactcgaccgccggctgtgagcttctcagttttttggattgctactcggggtatcatcagatccgactaaaggaatccgactgcttgaagacttcatttatcacgccctttggagcatactgctatgtcaccatgccgtttggactaaaaaacgcaggagcaacttatcaacgtatgattcagagatgcttctcaacacagatcggtcgcaacgttgaggcctatgtggatgatgtagtcgttaagaccaagcaaaaggatgatttgattttggatctagaagaaaccttcgcgagcatccgcgctttcaggatgaaattaaaccctgaaaagtgcaccttcggagtaccgtcagggaagctgcttggttttatggtgtctcataggggcatccaagccaacccggagaaagttattgctatcctcaacatgaaaccgccaagtacccagaaagatgttcagaagctgactggatgcatggcggcgctcagccgatttatttcaaggctcggcgagcgggggatgcccttctttaagctactaaagaaaacagacgacttccagtggggacccgaagcacagaaggccttcgaagatttcaagaagctcctcaccgagccaccagtcttagcctcaccacacccgcaggagccgttgttgctgtatgtatcagccacctcccaggttgtgagcacagtcttggtcgtcgagcgcgaggaagaaggccatctccagaaagtccagcgaccgatttactttgtcagcgaggtcctagccgactccaaaacgaggtaccctcaggttcagaagctgttatatggtattctaattactaccaggacgctatctcactactttcaaggtcactcggtaacggtggtcacatcatttccactcggtgatatactgcacaaccgtgaagcaaacggacggattgctaagtgggctttggagttgatgtctttggacatatcattcaagccccgaatttcgatcaagtcccaagcgttagctgattttgtcgccgaatggaccgagtgccaggaggatacccccgcggagaagatggagcactggaccatgcattttgacgggtcaaaacgactttcgggcactggagcaggagtagttctaatttccccaactggagaaagattaagctatgtgctttggatacatttttcgacgtcccacaacgtcgccgagtatgaggcgctccttcatggactacggattgcaatctccctagggataaagcgtctaatagttcgaggcgattcacagctggtcgtcaaccaggttatgaaagagtggtcctgccttgacgacaacatgatggcatatcgacaagaagtacgcaaattggaagataagttcgatggactcgagctcagtcacgttcttcgacacaacaatgaagctgccgatagactcgccaactttggatccaagcgtgaggcggcaccctccgatgttttcgtcgaacacctttatacgccgacagtacctcacaaagatgctactcaagttgcgggcactcatgacgtagctatggttgaagccgactggcgagagcccctcatacgatttttgacttctcaagaactcccccaagacaaagatgaggccgagcggatttcaaggcggagcaaactttatgttatgcatgaagctgagttgtacaagaaaagcccttcagggattctgcaacgctgcgtatctttagaggaagggagacaattgctgaaagacatacattctgggatatgcggaaaccatgctgctgcacgcaccattgtcggcaaggcttaccggcagggtttcttttggcctactgcagtatccgatgccgacaaaattatacgcacgtgcgaaggttgccagtttttcgccagacaaattcatctaccagctcaagagttgcagaccatcccactgtcttggccgtttgcggtttgggggcttgacatggttggcccgtttaaaaaggcagtcggcggttacacgcatctctttgtggccattgacaaattctccaagtggattgaagctaaaccggttatcacaatcacagcagataacgctcgagacttcttcatcaacattgtgcatagatttggagtgcccaatcggatcatcactgataatggcagacaattcactggcagagtttttaaagacttttgtgaagactttggaattaagatttgctatgcctcagtagcgcatcccatgagcaatggacaggtggagcgagccaatggcatgatacttcaagggattaaggcgcgtgtttttgaccggctaaaaccctatgccggcaaatgggtgaaacagctgccatcagtactttggtctttgcgaactacacccagtcgggccacaggccagtcaccttttttccttgtctatggggcagaagcaatgttgccgagtgaagttgaatttgagtctttgcgctttcgaaatttccgtgaagaacgctacgaagaggaccgagtggatgacttgcaccgattggaagaagtccgcgaagcggctttgattcagtcggctcgatacttacaagggttgcggcgttatcataaccgcaatgttcgatcccgtgccttcctagtcggcgacctggttttgaggaaaattcaaactacacgagatcggcacaagttatctcctctatgggaagggccatttatcatctctgaagtcacccgaccaggttcctatcgactcaagcgcgaagacggtactctcgtcgataactcttggaacattgaacatcttcgtcgtttctatgcttaggcttatcattgtacttccctatcttgactgtcaacattaagttttcttcttgaagttgtcagtcgggggctatcattataataatggagtttgattacttatcaattcaatttgcttacttggtctatcattgccttgtttgttttttctacttagtctgcgaggactgaaagtttttaatagcttctttgggttttaggctcaacaaagcttgataaaagcttttaagaaatcaaagacttggctagaattatcaaacacagcataaatacaccagtattgtacaagttgagcctccatttgttacattcatactcagtcagaatcagttctttcatcatcagagttattgttgctcggctgaaggtcgttgttgcggaattgctctacaacgtcacttgcaatcttgtcagccgcattttgagcattggtgatgagatcaagagcagcttcttcgcttgtcccgtctgcaaagccatcaatggcgtcaatttcaattctcgggtacaatgatttggtcatcgccaatgccatgctagctcccatacttccagctttcttgatgttcttgaaatatacatccggagcaactctcagcttgtcgaaaatttcggttgcgtcgagtgcactcggaccactgttattgaggaacatagcttggacgagtggtgtagcgacattggcgacttcatctcttgctccttcaagcctcttgatcttaccaaccaggacatcaaattgagcttgagatttgattttgcagtctgcaaaacacatttatgataagaatctgctgtatttaaaagagagaagtccagattgttagctggtagtaccttcaacctccttcaaggctgagtccctttgcgcagccagttctactttgtcttttttcaaggcttcaatttgtttctccatttgagccatcctggtggcttgcgctgtttgaaatccaaatgtttgaggatacagttatgacagtacaaattaatgggacagatctagaagattaccttttgatgaaccactcagctcgaagtttgaatcctggagctgggcaattcggtcccttaattccttctctgtctttttggcgtgctccttggcctcgtgtagctggtccctaactgcttccagagttcccaaatgaggaaccagcttttctaaagttgcagtcttggcctcattgcgaagatggattctctgcatgatggttcatggtttagttctgctaaaaagaaaacaaagtcatcaaaggcagtcgcctgaaagatttacattcacaatacgagtggcttccccaagcgccttcttcagctggcacacttcctcatcttctttttgacggtttatgacgatgccggcaacctgtgagttctcgtcccaccatttgagcaagataggaggacgagaatcatcagccgcctttatgcggggaatttcttcttcgccatcgcccggtggtcctgatgtatttccaagacattaggcaaacaaactggagttatttaaatcggtatcacttgagaagatgagttacctgaggatgttcctagctgagcgtgaggtgacccttgttctttatttggagacccaatcattgagtctttactagtctctggtccttgggaagttgtcgtctgcgctccaacttcagggatttcttgatcgggacctgcatccgactggtttccagtcgggggctcttgggttgttgcagtttcagctgctgtcgactggtttccagtcggcggctggtcactcggatcggccttatcacccgaagcatgggcaccagtcggctggctttcggcagttggctcaggatccttggataaatttggctctgtcacggcttgatcaggatcttttccagttggatctatgtcggatggtttcctgcaaagtgttctttcaatatttagtataatttctatgagagaagcatgtcaaagggaaatggtaccgagaggtttatacctggaagatgttctaatctttggcatttgacggccagccagttttttcctgggcatggtacgcttcgagagtttattaggcgagcccttgtccccagatttgttgtcgtcgtcgccttcatcgttgtcaagcaccagttttctcttgcgagaacctgtctgtccagttggattggaggtttgaggttgcgaatctggtctgattattggccctccacctccctgaacggtgtgctggcgaggagaccggcgctgagtgattgggggatcagattttatcaatacatattcctgaataagatgcctccatggttagttaactcaacatgaagacaagatactattttggtcataggttgaagatttcagatacatacctgcggaggtggattgaatgcattatatggcacaactggcagctgatgtgagtagctgacgacaatagcatttgagaagattttatacattctctccttcatgattttaaaatccagagagtctggttcttcgcgattaggatcatgcttgccgtcaaactcaaaagctgtacgggatctttctttaactggcgccagtcggcatttgatgaagtgccgagtgatctgctctccttgtaagccttgttctttgagttttagcatgcggtccatcaactctaaggcttgggctgcttcgtccccaatcggaagagagttccaagtatcttggtacactggaggaagacaagagtactcgggaagagcaggctcaggattctgaacataaaaccagttcgcatgccaccctttgtttgaagtcttgaagggcattgagaagtacttctggctcaaagttcccctcagctgaaatccggctcctccgactacacatggcttgctcttgtttggttggggtttgagaaagaagattcggcgaaacagagcgaagtggggtttaattcccaagaaggcttcacaaacatggatgaaattggcgatgtggactatggaatttgggtttaggtgatgcaagctgattccatagaagcttaatatcccgtggaaaaatttcgaggtcggaagagcgaagccgccataaaagaaatgagagaagaccacaacctcgtgtgtatcgggggacggaaaagcctcaccgcacgctggccgccacccgatgatctccttggcagggagaacgccgtgcgccactatctccttcaggttctcctccgtcacgtcggatggcgcccattggccctcaaagctttctttctcttccgccattgattttacccgaatgcgctgatttgattcgggggatggctagggagaggtgagggattgaggcggtgaattacgggaaggattttgatgaacttttcgaaggtggatttgagtggattggtgaaccctagtttgcctgcgcagctccgtactgtagcagggagtggggaaaatggcgagagttccggcggggaagacgaagtggcgcttggatcacgggattttttgttaagggtatcggaggtgcgaatgggcttaggcctgaacagtacctcagcccaatacttttaacagcgtggcccattgtgctccttagggacttaggcattttttgctttggcaacttatgcgcacaatagtgttgtccaatgctgataaaatccttttttacgcggtcatataattcttcggaattattgcaatgcgaattttcaggtgtggcctgtcacgttcttttagggactcaggcacttttcgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctctttgccacgtaagtgtgcgtttttattgaccaatattatggcttaggctgattatatattgtagtcattttttttaggcggttggtaaatcctttatgagtttatttactcggattttacaccacatatgcctgttttcattatggtggatagtcatagcttaggctattagacttattcattaccataatttttataatatttggtgggtaatctttagagttttttattcggatgcctgtcaagtgtgttcattcgtgaaccttttagagtgttaaccattcggattctttttattatggctaaaaagcagtcggctagaatgcctctttatgcgccgcatatgcttttgtcatatgatgcatgattgtgctattattttgttctcaactatatgtttagtttgttaactaatcacatagttgggggctacacctaattaggtgcatctattcaatgcaccatattccttattttttcgccctttacagtcttcgtcttcgctactcggcaggccttggcatgaaaagtttgaagcactcggattattatctttgagaaggctatgaaggttgactgcaaaggtctcgggggctactgtggagattatggatatcccatatctacacggcgatgatatttggactggatataggataccgaatatatatagaatatcttatttgtatctcgggttcgtttcttaacttgtacatcaaggaaacaccttgagacttagtcggttacgactgtattttacctgtatctgcatattccgttagggatatagattatcttttgtaacacggactccttcccatatataaggggggtccgggtgcctctaggggcagagatgttgattttctccaaatcatacaatcaataatacactcggcggattcatccccggacaggagtagggtattacttcttgaataagaaggcctgaacctgtataaatcctttgtttccaaacccatacacttttccagcttgatagccaccctcttttattattgccgaaatctagtttcgacaagaagttttatgaatatattgctggaatatttggtttagaagatatgctctaattttccatgatgttcagatctctttctttctttggaaaaaggatttcaaggaaaactttcctttccatacgcacagagcaaaagaggtggaaatactctttgttgtaatataacctgtaaatattttgtacatattgtattttaatactccatcca

SEQ ID NO: 45124 - DNA, 5215 bp, Oryza sativa
  unsure (1)..(5215): unsure at all n locations
ggtgtcaaacatttcgaaactgatggagtatattagtgtagtgttagcctctcctgttgatttgctataaaaaaaatcacaacatttaacttttacatatacgtttgatcattcgtcttaatagctgacaaaatccaatacatggcatcactatcccttttttggggctatgtgtcttttgtttgcttaattagaagttgtttgcaacacttgcttgtgtatggaaattttgatcaagctatgtatggatgtaaagtacgtaagagtataatttgcgcataaaactttttagaagaccaagccttatccattttaagttttcgcccgtacatgcatcttctctcgtcctatttggagtaaaggagtaaggaaattaagttgatgacaatgtttatgaactgtacataaatctttcttaaactttgtagaatataaccattctaaaactactaagaaacttttaaggtgagtttgatgtggctgtctggctaggatttttggtgacacgtcaaaaaggaatttttgtatagaaaatttttacacgatataatgtttaacacttggtgaaatgtacttgcaaagaacgagaaatatgtcgtttagagttatcctttggtaaagaaaaaacactaaaaagcgtatgtgctccaattgtccacaccccacaaaatattccagatgtaggacctggcgccaactgggaaaagggtggtccacatttccaactaattacaattaaaacaagcaaaaaaaaagaacggtgggaccatgcctatttgtgggtccatcaacatctcgtccacctttgctagctttgctttcttatttgtctctcttctatactaccaacggccctgccggatactagctactccttggttccacattccattgcaagtaaacatggttacaatagcgcaagagacaatgttaattaggagaattttctctctttttttgagaactggagattggttatatttaacttactacaaatctacaatgctcagcctgatctagccgtatatttttcgatgatattgagaaaattgcatggtctcaatcttggatgttgtactcattagaaaagaaatggacgaaaccgtacgttcggccggtttctctattagtatatgattgtatcattcctctctcatactgtatgtcacgcagaaaactctgcactcacgtgagctacctgcagtataggttaaggattcacgtcatgctgcagtgtgctgcacaatatatagccatataggctactgtactggtactccatattccctccgtcccgaaaagaaaacctagaagagaatgtgactccggacatcctctcttaggttgatatatgtggatatgagtatgtccacatacattgtcctaagaggggatgtttgattctttttggacaaagggagtactccctatgtctataaaaaacaatctagcactagatttgacacatcataatactacgaatctgaatatgcgtacgactattcaaattcgttgtttcacattaagtcctatgtttgtttcatgtgggacggagggagcatgcactaatgcactatagccaatcaggaaattttctgtgccaaatagtaaagccatacagttctgatatctgggctttgaatggtgctgtgtttgcttcatatcccgtgttactttgaagcataaagccactacttaattgtatccattctcttcagatgagccgtgtgcagtacatactagtcctatgcctaactgtcaaaacagtgcatgcatgcatgcgcaaactagtagacctacaatactcacttcctaggcctctcgtgcaagtagctaggtaagcgatctcaaatactgtacatgtattttgacattaggaaaagcaatactgtagtcgtcgtcggccgggtacgggcacgttgtaaccgaacacgaccggttatctctgaattctgctgttttgcgcagcctacagtgtgcagtagtcgagactacacatacaagtgtcatcttcgcagaggacaagagggacaagatttgttccatagccgatgtacgtatcagtatcactgtccagtgtcgctagcttgctttcatcatcatctatatatactgcatctctttcaaaatgttactacctactatagaatattagacatatcttaatatgacgtgttaatacacctaaatttaacacttcagatgaaaaatagaaaaacatagtcattcaaaaaaaaatagagaaacatgatcagatttgaaaaaaaaaaccctaatttaccatatgtggccagtctgatcgctctcatatagccggtcggaccgatggtgtgggcccagtctgattactctaagtttgatttgttggttcttgggttttcttatttgggcttaaggattcttgagtcctaactgattgttgggacaaaactcaacaagtgcatgtgtattcctctgtatttaatgtgcttaactgtgagcaatgtttacatatttatacaagggtatacaagaagaaatttctttattgcccttggtcctatagtgaatctagagtggctggccccggccagcccttgggctattagtaaaattcccggtgataggagtgaggcgccccataagggagcggcacctattcccgagggtgcgcactattaaccggataaaggcctgctccgggtaatagcgtgcgccgtctcgtcatcgtcaatggtgtcaggggtagttagggcgcgtagtgcgcattcattctaacccactagcgcctggtcctcaaactagccttgattccctccgggccacgctgctagctccagaaaccttgccggcatgcgaagccctcgcgaggctccggaagccacagatgctccggagttcttgaccatctccggagccccatgggcagcctccgaagcctcgttgggctctggagctcgaggtggctttcgaagccgtgacagctctccgggatccttggttgtctccggagcgggggctccgttcggagctccaaggtagtattcaccctaggtcatctccctggggagaatggctcctcgaagccctgcaagcccttcgaaggctagccatttcatccggagccattcccccaacactgatctataagcctaataggacgtgaagaaaaactgtggaggcataaccaacccctttctaagagctatgaccagttcaattttaacccccgacctcaatccctacataatcaattgaattttttttacctttactttttagctatgccttctatttttccctagtttagtccatctttatcaattacttcgtaaatcattcgttttcgctgtgagagtgtgatacatctttattggtttgtcccgtaaactttccgattcgcccacgagaccggcggttatcttcaaatcgatataaatcagcctagatgctggtttgatctctaaacaagctccgcttatcggtttaatcttcaaaacccatcttgatgtagaagatggttggtgactctgttaacaccgcaaatatttaggtgaattatgtattggcagaaaaaaaaacaccaacacgactaattaagcgtggctagattcgttgcactatgtagaaaaaaatataacggaggaagctagtgattactgaacttgcaaagcaaggtgctagtactatcagggtattggacgaaagttcagcggtcgagcaggtaggtagcacaagcagaatttttcaagcagcgtatacatgaatcgtcgtcgtggctgcagtaatcagcgaccgggctacgcatgacgagtcggccgcgctccaacaagatgggaacgtacgtagagcgaatagcaggagaccacaattccaaggagtattcttcgtcaatcagggcgggacccggccgtgacgccaaacgtgaagagacgacgcaggcgctaatgcaactgggtgaggaatccgcgacttttattacctagcgcgtattggcctgacctctcgcggcagtctcgcctcaaatttatgcacgattgcgcggttaaaagtgctactcccatgatcccatcctggcctcctagatgccggcctgcaccagctggtgcgacacctgtcctgccacgatgtatttctatgccaagctaacacgcacgccgagtattattattatangnaantnntnggnncaacaatcgattttatctgcacttgcatagtactccctccgtccaaaaaaaaaagtcaaatcttaggtttccgtgccaacgtttgactgtccgtcttatatgaaatatttttataattagtgttttcattgttgttagatgataaaacatgtttaatactttatgcgtcacttatttttataattttttcaaataaaacggacggtcaaatgttggacatggaaaccagggtttgtcttttttgggacggagggagtactatactctctccgtaaaaaaaatcaacctaaaaccatgtccagatatatcgttataggagaagtcacatcaatcaacctataaccgtgtctagatgcattgttataggagaagacacatctctttctatgttgatttttttaaaacggatatagtatatccttaacaaaacagagttggtgatactatacgagaatgagacaggggacaatatatccatgtccatcaggtcatgtacactagtacgtgaccatgcgttcgatcggaaccagcctcacgttacaaaagctctcacagggtacgtacataggagtagtacgtacaagagcgatgtgagatgtccgtgtcggcaccgacatcgatatgaagaacacacagcgctaacagtgaatcgatccatcaccgtacagcgttattccaggcaagatcgcaacgcaattgctgttctcccgtgcagaattaagaggagccacatagttcaacgaccgtggggcacgcacgcacgcacaaacttattaacattgtctcgatctctgccggtgcgcacgcatatgcaaccatcgatctctaacactgtcgaaacaagatttcggcaatagtaaaaggggtggctatcaagctaggaaagcggatgggtttggagacgaagaattttatacaggttcaggccttcttattcaagaagtaataccctactcctatccggggattattctgccgagtgtgttattgattgtataaactggaaaaaagaatcgtgccccgagaggcacacggaccctccttat

SEQ ID NO: 45125 - DNA, 4636 bp, Oryza sativa
  unsure (1)..(4636): unsure at all n locations
tggggtatccataatctccacagtagcccccgagaccttcgcagttgacaataatagccttctcgaaacaaaaaacagtaatccgagtgcttcaattcaactgctccagcttgccgagtgctaaaatcaaagactgcgaagggcgaaaataaaacatggtgcatcgagtagatgcacctaattaggtgtagcccccgactatgtgtttagttgaaaaactaaacatataataaagaaccgagtggttttatagcgaagcacgcatggtacttagtaagatacccagccgactgcttctcaacttgaatatatcaaggacaaaaaatacaagaaggaccgagtgataaacactcaaaaggtccaaaaatagacatatttgataggaatccgagtaagaaactcttaaaatgatccaccaaacatgataaaaaaatcatggtaattaatgagtctaatagcctaggctgtgacccttaccataaccaaaataagcatataacatgctaaaagaatgactattaataaaccagtcatctcaaatcaacccaaacagcttttgcagcctaatgaagcttacaaaaacggtataacacctttctgtcgggcaccttttgtttgcatcgtgttaattctaaagaattatcaaaccacattaaaaaagattttaacaacattgggccacatcattgtgagcacaaattgccaaagcaaaaagtccctaagtccctaaggatcacaacgggacacgttggaaataaaattgggctgaagtactgtgcaggcccaggcctgttagcactcccgataccctaatatcaccgaagtgaaaaacgtctcttcgtcttccccgccgagactctcgccattttccccatttcctgctacagtacaaactgcgccggccaaactagggttcatcaaaccactgggtctagtaccagaggataccgccctgggtggaccactcggttgggatgatccgagcggtcgaacttaattgctatctctgaccaccgaaggtattggggcgtgttgggctgaaccgcattgatctcccgttctgttagcttctgctttctcttagattcataagccaggggtccgtcgaagatgtgattgagttctttgcgatgatcttaaaaaccagtcggggcatcgtcttcatcatctttcttctttgatgtgccttgatctccgtctgagggcttacgcgcgttcttgacatattgctccgcaaactgtttgtagacgaagcaatctttggccacgtggttggagttgggatgatgcggacattgggagttcattatcttgtcgaaggtgttgacgcgggaacgttgtcgggaagacggagaggttgtcgccacaagttcttcgggcttacgcttgcgatccttgtggttgttacttccactccctcctgtggtcggcgtatccttctttggcttccaagtggtgcccgactgcttggacgccgtgatagcatcttcggctttggcatactcattggctttttcaaacatctgcttgaccgtcttgggaggtttgcatccaaacttgccgactaggtcctcgtggcgaatgcctttagtaaaggcggcaatgatgacgtcgtccgtgatgtcggagatcttgttgcattggtcagagaagcgtcgaatgtaatcttgatgagactctctagacttctgaatgatgttgtagagatcgaagtgtgtacagccccccnccgggtttnttcaaanaagtgccccttggaaagttggcgatgaagtggtcgcgtagctctgcccatgatccgatcgtgccgcgtggtagcccgtggagccatgaccgggcggaatccgttagggccataggtagataattcgccatggctttgttgtctcctcctgctgcgcggattgcgagaccatagacggtgagccaagactcggggttggtggtgccgtcatatttctcgattccagttggcttaaagccggctggccaatccactcgacgcagatcgcttgtgaaggcagcaactccgtccacatcgtcgtcgtagcgatccggtgaatgatggcctcttgctgcacggcgctggttgatggtgtcgcgaagatcgatggggcgccttcgatgtggggagtgtggtcgttcaactcgacgctccctatatcgttcgggaggcgaacaaacagaccgttcatcatgtcccttgctcctgtgactagatccggcgccggcaatgctgaggcttggctggtgatagtcttgagatcgaagattagggactcggctaccagtcggggtgcgggtgcttgcagagttggctggaaccgaggcagcgatcatggtcttcgtctggttcaagatgttgacaacatgatcagcttggttgagtgcgtcttccttggggagggtgtcgaggagagtgattgctgcaaccgcgttctgctgggggggtgcgaaagaccgttgttccatcgacgtcttgttgcccaatgagctctctcgctcgccgcccagattccaaggcgcgttgccgtcgatcttcagcctcctttgcaatccgttcgcgatcttgttgctcacgctgtagtcgttctcgctcctattgctgtcgctcttcctccagtcggcgacgttcagcttcttgccgttcgcgatcttggttcgcttctcgggctcgacgctattcctccgtttcgttgtcagccatgaatacgccgaagaagaggggcgtgtagttgtcctcatagccgtcatcgaagttgtcggggtcgccgtggtcgtagtggtagccgaagtcgtcgtagtcgaggatctcggttggtcgagaactgacgccgggggagttgaggtagccatccaattcttcaacaacattgggccacatcattgtgagcacaaattgccaaagcaaaaagtgcctaagtctctaaggatcacaacgggccacgtcggaaataaaattaggctgaagtactgtgcaggcccaggcctgttagcactcccgataccctaatatcaccgaagtgaaaaacgtctcttcgtcttccccaccgaaactctcgccattttccccatttcctgctacagtacaaactgcgccggccaaactagggtttatcaatccgctccaatccatcctcaaaaagttcacggaatttctccccgcgtccaccgctccgattccccatccctttccagccgtatctcggaccaaatcaaaccatccagtccacattcatggcggaaaaaagagaaagcttcgagagtcagtgggcgccctctgatgtgacggaagataatctgaaggagatgttggcgcacggcgttcttctagcaaaggagatcatcgggtggcgaccggcattcggcgaagcattcccgacccctgatacgcatgaaatcgtggtatttgctcatttcttctatggcggtttctcccttccaacctcaagattttttcggggaattttgaatttctacggaatcagcctgcatcatctgaatccaaactccatagtgcatattgccaattttattcacgtctgcgaagcttttctgggcattaggcctcattttgccttgttccgccgtatcttcttccttaagcctcagccaaacaagagcaaaccatgtgttgtcggaggggctggtttccaactcaggggaaccttaagccaaaaatacttctctatgcccttcaaaacctcaaacaaaggctggcatgtgaattggttttattgtcaaaaccctgagcctgctctccccgaatactcctgtcttcctccagtttatcaggatacttggaactcattgccaacgggagatgaagctgcgcaagcagtggaactgatggagaggatgataaagctaaaagaacaaggccttcaaggagaacagatcacccggcactttatcaagtgtcggttagccccaatcaaagagaggtcccgcacagcttttgagtttgacggcaaacatgatccaaatcgtgaagatccagactctcttaactttaaggttatgaaagaaaggatatataagatcttctcaaatgctattgttgccagctattcacacttgttgccagtcttaccgttcaatgcattcaatcctcctccaccggtatgtattcaaacgtccaaccttcctcaaaaacatgatttcatctctcgttaaattgcttgacatttatgctcagaaattcgcattgatgaagtcaaatcctccaatttcccagcaccaatcacctcgccgccaatctggtcagggaagcggaggaccaagaattcggtctgaaactcaactaagtgcttctgatccaatcggccagccagattctcgcaagaggaagctggttctaagtgacgacgaaggcgacactgctagaaagctcagagaccgagaggcaaccaagaaactgctgaagcaggttactccaaggaaaaaaaacatccagtcgtcctgtgccaaagatcaggaagtcttctaggtacaactcatataacgatctcccttgcattgatgcacacccagtgaggaaataatactgataatcaaacttgcaggaaaccatctgatatagatccttctggaaaagattctgagccgaccagcagggaaacgaggctgcaggaat

SEQ ID NO: 45126 - DNA, 1231 bp, Oryza sativa
atttgattgttgatcgttatccatggatacattaggaccaatgattggtgatgaagaagagatcctccggatacaagcagctgaggattcgcgccctcccattctggtcaagtggtgggatgacaacatgcagcctcaaggaatcgtaataaataagcaaaaagaagatgaagaggtatgcttgctgaaaaaggcactcagccaagccacccgcattgtaaatgtaggctctttgacgcctgatctcaaccgtctcgtttgccatttagtccaggtgctaattaaactgtcttgcagaggattcatcttaggaacgaagctaaaacggcaaccttagagaggttagtccctcatctcgggaccctcgaagccaccaggaatcatctgcacgaaacaaaagagcttgccaagaagaatgaacatgatctgagggatcggattgctgagctccagaaatccaattttgaactgagcggctcatcaaaaggtacacacaaactctgcccaactaacttatgttattatctttgtaatcttgattaactagagtcaatgtagtgcaaactgccaagatatctcaactggagaagcagattcaaactctggaaaatggtaaggcagaactggcaagacagagggactcagctttaaaggaggttgaaggtaccaataatcaataccttaaaagccattatcttctatatgctgattcgttaatgtgaatctgttgatgcagaccgcaagatcaagtcccaggcacagtttgatgtcttagttgacaagatcaataggcttgaaggggccagggataaagtcgctaatgccgctactccactcatccaagccatgttcttcaataacgccggtccgagtacacttgatgctgccgaaatatttgacaagctgagagtcactccggatacttacttcaagaatatcaaagaagctggaagtatgggagcaagtctggcgttggcgatgaccaaatccctttatccaagagtggacattgatgccattgatggctttgcagacgggacgagcgaagaagttgctcttgacctcatcaatgatgcgcaaaaagcagctgacaagattgctgccgacgtggttgagagatttcaagatgtcgacttcggccgactgggtctgataattctgatgatgaaaaaactgatattgattgatataacaatgattttgatgattaatgatgatggaggctcaattt

SEQ ID NO: 45127 - DNA, 5063 bp, Oryza sativa
tactccattattatcatagtagccccccgactgaaaacttcaaggaaaaacttgaagttagcagtcggagaggaaagatacaaacgaaatgcctaagcataaaatcgacgaaggtgttcaatattccaagaattgttgatgagagtatcatcttcgcgcttgagtcgataagaacctggccgagtgacttcagcaattatgaacggtccttcccataagggagataatttatgccgatcctgtgtggtttgaattttcctcagaaccaggtcgccgactaaaaagactcgtgatcgaacattccgattatgataacggcgcaacccttgcaaataccgagtcggctggattaaagctgcttcacgggcttcttctagtctattgatgtcgtcaactcggccctcttcatagcgctcctcgttgaagttctgaaatcgtagtgattcaaattccacttcacatggaaacatagcttctgcaccataaaccaaaaagaacggcgactgtccggtagcccgactgagagtagtgcgtaaagaccaaagtacggatggcagctgatcgacccacttgccagcatagggacgtagtcggtcgaaaacttgtgcttttatcccttgaagtaccatgccattggtgcgctcaacttgtccattactcatggggtgtgccacggaggcataacaaattttaatgccaaagtcttcacaaaagtctttaaatgctccgccagtgaattgagtgccattatcagtgatgatccgattaggtaccccaaaccgatgcacaatgtcgatgaaaaaatttctagctttatctgctgtgatcgtgatgaccggtttagcctcaatccacttggagaatttgtcgatagccacaaagagatgcgtgtaaccgccgactgcccttttaaatgggccgaccatgtcaagcccccagaccgcaaactgctaggacaacgggatggtttgcaactcttgggctggcagatgaatttgtctggcaaaaaattgacaaccttcgcatgtccgcacaatcttgtcaccatcagacacagctgtaggccaaaaaaaccctaccggtaagctttgccgacaatagtccgtgcagcagcatgattaccacaaataccagaatgtatatccttcaacaattgtctcccttcttccaaagacacgcaacgctgcagtattcctgatggacttttcttgtacaactcagtcttatgaataatgtaaagtctgctacgaatggaaatccgctcggcttcatttttgtcttgagggagttcttgcttggtcaaaaattttatgagaggttctctccagtcggtttcgatcatgcttacgccttgagtatccatggcttcaattatttcttttctgggtatggttggttcgtaaacatcagaaggggctgcctcccgctttgaaccaaaattggccagtctgtcggctgcctcattgttatgtcagaggacatgggtgagctcaagtccatcgaatttatcttccaatttgcgtacctcttgtcgataagcagtcatattatcatctaaacaggaccactctttcatgacttgattaacaaccaactgagagtctccacggacgattaatcggcgaatgcctagagagatggcaatccttaatccgtggagtagcgcctcgtattccgccacgttatgggacgcacaaaaatgtatccacaatacgtagctcaatctttctccagtcggggagattaaaactaccccagctccagtgcctgtaagcctcttcgacccatcaaaatgcatagtccaatattccatattttcctctggcatatcttcttggcctcggtccactcggcaaggaaatcagctaaagcttatgacttgatcgaagtttgtggcttgaacgatatatccaaagacatcaattctaaggcccacttcgcaatccgtccatttgcttcgcggttatgaagtatatccccgagtggaaacgatgtgaccaccgtggccgagtgactttgaaagtagtgagataatttcctgacggtaattaaacaccatataataacttttgaacttgaggatatcttgttttggagtcggctaaaacctcgctaacgaaataaattggtcgttggactttttgaacatggccttcctcttcacgctcgacaaccaggaccgtgctcacaacctgggaggtcgccgacacatataacagtagcggctcttgcggatgtggcgaggccaaaacaggtggagtggtgataagtttcttgaagtcttcaaaggctttttgtgcttcgggtccccactggaaattgtcagtcttcttcagcagcttgaaaaagggcatcccccgctcgccgagtcgtgagacgaaccggctgagcgccgccatgcaaccagtcagcttttgaacatctttttgggagcttggcggtttcatgttgaggatagcgttgattttctccgggttggcttgtatgcctctttgagatatcataaatccgagcaacttccctgacggtactccgaagatgcacttttcagggtttagtttcatcctgaaagcacaaatgcttgcaaaagtttcttctaaatccgtgatcaggttatccttctgcttggtcttgacgactacatcatcaacataagcttcaacattgcgacctatctgagttgaaaaacatctttgaatcatgcgttgataagttgctcctgcgttcttcaatccaaagagcatggtgatgtagcagtaggtcccaaagggcgtaataaaggaggtcttcaagcagtcggattctcttagtcggatctgatgatatcctgagtagcagtccaagaaactgagtaactcgtagccggttgttgagtcaaccacctggtcaatgcgaggtaacccaaaagggtctttagggcaagacttgttgaggtcggtgtaatcgacacacatgcgccattgccccgtctttttccgaaccaggactgggttagccagccagtcgggatgaaggacctccttgatgaagcccgctgccaacagcttggttaattcctccttgatcgcatccttcctgtcctgtgcaaaacggcggagtcgttgcttgatgggtttggcgtcttccttaacatgtaaagagtgctcaatcacctctctaggaatacccggcttatcggatggtttccatgcaaaaatatctttattattttgaagaaaggtgatgagcgcgctttcctatttacaatctaactcggcgcctattacagcagttttggtaggattggagggatctagtgaaatcttcttagtcttgtcgtcgccttcttcggtctttgacagcttggtcggaggcacctctccttcgcttgccgtggtggcagccagtcggatctcttcgcgagcgagagtgatctcgtgggtttgggtcatctcgcaactttctttgtcacatgtgacggcttgcttgatgtcgctccgtagtgatatgacccttcgaggaccaggcatcttcatcatcatgtaggtgtagtgtgggacggccatgaatttggccagaaccggtcgtccgagtatagcatggtatgctgtctcgaaatcagcaacttcgaaacaaacgttttctgtgcgaaaattctcctgagtgccgaaggtaactggaagagtgatctagccgagtggcgtagctgacaatcctgggataacaccatggaagagtgcattactcggctttaattccgtgcgaggaatctgcatatcgtccagggtcttagcgaaaaggatgttgagtgcactgccaccatcgatgagagtccgtcggagcttgacattgcgaaccactgggtctagtaccagagggtaccgccccgggtggaccactcggtcgggatgatccgagcggtcgaacttaattgctatctctgaccaccgaaggtattggggcgtgttaggctgaaccgcattgatctcccgttctgttagcttcttgtagcgcccgttccgtcgtggcgcctagcgggaaaattaactcttaaaaaccctaattgcgaaatttgtttccttgcttgttgtctagtgcccgtgccatctcatgatctcaatccccgatctatcgtcgagttcaaatccgaatccaaatccttccaaatcgaatccctccgcaaagtttagtttgcctcccccggggttcgatgggccgaattccgctcggcccatctctctctccctctctctctctctccctctctctctctccccccggcgcgctccccccccccccgctcagcctcgcccgcacgctgctcgcgcgtgcgagagtcgccccgagcgcctctctccctccgctccgctccatcccgcacgcgcgccgcgcgcgcgtgtgcgcgtgtgccgccgcgccgagcgccccctcgctctccgtctccccatccctcgctaccgctccccgcgtgcagttgctcgcgcgcgcccgcgtggatgccgcccggtcccgccagcccgcgcctgtcgcccgagccgcgccgttcaaaccaccgcgcctcccgttgttttcccgcgcgcgcgtgccgagtggccgaccgcccggtcgccgccgtcgtcagcgcctgcccgcgcctgtcgccagtgtcgccgctccgctccaaaccgccccgccgtcatcgccgtcgtcatcgcccggcccccgccactccgcgcgcaagccgccaagggacggaggccgagccctcctttccccctggcgcgtcgcccccgctccctcctccttttcccgatccggcaaaggggcaagccccctttctccccctcctttttcccttttcctcccgccggcgtcatcccccctgtcaccaatttggccgctagccggagcgccagctcgcgccttgaccgcgcaagtcggttctcaaaccgacattgccgtcccctttaaacccccccggcctccccttacccctcctcttccattcgtctccgcgccgttgccgccgccccgtgctctgtctcgcctccgccgtcctccgccgagcgccgggagagccggtgcattcgaggacgcggaagggg

SEQ ID NO: 45128 - DNA, 13961 bp, Oryza sativa
ttcggtagtagctcgagtagaccccccgtagctagccggcgccgccccaaccgtcgccttcgctcgccgtgtgctcgccgccgtcgccgcccgagctccgtagcacccgctcgtcgccggcctcgctcggcgtagttccgcccaatccgacgctagcgtcgagttcccgaagccgcgtagatgctctcaccgacgggaatcgacccctcgtagcctcgtcgccgtttccctcttctcccgccgccggttgccgccgccgtaatccgccgccgtcgagcaacctccggcgaatccgagccgttggctcgcctccccctgtcgcgaacaaccgcccggtgtgctcgcttttgcccgtatcaccgtggttcgctccgccgctcgccgccgccgcccgccgtccattcgtggccgggtcgtcgtctaccttccgccggcctgcgtggcagccacgtaggcgccacgtcggcgccagctcagcctagaccgggtcgagccgaccccggtcggtccctccccgtgcgcgcgttccaccgcgagccgtgaggctgcgcgtgggcccgtcgcatccgcgtccaccgcaaaccgcgcgcgtacaccgcgttcctccccgcccgcgcgcgtgcgccgcgtgctccctccgcacggtgagccgagccgctaacaagcgggtcccacccgggaccgcgcgtggtgagcccggtccaccggtctctctctcctctcccccccccccacgcgcgcgcgcgcttgggccgtcttgggccggccggcctgttaagctcggccgagccgccccaaatcttttgggccgcgccctagccgcccgagaaaagtctatattccctccctcccttctttctttttctttttccaaaaaaaaaggatttaatttaatcctttttcctttagaccaaaatccaataatcttagaaattcaatatcttcccaaccgtaactccgtttgattccgttcaaattccaaaattcatcaaatctcgagatctatctagtggcacgcttagaggtcattaatagggctttattttcgctgtttgttgagttgccccgtttcgcatgtagtttcggagcccgaagacccgcagtgcgaggatttcgaggatcaagctccagatctcgagcaaggcaagccacctttgaacatcttgagcctatatttgaaatttaagtatgttgcttgcaaaatattatgcattgataggatcacacttaatctgttgtcccgtctgcgaagcagattggcggacttacctaaattgtcacatttgatccttccattgttaattgctatgccatgtccccttgtaaccacccagttgcgccttgatactcgtgcactctgtgcgagtatcgacggtcgccttcaaacttaaaatctgagtaacaacttgggtaaaactggagttttacaaaagactcggaaaacccgacacttgggtcggtgcttgcgaactaaatgaatttccaaaaccgcggaccggggaacgtaccgggtgtacggtttcccgctctcgcacttaaggaccgattccttggaatttcatccaaacataagacaagtacgaccacatgggtggaatggaacacccctggctgagtaactagcttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgcatcggctttcgaaatgccttgtcatgaaagcttggaggtctcccgacgtggctgatccccacgggctgggtgacccgggttagtaatgtcgtgtgggtaaaatgtaccccctctgcagaggtcattaaactgttcgaacagccgtgcccacggtcatgggcggatgtgaggtgattcctagcgtagttttgtttgactactgcttgtgaaattgctgttgtgaaactgggttcgatgtttggaaaacctacagctgatgggatcagctaggcccgggtggcagtttaaaagttgttggcccgggtggccgtttgaaaagagttggcccgggtggccgttcaaaaagcttttggccgggtgccaaccttgtttcaagatctaaagactgacacattgcacatactccgaccggacgagacgcactgtctcatccgtgtcgtttgagaagcactcacttagttgcttttagaaaagagttccaaataaaatcaattgcaaaaaaaaaaaacaacagcctttccttgaagcctgcattaaacacttatttcccctggcttgctgagtactcccgtactcacccttgctctatataaatatttccccccccccccagttgctgaagaagatgaagcggatcctgctgataaggagttcttccaggagcaagccggctacgatgagttttagggtttcagcctagttcccaagtcgcgcctgtgattgtttggtccaagtcctggcttccgctttccttttgtaatgcagttgtgagctcgggatctgtccgcagcccaacatgactgtacttctactctataatgaagagacttctgttgctgtgatattctgtctccctgtgataccagcactgtttcctgggactggtatcgattaacaggttaatttggagcgtcacgggttagttccggtcgggactaattcggggcgtgacacttctgctttctcttagattcataagccaggggtccgctgaagatgtgattgagttctttgcgatgatcttgaaaaccagtcggggcatcgtcttcatcatctttcttctttgatgtgccttgatctccgtccgagggcttacgcgcattcttgacatattgctccgcaaacgcacgcatatgcaaccatcgatctctaacactgtcgaaacaagatttcagcaatagtaaaagggggtggctatcaagttaggaaagcggatgggtttggagacgaagaattttatacaggttcaggccttcttattcaagaagtaataccctactcctgtccggggattattccgccgagtgtgttattgattgtataaactggaaaaaagaatcgtgccccgagaggcacacggaccctccttatataggggaaggaatccgctttacaaagtacagtccatatcctaacggaatatgggattatagataaaatacaatcgtaaccgactaagatcccggatatttccttgacatacaagtttagaatctaacccaagtcctcatagagatattctaccaagtcctcatagagatattctatttatatttggtaccatatatccgactaaattataactgtcatgtagatatagggtatccataatctccacaaacacgaacgtcttgacccaaaccctaaaaatcgatgcacaattgcacgaagtcttggcaagctagcttggtgcatgtaccgatcgagataagacgtcgccctcgtcggagaggccgcggcgaggagatgtatacaggggtgggccaattggattggaacgggggatggatctgtctcgcacgacgtatgtgccgcgccggggaacacgctccttttcgtgctacaatctcaccatctccttcgaccacttcttcagtcttttcatcttgtggacgatgcacacacgctgtccatgcatgcacccgtcttcctgcagcctcacaattaaccgtctgcttcggccacaagtagtgtatccatgtcggtaattgtcagctggatttcgtcgcgtttctgcaggtcgtcgatctcacacaatctatgcgtgtatagcttgctttctgccgacggctatatacagcatgcgtgcttttgttagactcgatcactttgtggatgcggagcattgtaattccaagccatcagcccatcattatcatcgttcgcgccggaaagaacttcagatgcctatgcttttttcaagctgcctctgtatatcctcactggtaatacggctgatactagctgctagtgctgtttttttcccctttctgcgagggttaacttaactacagggtagtcccctcttgtatttaactatgttacctttgattccgaattccccttttttcccccgaaagacacctttggttctgaaatctgataacatgttagtatttgacgttccatgaaagagcgtcttacactcttacgttaaattggttaatcctttttctccatccaatgatggactgcctacttcaatttagctcttttaaatttagacgatctttgttagtacgagtggaatttcatttttgagtttgcttgccctgtacctgtttctctatccaaccttgacatcttgttgggcctagtactatggtattgggccggtaaaccaagtccatttattcacaaggtgtgtacgctacccaagagtccagaaatccagcagatccttttcacattgtgcatcttccatttttcctaatacatttgacaattattagtagtagcccagacacaaacttgtggtttccgttcaaccggcccctctagtggaaaaggctgactgggacttctagaagctgtatgcaaatcaaagtcttctttacccctttggtcaagggtctagattgccaagcttattggccgtttagaagacttgctagcatcgattcaattgggcagtgctacttttaaattatcatcaggtgcgtcattgatcattggtctgaattttctacggttagcagaattttttttccatcagttaggtgaaacatggaagaaatcttcagcgtctttcatatggagctacctgataaatttcgatatatttgtgtttgatttgaccacggttaatgaccattcacatgatcatgtgaggaccttgcgaattcagagaattatacaaagcagttccttgtagtaacttttttttttgtcaccgtatattagtattgtatagttttataattttgatgagatccggtgctggtcaatttttatagatttatgaatagcaaaacgctggtctgaggactgaggtaggactgattgtattaggatatcttcatcttccaaacgaagatacgctgttactctgtttaagcaatagagtttggagatggctcaaaaatgcttcagataggagtacttttttaaaaaattaagataattagtacttattttaaacagaaaacagttaagattgagacgcgttcttctgaaacggactcaactcaaacgtgccactctcacaggggagagatatcgacctgatagccagatgattcgaattgatccaatcatgtgcatcgtcaccgatgcgcacctgtggaaattcacacgacgaaaccaccccctccgtctcacagctcacaaatgggaaacccaccaaaaatgacaagcatgcatctgccgaacggctcatcctatttttgcattgactgcaggaggccgaagcacaaatgtttcgtatttacatcttctttacactatttttcacttgaggtacagtgaacggtcgtgttgtacacatctacttgaaccaaaaattgagaccggaggaacgaaccctgcagggccctgccatgccgtggcattcagtttgtgtccgactgcaacggccaggcagcgagtgtcatacggcgaactgctgcttcagggacttgggcgtttggcctccctttagccttacctgcatgatccagcaaagagttcattagcaagatgctattggaaactgttttatttccggcaactaatacaattcaatgcagttcttttgtgggtaaataatcgttagaaacttcaagataatagttggggtttctccctgttcaatactgtgacagttaaaatttgacagggtcgtgtagattccctggccatgaatatcacgctagaaactgtcacggatgtgagggatagtgacagggtaaacaattgcagttgtgatgtcaattgagctcattgtacacggatggctgcattttccagatatttctagagaactgtcctgatcggtccactaggctgtgacatccaacgcatggaaaatatgctcaggccattatgttagactaatcttcttcatgcgggttttccttcaaattctaatcggtttggagtgatttgacagtctattttttaatgataaatgtgaaaaaaactgaaccagtactaaatcgctaattaacagcattccagagcaacagttaccagttaaaccgtgggaacaattcagctagtaaaccattactgcagtaattactcgtagctatctgaaatttcaggtggaggtaagaagtttggtggggctagtttgtgcgtgaggaatcaggaatctccaatgcagaaatcgcgaggacctccttcgcacagttgctcacaggtactccgtccaaaaaaaaaaagataaacgctggtttccgtatccaataattgatagtcagtcttatttgaaaaaattatgaaaaaaattaaaaaaataagtcacgcataaagtattaattatgttttatcatctaacaataataaaaatactaattataaaaaaaatttatataagacggacagtcaaacgttggcacggaaacccaaggtttgtctttttttttttcttttggacgaagggagtacacggcttggtcggcaagggctaaagcagattccatggcgctatttgactatgtcgacgcgttacctatatcacatttggccgaaagcgtttgcgcaaatgggcaatacaggatacacccggcaagcgtattgttctacagaatctctctaaaacacggattggaatctggaaagcttgcatattttgggtttaatatgtttccaatccacactacaagctacagctaggcggaatcgtttgtttctctgttttgtgcgggcgtgacatggactcggtaaaagaaacaattgatacgatacgagcaaagaaagggaatcgatcacttacagcttcgacgtcgattctgtagacgagcaggcggcgtcgctcgcggcagctggcgcggtaggccatggcgatgtgcgcggcggcgagcgcgagcgacatgaggaacatggcctccacggcgacgagctggcccttgccctgcagccccagcacggccctgtcgggcgccgcgccgaacaccacggccgccttggcgacgacgtagcacaccgagccgacgctgcacgccacggccacccacaggtaggccgcgcctcccccgcacgccgtgtacgcgcctgcacaacaacgcccaccaagtgctcgtcagccaaaccaccatgacgacatgagatcgatgaacacgcagaaaaaaagattaaggggatcgcatcgaatcgcacatacgcttgataccgattgcgtggtggggttactcacagaggatgaggagggagcgcgcggcggagacggcggggaggtcgacgagcgatgaccggaagtggaagcccctggcctggtcgatgagcgaggtggggtggttcgcggcgcggtggaagttggagaggagcgcgggcgggagtagcaggtcgaggacgacgatgagcagcggcggcgcgcagacgagcagcagcgaggcgagcatggagacgaggaagaacaccgtcttggcccaccgccacggccgcgcccacagccgctcgttgtgcaccagcggcagctgcagcttcgtcttctccaccatgatcaccaacgtcgagcgaccaattcacctactagcagatatagccgcactagcaagatcgatcgatcgaacccgctttcttccagtggtttaccggtttcggtagggttgcgggattgatggggggggagtggattcggtcggaggcggcgagctttttaagcggaggcgatcgaagaacgcgagacggaaacgggggttttggtgcgccgcagggtcagagatgaatagcgaataccaggaagaagaagatgacgacgacgacgggtagtaaagggaggaaggaacaagatttgaccggccaggtgggcccacgcgagtacccgaccccacggccacgggctcacctggtgggccccgtggctgcccttagtcgccacgcctgcgctgcgtcagcatctgcgtgggcttcgttgagaaccttcccccgcgcttgcggcttgcgtatttctcaacgagttttcatcgcggtttcaggtgtacgaaactagagaattatggcgattgtagcagtacatgaacacgtagataaattcaggggagaaaaagaaaccggtggatggaaattcctgggaacactttgtgctgccgtgtagtacgaattacggcggctatgcctttcaggactagttaacaaaatcttttattactaacaactgccatgcagggccggccctggccctatgcagccgaggcgaccgccggagcccatgatggtggaggggccaacacctaatactagtagtctagtacctcatccgatgttgagatcaatgtttttttattcagaattaaatgtgtgattcttcgatgtttgcgcctgagattcttaagttcgttatggatgcagattgctatccaaatgttttagttgcctatcgaaatctattaactgtacctatgacggtagcttcagctgaaagaagtttctcaaacttgaagttttgaagaactatttgagattaactatgtcaaaaaaaggttaaatggcttggctatgtgctcaattgagaaggatatcttgaacactattgattttaataccgttattgatgattttgcatcaagaaatgcccgaagaagtatcttttcatgggagcaacggatatgatggggttttgttcttcattaagttaatgaataatgatattagttccaagttacaaatatattgttatttttatttcttcataattaccagacatgttaaatttaatatatggtgtatttgttatcgttttgcaagtaaaattattatctctatatcataaaattttatatatatagtttagagggcccatcgcgatgagttcgcttagggccctcagaatcataggaccggctgccatgagttgttcattgcttattcatgagccaaatggagcgacgtactacttctagaaggaagtgcaatttgtcagcgcgatccctgttatccacctgtctctcgtttgcaacgtttatcagaaaaccgatcgtgtaatgaccaaacggaaaaaaacgacaggctgatagcagtacacacgactaaaaaaacccgtgcttttggacacaacacatggcagccatgtgactcaaaacgcgatcggggcagttcaaaacatcccaggttgaaaaccacatggccgcgatcgatttcgacgcacaccaccaccggtactccccctctccacatgccgtgatttccgctacaatttcgcagcggcgccaacgtcccgatcccttgtggtggagttgggaagccgcggggcggcgcgcgcatgcggtaaccgttaacggccgccctcgtgatagccacgagtccaaaggcctaaaaaaaaaactcggtcctccatggctagccgccctgcagatcgtcgtggattattaagcgaccggccgtcccgttcccccacattttttacgaggattctcacgggttttgagtgctgggacctgaccccttggagagtcttggacggcttgtctggctgagttgagtatagctgctgaccagatcaacacttccaaggcgagctttctgccaggtagcagcactgctgcctgcgtctgaaactctgaattgtttggcccgggagcatctcggttaattgcaatatcagggtattcttctcgaattaaccgtgggtttgtttgttgcgtgtgccctctgcgtgtttctggcattctggtttcagaaatcagaacgatggatttcgatcagttgacgactgaatatttaagagaatcttggtgacggaatcacgagcaactgttgcttgtttgacaaaacgccaagaagcttctgatggtgatctgatcatgtttcttgtttgacaaaccatggagaagtttccgctgatgatcacaacgggagtttttttcgttctctctccttcgttgttggtttgagtttgaccgggagctgtcgtttactcgtttagggcctttcagtaatcagaacctaccccactactagtattgctggtctttccttcacgcattacttttcctccggtcaaaatttggactctatgcaaatatattcacgtgcaagagctggagcttctaggttgagctaattgcaacactcgctgttaattgtacaacctgctgttgtttgtgagttcatcatatctttgagcacgggacaactgcaaataggtgtcaattgtggattgtatggatgccacgctgtctataataaatgctgcaaactctgaacccagctgttgtaaattcgtagagtaccactacatacaaaccggccgttccacgtgccaatgatgcactcaagtttgtttttatataagcaagttgaaaatacaggataggctagctaaatgctcaaaaaaaaaagaagagagggtttttatttttacagggtaggccagatatttgctttgtatgagtccaattggagggtgattagaggataagacaatcccacgtcaccccaacttaaattctaaaaccagtgcgccttgtgtcacatctttatctctttgccttttgacttctcctgatctcctcatcgtcacgggctaatccacttaccactcaaatctccggcatgagttaaccagaagactccttttccgtgtaaagcagggcctttaattgtagcccttgaaagattgtgattaggattaatccgaatctagcttcttatcgttaatcccctttctcctgacagcacctctgttgcttgcctacccccaaccaattctcacgtgtgccccaaaccgaattaacggccagcagctggtttgttcatcaccactgcaagctattgagcacatgatcctgtcaagccaaagatggcagcaacatatcaatttgtgttatgcatttgaattgtcgagtacacatctctccgatcacgtgtgattaattagatatgacaccagaaagacgtactgtatcctgcaagcaaatcataatatcatattgtacagatttgaatgacgggatcagccatgggaaaaaagttggcaacaattccaaattattgcggtgcgagcagcgacgtcactgctttgatatttcgcggcatgcagtgagtagaggcggagctcggccgtttcaggtgatgaggtcacatgccgatgccgccatggccgcccgtacgatttcctccctcgcgtgagctcagctcgatcatacgacagcgaccatggccgccatatggccgtgtatttccccatcgtttcttccatagttcgcacattccgttcgtatgactacagtactgttatgtaccgccttcgatcagagtcgatctccttacgaattgatctgccgtatcccctattcccctgcgaatcgtccatacaacgtgcttgactatccgttcgatctcttatgtacggtcgagatcgagaatccacctttgcatcggaggccccccttttttattgcaccatcaagtatatcctgggctggattaaactctacattgctagcactctggtggctagggtttcctatttagggggtgtttagatccagggtgtaaagttttggcgtgtcacatcaggtattatatatggtgttgcataaggtgttcggacactgtaaaaaaactaattacagaatccgtcggtaaaccgcgagacgaatttattaagcctaattaatccatcattaacacatgtttactgtagcaccatattattaaatcatggagcaattaggcttaaaagattcgtcttgcaaatcagtcgtaatatgtgcaattagttattttttaagcatatatttaatacttcttaaagtgttaaacgttcgatgtgacatggtgaaaaaaatttggggtgagagctaaacaggacctaatggaggaagcacaccatgatcaatttaaatatgtaaaataaaacatttttataaatattttaataaaaataaaataaaaaagttcctcgtctttccatcctgtaagataagcctggcccaggaaataaaggataatcaatttaaatcctcactggactggatcgtgccttgtgctcagtttaacaggaccatcaaatgttcagtccgatgtcaggagacgaagggaaagcggaggcacatttgtggagtataggaagaagttcactctgactcccttaactaatggctaaatctgattcgcattcttaaaccacaattcctgatacactctcggcggtttcactgacgtggctcctacgtgacagtgtcgatctgtcttagtcccacgtagcgtttatgtggcactagaattaaaaacatatacgtgggacccatttatcattcacacaaaaaaaacatttgtgggacccactgatatgtgggcccacatcctttcttcctcatccctctctcccttctctctttctcttttctcttccctttctctttccttttggctggagcagcggcggtgacaggcaagtgagggtcgaagcggtgaaggggagcccacaacggtgatcacgaaggaagcggtagagacatggtcgacgaggtcgatgccgacgccatctctccccgctcttatccccctatgctccgtcacatgaagggcctctcgatggacgagtgacaggggtggcgccgtggtgggcaacaacaagatgagggagagggtcggaggggagatctccagctccccgatgacttcgcaaccaggctgcgccaaccttgtcgtgtcatcgccacccatggactccatcgtagggtaaagtagaaggcatggactccgccgagggaatcaaattacactggttttaatagttggggggtggtcgagatattcggtattatggtttagggatacaaaacagattcgattgctagttaaggaagttaaagtggacttattccgtggtatatatgttgcttgtcgctaccattggtagaccttgacgaggatagggttcttagtgagcgggggtggtgtcgttgcagaggatggagaaatgcgtccgagggaccagccaccgtcactgccaatgccgtaggagagtaggggtggggaggatgaggagggagagataagaatggagacatgtgagacccacttttgttttgtcacgtaaacagctagtcagcacgagtaaaccgggtcaacttgccacgtcagcgaaaccacccatcaacagcgcgagtgaaggatctaatttaatcgggtttgcaagctgaaagtttaatatttctggcattacggatagggtttgtaaattaaactcagcgtaaaggtgagggttgccatgtggacttattccgccttacgacataccaacagcatggaacccatcaaggcccactaccatctagcccagctgatagactatgaggcccagtcttacattccacgttttgtcacttttggatcgttgggtcgctcgtcgtgttccgtaaaccccaccccgtctccgcagatccgctctagctgcacgcctgcaccttgctggcttggcgagtggcgacgaaccaaatggactcgcatcgttgtcgccggggccggtcacccgccgtctgtgcaagccgtcgtcgttcgtgccgtccattacctcggtcgatcacgtccaaaacactctacaaccaagggaaaaaaaagaaaagaaaattggggaaaaactttggacgactccgcctcgttgaccggcgggccatggccatcagttaacgaggccgcacaaatcggacccgatccaacggccgaaaccccaccgaaacaccgtcgttttcctcccctcttttcccctcctcccccgcgccccaaaaagagagagagagaaggatagtggcttggtgcaagtg

SEQ ID NO: 45129 - DNA, 13296 bp, Oryza sativa
  unsure (1)..(13296): unsure at all n locations
cccccccccccccccccacatctcccgcagagtccacggccgatccatcccctcgtgcaggccgccggcggcggggaggaggaggaggaggcgatggcgtcgtcgcaggccaacctcgacaagatgcagctccgccagagctaccgcaacctctggcactccgatctcaccagcaccatccaggccgacttcccatgtatgtcaacttttctttttcccccctctctgcgaatgctaatactgcgccttcccatggcgagatttcgttctgatgggttctccctgtcgttgttgctgctgctgatgcagattgctgcctcgcgctctggtggtaagcgatcctcgtcgatctccccggctccatttttttttaccccgacctgatatattcgacgccccccttttcttctagatctgggcgaatctgtctttttatttctgaattaaactagggtttaaggaattctaagtctgatgagcataaggacaatgtgtgattccgcattgagttgttcaatcactcgcagccgtggagattgcctagattcttaatgcctgtttattatgcgcttgtttgcattcttaaatttgatcggattttaggtgcgaggaatacattgcgacattaagggacgcgttgcacctttgtcagttccttttattctttattactgaaaggaccgcggaatttagattggcctcaggaatcagatccaggatgacacattactgtttcatgtaatatattttgttcaacattacgcttcaaagttctcataatggcaaaagtaaaacggttcctggataggaactaaactgaagtttgtcgttttaaagacagctccattagcttcaagcatcagcagcgtcaatgagcagtcaccgcataggttctttgattttcatgcaatgctttcctgatttccctagtcacctcctcgaccagcattactttcctctgcagccgcaaggcaaaggcattttgtctctatcgcaatgacccatatggggtaatacgggatattcgataagatactatcagcgtgatggatccacaaagcccattcagtacctgcaggccctaaaagaaagatatcttttgaatccacattggtgccagtgtttgtacattccataagaattgcaataaaatgcgttgagagcatatatggtagtcctttcatttgtctagttctatttcttgtttaagttcccgccctcaagctcattctggaccatgtcaccttatcatcaatagctatccacaaaaaagattttagtcttctgggtactctgcttttccacaggcattgcatttaaacggagtcgtgtttcattaatctgtacaatgatattctgtggtgtctttgagtaggcagaattagcatttagaaatgttaattttttacccagtatttgatcttttacattcccccctttctgttcagtggaccatgtgtgtcatacatgcttcgcaaaagggctctgtataatgacatgtcaaggtggggtttcttctattttcttctacttgctatggttagatacgaacattgtgttagacctccctgaatccattcccctgcacctctgtcttgtagatatgtctgctgtgctgggtacatgccatgcagtgggaagtgtggtgaaagccgatgcccagagttctgtcttgctactgaggtacaagatccattcccttttttgctgataaccttttgatgactgattaggctgaatttataggcagcatgtcacatgtaacagttctcatgtggctatgagtattgatggtttttatatttcttttctttgctatctggctttgtaatcagcctgtaaagactgttccatttccggtaatatgattatttatttatttatttatttttttttttggggggggggggaaagtggtggccaccccttgctaaagaaaaggagtattgatggttccttctgtaatatttgattacctatattttctactgatttctggatttcacatatttgttgtgctcaaaaagcatgcttttcatggtatttctgatagtctgaaatacagttcagtatgacaatattttttctgttcttcttttttcaatgaaagagcaccagggtcaatgattctggggtaaggataatttggctgtattttgttgttatcttgtttgatcaatcgtatatatctcagattagaacgggaacatgtaatgcttgtcttgaatggagtaatctccaatactgtcactattcctttaattatgctatttttgtgcttaccttagaactaactagtactttatttttcaggtgtttctgtgctttggtaattcagttgcttcaacccgcttcttgctccaagatgaattcaacatacagacaactaaatgcgataactgcatcattgtactgtcactgtcctcttgttgtttgttttactaacttttaggtataattcctatgttccctttctatgagactataacactgcagaagatcactcttttcctgtagggcttcatgttctgcctccaacaaattgcttgtatcttctctatagttgccgctattgttggtagtgaagagctttcagaggcttcccaaatcctttcctgcttgtctgatatggtctactgctcgtaagctctcataactctgttattttctcttctccatagttaagtcccccaatgttgataatcttgtgacctgtgcaccattttttttttgcagggtttgcgcctgtatgcaggtaaacatacataatatctttggtgattatttactcactcttcttaacctttgcgtatccatcttatccactgaaatgcatgtgcagacccaacacaaaattgaaatggacaagagagatgggaagttcggcccacagcccatggcagtgcctccaatgcagcaaatgtcgcgcatcgatcagcctattccacctcctgttgggtacacaccacaacagccagcatacggtcagccttatggtggctatcctcctgctccgcctgctcaaggttatccaccagctgcttaccctccggcaggttacccccagggtggtgcataccctccccctggctcttatcccccacctggttcctacccgcctcagggctcctaccctcctccacaaggttactacggcaagtaaaggaaatgcagaaattggagatatgtctttgtgacgaaatcggtatattgtgaacaatgtaaacattagggtggttgtagtgttattataggtgatgtcgatatattaatcgatctgtgactggtctgggtggtaaactgcaaacataatttggattcctccgggtgtggtatactgtgaacccgtttcgtagaaattatcagctccccgtgttgatcattcttgaatacgttcttctctgaataaaggatcgccatgaaatgtcaacttagatttggaactttttatcagaatttggtgataacattgcctgtgtagattgttgcttgtctacaacgaacaatcaacaactggagcttgtatgtgacccgtgttatgtctgaatctctgaatattacgtctgagagcaacacagattgacgcatcagatactttttttttttcaccagaactttgaatttacgatcagtatatgtttggttgctttatagattttggacatgagtagctggatagcaacctctatatggattatgggtgctgtttttcgctgccaatcttcagggaaccaacgtgcagcgtcttccgagacagtgaggtctcaacggagttgtccgttctggttgagacgtagctagccgtgcactagctccagccttaattgattggaatatttgacaatcagcacagcgattatctggaagatgttaagccacatactaatgaggaagacgatgcaaaactatcactaaccacacactaaaaaacagaaacgtgaatatatatatggttggtcttgtgtccctgctggcttgctggaagggctctcgcatatacgccggaaattttcgggattatcatgagaggctagtgccagccttaatttgtcttgtggtgttggttaggcctaattgtccaattaatcaccaatagtccaactccagtttggcatacctgctactacttgatacaaggcccacaaatatagatagagattccgttccatccataaacgcagttgaattaatgctggattgcaatggcgtgcgctttttgattatttgactagcagaaggttatagaatggtcaatgtatatgcacagcaaatgaattagtcttggggttatgtatgcatgcaggtacacccacgacaacaaaattaaaaactataccaacaagaagaatttgcttgagcatatctgctcaaaaattacaacgcatatgccagtggtcagactagtatgtatgtcatgaatttgtcacctctgactaattaataactagatatacaatttaagatgatcttattacttatgagtcaccatgtcttcttttgatttgattagcgagtacgtcaggtatacatttttttctgccctttacctgtattacatatagaaaaaagaagtttgtgttataattcagttgttaattactgaaacatcaacattgtattactgtggataaaatacttggataacggtttgtttaccttttacgctttgatttaagggttgatgtctgtgagttgttgtgccagttacgctttctctgattgatgaaccagttgttgatttgcttgagctgcaggccagtctcttcaacaagctttgccttatcatcctcctgtaccaagaaaatatatatgccactcaaccaactgtattatatccatgcaattcttcgtgcatatctgattagctaattaataaatattattgcttcttgctatattatatataaatattaattgtaaagttagcacatcaagatatattgatcaacaagttggagaacagctaagaagggctatctcgactagtagctagttagttgcactcttgcaagcatgcttgataggtacaatgtactcaccgtggggtatggccacttggagtgttgctgccaccattgcttgagtatggtggtggtgtccccaggcaactttcctgccctcctcttcctcaatatttcttctctcacatcctcaatccttgacttgaagccctgtaacgaatttaataatttaatcagagataagattgcaaaagtacgtatcaccctctagttaattacataatccaatataattaatttaggaactgattgaagaactagcaatagcatgcatgcatccagaagtagctagtcttagtcagttattgtcagtcacatatatagctgaggcgccgcatcaaacatgacaccaattaatatgatatgcaatgatctaggctcagtcttcagtcaaagtattctatgacacagtacaaggaacttaagaaggagattttcatgctagtaactagctcatttaagctgatcatgcactgtttttgccctaaaaagcagctagctagcagcagtagtactattttagctagctcggcatgatccttgcatgaacagtctcttatcaatgtttaagcatgttaaatgaacacgcttaaacattgataagatatatgcatgcatgagttgaagagacgaatgtaggtgcatgcaagacgtaagaagaaattaataacaatgcatgcatgtacctgcttgagctcaatcttgagctcttgcctgacccgctccatgagggatcgctcggagtcggtgggcatgagcgggccgaagcccatgaggtcgtgcccgtccgagcccatatccatcgggccctccagcatcggcgccgtctcatcctcgtcctccgacatggtcgcccctgtcccttcctccaaagttgcacctgatgatcaattgcatatgcatccaggtaagtgtaaatcaactactgtagttaattaattgatgatcacatctcttgtaactgtcctatttctttaatttatttgattagttattcctatatctaataacatgaaaaattaaagattagcttgaagcaagtataataacatgaaaaagaagagctagtagctagcaaagtttgtcggttatattcaatctagattgtgctacacagtgagttagagctaattagctagggcatgcatgcagtacggaggcatgcatgagggctttgtcgacgtcggcgatcgatcgagctgcatgaactggaacgtgtgagatcgagcagagatagacagttgtacgagctatgcgcatggccacttgaaacagcttgaaagctacccaatcgaaaagatgtctctgatttggagttttgcatatgcagctctcgccagctgcattgcctgcatgaaacagctcgcaggaactactagctagctaccagtgtactttgaactgcctagctagataagttagcatattatagctccaattcgatcttcgtctttatttcttcttcttcttcttcttcttcttcttcttattattattattattattattattattattattattattattattattattattattattattattattattattattattattattattattattattattattattattattattattattattattattattattattattattattatagtttttttaaagtagcatggctttgatgttatgctctaaagcaaccaaaaccaactgaagcgcgcgcgcgcacacacaccaaaataaaaaataaaaataaaaattcaacctataaagaaccttagaatccaggtcaaaagagtggactagtaatttaacaacttcccagtgtcctaatttacaggtgaaatgtaatttttctctacctacaattgaagtttacgtatgtatgcgcatgctaagttttcaacatctatttcgccaatcatcatgggtgtttttcttcagttacattacatcaaccctgatgctttttgaatatgcaatgactactatagttgaatcccaatcgatgcatcatgattatgacgatgcccctcatgataagaggacgatcgccaagagctcgatcggccggtcatatcatgtcatgtgacacaccttccactttccatggtcgtgtgtgatatatattattcgacagaagcgaagcacctgaatcatttaattagctagtcgattagacgagaggcatggactttcaactccgagccaggattagcatggaacctagatgactttcatgtaacctagattctgtttgagggagcttttgatagtcgtagcttcttttatataaccttttttttcaaacagtttaaattttcatctagattctaagaaattatagttattgaatttaaaaaatgaactagaagtttaaagttagaaaacctatttttttccatattctcaccaattgagtgattgactactaactagctatgcttcctaaaatctcaaagctctccaaataaggcttaggtagctgttacactacctactagcttttcaatatcctctcagcgatttctcgctagctagcaaccaaccaaccaatcggccatgaccgaatggcagcgcttgatctgcgccggagatggctaaatgcattttataagttcatggattgttttcttagataacagattaatatccagcctctacactaataaggatgtatatatccaacccatggttctcttagcaaaggatagtttcattagatttatgccaaatagttggttcaaattttgttgttggaattttttttatttcaactgatcataaacctccaattgagactttgtgagaaaagaagaaaaatagctagctagtcacctcatatcagtatatatatgaactgattaagttaattttaccaagggtatcacgtctaactacgtacacatatatatatatataggccttagaaaccttgactatgctattctctgttaataacacaaaatgattataaaaaaaaattggtgcccttgtttttgaactggaaggattttatgctaaaaaggaatatctgaaattgttttcgtgacatctaccgttgggcttctgggctttccctagtatacgggctgccatctatgtgggccttggtaattccgtgttatttatcattccattgattcgagtataaacatcagcaataaagtcgctgttaggtacgtgtgttagagttttcatatttaactaatctcctctgaatacacctgtagaaaccggaaccttagaagtcaaggcatgcaaatctgttgagagggaatcaagagaccatatatatgtttgaacaagacgctgcaactaatatatcactgcaagagctagcggcaacgaactaaaaaaaaacaatttcaccatctaatctaactaacgagaagagcaaaaaggtgaacaaaaatcataaagacgacaccatggaaatcgaaaaaaaaatacagaaaagaaggcggcgagaaggagagggaaagtaatgaaatatgtaatatatagtggaaaatatgtaatgcatgtatgatactgtagtagttaattaccggttaggtcctgcaaggattgctcgatctcgcggcacgccatgacggcctccacggcgtgcacccggacgtgctgctgcagctgctccctgaacgagcacagcagcatcatgtactgcgcctgcatcgatcatttcagtatgcatatatacagttagcttggctggatagcttctagttaatcatgtagctagtgcgtacggtatgatacttgcatgtaatgtatgcatgcatgcacaaatgcaaagattaaattcaacctagtgaaattaatcaagcatggcgcatcgaactcaggaagaaattaaatagatgcgtacgaggaaggagtcgagctcctgcttgtcgtggggggagaggaaggggcggtggtgcgcggcgtaggagtggaggaggccgctggactgcgcgagctgcgcgtcgatcagcgggaggtggtcgatgggcgtcgccacgcgcaggcagcccacgtgcgccgccaccagctgctcgcacagcgggtgcaccgcgatctcccccttgagcagctgccgctcctccgcctccgccgccgccgccgccgccgcagccgccgcagcagccgccgccgtcgccgacgacgacgagcactccccgcctcctccgccgccggtgaacgaccccacgcccatctccatgcctccgtgatcaccgccttgcatacacaacacgatacgcgtatacaccgatcgatcgaactcgccgcgcgcgcgcgcaccaagagcgagcgagcttgttgggctcgatcggttggtgcgcgtgctcgctcgcgcgggtgaccgtggccgttgggtacacgtatgtatagctgtagctagagctctcgctagctagctctaatggccagcgagaaggcgcgcggagagggatttaatggggagttggttagcaaggacacaaaggagatggtgaggggtcttttcgagggttcctaaggtgggaggtaactggaaaagaaagcacccaagaaccttcaattcaattcccttccccctaccttagctcggtgaaactggagcttggatgctaaagcatggagaagaatatattaatccagcacgatgagagagaaggtgtgtccacgagaggatagagctgggaaaaagctagctcgctcgctctaacttaactcttccgatttcataattcttaatgttttgaacaagattaggattaaatatttagaagtgcgattatcagtaactttaaaaatattaaaaataaagacactaagagaacatatataattttgtctaacaaaatattaataataaaagcaaaaaatatatttatttattatatacaatatagataaaagaaattaatcaaagatgtattttggagatcatgtcattggaaccgaaacagtaggttgtaataagctagctaggataggtggaagaagaaggtggacgaggagggtgaggtggttttggaatctaattaagcatgtccaaacctaagaaaaggtgcctaccgaattgcactatatgcatgctgtgctccaaaggcggtagaatcgatcgtacataggagctttcatcttagcttttgcatggatcattctttcctttctttctttcttttttcaatattttagatcaaacttaacaacagtcggtttgaagctgattgagaaacgagaatcgcatgcacgaattatatatatgtgtatgttgctgtcgttaacaattcctcatgtttcggtcagcgatggttcaggattatacatattacataccatatatatagtatctggagttcaattaattgttgaatacaaccgatgaagtgtcaatgatcatgtacaggaataggccggggagtttgttcttcctgtaaactaacctagatagctaacctaatcctggcttagcttgttgttctccttgtaatttggtgcgtgaataattaggagttggtttcaagaaaggaaatacctttggtggtgtttgggagtttcggttgcctctaccaactttgcggttggcgtcgggaatgggcttctgctggctagctagcttagctgctcctgcttctgctgctgttggtcgtcgtctccattattggctttcccctgctatagctgcagggtgagtgcatgctttgttagtattagtagtacgtaatcaatcagcgtattagtagggagatcaacgcctttaatcgatcgtacgtactgctcagcagtataataatggtattggttaggcatacttttgacagctgttgtatatataatcgcccatggtatgacgggcccgtcttctgtagccttgtctttatcatatcttaacaaaaggataatgacatgcatgctgcctgctgtttagggttactgcaactttaatatattcgctatgttttattttctcttatgaggacgcgtagtcatactgaatcatatatatatatactaattaacttagtttgtttgggcaaaaataaacatgaatagtactacgaatatatcatacgattgctggtttgtttgggaattaagcgtccagcaacgactcttattggtcagagatcgatcaactctagcttaggctgcactgcactacatgatcatgctcaagagatcatcagttaattaattaatccgtaccgtacatacacctctcagaacagcattaacgtagatcatgctacctagcttgtccattatgtttcaagttagattgcctctctccagccattaactagctagctagcttcattcagtcgtacgtactcccatcgcgtatcagctgcagccggcctgcaggcgtatcagatcaagagatgcttgcattgtcagcagtagcagctggtagtagttgttatagttgttcgctctggtagtctcttgtgcctcttgatttgccaactgccgtcttccattaattaatcctgaagaaaattttccaaattaattccacgtttggtctttgtactccctatcagtggtgatttcctcgagtttaacaatgaaaaaaaatagcattgtatacaacctgccaatttaagagaaactattttaatccatcgagaggatgttctctcgttgtttgatatcacttaaatagttattaaatttttttttaaaaataagaagatatattaatagcatgtgatatatcacaggccataaacgtgcaagttcaaattcatcttatacatctcgcaacgaaaaaacaaattaaactataagtagttaacgtatattcataatcaaatttggtttttttacaagatatagaagttgaatatgaacttgcatgtttgtggagtgatatattatatgcaaataatgagagaacatccccatgagggatcaaacccaatttaattctaaatcgaggggtgggtggaagctaatcagatttttatcaagctttcttcgaaaacaaaatcatgatttactttttttttactattttgtttcataacgagctgaggcagggtgaaaacaccttccatacaaaattaaatatttttaattttaaaagaaaaaatagannnnnnnnnnnnnnnnnnnnnnnnnnnnnngagccagctaaatgatgtaaggtaagtacattaacattagtagttcgcagctgagagcaagtacgataacagaatattaagccagctataaacatagtttaaagagataaaaaaaagagagaatagcagcgggctatagaatctgtagtcagctgtagcacgaacttcaaaacgtagcgtgtgtataataggtgggactaaatattaatagtatagtaagcaattattgtatgaatttattattatattggctctagatgatttggagttagtagttgactagagatgttaataagttaccatgggctaggcgcggttaattaatcacggcagcggcggccggacggcggagccggcaggggtagctttgcagcctgatcatgcatgcaggtcagtcaaagactcggatttgatcgggtttgtacgtgtacttttggtcacccttgacgatgattatgcccacacgttttgcacaagattactatagatcgctggttgttgggcatgttggtatattaatgcttaagagcagtaccaactactagttctaaactatatatagtcaatttcatagttaattaatatatttatattatacttacctataaatatatactctactccactagtaatatttggtcctacctgtgtctttgtgctgtagttcgctgcttttctctttcattatttattttttcgatatgtgtttatagctagcttatagtttgctattgtacctgctcttagccctgatggcctccttgccccgcccgtccaattaacgaacctctcccttgccggtctctacctctctgactaaatccatgcatatatgactccatttcttttgcttgcatcggttattattaactctttttccttaccaattcgtgcacaaaatcgatctttttaatgagaagcagaggaagaagtagtacttaatagctagcagcaacacaaccaccttgtccacttttaagttttctttagtggacagacatgacaaatgaacaaaacacatgtgcctttctaagcagcttttagctatataatacatttctttatttaagattggtgtaacaagatatatagagccataaaattaattcatcctctttcgttatttcccattaaaaactgtgggctcagggagcaggagattagctcgaccggcctggattagcgac

SEQ ID NO: 45130 - DNA, 2245 bp, Oryza sativa
  unsure (1)..(2245): unsure at all n locations
ccgccgcgccggtggttgggcgagctgcccgcgtgcgcgacccagcgcgagcctgctgctgctggtccacgcacgcacggcacgaccgcgcgatacggagagaaggcattgcttccgccgttgcggtcggccgcgcggcacggcaacgcacgatacgaacgatacggcgcgagaccacgagacgaggcgggaatgggattacgcggaacgccgcgcggggcttggctgcttggggagttggatccgcgacagcgacgcggcgcccacggcctacggcctagctgtcgcgcgggcttaaacctgtcggtgcgctgctctcccacacgcgcctctctccacgcccgctgccgcctgcccgcaatgcaaatcttgccgttgcacgcggaccagtttttcaacacactgattatgtactactccttccattgttccgtcatgggaaccataaatagtgctcgtattttcgactaaaaaccgatcaataactgtgaaattttttaggttctcatgcgggatgaatggcctgtttgagaagcttaagattataagaagcaacgggttggagatagcttttgaaaatttaaaaatgctaggtttattagtttctagcttttcattttttttattatacaactgcaacttctcaaaaatcaaaatggactgtttggaggagcttctgattttaggaaaagctgctgaagctagaagctctctcaaacaggggctgaaagtagattccgagcgaaattttgaatgtttttcgagaattcaaatttaaaacagtaaatttgatcgaaaccgtcgttgcgctcaatcggggaggtgctatactgtagggaatagagtagtgcatcttgctttggctgtagagagactgccacgagtaacagaggggagcacgtacaagacattctcgaccccggctgactattatttattctacgatgagtcctgtatacttctgggacgtacatgctgatagctacaccaagcttttccctgcattttccaggccgagtcactgtcgacgagcaatcgaatcttgcggggaaacgttcgcgtccacgtcggtccgtcgtacgaaatgcaatcctcccgtgcgggggcctcccctccctcgttgcaanatacatatccactctgattggccccaacggtgatgcttcttgataagagttactcctagcttctgcttcaggccggacagttttgcttctttctggctcataagctcatcgtttgtttccaatttcactagtagctctgcattgtgataagccatttcggcagatttcaacagtatggagtatgtgcttttagttaataaaatgctgaactgattagttagtgctggtgctaacatttgaggcagacaaatggcacaaaacggtggccgcaacagattagttagtgtgtacgcttctacacactccaaaggagtcagaaaggcaccaaaagagaggacaagacacgagggaaagaagaagagaaaaaaaaacaagaataaagcagtagactttggttgcatgggaaaatttgtgtgcaagacgaaaggagcattacaggcttcttttaatacagtcttccagatttggatagtaggacctgaagctttacggaaagcaaagtttttaaagcgaaagctcaaaggaaaaaaataaaaactcctagcagggaagagacggccggagagggatgtgacacgaagtatttcttggtgtgctgaaatttcacctccatttggtagaacaactgttttgatgtagtacaacaaggttacttccaagttcatcaatcgtagtttttggatataaaaaacgagccatgacattcagagatcgatcgctttacttgctttgacaattacaccatccaatggacttccacacacctgatgaaaacttcactgaaaacgatcatttgctagacaaaagggtatccagcactgtaccatgttttgcaacagttaatctgactttgtttcatctgtataaaaattggcaccatctgtatggaagcgtatgcttgttagagtagaggagggtattttgattgggaggagaggatcgagcaccaaaaatggtggagaaataataatttcggttggtgagagaggcgtcggttggagagggcgtagaagggtcccaatcggttggttggtccacctacaggcattatctatcccatttttctttctttctttctctaatcttcttctcttgtctctttgatcgggctgcaggaa

SEQ ID NO: 45131 - DNA, 15732 bp, Oryza sativa
  unsure (1)..(15732): unsure at all n locations
tacagacctattcaagattcactcagcgtcctcagtacataccaaaaaacaatatgcttaactctacagtcttaatgacatggcatttctgtgaaggtttcagatatgaaaacaagaaatagaacttcactattgaaaatagagctcagcctacatttcttacttttcggaactgacatgactaaagaaatgttcaattttttaagtgcgtccaaagattgagagttatcatgcttatttcacataccatataccacggtatttaatatggtactataaatagaataaacaagagttcattaaagttcagaactataaacatgggctgcacaatcactaaagaaattagatgtgtagcaaaatacctgactgcctgtgtcgacgcaatttaagtgcatattcgtggtggtattccaaaatcgtatgcatctatctgcagttcctccaccagatgcaagcagcccatgaagatgaggtgaccacgcaatagctttgacagctgctgtatgctcagtatacttcagtaccgggtgcgccgagtgttgattccatacataaagctggaaaagagacattgatatggacataagaaattgcaaccttgaattccatgtaataccaatgatccaatcaagaaacaattcatggatgcattcttactctgttgtcattaccaccagatgcaagctgacggttatcataagaccacttgagcccacagacctgaaaggtgtttggaaacagaatatgcatattataagaatatatcaaaagggagcacaataggataatccaagaatctgacatgtcggaaaattcataatgatgtataaaatagatcacctccgatttatgcccagcaagtctactaatataatcatcctgggcacggatatcatggtgaaggatgctcttgtcacgactgcctgacgaaagcaatgatgaattccatgcaagagcacctactcgcatccgatggctttccatggttcttattctcttacaacgagtggcatcccatacctaaataagataaaatccaaggtgacagtcagacaccaaattgaaattgtagcattgcataccaatttcagagctcaacaggattaatcgataatcatcaaatactacagcacatttgtaaacagagattacaatggaccaaattcattctttggagtaaaaatgaaagtcattcagtttagtcataaaactctactgcgtctatcatatattatttgtgcgaaaaattaggtccactgttaatagtattgcaatttttctgatctttccataagtgagttgtatacttctcaatgtttccattgacactctagataaagattaagctaaggcatcgttccaaattttggtggatcatgactatgttatctgatcatttcagaaaggggcatacgtctaacctgaactttgccttggtttgtccctacagcaaggtgagtgccacgctgtgcccaacccactgaacagacattgtcatccacccccaaatcacatagcttggtgacctgcacagcaataaacttctttacaaaccctcttcaagtacccaaacaagaatgcgcatggatggccgcagttggctcaccttgctgctgcatgcattccataagtagacacaattccccaatccaactgcaaggatattatgcgaagaccaatccacaaggttcaggtagaagtcatcctgcaatgcgggagcatccagcacctaagagcaacagaaggaaaattcatgtgagattttgagtaataagctttcatatcagtctctttatgcatgacaaataacacaggattcttggtacagagcagatgaataataaagaccatgtttttctcaattcaaagaaacatcaatcaagaaacagaccatatcaattgaaagaaactatgaaatcgaaggcgaacacttctcaccttataaggtgacctagggatcttcctggggccagtgcccctcgtcgtgaacaccccggggaagagcacgccctcgtcgtccccgtcggagaaaagggcgcgcttagcattccggggcacctccgccttgaacctgaatatgttgccggtggcgggtgagcccacgggcgacgccccggcggaggaggaggaggagcacgcggacgccgacgacgccacccggtcgggcgtggtggggccgaagagcgcggcgcggaggagcgcgcagtagggcgacgaggccggggtagatccggaggggggcggcgcgccgggggaggcggcggcggcggcggcgtcgtggtgggacggcgacggggcgaggtcgaagagcgcgaggttggatccggcgcggctggggatgaagcggtcgctgtagaccgtccgcgaggccggcgtgggcgcggaggaggacggggaggggtgcggcgccgcggaggagacgcgggaggacggcgcggcggcgaggcgcgacgacggggtggacgccggggtgggcggcttggaggacgcggagttctccatcggcgaccgcggcggcggcggcggcaggtggtggtggtggtgatccatgggtgggggcgagagatttggggatcgggagttggaggggaggagaggagaggaaggtgggtgatgcagttgctgtcgttcgcgcccccgcgctttctctctctctatcccttcgcgggctttttttttctctctctctcttttgcctattttactgcctttttttactcgactttttgcttcgtcttgttggtgttgccgctctttttttgttcgcttcttccggtttgggccatatacatacataaataaataaataaataaatgagtaaattgtcatttggtccaccttttattatctaaattttattttggaccacctttaaatctatcttttcaatttggaccgggtaaatttaccattgttgcggtttagactaccgtgacaacttttctcgtcatatttaacttctctttcagcaaacatatgaaccatatatagaggagatcgactgtatactagagctgatgtgtttaaggttgttgattgtatgagaaaaaaatcattcgtggtggtccaaatcgcaacaatggtaaatttatccaatccaaagtgaaaagatacgtttaaggatagtccaaagtgaaatatagataataaaatatggcccaaagcgtaattcactctaaatgagtaaatgctcacgctcagccgctcaggatgatgtaaaccgaaaccgatcccgtcttttagtactaatccgacgctaagcatatacatgtctctctcgaatctcgatcaggttgtgtttaggacaccacctgtgacgtgtgtgatcaacataaaatcgatgttatatgaatttgatatgtttttttcttcaaacatttcaagtgaaggaaataatgtactggactacctcgcaaaagcaaattagacggcagatccttggaccagcacggctgattttatgtcatcgtttgggggaaaaaaaaacttactactccagatggtgtttaaagtgtacgacgatgtgtatcgtaatagtcgcccagtgacagggatcgcggcatccagctacgacgatgctgccagcaacagcagaagataccttcaagattttctttctcgctcgggccgtccgaagccggccaaattgtgaagattaacatgatagagctggaaaacgaacaagcaacgacatggttgctgcacgctgcaagtctcaggattgattgccgtggatggcgatggagaggggaggacaggttcaaatcattttaagatacatgtgttaacgtgtgaggcaatatatagaagagtaagattcatgtaccagtgattgtaatggtgaaattatctcaaatcgagcatctagcgggggagttaaaatcgggcgcccccacgccgtgcctcccgcgcgcgccgcccccgccacgtgtcctgcaccgctcccgctatgtgtccccaccacgcacgccgttgcaacaaatcacctacatattacggaaaccccctattaagggaatttgtttcattttttgttccactaaaatgtttcacctaatgtactcataatatttcactatgtatgaatcaaatgttgcagtgagttgaaatattcttttgcaataaatcaccagtatactatgtaaactctctgctaaggaaatccatttcattttttttccacaaaaaagtttcacctagtgtactcataatgttttactatgtatagatcaaatgttacagtgaattgaaatattttgtcgctatttgctgaaacattgtttttatatagggtgaaacaacgctcgattttttagaaatcgttgtttcatacgttgtatcaaaatgtttaatgaggtgatttagttgtgttacagctttttaaaagactgaaatattttcgatctatttagttaaacatattcgatctacttgatgaaacagagcctgattaaaaaaaaaatcggacacccgatttataggcgcctcgttgtaatgttagtgctcggggagggcacgagtccgacctggattagtgtggctggacgtggacgcgatgctgcttgagaacctgggcccaaaccgatgctcttatctcaatcctactattataaggagcacctcgttttaatttgagctggtcgattccttcccgtgctgaaatgatcgagaaaaggacgttcccgatccgtgtcctcccagcttgtcgagttcatcgtttccattcgggacagagagagaaaactcgaatcatcatccagcggttagccagctatctccgagaaatgaacaaatggcaatcaatcaatcatgctcctccagcaagccgttccacggatgccaattgcacacctgacaggcaagctacgtacgtacaggaaaacgacgttcctttgcgtaatctgatcaatatccaggaacagatcacacacagatctccgattttaatctgatcaggcgcgtttcagctgttcagattgggccaaagctcagttgcaactatcaactagtggtaggagcaagtagtagttgggttaaccaaacacaggagaatcattccagttaattagaagcaccaagcacggcacaaagccaacagggtctgaaatctgaacttcacaaccgggcaatgtctcctccattgcaagaacacagggccccgcagcggccagaaaatcagagacatgttcttgtcataatgagatatcacgggcatcttatttactgaccacatgttcttgccaggacgggaagtgaatgaatgcgtcgacaaacaagacctgaaacaaacaaaatccttgtccatgtagtgatgagctcagcgactgccttttttctatatcatgagatggacagtattatgagcatagttacccctcccagggcaccacaaaagatgcataaaaccaaccagaaaacatcaggcagtggacagcagacagcatcaagcattgacagcaggcgtgcgtgcctcagggagacgttaaaatgcattggagaaggcattccctgcaaacaagtactgtgaaaagcatatactctagttaaagaacgtctattcagatgggatataatactctaaaagattaggtttagttctgagctcaacaattactaactttaggccctcgacatcaaactcaatgagacaacattccaacatcagtcgccactgctatgaccagatagttatatttgacagagatttctgagaagtgtttataaggtcgatattaagtagcaccaagtatttgtcacacggtgaattacattctacatagagattgatgcaagaaacaacactttcagtagaaacttaatacggatatataaccgtaacaaaactgagggagcaaaagcataacactgaggctcgctcatgctcaaagtttactatctagtagccttcagcccctgttactgacagcatatgatatcttgataggtcggccgcgcagttcagattgattcattcctacagccttctcaagcgactcgtcgtcctcaaaatcaacatgacaaaaaccacgagaatcacctgttctcttgttgatagcaaaccttatcgatgaaatcttcagtgacttgaagaagtcccttaagtctgtttctgtaacatcccatttgagattgccaacatatgctgacagacacccatcagccttcttaggatcagtttggaactccacagtccttttcctcttcgagccagcagccaacctgcatctttcaactctcataaacctgttgccactgtaaacacaatgcatatatcagtatagagcaaatgctccatggcgtgcttccatgagttgaagagaaatagccactcctcatccttacattttgaatccgtcaagctcaagagacttcattaccacctcgtttgactgaaatggcacagtagaacaaaatcagtctatcaaatcaaactaaaagtaaccaactttggcaagtatgttccatgacaaatgaaaattacaaatatagtatgaaaaggaattccactgttaaaaattttatttctttatcagctttccatcgatccaacaaagtcatgacatacagtattgttccatgcacagacatccaaggattgtagtataagattaggaatacaactatacaaggcttttaatatgatacatacaccagtagaacgacatttctcaataccagtgaaacgacaatcagagcaatgtaacaataatcggataggtgcagaccataagactataacagcaacttcctctgtagcaactagcaagtcataacaccaagttgattcagaatttcaggtagaggatgaagcggccatggctgcaaatgagcattcggccaaccatttgttacctccaaagtccaggacaacttaagacaaatagtagtacaatcatacggatgctgaaattatttggtgcaacatcaagatggaaataaaatggagcataatagaagtgttaattcgacagttacctcgaaggagacgaacgcgaggccgcggaagttgccggagtccgggaagcgagagagctggagcgaccggaggggaccgaaccgctcgaagagctcccggatctccgcctcggtggtggtgtacggcaggccgctggccaccaccttgccggtttcatagatccccgcctcctcctcctcctccgccgccgccgccgctgcgggcgctgggacaggctccggctctggctcaggctccggctcaaccgccgggcgatcgccggcgtcgatgataggctggccccacttgtccttcctgggcttcttcctcttcttgctgttcccggtgctgggtttggttcgcggagtctgctcctcagctgccatggccgccgcctaaaccctaatccttcctcccggctttgcctacgcgccgccgccgtgggttatgcggcaacaccagcagaacagcacggcagaagatcaggaccgtctatccacttgggacatggccaccataacaaatgtgttgcaattgccttttttttttaaagaaaaagaaacatagtataaacacgaacgctaatgacctacacgcatttaagaaaatcttactctataaaactgaacaatcttattataaaactctttacgataaagttttcaaccgcttgatttaactggatgagagtcgtaaacaatttagattttttagagttcagtaagaaaatttgtgtatagccttttcctctatttttttgagcggacaatcgtcccattctacttaaatccttgtgcaaagaaaaatcaaacgtatagtcaatgtatacacaaaattagtgtatatgctgcataataaatattacatccgtcccgcaatatagcaaccaagatcggatgggatgaagtgtatatgctgcataataaatactacatccgtcctagaatatagcaaccaagaatcggatgagacgtatccagattcgtagtattaagatacgtcccatccaattttagattgctatattctgggacgaagagagtaagagtaaacggcagctctttacaaaacataaaccttgctattgtgcaaggcactagcagtaccaaactaaagatatcatcattgtgctgaatcatctggtaattgtacaagtcactggtctgatcacaatttcacatcgtaattgactaggaacaaaagattagcttcccagctttgtagttgtacaaggtaattatgcgtcgtccgtagttgaagtccatcgttattgtctgaaaacccagcgctagtacgtatcggtaacttaacgctattgctgccagagatataccggcgatagcataactgccagagaatgttcaggttacagaaaatcccagcagagcaagtcaatattaaggttagagaaattctgagcaaagcaggtgcactgtgtacttacgcctccgacgtttacattattttcacctctgtatagccgacagatccggatcaaaacagaaaaaaatgcagaaaatatggaagttgccacatctttttgcaaactaatatgtttcgtcgaatttaatctgggttttcatatagactagcacagaaatagcaatactcttgagattgcctgccaaaccaatgtttgacattatcccataaagcaagcactcaaacggttgaaaaatcacagttaagaaaaccgtttacatccaagacggatctcacaagacattagtccacaacgatgataatacttctcaaactccgaaagcaccctttttccaggtcatattttggtctaatccatatttgcagaggcactcattttagatctagcaagaactaagcgaatgtgcagcatgggtccctatgccaatattctcagacaatcggaggatactgcttggcctgcagccgaacacgcctcttgtattccgtaggatcctgcaaacccaaagagcacattaaaactacaaagcttgaatatcttagcattattgatttatagtaaaaattagcagaaccctgattggtcactttttactgatggctaacctggataaaaagatggtaaccatcggtctgagcaggatcagcaggattaggctgatcaagcaagtcctggattccaacaagaatttgcttgacggtaatagcaggtctccaaccctgaaagcagaaaatcagaacagttataaatgatatctaaattgggattgctaaaaacctaataaatgcttgtaaagcttacgctgtcttcattaagaattgaaaggcagactgtccctgaaggatagacatttgggtggaagaaaccctgtgggaacttgcacttgggaggtttgctagggtaatcctcactgaaatgaagagtgagaggaaagtatccaccttcccaatcagtctgccaaaagagagagagagagagagagagagagagatgtgcattagttataggcttctagctgcaatgcctttttacaaacacttctctacatgaacagagaagcaatataagaatgtagttttgtaaagtatgacaagcttgagaaagtaacatataagctgaccatgtgcaagaattcaaagcataacatcaatcaacacgttagaaatatagaagactgatgaagtaaaagcaaacaattttgtttgttaacagaaaaaataagtcttttcaggaaaaaaatatatattactgtgttacaccaccaaggacatgtttcaaaggattctgagtattaaaaaaagctgtaacacgtaaatatggacatgtttcaaagtcttaatttatatttgcttcagatagaaggaacattaatatatcctaaatcacaccaaagcacctacaaatggcaggacagcctaggttgccaggaacttactgggtttcatatattttctaaaacactaagataatgttaccagacagtggtaatacatgtaaagatatgaaaatctctggatggtgatgttttgtaagagatcgtgttagcttgaataatgtgaaacttggctcacatcacaactaatgtgcagagcaaggcctgagggtgtgctaacaagttcaaaatgttattacccctgcccttttatgtgatgttttaggattttgattttgttcttcagtagatgatgttttagattttttaggcaacatttttccaatatcaccggtcaccgctaccctaaaaaggggagctataaggccaaactttgtattaattcaagagagcgtttggtgtatctaattgaaatctaaggaagccataatattttgatcggagattcgcatggcctagcgttcgctcacatccactcgtggcaaactggtgcttgcactaatcaatgccaatgcactcttgtgggtcattggattagaatgcatgaacatttattattatcattatttatggagcatgagctattagtaatactaatgaaggggcaatttttttctattttcctcagcagttaaactgtgctgttctctgtgcccaacattaaagcgtcatcctttagtgtacggaggtagtactacgcatgccacttttaaaaggctagataaatgtcagcaattcctgctcaaatgctctctagtttgttcaaacttcttctagaccaaactgagccaacaagaaatcgagctattctatctcaaggactcctaacttggtcaaactcctgaaggagagactgcacatggtccctcatgcacgcacatgacacacgcaatcactattcctctttgttgtcttttgtcaaagctgaatctgaccataaaagagaacccgcaacaaatatgaaatagtgttaatccagacctactgagtagtattatctttttcatgacattctactcgcttatttggcctagtaaatgataagaacttgcagaagcccacgtgtataattcaaccgaatttatgtgtgcacttgattttaatgcccagtccatctttttatatatcattcggggcaatactcccttcatcctatggtagttgctgtcttgctgaaatgaagactggtttcaccctttgatatatcatttgaggcaatactcccttctacctacggtttgcagtagttgctgaaatgaagactggttttaaagcatgtaagcacatcatgcaaaagcttggtgactgacagtgaaccagaactcaacttcgatctatggtgaaaacagtttggctagcccaaaaaaaagacagtcttttcgcggcacaaaagcaccacacctcaaacccaggccatggcaacaaatgtactacagcacaatccctaattccgatctcccaaaacaagagggagatggcactgaaataatctccgcctgaagagatccatctgataacacagtggatagctaacgggataaccatcgaaaccatcctggttcagaatcggacgagaaccagagaggcctctcgaatttcaagttgtactcttactattaaattcagtgtagcattcagggcgatgcttaccccttgcttgccggggattgtgcagtgccagatcatgaggttgaccgtcccgtcggccaacgtctccggcttggcgacgaaaccctacggaaccaaatcagaacacagatcagggggatcaagccccgcggcgcgacatgtaaaagggattaaaaaaaaaaagaggggaggcgttgagatcgagaggcaccgacgtgtgggtggttcttccgccacgccttccgctcctccgcgaggcggccgcgcgcgattccccccgacatggctgcggcggcggcggcggcgtctcctccttcctccggcggtgggggtttgggtggggtggggtggcgcaagtcaagaagagggagggccggtcgctcactttaactccgccttgcgggcccacctgtcagccaccgtgggccccacgacgtgccatcacactgcggggtggggaccgcaaaaggctcggggtcgggggggtcgctcccttccttcgcgggtaaggttgggcgcgccgggcccactcggcagtgacacagcgagctgcttttagtggtggtagtagtagcggaattgttttttttctttcgtcgtttggggcatctgattcgtagcgtgagccgtcgtccgatgggcggtcgctgtcgcgcgggtcaacgttggagtagtgtggtacagctggatggatgacccgaccgaaaggggccaaagggggccgggccagaatccggttcgccttccgcgtccttttctaggcttgcaaatggcccgggaatggaatgggatgctcctcctcgatcaacttcaactttggtctggcccagaaagcgatccaaaggcccagcaaaatctggtgggttagaaaaaggccgtgttgggtgggctgcgctgcacagtggctgccgtaccagcagctctgcaccatagtacaattgcgtctcctcctattggctgattggtggtgaccaatcagaactcttctgcctctgcctctctgggctggcattgatgacgctgtttatgaatgcgctcgatgttctctctttctggctataaactgcaggacacagttttgttctgatccagtaacatctctgctccttggcattgatgtactacagtggagtatatatgtgtatacttctaccgactggccatgaatagctggagagaccctgaaaggaaatggagaggtatcctttaaacgcaccacctgccccggtttctggagtactcccacgctccaaggactgtcactgttattggaccattcacttaaagtgctctcccctttggctcttccacacagctatcaaaacctacgagaccagctaggaggagtctaggagtatgctccacctttagaccgcagttgattcaaagaaaatttataagaattttagagcaccttcgaatcgcaagaatggaaaaatagagaaatagaaaaaacgcaggattctgacaagaatgcaagtgtaaaatagagtaatagaaaatacagaaaaaaacacaggaatgaccgtttgattagaccacaggaaaaacacgagaatcaaatgagagaaatagactcaaaggaatttttccaagaggttagacctcttgctaatttttctccaaaatctatataggattgtccatttcataggaattttaaaggattgtataggattcaatcctttgtttcaaagactttcataaaaaaaattccataggattgaaacccttcaaatttcctacacttttcctacaaatcaaagggaccttagaggattttgttcctataggaattcttcctatatagacctttgaattaaaagaatgaatcctatggaatcctacgaaattcttacgtaatgcctaataccatgcaagttttggaggaaatctaacatgagattctacctcgtggaaactttcctttgaatcgttatctctcctctattcctgtgtttttcctgcggtccaatcaaacgatcatttgtaagttgttactgtgttttacacttacattcatatcaaaatcctgcgtttttcctattcctatgttttctcaatattgcgattcaaaggggcccttacttcctccctcttgaaataaatttatttttcactaatcgcacatcccaatacaaaacaaaaggactagaatacatctacgtcatcaaattcaaatgcaactatttctcaatttctttatcctttcaatataaatattttctactttcacaaactctagcgcaacgattattctaaaagtaaacttattttaagacaagtgaaaagagctatccacaattatcattttaaatgtgacttttatcattttactgcccacactatccgcactacccattggtttgttacaactctaaggtcccctttgaatcaaaggatttatgtagaaatttcataggattcaaatcctataggaaaatttcctatttagccttttgattcaaaggattgaagttttccaaatactatgaaattcctatggaatggcatattgcatgtggattttggaggaaatttagcaagagctccaacctcttggaaaatttctttgagtctatctctctcatccgattcctgcgttttcttgtgctccaatcaaacgaccattcctgtgtttttcctgtgttttgcaatcctctgttttacacttcaattcctgtcagaatcctgtgtttttcctattcctccgtttttttctacccttcgattcaaaggggccctaactagttcagacctatatcttacccacattaagaaggcaactacttaacacatgtgtcaaaggctaaaactttactccctctgtcccataaaaaataaacctagtatagggcatggcacatctttttgactaaaaaaactaatttactcaggtagggctcatatgaattactctctttgttgtactgagtaggtatatagcaaggaagatagggaaactattctaatttctcgaggggatgtttcctcgtttgctcaaaaaccatctaaacggtcatgaaaaattctggaaaaatttgacaacattcatacaacacatatatacaacttcacaaaatcttaagtccaaactcaactcacacgtcaagatataaaaaagacaaattcagcatatgaatagtagcgtactgtttatatctaaatttgtcttttttgtttctcgatgtgtagatcgaatttgaacatgaattttggtggactagtaggaatcattatactctacattgtcaatttttttttagaatttttcacaactatttgcatcgaatttagaagaaaaaggtatataaggggatatcccctcgagggattagaatccactcccaagaagatatcgttcttctttgggttaattagacacatgccattactaatttgaaggtttggaaaaataccattactatttgacaaattgtaaagatgccattacaaatcgcacgatactggaaacatgccatgttctacgcctgatcagcgattgttgaccacgtgtgactaaaatttgttcttaatgaccaaaatgcccccgtttgaccggctataccgactggagtcgggtcagcaggagtagcacacattttatcccctttctcgttctcttagacctaaccctagcaggagtagcgacgacggcggcgacgtcatctacggcggccgcggcaacgacaacgtctacggcggcggcggcggtggtggcgacggcgcgggctacgacggctgcggcggcatcttcggcggcggtgacgacggcgtctacggtggcagcagcggcgtattcggcggcggcggcgacggcgtctacggcgtcagcggcgacgactctttctttccatggaggggtaggaaacgtactgcaagggatggagcccaaatcaaggtaaggtagtcgattccttcgattcgatgtgctgtgagctggatgtgtaggtttttttttctgtgcattccatgtgtggttgacttgatttcattccaatgtcaatacactgttgttctcgatagagttaaaggttcatggttttaccaccatagattcggatggtagacggaggtatactaagggttgtgtgctgaaatgggatgttgagtatggtagcttctctttggatttgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45132 - DNA, 1246 bp, Oryza sativa
ggaaaaccgtccacccggtttgttccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcacaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggggcttgatcctcgaaatcctcgcactgcgggtcttcgggctccgaaactacacgcaaaacgggacaactcaacaaacggcgaaaataaagccctattaatgacctctaagcgtgccattagatagatctcgagatttgagaaattttggaatttgaacggagtcaaacggatttacggttggaaagatattgaatttctaagattattggatttttggtctaaaggaaaaggatttaattaaatcctttttttttgaaaagaaaagaaaagaaaaggggagagggagggaatatagacttccctcgggcggctagggcgcggcccgagagaaagggcggctcggccgagcttaacgggccggccggcccaagaaggtggcccagagcggcccaagacgcgcgcgcgcgggagggaggagagagagagccggtggaccgggctcaccatgcgcggccccgggtgggacccgcttgtcagcggctcggctcaccgtgcggagggagtacgcggctcatgcgcgcgagcgggggagggacgcggtgcacgcgcgcttttcgcggtggacgcggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggccgcgaatggacggcggccgggcggcggagcgaaccacggcgatacgggcaaaagctagcacaccgggcagttgttcgtgatgaggggagacgagc

SEQ ID NO: 45133 - DNA, 1031 bp, Oryza sativa
ctgtatagcacaagttggtgggctagctggctcggcttcaagcctcatcacctcttaataaacattggtagttactcctctcatatatataggttttaagtacttgcataacaagtcttgcgaacactattttttgtttttgcgaacgccttgaataacaaatcttactgaagccctattttaaaacatgagtttcccccaatccctatatcaatgaactgattcatttgatttttcacggatttcaggattcatgcctcttttggaacataggaatttcggaggttaaattttcatggacattggacttgtgtgtaaaaatgctgtaaaatttctgtgtgcttcagaacagacagagctgggtaacttaccaatgtcctgtcattgttgactaggacatacgtactggctggctggagggcccaatattggggcctgaaatgaacaatgagatgccaatatggaatttcaatttgtagctaggagtagcacaaactagggatgtgtgaagtgaatctgaaaaaccataggtgaagccggacgatggatggatgtgcatgggcatatggtggtgtggccctgcagagatgaaaggaaagcattggggtgcatgcagaaggccaggccagagatgagatttttgctttggtaggggacccaagatcaggctttaaatttggggcttttgcaacaaagtgtggttgtgctcttgtcgttggatgacctaatctgagtagcagtacaaagcccctgccacacatgacacacaccaggacaaccataactgcatctgcattgacattggctttaatttttcagcttgtttttacttttccagtttggccggtcttcatcgagcacaatttactcaggaaaaaagatgtgtattccagcaaacataatactttctaggaaaatgatatacatatgtccttattgtctagctaccgtatacgaccacggccacaatggaaggctcaatcacttggacgataaatgtctcacttcggcaatagaatctgacatgtgct

SEQ ID NO: 45134 - DNA, 1753 bp, Oryza sativa
aggttaggttcagatggatcttcacctcattttcgccttgtctcacctcgcaaatcttaattcctctaatgtttttagcacaactatttttttatatgtttatcaaccatccttaattatctatatatccggtcgtaatgcgcggggttcatagaccaacacatgtcttttctgcacactttgtcctcactcgtgtgcacccgggaagaatttcccggtcggtcacccatcccaaattactccaggccaagcacgcttgtccagtgccagcacatgtgccatgctgtgtgaccactccgggtccacaccagccatgcacaccatgcctgcgcaactgcgatacacgcgcccgtgaaaccacgagagtcggctctgataccattttcttaaccctagagttatttgaaaatcggcttccggaaaagaagttgcaacttggccacgtccatgtatccagtgccagactgctcccaggccgggcctgcttatataggtcgtagactaccctactctggaataacacaatgtcttttctacacactttgtcctcactcgtgtgtacccgggaagaattttccggtcggtcacccatcccaaattactccaagccaagcacgcttaaccccggagttctttggaaatcggcttccggaaaaaagttgcaacttattgatataagtattctattaatcctattaagccctggctgggatgtcacaccatctttcttattcatgaaaaaaaaaatcatgtttaagctctaaaggagtattaaataacttgtgaagcccccaatcaacttgaggggagattgaatggttggaagctacttgggcacaaccttttaaaaattttcatggaaggagaacatatataaaattttgcatcagggttcaagcatgcatgcatgtcaatctactactacttctgtactacttagctgtgaaattcaatcaatgggccaatgatgtgtgtgtaaatgcaaaaagctgacccttttgcttagcctgcttcacccactaactcagcacacttttctcccttccttaacagcataaatgaatgaagaagcccatcattctccaggaaatcataccaacctttcatcaggccatactagctagctgctagctttccttccccacttttaagatcgccaaagctgattgtttgtgtgtgccctaattttgttgccctgcctgaagcaaacaaacattcatggactgctcacttatctccactaatttaacagttgtaattaagatacctaacccaaagctggaggagagatgtgcatatgctgaaagatacacatgcatgcacagtgaccgatcagaattcagaacaatgtggaaaaaaagagaagtggatgatctcagatcgacctttatgtctcatgtattggtgttatcacgccctgttccaacatttcgaagttagttaacactcactacctatatgctttgtttcagatgtagaaaaaagattcaattattcagtatgaatccttgcacaggaacaccattagctttaattaatcagggccctacacaattaatcagggcaatggtgatcataagcaaaattcagacttgtcaattgtgacccatgtcccacctgtccactacttgtctttgcactttagctcatgtatatctgggcactattcggaagaagaatttttacaatccttaaagaaagtattcacaggtaaaaattttagtaacttgagatatctaatacctagagatat

SEQ ID NO: 45135 - DNA, 2179 bp, Oryza sativa
acaaggtgaacaaactaggcggcgccagggaaggggcaacaatcggtagaggacgagctcaatggcaccggagaagagtcggtgccatgttgggaggaggaatagtgtgtggagcccactattaacatattgtgtattatctttttatataagaaaattacttttatcatatgtgtaagttacttttagattttattaaattacttcttaggtatttatgaaagtaaattgaataaagcctaaaattaaactacataaatcaaatttacttccaaattttattcttattattaaatcatcttgtagcgaaggtatctctagaatggtacggttagtcctattttttttgacaatatcatgaaatgttacttctacagatgtaaaaaagtcagttataataccgtgaatagttatttttatttttctagtcacttctctactattataaaaattaaaaatattttttctgatactttggtacgtcatccgcatatgagttggtttttaagtttgttcgcttttagaaatacaaatatgattttgagtcggcttttaaggccccgtttagttccccaaaaatttttcctaaaaacatcacatcgaatctttggacacatgcatgaagcattaaatatagataaaaatcctaattgcacagttatgggagaaatcgcgagacgaatcttttgagtctaactagtctatgattagccataagtgctacagtaacccatatatgctaatgacggattaattaggctaaaaagattcgtctcacggttttcaggcgagttataaaattaatttttttttcgtgttcgaaaagcccttccgatattcggtcaaacatcttatgtgacaaccaaaaaatttcttttcgtgaactaaacagggcctaagttcgttcgcttttggaaatatagaaggaatcatataagacatagctgtttaaaaaactcacatgctaacttgagacgatcagactcctaattgcaactcatgattttctaacaaaatatatatccaagcgaatttaacacagtgaatttcacctttactaaaccatataacaataataagactaaaatagtcttcacccattgtaatgcacggatattttgcaacacatattttttctagtccctctaataatgtacttgcttctaatattgtgaagagaaaaatagacctattttccctagtgtaattattttaataacgtgaagggtcactagcttctattcttttagaataacttccaatgatgaaaattactttttttaaagaaaaacatagtgattacttcaaaaatatataaaataaatgtatttacccatcaatcttctccatattttacttcgcataatttcttaattcaacatcttctactacgtttactttcgatgatacagaaagctacttctattgtaaacttagttacttatagggtttaagtaaattacttttgactgtttaaatatatttagtattggacttgttttgtcacatattttgagtggagtccgatggttcaaatggatttaaaaaatataaatcatcaaatgttctgtactttaaaaaaaaaggagctatagtgcaaaggaaaggctagtgaattagttggtattaaggaaaggctagtgaattggttggtattgaacccagccacgtgaatagcgttctttttcatacaagagattcttggtacgtctgatcggactatctgcacatgtgtcgctcgataagtccaacatcgaatgtccgcacgaaatagatttcatcactaaaacaaggtgaccgcgcatatgcgctaggtaacttcctatttggacttaaaagaaacttcctagttggacttaaaaataaaaatttaggccgtgctaaaattttttaatgtacggacaaacatttgacgtattaaacatagactataacaaaacaattgcagattccgcatataaactgcgagataaatttattaagcctaattagttcgttattagtaaatgtttattgtagcattacattgtcaaatcatggcgtaattaggctcaaaagattcgtctcgcaatttacatgcaaactgtgcaattggtttttttttctcgttcacaattaatattttatgtatatgttcaaacatttgatgtaacggaattttcgaaagtttgaatggaac

SEQ ID NO: 45136 - DNA, 5116 bp, Oryza sativa
caatattgaactcgttggaaattcttctcaaaatatataggatgatatctcaattggaaaagtattttctatacctggtgtaggaacatgttaaatacctcttattgaatttggtggaaatttctctcaagattatgcataggatgatgggcagtattttctacaccttaatgctatgacacctgagttatataaaaatttcataaaatttaataaaatagattccaatattctaagacactatacaaacatgtaaatccaaactcaaactacgtataaaaaacaaataaagggtgccatgacccttatattagaaaaaccttctatgaggccgtctctgtgtccgtttgagagaaaacgccgtgtcgcacatgaatgtgttttcattggacttcctttcccccgagtcccttccccgtgaaaatggatcaatctacgtaagaggaaacgttcgacgtcgctaggccgctcgttcggcatcggacggacgcaagcaagcacggcacaccaacaggcacctttctttccgcccacgctagcaatatcagcccatcaaacaagggaggatttacagtgtaagcatcggtgtcggacgacaccgacgactttcgataaaacctatggtaaaactgcttatctatatatcataacactattaacactatagtctaagtgtaattagcatgctatgacaccgatagacacattatgacaccaacaaatcaattttctagatccgccgctaccatcaaacagcctcgctctcggccacttcgctcgccaacgcatggccttcgccgacggtgcggcagcgcatgcatggccgccgagtgcatgctccggcggtggcggcagaaggtcctgcacaccttcaagtctctcgatctcctccgtcccggcggccggcgagggagaacccataacgaacacaccaatgcggcataaacatatcatgaatatattaaattggtaaagaatcaaaccctggaaatatcataactgtttatcactgactttatgcctgtgtcaaactatgcttcctttcaggcaatcgttggactgcgtgcagggttgcagctgttattgggggttggtgcaatttcctaactgtcatttacattggtaagaggctgctacttcaaaacttcttcccaaaatccctctcattcaacctctgaacgtcagaaatttcatgtctgtcactattttctgaatgtacgcagtccactgtattagcgacaaatgtcactgatatttcatatttgattaactggaacaggatttgttagtgctcacacactgcccgtcctctacgagaagtatatatgaagatcaagttgatgatttcctctgcaatattcttggcctgctgcgtaaccagtatcagaaactcgatcaagttgtgttgagcaagaaaattttgccaaattaattagttatattaaatctaatttaatatcacaaacatactttgtggtcactattattattgagttacagtggtatatgtttgactgtcttgatgtgtgatcactgatcaagttctgttgaaaccttcagcatatatttatattattcttccattatatcatcactatcagattatcagtgccccctttgtcagtagtggctatataaacgttgatagtactattttttcccacacatcagcatatctattttgttgatttttagcttcaataatcttatgtgtgctgcttagtaacaaattgtgtttacggtttgtttgcatgttagtggcctggccgcaaatagcccagtgggccagcaggacgtgggttggcggttgccacaatacacctcgcggatgctgcgggcaaccgcaacgcgtcccacctacgtactccactaaatattcgacaccattaactttttaaaagtttaaccattcatcttattaaaaaaataaaaataattatcaattctttttctaccatttgatttattgttaaatatacttttatgtatacatatagttttacatatttcataaaagtttttaaataagacaaatagttaaatatattttaaaaaaaatcaacggcgtcagacatgtagagatggagggagtatatccttaccaataccgcccacgggccaccatctatcgtctaccggcacaccacacgaaggcccctaccccacttcgctcagcacgcgggaacaagtcaagacggcgatgccgcgccggacggacgtacgccgacggtgacgcgacgaccaccaccacggcgtacggcctcgatcggtggcccgcgtggggcatgtacaggtcggctttccaggggttaaatgtggccgtgccggacgatcgatatatatcctggcctcctttaagacgagtcgacgtcaatgagctcgatcgattatgtcgctgtctccaccactgaccggctagctgctcaccgacctgctcacttaattaggtccctgtttcagatcaaatctgatcagactttatgccaatgtgatgggaaagggctgttgattttgatgcccatttggaccataatatttttttttaggcaaagtggctaaaattttagtaacgtttagtttgttggccaatttggtaaatacataaaaaaattctggtaaaatttggccatattaccattggcaattttggcaatggcaaaatttggtaatggttattttggctacaatctgaacaggcccaaagtatgcctaaattatctatgtatatgggtatatgggtgatcttttaaagatattttttgatcttttaaattatctatatgtgtgtattttggaaagttggccttttggttttcttttctttttttttttttttttggttttgcatctagaagtaaaggacaacactcgttgcttgcaaaatgcagggagcgaaggaacctgccaggaaagtgggaagcaccgctgcatgtggcagtgtcactgctgccgcagttgtatactctggatgcttgcccaatatactaaaagtatttcactatatatggttttaaattaataataaaaattgccaattttggacacattatctttccacagcatgccacggattattaagaagtaggaacacctaattaaataaggacttgcttaattagtagggtaataaatggagtatttattactggactagaaaattcctatgcatcgcaacgagtggaaaacaattttagttatacactatctgctcccggcatgcgtgaattttttaaaaaaaaataacttttctgcaattatatatattaattaaaattcctcaaactctcacaactaaagtcaatcaactctcacaactaattatatatggataaggagccgggctctactgacggtattgtaccgcgatgtcctcccagagtacggcattgaattcaagcgctaggagatactccctctgtcccataatataagagtttttgcttgcaacgtttgaccactcgtcttatttaaaaaaaaattgaaattattatttattttatttgtgacttacttattatctatagtactttaatcacaacttttcatttttctatatttgcaaaaaaaatttaataaaacgagtggttaaatattacaagcaaaatctcaaaatcccttatattgtgggacggaggagtaatagacatggctctgctgatgcgtcaggcatctaccccaacaagatcttcacgtcctcgccccacagcagcgacatcgacatggttaggccattagcaggacaagctacgcaaattgaatggccatgtgaaaagggggcttccacgttgcatggaactgcttaaagaaactcattctacaatgcatgtatcctaacagtactaacacgaaattttctatttcaccccttatgtttttattctgtttttattctagtccgcccaaatctaataaatccagaatttattagatttgcgtctcccacggcgacgagctcagtgtcaccatcggtgcaaagccgctgacagatgccttgaccaccggatctagcctggtgcgaggcgacaaggccggagatggagctcggcggcgtagatccggtcagctcctccggtccatggcgggacgcgatctcctctctctctctctctctctctctctctctctctctctctctctctctctctctctctctctctctctctctctctctccatttggttgcgagggactcgacatatgcatacatggaagggaatctccttggtggcaggttggggctggatgccacctaagagcattgtgaaaggtcttagatagtggcttcaggacatcgagatttcctctagccgatgtttacacctatgcaagttagcacatttttgcgattcgctaagtactctttctattccaaaatattacaacctagaaatttatctgtgtattacaaatctggacagaggtcctatccattctagaaggatatggattttcatccatcgagagaaatcccctcgttacttataggtcatctaatataaaaaaattttaaaaaaagttgacaatatagattaatatgaaatatattactccacaaacatacaagctcaaattagacttctacaagttacaacaaaaggaacaaattaaactgaaaatagttatcgtacgctcgtagttatatttgttttttttttagaacctgtagaagttgataactagttgataacttgcatgtttgagtgatacattttatattaatctatctcatcattcctttttttaaaaaaaatgactatttaggtgacatagataaaacgagaggatatcctttttgattgatgaaaatgtctccttcttgtggcttacgtatcatcttataaaaaaattatctaaagcctcgatctctaccggatcctctctcttcacctcgccgccggcctccggtggcgccgccacctcctcttcgtcgttcttggtgtcgtccgggcgggtggacagccgcgcctcaagctcccggttcttctcctccagctccgacagctttgactcgagagacttcacgtactcccttgctctgatcagtatcgacgtcttgtctttctgccattaaaaacgatcgagaaataatttaagcaaatattagtcaagatcaata

SEQ ID NO: 45137 - DNA, 925 bp, Oryza sativa
cggcgtggtgcgtcgacggcgaaggcgtcaggaggtcgtccaccatggcgacgccgtaccccgcggactgatcatcgtcatcatccatgctcaggtgcatgctgatctgcacgtcataattaattaatccaacgcctaccaaattaatcctacaatttctttgattttatacgcattgttcttgatcgatcggacgctcgaggcctcgagctagctagtgaatcaatgtacaattaaactgcagcaattaagcttgcctcattgagacgtgctgaatctgcgagctgatgaactgctgctccctttgctcgaactcccaagaaccgcagctataaccatatacgtaactgatcaccagccaaacaacgcaagaacagtggaatttacaaattacagagacgatattatcgtcgcgatcaatcgatcgaattcctgatccgagagatggagtagctacctgctggcagcatagccacaggtgaagccgtggttgccggcgccggtggcggtggcgccattggtgtagccatggacgatccagccgccgctgtccatgatatgatcagataaccaccacttctgttgctttgctacaactcgatcgatgatctagctatgtgtttgatcggcacaatatcgatatgatacagttgatgctgaacatgcagacatatatagttatatactagcagtatctaattaataaagtataagatgaggaagctacgaagagcacaactcagaatgtgtgtccgaatacaaaaatatagccattgaaggcagccgtagcatggagcaactgatcaactgaaccagtagcaattaatccacgtgggagatatataaacacattgtcttgtagtagcaaatatatattactaccacatatatagtatatatgtaacgtacatttagtatctggaat

SEQ ID NO: 45138 - DNA, 825 bp, Oryza sativa
aaactcttctctgcaaatggatctataaattagaatctggtaacaccagcccctgctgtgaattgctaaggaaaaaatacttctcagctgggggaggtttctttcagtcttctactgatgggggatcacaattttggaaaggacttcatgaagtaaaaggtggatgaagtttggtagtgcatacaaaattggctgtggggattctgtacagttttgggacgacatctggttaggggagtctcctttgaaaatccaatgtccttacattcacagtgtttgcagtgaccctgacaaaaccgtgaaacaaatgttgtctggaggggagtgggaaattaatctcaggagatctttaggtcaagacgaattacctgattggctaaggttgtaggacttacttggtacagtccaactgacgacaaagagagatattatgatttggaaattgaatccatccgggagatttacaacaaaatctctttacaaggaaattttacaacaaaatctctttacaaggaaattgtttttgggggagtcaaagacattctgcttcaggaactctggaaagcccctacccccctaaaaacgagagtgttcatgtggttgatgttacaaggaagaattcaagtagctaagaagctcaaaaaaatgaattggtcaggtagccctctttgcaagctgtgtggcttggaataggatacagatcacctaatgtttatatgccctccggcacgttttctttggtgctgctacagagatgcttttgggtggaattccatccctacttctagaaacgatcttctaaacctttttcagaatatgaggcga

SEQ ID NO: 45139 - DNA, 1746 bp, Oryza sativa
atgacttggcatgctcatgtggcactttttttggtctaaggactatattaacccaaatgattaatttggaggacttgtttggatgatttgaaatctcaaggactaaactaagtctgaagcgaaacttgagtgaccatattagctattcaccctaaaaaaaagtaattaaggaaatgtacattccagaccgccccagggttattgaagctagcacacagcattggcgatctctgcacgcacgaaacgatgtcagaatcagatctcatcacgcacaagaactcaactgctaaaataatcactcgcagattgcattgatgatgccaccactatgaatttatctatgcatatattcaaaaatgaattttatatatacatgtatgcgtacgtactatttaatgacagtcagagagaatctcaccggtcacgtagtatacatatatatgtccatgcatatagtacaatcgtataaaattgactttgcacgcaaacaatataatgtcctacctccatatttttattttaatgtataacgtcgtaactttttatccaacgtttgaccattcgtcttatttaaaaattttatgtaattatcatttattttattatgacttgattcgtcatcaaatgttttttaagcatgacataaatattttcatatttgcacaaaaattttaaataaaacaaatgatcaaacgttggtcgaaaagtcaacggcgtcaaacattaatatacggagggagtattcaagttaattaagctagccgacaaacaagtttgcatatataagctgacaaggatgacacatgaccaattaatttaattgaaaagaaattagaccgatgcaaaagtaaacaaccgttgcattttcaatcgacagaacctgagcaccgggggtgagcgctctgaatttgatctgaaggtgtgaaaagggtaagaaaattattgtccgtatcgatattgtttccataaaagtaatagaaaaaataggaaaaaaaaagtacgaattaccctgccgaactattgcggtcgaccggattatacccctaaactcaaaaaccggatattttacacccttaattattgaaaccggacaaataacccccctaaacactattttgagcggttttgactagaaatcacacacgtgacgccaacgtggcaatccagtcagcaaaacaaaacaaaataactccctgggcccacttgtcagatttatccctcaacccccctgctctctcttgcgcatgatcttggactagtagccagcgacaggcggcggaagcggacctcgcccggtcggcagcaggtggcggaggcggacttcgtccggtcggcagccggcggtggaagcggacctcatccgggcgcggtggcggacttcgtccaggcggccggcggcggagacgagccttgctcagtcgttgggtggcggagacggaccttgtccaggcggcgggtagcggacctcgtccgtcttggttgaagtcgatcctctctttgtcgtggtcggagaagatgcggtcgccggggcggcctcgagcccatgacgagctccacggagatggaggcgtgccagtgctctcctctcctctgcactcctctctctcctctcctctgctctctgcatctctcccctccacgcgcgccacggagccggcgcggccccttctacgactcccgcaaccacctccccaccgttgggagccgcgtaggtgagccgatgcacgagtggaccgtgaggaggca

SEQ ID NO: 45140 - DNA, 2295 bp, Oryza sativa
ttgcataagtatcaattaatcttatagggtaaacaatactagtaataatattaattttgtctaaagtgtgacgatgattacttcagtctgatatcaacttcaaaaaataaccaaatctagtttaactgcccaagtatcgaggctaaagcatctcttgcatatacattgacacggatcctctgtcatactatatctaaagtagcagtggctaacaagtaaacccacatatcagtgacaactattacatatgtcaaactacatacaatccttactggtacataccacgtttgaaattcttgtcaagctgaatcattttttggttagctagctaggtatggtagcttcaaaaaattacttcctccgtttcacgatataagtcattctagcatttcccacattcatattgatgttaattaatctatatatgtatatatatatatatatatatatatatatatatatatatatatatatatgtctagatttattaacatcaatataaatgtgaaaaatgctagaatgacttacatcgtgaaacggagagagtaattcctcaattcagccacgtcgcatgaaaacttcaaattttataggtatatatgtaatgaacgaataataatcagctttacctgactgattattgaatatattgattgattcgaagcttaaatagcgtacacgggtgaacagtgtgggatcgtgtgctgcagctgcatgtcccgatggatgcatgcacgcatcgatcggcacatgaaatttcgtgcctattattagatcacccacaatgataaagtaagttgctctctataaaacatgtacatctcagcaatagactagattaatagtaaaccacctcaatggtatgtctatatgggtatctatagttctctaatacattgtcccgtttttctctatagactgtcttcaagttagtagatagttttgctctctctttatttaatctcttccaagtagtaaaatatgctgacatggatctcttgtagagagcctatagataaccattgtgggtgcctttatacttttatttttttccttatttttttcatagccgggaattaagcagcagggcacgtgccacgccacgccatgatgcatgcatgcatcgagcaaattaaacaaaaattaatatatgcatcaactcgatctcactctgccttgcaatgccctgccttgcagtgttagcaaccctaaactgatctttactctacgtttcttcttccattaatttcttctcccaaaagcaacgtgaatacatacatcttaattaattaattaattacaattaacaacaagaggagcggaaaagcagcttactgacaactaatcacatcaaattaacaagatcatcgcttaattacttttgccaattggtttgtattgaacgttgttttgatcatgagaaaattcattggcagggaaagcaagcggccattaattagggttctaagtttggggggtgacgtatactaattccattaattacccacccccaccacaagcactttaaatatgttatcttgctgccataaaataatcgccttccaaagtagggattatacgccagtcatgtgtagtaatttaatttacaccaaaccaaaaacacatcacatcaggacaaaacagaagaggagaatacttaatcgattttgctatatctcactcgaaagatttttttcttatctctcactcgattttctcactcaaatttacagtgcattttcttgtaagttacagtgtaatttataaaacttacactgtaacttttgtaagttacactgtaatttttgaatcttcacatgtaaattttaaattttgtatttgatttggtctttttcttgaggatatggtaatttaatgttcattatggtgtttcttaattgctttttgctttttattatatctatcgaattttaatacaaagattaaaaatctgtgtgatacgattataaaaatctttcgaaagatgtataggtactcccatacttaatttaaccgagagatatgcatgccatgcatgcatgggtgtaacactaccagccagaagctgctgttaaaaaaaaggttgaaataataaaaacagtaaaaagataaacattgaactagtagtactgtttaataatcacatttagatccaggaattttctcacaaacccctttgatttccagaagaacacatgagcccaaacaaaatttagtattatttcggcgtggaatttttcaccccaccccctctagatttctgaaatggcggagataacccaacttatgtacatg

SEQ ID NO: 45141 - DNA, 849 bp, Oryza sativa
ttattattgcattctggatggagcttatttgcaagcatttcactgatagatcgatcggtactagcttattagtttgccgtcaactttactctttcgttggtctagcagcgaccggtcacgcttagtggcggtcggttcggtgctagccttcttctgggtctatgtattagtgttgtcggtacgtgggtcattttttttcttttttcttggttatgatcttccatggttataattttgtaattttttttctgttctatcaatataaatttcacactgtctaatacaagtcattagaaaaagagatagatagatagatagatattgtgcaatttgattggttgttttcaggaaatgaagtggttatgtctcagggtctcattaattgttcactatatgggttataaaccactatactaaaattcaaattttcaattttaaaattgattttgatgtttcttacatattttcagtacttatttttaagtcgctaagattatatatataaaagttttatctataaaatacttttcaatcactaattggttatggtttatactaaatcataggcaatcaatagactaggtcctcagccatcaatagtgctacggccaagctacacaacccaacgaatcacagagagatataattcttcttcttcctcctgtcctgcgagaatctccttaattgcccacaaataaatatgactagtacgttagtggagcagtaacaaagatttattcagtgaggttctagcttgtgattcgtagattaatttgttctgaacatgttttggaggtcaacgccaactttatgtgtgtgaggtcgtcgtacgttttactgggctgcagg

SEQ ID NO: 45142 - DNA, 1167 bp, Oryza sativa
acaaccagctgcagcacatgatctcggagcggaagcggcgggagaagctcaacgacagcttcgtcgccctcaaggccgtcctccctaccggctccaaggtaaaattaatacgtactccagtacatctatctattatataattaaaggaatagaaaaaggagcctccacgttcgctctcatggcctagaaattctcacattaatcggagaaaaagaaaaaacagagtccatatagaaatacaatttagaaatagcttaaattcggaattaaaaaataaggaatattagaagaggagaccggagtccatatagaaatacaattaggaaatagctgaaattcggaattaaaaaataaggaatattagaagaggagaccggagtccatatagaaatacaattaggaaataactgaaattcggaattaaaaataaggaatattagaagtagagtatagagtccatgtagaaatacaattaggaaataactgaaattcggaattaaaaataaggaatattagaagtagagtatagagtctatatagaaacttaaaactaactaaaatttggaataaacataataaaattaaaagtagagtttagagtccgtataaaaatacaatttacaaatagttaaaattcgaaattaagaaaaaatgggaagaagagtttaatgctaatataggaatacaatttagaagtaactaaaattcgaaattaaaaattaaataatattgaaagatgagtttagagtccacatagaaatataattagaaataataaaatttcagaaataaaaataaataatattagaagaagaacatatagtctatatagaaatacaatttacagaaaaaagaaatattaaaagacgagtctagagtccatataggaatatatataatttacaaataactaaaattttatcttaaaaataattaataactaacacatatataaaatgcaatatgaatattacacattagtagttttgtaaagttattgcaaaatttaaaattatgttgttattttaatatatttgaataatataatgagaaaacatatatgctattatatgagaggaaaaaatattacatggatggccgtagcccgcgcaatctgcgcgggccatcatgctagtttgtacgtattacacgtgcatatatatatgt

SEQ ID NO: 45143 - DNA, 1259 bp, Oryza sativa
aatcaagataaggagtacacatttattcaaatctatttataaatctccatctatattttgcagaaagttacataactgtcgtctcaagcctaagacatgcaaccttcataagctctccatcatcttcatacttttgcagttgtacccaacatcggagccaatatgttgctctgaaaattacctgtaaatatgagatagatggtgatttgtcaaataccatatcatttttactcaaccacagagcccaacatatggcagatgctcctacaagtatgagtttactctttttcttgtcaaccgtcaaaagccaaccatcaaacatattagatatggttctagaaaggtatagatcagatgagaactgaacttgtcaaccctcaaaagccaaccatcaaacatattagatatggttctaagaaggtataaattaactaaataaaaactgaactgctctccaaacaaattgattcgaatacgtgggcatgcaatgttcttgacggcttgaattaattagccttgacacctcaattaattacttcactctgctgacgatcctgcgagccccaaaagtctgcatgatggccgatcgataatgatggagggctaattaacgtggtactttagtaacttcaggtcaacattaagaatcaagcgtgaaagttgactaatactactgtaacgttcgtcgtcagtcatagctagcagacacaaatattataacaagattctctgaaaagtaaaggaccatgatgtcaaactggtaaaggaattctacaccactgtacaaatcacgattgatcgagacgataatgtatatatggtctgtgaattcctctggtctgtcgtgcatattattattgcagctgcagcccccgggagtttcagcaaaaggaacaacacaagaaccgctggtcatcaacttcttccaaaatcaacgccatttcaaccaagccagcttatattaccattttttttattgattaactagctcgatcatgaacaatcaagcatataagatcaaagaaatatattgtagaattaactttgtgggttttggattatgacatgcagatcagcatgagcttgagcatggatgatgtgacgatgatcagtccgcggtgagccggtgccgcggtgtacggcgccgccatggtggacgacctcctgatgcattcgtcgacgcaccatgcatgctgtcgccgccggtagcttccctaatgagatttactccggtccaataaaaagtatctcgaggtact

SEQ ID NO: 45144 - DNA, 2759 bp, Oryza sativa
  unsure (1)..(2759): unsure at all n locations
cttcatccggtttattttaaacgcaatctacaactttgatcattcatcttatttaaaattttttataattagtatttttattattactaaataataaaacataaataatattttatacctgatttatgtttgtttttaaaaataaaacagacgattaaagttggacatagaaatttatgactgcgtttaaaatgggacggagggagtactttgctgtttactctaacacaatcgacaagaagccactaattaattgtgtcagtcgtgtgagatgagaaatgaagtagatgagatgccaaaccgtagaccaaccgcaacgagggatcctcggccgtgtgtctgattctctcaaggacgaaacgctagcttcttgacagcctacttgtaatttgacagcagacactccacctgtctttgctaacactgatcgtgcatactagtcgagtgataagcaattcacctctcagagatactgtagtaattatggttgtaaacgtgagatacctgtacttgtctgctgtatcggtgcaagccatttccgaccttatcgaagtttcatgctaagttgtaactaccgtgtcatgcaatgaagaaactcattatctgaaaacaaaaaatcatgaagtgaagaaaatcgtaactgcgtgtttcgtcctgaccatatgggcttattcatgggttgtagacaggcccaaatggtattgggggtaagaggccttgtgtaggcgaaggtttgtgattggtgttgatcaggccagcggcccagctactctcggtaccgtagagacaaggaatgaaagaaggaaacaacctggtttttggttatttgtatgccggatacgtgacgtggagcgcatatatcggtgtaccagaagaaactacgagcattgttcagattgttgccacatttaacactatcaaggctgtgtttagttccacatcaaaattagaagtttaactaaaattagaagttcaaagaaaaaagttgaaagtttatgtatgcaggtaagttttgatatgatggaaaagttaaaagtttaaaaaaaaatagaaaactaaactcggcgcaaactttcgtcaatgttataattggatagggtatcaaatcaaacatactttagccaatattttcttaccaacatttantaatttcagaaacttctactattaaaaaactatcgaaacttaggcctcgtttagcttgcgaaaagaaaatttttgggtgtcacatcgagcgtttgaccggtatcgaaagaagttttaggacacaaataaagaaactaattttataactcgcctagaaaccgcgagacgaatttattaagcccgattaatctgttattagcaaatcaaatgtaggttactgtagcactttgtagctaattatggactaattaggctcaaaaagttcatctcgcgatttccatacaaactgtgtaattagttttttttttaaaatctatatttaatgctctatgcttgtgtcaaagattcgacgtgacgtttttagaaaaaaaaatatgaacgaaacaaggtattagcaaggcatcaaaccaaatgcttccaaccttatcaaaatgtgacactaaaattagacgacaatcagaacaagccctacagctccggtcacggtgtgcctcgggacaggaacgacgtagtagtacgatctactgtatactccaatatatcggcagaaacaaacaacgccgaaacccctgctttttttactgcccccaacgtcacgcacttttctctcgcaacagcggcgcgcgccttgtgctacacgacgcgcctcgcttccgccacaagcaaaccacacccccacccacccaacccaagcgcccaagccacacacactgacacgaaccggaccacgaccacgacccgagcccgagcgtgagacctggtcagtcaacgagtcaaccgccttttctctttcccctttcccttctcatctcctcctagcggccaaaaaacccgcgccttcccgaagcgcgctaccaccactacgcggcgagggggggcccccggtcccacgcggcgccacgtggcgtcacgcctgacgcctcggcacggacggatgcgcggcacgacgcgccgcgccgcgccgtcgccatactctccgcatccgacggtggtgggtggttacatatacgtgccctccccccgcctacgtgtccggctcaaaccaaccaccagtccactactccactctcttctccacttggcggcgccgcggcggtggcggctcgatcgatggaggcggaggaggccgccggcggcggcgagcggaagcggaagagggacggggatgcggtgcgggatgaccaggaggaggaggaggagggggtgtatgagggcattgcggaggagtcggtggcggagctgatgcggtggctggagatggagatctcggatgcggcgccggagacggagaccaagacggagacggagtccggcgacgatcctgccggcgccgccgctccggggttcgtcaccatcaacggcaacgaggagagctgcgggccgtccttctccgccgcggcgtcgacggtcatggcctccgtcgacacccgcgccggcgcgccgcccgcaccgcccgtcccctggcccctccctccggcggcggacgtggtaccggccgaggtcgtcgtcgacggcgtgggggaggagtggctggtcgagctactgacaagtgggcccgcggtggcctagggagtcgtggcgtacgtacgcgtgtttttccttttgccgttttg

SEQ ID NO: 45145 - DNA, 819 bp, Oryza sativa
aaaaagctatgaattatttttagatataaagttttttagaccgtcctatttgacccagataatattcaaatccaagtttagagaccggggtgacataactgaacaagttgaaagacctaaacgagtgatctgcaagtttagggaccgggatgccacagtcgaacaagtttgaggaactgaacagtcgatttacgagtttagggaccggaatgataccacggtataagtttagagaccggtgatggacctttactcttaattcttcatcttttttttcttttgtaattttgtttgttttcttcttggatgataaatgagaaatgtccaggggtcttccggctagctccacaaggtggtgggctagatgacctgggttcaaagcctcacccctcctaattatttgatattaggtccttctctaatattctagttttttttttcttggatgataaatggtggcttgctcgtgtcggtgtcaggttcccttggttggctttggtttagagggagggactgtgaacagaaagaaacgtcgtctcgtcgggatagagcctaagggtgtgtttagttcacgcgaaaattagaagtttgattgaaattggaacgatgtgatggaaaagttaaaagtttagttatgtttagttctttccaaagttggaagtttgggttaaaattggtacgatgtgactgaaaagttgtgtgtgtatgacacgttgatgtgataaaaaaagttgaaaatttggatctaaacacagcctttatgtgtgtaggaattttgatgtgatagaaaagttagaagtttaaagaaaaagtttggat

SEQ ID NO: 45146 - DNA, 3496 bp, Oryza sativa
ccaacagatcagacatgtctccatatagtgaaaaacttcgtgaaggcccaacccgacccatcaatcataaaaggaataagtccatcttacctcactcatctctttcacttcgccgaataacatccctcaaccgcaaaaccggctataatacctcccccatctccgtaaaccggtgcaaatcgactcctccggtggttttgaaagcggtttatgctgatatggcaggttgacttggtccgaatgtgctgatgtggcagccatgtcattaaagggattgaagatagaagtgggtcccacatgtaagtgacaaatgctaaaacaaaacggggccccctgtcagccccatttttttcttatcttcttcctcctttctaccttcttcttgcagccgcacgcacggaggccgattcggccggcttcatccaacactggcgccagttgatatgaggtggaagtcgctgacatgtgggccccaattgccaactcagcgagtcaaccgcggtctagcatccatgtcagcaaatactgcttgctaaaccactaaaggagataatttgcaccggtttttgaagatgagggattcattatacccggttttgtggttgagggaggcaattcaatcaagcgcaagagatgagggagacaaaatggacttattccatcataaaaataatgtggcatctctaggcccagtccattacagttcttcaccaatatttattttcctttttgttttttatccacctaagaaagggggaaactacatccaattcgaatccgataagaagaatcaaatccattgcgtgtagaaatggagaggaacgaattcgccggagatctctggttgttgtttccccggaccagctggtgcatttctccctgatgggaagagaagccagctcggttacaagccatggctccgcaccggcgcgtccggcttctacaccggagctcctcgcatcctcctccttcagtaacggcagcgacaaggttctataaataatgcttgtttgcattgtttgttgatatagaggtcgaaaataatgcttccattatcgttgtctagggagtggattttgatatcccgaggggacgacttctcgttgtttgtacgtcactcaaataattatgaaaaaaatttaaaaaatatattaatatgttatgttatattatatttaacttctacatttcacaacgagaaaaacatattaaactacagcttgttaacatatattcatatgtcaaatttattttttttccgttgcgagatgtaaaagttaaatttaaacttgtatgtttatggattgatatatcacatgctaatacatcttcttaatttatttttcataattatttaagtgacatccaaacaacgagaaagattccacattaattatctaaagcctcaatctctactcactactggagaaaccatctttggtcagttgcctaaaatccacaataatcctggtttgaattttaaccgggactaaagatgactttagtcccggttgaaagagctgacatcactttttactctttagtcccggttggtaaaatcaaccgggactaaagatcatttttagtcccggtttaaaagaagacagactgtgtcagacccttctattatctttagtcccggttggtgatccatttttaatctcggttccttataacaaccgggagaaaaaatgaaaacgaaaaaaaaatcgcagagcaagcgccgcgcctcctcgtcctctcgcgcgcacagccttatcctctcatctctcctcgtctcccttcttatcttctccaatctcctcccttctcaactcctcctcttcccccttcctccccttcacctctcctccccctcccttgcgggcgcggcgcgcggcggacggtggatgcggccgcggcggcgcaggcggtggcgtgcgacagaagcggccgcggcagcggccaggcggtggttgggatgcggcctggcggaggacagcagccgggtagcggaagaggccgcgacggcggccgggcggcagctaggcggcggcccggtggagggcggcggccaggcggtggctgggctgtggccgcggcggcgcaggcagcggcgtgcggaagaagcagccgtggcggcggctaggctgcggcctggtggagggcggcgggcaggcgacggcggcagtggaggatttgtttattttttggatttgtaatgaatttgcttttgagaatttgtgatgtatttgatctgtgtgcgatgtaaatatgtgatgtatttatgatgtttgtatttgaagatggcggatttgtaattgatcgatttgagatttagagatgatgttctgttatgtgattctgggggatgtggtgaaatcaatattcaaagtagaaaacaatacaagaaaagagaaactaccaatcagatctgacttcatctttagtcccggttggtaaatgactttatttttaatctcggttggtgttactaaccgggactaaaaatcgatctttagtaccgggtatttgaaccgggactaaagatagcgatttttagtcctgcattcgtagtctcgatcgaaaaactaagactacagatggttataaaccggtagtaaaaagcctttctctgctagtgacttgatccgatcctctctctcttcacctcgccgccagcctcgggtggcgccgccgcctcctccgcgtcgttcttggcgacgacggcggggctgctaactagccgcgcctccagctcccggttcttctcctccagctccgacagctttgactcgagaaacttcacgtactcccttgctccgatcagtatcgacgacgtcttgtctttctgccattaaaatggatcgagaaataatttaagcaaatattagtgaagatcaatactaatcaattatacggagtagaagaaaatgttcatgaatatgcatgtatgcatatgcacgtgtatacgttcgtgtataagccagctataaacatatttcgaggagataaaagagaagagagaatggtagcgagctacagatttgtagctaacttcagcacggactccaaggtgcaagtgtatatgacatgtgggaccagatattaattatatagtatatgtttataattaactattatattagttggctattaagttggttatagataatttgaagccagcagttgactgtactactgtattaaacttgctctaattaataattgtacctagcttggagccgggagggaggacgtacggcctggactggagggcgacgaagctgccgttgagcttctcccgccgcttccgctccgacatcgtgtgctgcagctggttgctggacggcggcggccgctgtctgctggtattagcactggcgtacgcctgtacattgttgccgtgtgcatcttggtcagcaccgattctatggctgtgtttagatcacactaaaattaaaagtttaatcgaaattaaaacgatgtgacggaaaagttaaaattttgtatgtgt

SEQ ID NO: 45147 - DNA, 1696 bp, Oryza sativa
agtaatccacatatgctaatgacggattaattaggctcaatagattcgtctcgcggtttccagacgagttatgaaattagttttttcattcatattcaaaaacctttttttgacatccggttaaacatccgatattaccacccaaaattttcattggcaaagtaaacggggcctctatctatagaactggcacctagctataatctttaaaataaaaaaatgtgtcgccgccgtctggtggagctccgacaggaagatgacgccgctgaccgtgacgcccgagaaggcgccgccagcctagcttcttgcactgttcaactcattattaatcgattttgctatatatttgtcgacaaattttcccctaaaaatttgacaggtgtaattacagtacaatcgtaatataattacactgtaacttgcatgtaattacactgtaactatagtgtaacttgtatgtaactttcaaaaatctatccgtaatatgttatttcggtaaattggaggtcgtgggaacaaattctttcacatatgtgtgtgctatgatttattttctttctcaccaaaataaatcttgtaatagatctaatgatttaaaattatgtgaaacttacatataagttacactgtagttacatgcaaattacagtataattacatataagttacagtgtaattacactacgattgtactataattatatctattaaatttttagaagaaaatttatcgataaatgtataggtagtctcttattaattagcgtgcctctccgggcttctccccatccccatgtacgagtacgaccacctcccgcccccggcgcggtggccatccaagcgagagctcgaatcaaccggtccaagaaggaggcgccccacaccaactttgtcagcccgcgccgctggctatgtcaccaccggccgtctacatctgcatctcgttatagtgtaattatgtgtggattacactctagttaattacatagtgtagcatttagattgtaatttttattattgttctatagtataatttctacttattgtttatacatgtgcatctctccctgcttcacacaatcctggtctccacaaccacattgaaatagtgtagtaagccaaatgcgttcttggcccgaggaaccgagaaagttgcagctaaacacaagagtaattagtgtgctcacggataacgaatcaacagagaacgtgccaaagaatcacatatctcaagatgggatctgatggtaaaaaaaatcgtatgatacggtggaaaaaaattctgtcaaatgatttatagcaaaaccgataaaatattataaataccggttttccctttaaaactgacacctatagttaattaaatatatcagttttatatatttttattccgtgaaggttagaggtttaaatgagagaacttttatgttacaatatactacaagtatatactagcagtataaatgatagaacgatatagattgtagctgcaatggcttcaactgcgagcttcttagcctcatgattatgcgctctgcttgctgccaacacacccaccaccgcagctgcgcctcccgctatacttggcctccccgccgtgccgtcgttgcctacacaccgccgccgatgtttgtcgttcggtcaatgccatgggtcgtctctctgctccggatagattaggcatctacgatcaatt

SEQ ID NO: 45148 - DNA, 1008 bp, Oryza sativa
aggtttgcactaggagggcggccgccggagccggcgctggtgctcatcgccacgaggctggcgccgtcgccgatctgctctctcaggcactgcagcgtccggagcacaacgtccgtcgtgctcatgcctccgccgccgccgccgcgcaagtccacgttgagcgtgcaacaagtctcttgatctcctcctgtcgccgccgcagccgccgctccgctgccgccgctcgtcgtcgtcacctcgatctctactaggtcctctcgcttcgtctcgtcgccggcttccgccgccgccgtctcgcctttgtcgttcttggcggcggggcggctggctagcctcgcctccagctcccggttcttctcctccagctccgacagctttgactcgagagactttatgtgctctcttgccctgatcagtatcgacgccttgtctttctgccattaaaaaagagaaatattttaagcaaatagtacggtttttttttcggtcagataatacttgtcgttttggataagcgtgagatcaaactttagagtatttaattatgaattatttttaaaatatttattttttaaatatggtaactatagtaaatatatgtatatagagtagtcttaaaaagtactttaataaggttatatatttgttaacacttttatatatattataatgaaaaataatggttaaagttgtttatttaagatcgtgccttttacaaaacaataacccatattatggaattgctacgtatctgtcgacagattttctattaaaaatcagtcgatttgttgaccgcatgatttactttgagatacgtgcatgtgccattgagtgaaaaaaaaaagtcgctagaaaagggaatcaaacccatgacgtcgggatgccacaacatgcactccaccaactgagcaagcagcggacaacagctttatgtctatacttaacatttttaaaactttcaatgcagttacactacacccactcacaccattgttatacgggctgcag

SEQ ID NO: 45149 - DNA, 5867 bp, Oryza sativa
  unsure (1)..(5867): unsure at all n locations
tctgctgtatgaggaaatatgctggatgagtacacataccagatgatctggaaaattttggaagtgcgctatgtggaaatctttgagccaagccatccgaacccctgaatctgattatcagcaaccatgcagctagagtgcaaataatcaatgctataacagtagacaagacggcaatagcaattaggctgccattgactctttttttgggcctgcctacatcaaccccgaaaggcttcattacccttgcatttctgttgtttccaaatgccccgtcaccaacactttccggtgctgaaaggggagaaagaagaagccctgcacaaaatccatatctttgggaaaacttgtggggcagaaattcagcatgttcaacaatgagaaagtgcaagatggaataagtttatgtctgacattgctgttgtttatgagatcaaccagatgactataataaattgatagcagttggtggcattgaccagtgacaaaaccaaatagagaaggcacatcaaaagcacaagcaagaatacacacctggatatacaacatacagaatctcgtaatccccaaaaactgatggttttagggaaatttttttgctccataagttttcaaacgttaaaaaagcagtagcattagtcaaacttcacttgcattgatactaggtcaacaagaactactgtcttgtcaagctaatcaccanctacatttacacccataacacaaacctatgtgtataccatatttaccccagataacacttcttccgcaaaatcaaataccaatgaaaagaataaatacagatcaacacttaagcngactccaactttaattaggagaacacaaacacataagactcccacaagtaaatctattagaggctctaaacatactaataaattacaatctacatttataaagctcattagataatgaaacaataagaacacatatattatatccatgtgtaaatcttaaaaggacatactaggtatataaacatgtaaataaagcaagcacctagattaggcggtggtggaggtaatgcccaaataggatgggctgatggtgctttcggccctggttgggcagggattggtggcatggttggagaaatatgaggccctgataaaggcagcattttttttcaaaattcatcagacaagagaaacatggatatttaacagggagataaattaaggctttgagagtacttttgtttgaatgagtgggagtccttgatgacactggtgcagaagatggagaatacgcaggcaagttcgtatggcctgggcaggagaataattaagttgttagtgctatcaaataaaatcaggacccatttggaatggaatattttcctttttcccatgggtactcataggataagaactaattcttgtgaaatccatacaaatagggcttaattaacacagaaacagcctatcaaatatgtttagacagcaatggcctacattacctcgaaacataggtggaggtgcatggtgcttttgccttttagccccagactgccttggagcccgtgagttctcaggacctataatgcaaaacttttgagaatctaaatgactcaatatagacaataactaggttgttggtagaagaattttgtcaaaccttgagcatgagatggtggataagatggggcaaatggaaggtgttctcctttcttcggtgccccacccccaccatggtatctgctagaagttgctggttaggagcatctactgttgaagggggtcggccatgagaaactgatgatccattctttgggactgctggcatatttgtgttctggggcaaaggagtttctgcaggtgctgatcctgagatgatgaatttttgtaatcaagcaactttgtcatatccaagctaccacggcccggcaacccaatgaaattttctgagattacctctaattggcggtttgtgagctggccagtttgactactggattcctttggtggcagtgcacgtggaatatgactattcttatggggaggtgatgtatttgctgggggcactgagtttcctaaatatttaaaaacaaaaacctccaaaaatttagaacaaagggacttacaaagcatcatcagatcaataggattggatatgtttatacttcattctcaccattgctatggtcactacttggtgccagtggcttgctgacgtggtgcttgtgcaataataggtggtgcaactggaggtttacactgttctcggggaactcctattgaagaaatgggaaaacacaagcatacccaacatgattattttgattgaactcaaagcaaatagtttagtttacctgaagtggaaggaggaatggcaggtaacttctttgaggtggtggatacggagggatgccattccctagagaaataaatgtatcaggtgaatatttgcataattgtaaggaacctttttggacatggacatgaagaagtccaggaacttaaggttttgagttgccactatcagaatatatacttatacgctgcctctcagaaaaaaaaaccggagaaagaatatttccctgatccaattggtctgcttggtggattgttcacagaaggaggttgcactatcggtagattaggattcctggccacagatggagcaggaccctgaacaaaaggcaccaaaccaggggtccaagaaagcactggggcaggattttcacctgcaccttgcggggaacctacgggcgccacatgagtggaaccagaaggcgtaagctcaactggaggaggcgcattatattctacataagacgtagttagtgatacactcattagaactgatgcgacatcatgatctaaccgcgggacgaactacctttagggggtgttactggagtaggcgcattttgtggtcgagtgggaacagctgggctgacagcgcccttcgccacaggagggcttgctgatggaccaaagggtgctgagccaaagcaattgtaaggccaattgtcaatgctggttatgatcttgagagccataatgccacaccacattagaaattcagagcaacctgttggaagagttactggaccgagggcgattgtaggtcaggagggctagaagtttgatcttgagcatctggcgagttatcgaccacaggagaaggaccagatcagtacctgcagtggagtaaagaacacaacagggtcatggaatgtgccacacgtacactgatatccaactactaatctcaaaattgcacaaacaagttggtaaccaccctgtgagtgtggattagtactagaggcaatttgtccatgttgttttgccgtatgaaattagcaactaggaaaacaagaacaatggtaatgcaatgcaagtgcacagcaccaaaattatagaaaagaaacaaggtgtagtatgcaacaagtggggaagatacatattcagcgaagttaagcatttcccagtagacaagcaaatgggtggaaaataaagcacatgtgatggaatttaaagtggctagtaattagcacgagatgcctagcacacagccaaccagatatgccaagccaccgacattgcaccatccttcttaatgagaagaagcccattcaatcctaacaaaattcacaacatcctctcccaaatttgctcaaattttgaagtaggaacaggcaactgcatttttttttcccattcacagatcaattaggcagcatgtgcatcacagaatccatccatgagctctcctaacaaatcacacagcattcttctaaaaattctcctaacaattcaaacagcattctaaattaacccagaaaaaaccatggagaaacaaccaaatctccagattactggaccagcatccacaaccccatcatatgatcccaacctgaagaagaagaactaaaaaaaaaaaaacaggaggcgcaaaaacaacctgaaaaccatggcgaatgcccggagctcgtctcacctgtagatccaagaaccgaagcgagaagaagcaccgcgcaacaagcgagcgaccgcatctcgcccttcctcccctattgcgcctcacaccaagaacagccaactcaagaacagccgcgccaaaatgcgagagaatcacagatcacaaccatctcgggtggcgcgcggcgccgctcctcctcccgcaggaaggcgacggggcctgaccgccattttggcaccacgccatgagcagccacactcccatgtggggagggagaagaagagggcaatgaggaggcggcagaagaggggttagccaagcaaagcttgtactagtaccactagtggttactggttagtacagtacagtacaccacaaggcagtggactagtggtagctaaggaataaattagtgagaaattagcaacagaagaagaggagattaagaagaaggagagagctttgggtcaagatgcaagaaccagcacagtaaacattccttgcttgctgcccctgcactcctccctccaccactacccagatcatcataagctgatgaaagatgaaggattaaccaactaatcaggaagaaagaaagaacaaagcaggaatctttgcttggggctaagtaaactattcacccccaagaaacaccctcagagatgcaagctcgtcctctctctcatgcatcagagtgcctgtctgtctgtccctctcgctgtagattcttggtctgtgttgtggggggtcactctcctctcctgcatcgacagcctggtccccgttctttctcactgattactttatttactgttgcgaaatcggtgggttggatgggatcggagtatgcacagcagcagcaagaaccctagaaatccctctccctctctctctctctctctctctctctctctctctctcctcgtgccacggctttgtcggttgatcacgagggcgcgtcgaccatcaccgatcaccaagcacgcacggctgctccctcccagcgtagtaagtaaatgagcagacatcggattctggcgttttgatctgcatttgcaattcgaatttgattgcagaatgtgatggtggtgggtttatctgaatctgaaacccatcctaacagccgatctgcgtcagtttgcgtttggtttcgtcgggactcgaggttgtggcgtcgccatcaccagcgagacccatatatcagctcttctgctgctgtagctgagctctgctcatgcaccacgtaccaaaagaaaatgggattaatcttggcaaaaaaaaatcacaaacaacaggtttattagtagctaatcacgggctgttcatggtgctcttgaggtaatcattggttagaggcaaaaacaagaaaaagaacagcattaacagcgatagtcgattagtttactcggataaattgggagcttttgtcatcatacttgagctgctcgtgatcacggtaacagacaagcaagcaatgcccttccaagagcccagattacgaaaatcgatagtccaaaataggtttgcgcccgtgggagactgtcagatcctctagttaattaatcaaagacaagaaaagaattatacaacttggaatacaatactagtagcaaattactctcggagcttaattgtctttcacttcatgctcgaccagttcttgaagcaagcaaaccatgcaacatttgcaaccacaataaacaccatatcatctcatcttatctcttctcttatccatatgcaactcgatcaattcagcatcaagcaacagcaacattagaatgatgccatgtcatatttcaacctgtaaaaactaaaaagatgataaagcttctagagcagaagcttatatacacgcaacaaccgaaaatgtatcaaccctgaaaactgaaggaaactttttttccctttctttcttt

SEQ ID NO: 45150 - DNA, 1199 bp, Oryza sativa
  unsure (1)..(1199): unsure at all n locations
aaaaaatagacgcaaagctaacagtaggaatatcatggaagaaatataaagacattgaagagccatggggaccagctaggaaaatattgggaataaattattatctagagcccgcggccaaggaatatattcaaaagtgcaagaggctagaaacaagaaaaatccagagcccccacattatacaaatattaaggaagaagggtcatccagaaaattgacatataaagaatgcttaacaaagggattagaccccttagatagtgaatatattgatttaaagataaatgaaaaaattgcagaagtctcgactcagtgaaagaaagatttaaaggaagaaattttcaaagaattaaagcaagaattaaatgaaaattttgaagctctgaagaaagcatatgatgagaaatttgaaatagccttttctgatgatgacactatggatatcggtggtcatgggcaaccagacgaatagttattatatataaagacctcattgataaggtattatcaattatacgggcatggtagaccatatatctatatctgttgaaaataaaaataagattacaaaggtctgtcgttatatcattttcttcaagagaagacgttcaaaattttgtggagaatattccaaagttcaataattaccaaagagcatcaaatatggtaaatattctctcatataatctaaactagcatgaatgcagaagacaacaagtcacaatatgctaaaggtaaaaatccaacttctcgggaataaacagagcactcgtgatcagaagaagacatataactctctgaagaacccatgatgccacagtatgataaaaaaatatatgagtgaagattgagctccctctccggcttctataaaaggggaagttggtgaaacagaaggataccaagaggcagcaaccctcagccagagtctcagaagccactctctaagctttagtagtagaaatttattaagagttcgccttgctagtatattgaagcaaggagtgcaatataaattgtgtaaggtaagcaaaccttgtttgtatcatcatccctcggggttcccgaaaaggaaaaccatatgtattctattttgtggtaatatagtagttttattnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45151 - DNA, 1284 bp, Oryza sativa
tataaggagtatatattgttaatatctacagccgatcaaatagatttagttccttcttatttactcatggctgccgatcgatacatatatgacacggctcaaagataaatgatatgtcatcggcacctagccaatcggctatcatttatagatttaaccgcggtttctttgcctttatttcttgttgattgcaggatcaaatccactggcacgctagcatacccgaaggcgagctttggacatgcactggagttaagcagatttcccaggcctcgtgtttttcatcaacactcatcacttcgagatcctataaaatgtaaccacgtatgactaaacgaagggatattagaggatcttatactattttctaacagggattttatttaggaccaccaactgctattactaccaggtaacaggactacaggaggtaccagtgacatatcccaccactaatttgaaaagagtatgatggtagtaccggatatttgtgttggtaactagatctagtagggggtaaggacaagtgtatctaagggtgtaagcgggcagacctgcggacccagccggtttacccgcttatttgtattataagtgagttcaggggcctgtctgattgcacctttaatctcgtcccattgtacaccttgtccttcgcgccgagttcaagattgcgcaccgccatcgccctaccgtcgccctgccaccgtcgccatcacccgacgtacgtccatgctgccagcaccagagccaatagcattctctaggaaatccagaccctactgtcttaaggaaatccaacccatccacctccacccagcatctcctggcctcgattttgaatctgatgactattgggtgtttctctcttatttgattccttgcacaaggttttgtcttagcaaccgagatggccatgacaaagcttggagattcccacaatgcaatgagtggtgggctgagcacttcctgaagttgtggacggctggcgcagtgctatctaggacatccagtcgtgaaagataacacggagacaacgacactgttgagagaaaggagtgggaggcattgtgctcttgcgtgacgggagagggagcagcgggggagcgtccaattaagtggatcaaccatccttatttataagggtgtataacgagacaactcaggctcgtctcttttgaactcattgtcttaacgagccagctctgcttgactcgttaactttaacaagctaaagtctagcgcaattcatcttgcgagctggctgctaggctagttaggctt

SEQ ID NO: 45152 - DNA, 1781 bp, Oryza sativa
tggtaagcctacgtcaagctgttgatccacttcttggccctaacgtacccctggacaatgtcgcaaaagcagctgccatcgcatcaatgtgtgtacaacctgaggttgcgcatcgcccgagcatgggtgaagtagtgcaggccttaaaacttgtttgcagtgacggtgatgagggcctcggatcaggaagtttcagccaggaattggcggcacaagctgcagcaatctatgatgtaactggcatggaagctgagagggtgctgttatctgagatgtttggctcaacccctgtcttcactcccgctgcggattcaggttctttccgaaagcagtccagctcaggtccactgatgacaggcaagaacagaaagttctggcagagattgcgaagcctatcaagagggagtatgagtgagcatggtgcctcaccagattttgagacgcgctcgcagtgtagtaataggtgaggtttttttctgttcccttttcaatcttgcgaagataaatattcagttgaatggaaatagagagttttcaggcctagtttctgtacattactcatgtggagataaaaggctgtatagttcagaaatcaggatagtagcagggcagagcttgagctgtggagtattcaaggatttaatgagatgagctcagatttggttccatactaggtttgtctgcatttggatttggatgtcgtctctttttcagcttgtcagtttgagttcatttgtgattttctttgttttctttttggtttgagttatgattagttgtttggtaggaactgttgatgtatagattcagactacatttagaaatgcatttgttgcaatgaagatgataagcttctttttttctggctagttgcagcttctggctgattccacttgtttcagaagaaactgccatgtaaatctgacagaattgcttctgttcttccatacctctaacccagtggatgatgctgctgcatcagcaacttgcgagagttgatatgctttcttgagaatatggcataagtgctctgtttactacaaagtattttttttcagagaaaaagccgctttagggcctgtttagatccatttggaatagcaaatggcaaatggcaaaagttttggcattgcaaaagtactagttggtgtttagatgcatgttaaagttttcccattctagcaataaagtgagaaagagaaagagagatggagtggtcccaagcactttttggcacaatttgctactatggactagcaaatgccaaataccaaatcgccaacttttactactagtgtttagatccaaaatggcaaaaagtacaacaaaatagcaaaacttttgtcattttggaagatctaaacagggccttagtttatcatgccctttttcttcagtttggggatgaaaagtttcggcattgatggtgcaatcttcctacccttttgttatcctttaccagttacacatcttccattgaaaggtgccaaattgctatcatgtagtgctaattaagaaagctaaatcatgtatatcctttattccatagtcctcacacggattggaagaacgggaaaatcctaagcttttttgaggatcaaaacctgaaaaattcccttatgaagatcaaacaaacacaagggctcaatgaaaaatacagttcagagaaaagagtaaccttcgtgtaggtgctaccggggtagccactgaatccggcggcggtaaggtcaccacggtggcgcggttgtcggcggtgccatcgccggcggctcgccggaggt

SEQ ID NO: 45153 - DNA, 2474 bp, Oryza sativa
gtaaaaatcaagaaataggatttatccatatcacgatgagtaaaacttttacttatgattaaaaaaatattagaagttaaatatttacttctgggtacctgggttaattttgagtaaattccctttatacccatgaaaactcacataatctctttcatatcctgaaatttatttgatcccttctatacccttaaaattttgatcctttccatgccctgccgttacatttttcttcttttcactgttacgtttggttgcaaatgtctgttatgcccttgatgattaatttaggattgaatataagcatgaaaaagattgaaatttttgtttgagtgcaaagtgtgtgcattttatgaaactaatgagactataaataattatatatcagaaaatattgacataaattttgaaaataaaaaaatgtaataaacaaaaaaatttatttgcaattttaataggataatggatttttttttatcgggagcattcataaaaatagtatcgtgagcattggtagtcatatctttgtatgaatgctcctcattattttatgattttttttaaaaaaataaaataaatacatattttttatttcattatctaaaaataaattttatcataaataatgtatcgtacagcaaactcataactataatagtttcatgcgacaaacttttacattttcaataatgtaattcataatttttttatgttcatccaaagggtaaaatggatatttttatagaaatcagacggtcaactgacgggattggcatggaagggatcaaaatcaaattttgggtatataaggaagtaagcaaaattcaagagtatagaaggaattagctaaaatttcaggagtatacaaaggattttgtcattgttaaacgtctgtttttcgatcctaccgtcagtgttcgcctagaccatagtctagatgctagacgatcggttatcatcgagtttagagcctaaaccgagaattagaccgtttgaccatctagttagtcaaagacggttctagttctagactgtctcgaccacacaattagacagcatcgagatgagtgtagaacgtaaaactgtcgcttagactatagcctaggcaatggaccaatgcattttttttgtgtggcaggacatgaaactttgtgccctccccaaaaccaatatgttttagggttttcatcctattccatactcttcttctctgctctaagccactcgcagccacgaaatcgcaatgcttctcctttgctagttgctaccgtggaccttactcccacctccctccgacccacgactctacgagaggggctacatcttgggacatgtgtaagtgtgtttagtgtattcatttgtgtgcaaaaataatatgtcgatagtagatgtattgtctagaccatgtagacttgcatttagactagctagagtctacaggtggcggcgttgggaaggtggtgctcgaagaggaaaaattggggcgcgctaggaactttgtgctaggtaagatgactgaaagggtatttcggtcattaaaaaaaataacagtaaaaatggcgtgtagctgatagactgtggacggcgatagtaaatcgttgaggtcaaggaaaaagcgatgacatattatagatgtcgataaagtcagtagcatattgttgaactgtgacgaactcagtggtactgagcagagaatctcttaaaaaaataaaaagaaagaaaggaaagtgcattgcctagatctcctaaagtacctatatgtaatttatcttttatgggtgtgtctattttttttggcaaattatctatatatctattgtctacaaattagctatcttttgtcgaatctttattttgtcgaggtattttgctatatccttccttactttattttccgtatgtcgttaattgatcttagctattgtcatattagatgttgacttgctgggtcagtgctccaaaactcatatcattaaaataacattttgttatgcacttgcttcgtcctaaaataagcgcagcatgagtttccgtgtcgaactttaattgttcgtcttatttatttttttttaaaaaaaataaaagacataagtcacgtataaagtattgttcacgttttataatctagtaacaataaaaataataatcataaaaaaaattaaataaaatggacaattaaagttgaatacagaaactcatagcagcgtttattttagtacatttccatttttccttcctccgccgttggtgcggagggaagcgacaagatgatcaaccatagtacatcctatcctaggcctccatcggttggctttttttctaataagccaaaacggcttattatggaataaaaataaatttgtaggtaaaacttttatatatgtgttctttgtaacttaaaagccaatgctgaaaaaaaactacattgaaaatatttcaaaatcaatctcaaaattaagtttgaaaattcaaaa

SEQ ID NO: 45154 - DNA, 2742 bp, Oryza sativa
ataaactagataagctatgtttgagggataaatttaagtatgacacataaatgggggctattgctaataatataattatactctttccatccaaaatatgaaacatttctaggccactgattctaatgcacaaacaatgtacatttttaaccaatgagatgcttgggaaaaggaatactataagcaattcaaatatcaaaatttgactactgaattgaagtgactagaagagaattctttttccctccacctttgtttttgctgaagaacctaaaaatgtttatattttcaaaagatggagtatttcaagcttggtctatggtgtttttttaatatattcagggattgtttcctgtttctgctgccatgaaatcatgaggattccctggaacaagacaagggggaaatacaagcatttgagatcaccaaggcatggccaaaaggaaagaaatggatggcatggctggcttgctggagctctcgtctgtgtcgtctgtgatcaatcatgattccgtagaaactaccaaagcatgcaaaaggccaattggcataaaaaaaacccctggttattttaattacctacagcagcagttgctcctatatctatatatgcgtgtttcttcatgtttgatagtatatgaattatgagtatataatgacagaatcaaataaaacttttatgtgtcatacttgaattatgagtatataatgacagaatcaaataaaactcatcgtgcaagattcactgatttgcatgaagtttaaaacgactgctttcttgcaacaaaagatcttagcattcaaaagcctaaaattgtgtaagatgcagtgtaatacagtacattctactattcactttccagaaaagatgtagccagtaggacattctacggaatatcttgactgttctgtcttgagggaaattaaagtagctaactctacataatagttgcaattatgcccattccatgcccctagctagaaaaaatatttatattcaaatggaagaacagtttttctctaccatgcatgaagctacagcacacaccatgagctagcccatgcatgactctggagggaattggcaactttatctgacattctgcctatatatgttgttaaatgcctaatctaataactgcagagtacacacaattaagtactggtgtgaagaagaatatgcaatggtccaggcagggataataatacggtttattcttgtcaaaagtaacatgcctaagccctaaggtatgtctattgattgatgttcttacatttgaaataggcattggaaactattttatttgtataaccaaaatgtgaaatgaataaaaagagtactccaatattaaaaaaaaacaaggcattaactttactgataatgtcacaatactgttacggctgagagagtgagattacactgggtagtgtttatttccttgtcaacgctttattttaaaggcggtttcagtaactataatgacatagtagttctcagcttacagccttacactgctgcattgattaaagttctcgaattactgctacggctttctgaagcagtaccgtgttttcttctgaaaaatgtttcataacatttcacttccaatttcattcattttagcagagaaagcatttacatgtactccaattcagtttatcagaaatgaaggaaacctgtgcagttacaactaagtatatacgggcaacaacatgtgcataacatatgaaaaccattagcccataattaaacacagattttgaaaattttacttcatcacaccacatttattttccagataagttattaattaagtgcacccccagctcaaaatgcatgcaaatccattcttcaggaactagaaatttaagggaatgattaatggtaacaactgattacaaatggagctctaatggcagtagctctacacagctttatgagctgagaatggctaaaaattttattattacagtaggaagatgaattaactatgatatatagctagcataaacaacagtatataatttgaaaagttccatatatatgaattgaacagcccataccctcccaaaagaacatcgaattattaaacctcaattggaacatcaaaagagagagagctgggtaaattcgactcacttacccagctatgaaataatcttgacatgatcatcatcatcaggcagttcttgtcgaacgatcgatgagtagcccacgaacaaaatttgtttggatttgcttgcatgattcattcgctattcatccatggcggccgaggtggttactagctatgccatggcttgttgctgtggtggtggtggtcgtacggcgccgccgacgacgccgacgtcgtcgacatgcagggatcgaagccggccatgctcattatgttgccgtgggagaaggctcggagacccaagaagtccctggtgaggccgtcgttgccggctccggcgacgccattgccggtgtcacgatcggacctggcgcccctgctgctctcgtctgctgcgatgaagtgggacgcttcgaaggcgagcccgtagccgccggcgccgacgcaagtgctcgacacgttgctggtaggaggaggagggggagcattggtggtggcggcgctgctgctgctgttgtgcgtgctcgccgccgccgccgccgccatgtgggcgtggctcgacgggcggctcaggtcgcgcccatctgcgcctactttctgcagcagcgcggtggcggacatgtgc

SEQ ID NO: 45155 - DNA, 890 bp, Oryza sativa
  unsure (1)..(890): unsure at all n locations
cccatgcccccccatcgccatcgccgcctggtgatcaagcacatccgccacctgcgagaagagcatcccgcctccctgctgctggtggncccgccaccgccgccgccgccgtgaccgccctcgcgctctcctccgccagcgcgtcgcagaacgccctgtgcgtgatgaagctgtcccgcctgcacccacaccgcaacccgatcatcagaacctccgacgacggccatggcggcggcggcggcggcggccacgagagacgactgaccgggagaagagggtgccgcaatcgcagcggtactcgcgggtgccgcagaccttggagtgggccttccagtcggagtggacggcgtagcgcttggagcacttgtcgcacttccacttcttctcgccatgctggcggctgaagtgcttcttgatgccggtgaggtcgccgagggcgcgcgccgggtcgtggtggacgcagccggcctccgggcacacgtacaccttcttcctcaccacctccttggggttccgctgcttcagcttccatggcaggttgtgccctcgccggtgcagctgcaggttctggtctcgctggaaccctttcccgcagatctcgcacacgtacctgttcgtcgccatcagcgtcctcggcgacagcgcgatcacctccgcctcaggatctacccataattagttagttagttcatcctaaattcgattaactcgatcgcgatcgaagaattcggtgctgacctgggttgccggggaggctgcgcttcttcttggcgggaggaggagcggggtgggacgagacgctggcctggtcgccggacgccgacgtcaggttccacatgttctcctcggcggcggcgagcagctgctgctgctgaatttcggccagatcc

SEQ ID NO: 45156 - DNA, 1874 bp, Oryza sativa
aaggcatcaccaaacaagatggaacgtttttagctgctctgtaaacaaaaataaacaaacaaacgaaccaaacaaaaagttcccaacatgtaacagtgagatgaacgaaaaaaaatacgtagtatattatgttttatccatgtttaaaatgctgaactttttctaattctttcttctgtagcttttgcggcctaaaagctagtactagtactgtaataatgagttaatgacagctgtgaggataggtttagcgattatagtctagagagctcctagtttcctatcaacaaaattaaaattttcaaaaaaaaatcgtttttatatgtacgtgttctctcagattggcatttttgcacgtgttggatggaagttatcactgtactgaaaaatgaagacgaaatgctatctcaatccctctcgctctccgtttggtgaaatccacgcaaatgagtgcaaattaaggggctattcactttgatacttaaatcaacttaccaaaatttagtactgttaaattttggcatcaccaatattgataaggttgagatgtgtaaattatgtttagtttgttaattttgtggaaaaatctaatatattgtattctgatgttttctcgtctattacatcgatcctctcatgggatatatataggagtacatatgggatagagacttagagtacaatacaagtaagagtagatttatctctaggattctatctctaggactgtatcttatctataggattctatctctacttctctaggatatatcttatctctataatttggttttgactcttatctctaactagtatattatacttctaacattctccctcagtcgtaacgggagcgaaccgaacgattgcgactgtatttgaaatcttctatttcttcatctccatcgactcaccatcatcgattgcatctctgatggacgggcctccacctgattcctgcgtccccatctgtgtcgtcgcttgactctcctctattccctcccgcagtcatagcaggagtgtcatggacgatagcgatgacacagacactttgactgcagtttccgtcaatgatttttggtgtacacgttcgtcaatgtagccgatcatgtagtagccgtagtcgtggtagttgttgtaacccgcatatagccgaaagcgaaaaaaatatttacgccatggtgtgaagacgaaactgtaattggtagcatcttgcaccttgtagatgtcagaggatgccattggaaacgtcttgcatatgtcagaggacatcgttggcgatgaggccaccactttggttggttctcctgcgccgtgtagcggtcatcacaatagtgatgccgggttgatgcagtcgttgtagtcgtagatgacgtgatcgatgccgtcgtcggtgacgcggtcgttgccatcgtaaagaacgcggtcgatgttattgatgaagcgtcttgcagattaatctgttagaggacgcgggatgtccatccttgtggacaagtggcggcggcgtgtttcccttgttgatgaagaccatcggcgatgttgcatcggcgaagacaattgcgcagtcgtacggctgatgatgatcagtactgtcggtgtagatgaagtcgtgcgcggggaggtccgtgcgcctgtgcaccgaagtttgaccttctcgtgccttcccgaggatgtgccacacgatccatgcatgcatgcgcatgacaatggttgtggttgttggcttgctgcttctgctcatgaggatcatggagctaatgaagatctaatctaatgctaatcattacttaatctaggaatttttttcaaatatgttgtattctgatgttttctcgtctattacatctattatctcatgggatatatatagg

SEQ ID NO: 45157 - DNA, 37697 bp, Oryza sativa
tacaagcaactatcgctctacaagcaaccatcgaaagaagaaagattggatagaacacgcaagctttacctgacttgagctgtattgcactttgcacagatcatagaaaaaaagaaataatgatattgtacagtatgcaagtaattcaggtgccacgaagatctgatctagtctaagaacccctcgtggccacgaatcaaggatcacgagaaagcctgaaactttcatttcacccccaaactgaaaagaaaacgaagcaaagcaaagcacacttcacactaggcacctcctcaccttcttgtggctctcgacggggagaggcatcttgcgcttgggcacgcggatgcggatggagcggagggcgacgagatccgggtcgtcggcgacctcgaggtcggaggaggcggcctcctcgccggcgttggacgactggttggagccggacgccgtgcggcggtggaagaggcggcggaatccgtcgacgagcgtgccccctccccccatccccctccctaccagttccccgccggcattggctagctacaccaccgcagctcgccttccaagctctcgcgttcttggctacttcttcttctccttccaagctcggacctttcttcccgcgttcccgcgaccaagcttgcctcctctctccccgcgcgaagtcttcggcgagtaatggatggatggatggatgcagaagcagaaggcgaggaggaagaaagcgatggtggtggtggtggtgatggggaagaagtagcaggatctcctcgtcttatacttctgattagtgaccgatttttttttctcctccccgtctgccgcgtactccccctatttcatattataatattttctagcattacatatatatatatatatatatatatatatatatatatatatatatatatatatatatatatatattataaaacagaaaaaataatagaaaactaatctataaaatataacacattgcaatgctaaaaatattaagacattttgtattaagacattttgtattaggttatagcctcatcgattacccatattttctagtaatactaaaacggtttattaagaaataaaaattaatttattagtaaaaactgtcttatgaagacgatcaagtgggtggtggtacgtgcaaatctggaaggaaaacggtgcaccggccggtttccatcttgccatcaaaggaagcagcagggaaatcccagtagtggaagtacagctagatttttagtattagtacgatgtggacaagacttactcctacttcatttgcatgcacggctgtactgtactccaattgtgtgaaagttatggccgaatctgccctgcacgtacgatttggtctcaactatgtattttcctgtactgtataataatctcaattctaaaatggaaaataatttgctagaactatactactactagtagtacttgcgaattggtctagaccgttacctgtatggattgaatttgtctgcggaaattctctggcaccaggcacaggaacatgctgcaattaacatgcggtcaacgctgcacagaggagagacatcctggttccagttggtaaggttaaccggattctgaccgctaacgactggaaacaccatgtaagaacaatactacaatactacggtccccatcgtttagcatattcatatgcttatcagtcagaatttgaattttcaacgttaaattttgagttgattttgggattttttttcatcgaagtatatttttcagtctttgcttttagatcgctaagaatacatatataaaaattttattcacaaattacttttcgtttgtaaatatgccgtttgacttattccaccgatatgccaaacgatggcacccgtaaaacgcagcatacgccgatgcacgcaaatgtgcaatgccattatgcaagcatgaatacgaaatcttgctcatgtacgaacataaacacgcaactatagattatccaaatgctctacaacatttataaccattgatcaaattctacatgaatcaaatccccatcaaataatgggataatatgcatagcaattttcatctgctaatgcttaatcagatcagatagcgatgattggaggagattactcgtagtagaccaggccgatattccctgtgccacctccatgtggaccccactagccatgcatccccttgacgtgacggtgatgcgagagacaggtggcgtggcggtgcacacagacacagcccgggcattgcagcgtcagtcacatgcacggtcgccgccggccggaaggagacgggacagctggcgtgttgcctccccgccgcaccaacgccaacgcgtcgtcgccgccctcgtgggccggcttggctcgacgtggccttttcacccgcgggccagtccaacgccgtgtgtccccactcgacgcgggtttcgaggagggtggggcccgcatggcggttcctggcccatgctgacaaccgggcggtttgtgggccccacatactgggccggatgattggagtccttcaacgtgggccacttagtttcggcccgttggcacgcgggagagaaaatctctctctggtcacgggcctccagccttactggcttccttccggcgagggcgaggcggagaggtgggcgcccgcctctgcctccgcctccgtctcgccgcgctccggcgggtggccgggccggggtgcctccacggcctcgtggaagccgcgctccggcgccgccggcagcaacgtgtgggcgaggctgttgctgcgagcgcccgcagagaccactccgcttttgaagggtatgttgatctcccccatttatggcagcggtttctgtttggttccgcgttgctgttcatgcgccagtgatggaggatgtgttattgcttattgaatttgattgtgatgtccattttgctatttactttcacgtgtatgtttgatagtagtcagcgcaagtaaacctggcatctacaaatgcagaagggaatcaagggattggattttgggatctcttccttttggggaatttttaggtgccacaagctaacatgtcctaggagctagaatgtctcagtgattttttttcaatgcataaaatcgatggttcatttctgcaattggacgattcattacatttttagcttagagaaatagttaatacatgaggtacaagagcgaattcctttggtttccataccgtgactatgattctgctttctgccatccgcaattcagtctaggataaaccgaatggctctcatattgttctcccatgtaaacatattagctgaaataggcactatctgaacccaatggccattgtctatcgatcccaatatctttatatagatgcagttatgattggctgcatggctttaatttctcattttaaactacagaatgcattttaaggtttctttgatgtgaattggtaaagtatttggttgcatacatccgcgttggatgtagaggcccggttttacccgttttctaaaaaataaactggtaaaatagaatatagaaggcggcaattaatacacagtgtatgctcttactattgagtgtttagtgccttagtgatcaactggagcatgtaaggatatagacttctgatcctcacaatatttcaaactttggcttataactttttcacacttggtttagtatcctcaggaaccatttagtacgagtcaggcaatcctcatgaaccatttagtacaagtcaggcaatgggttgcactgactaggatttaggagagacagtgagttgcaagctaatgacaatcttcttactgttttattcttgaaaacctattttcgagtgtgtgcgtgcgtgtgtgtgtggttctatttctagcatatgccattatgccaagcatgggcgcatggcacacaactaggatttgtcaggttagaagtgcccatcaaggttttggaaacaggtggagaaaatggcaaccaaaatatcagcttcgaagacttggacatgcactgatgcacatctgattcttggagattatacgaagactgtgtgggatcattaccataagagcctccctaaagggctctgtggatcaagcaaatggcagctgctattggtcaagagcagagctcctctcaaatattaaggcattgcaaatgaagccaaatgctgctggtgcaaaaggcctactccgtatggtgcaccagcaatcattggggagcacctgcttagacagcctttaacaggcacatgcctgcttgatcaagaccactggcattctggagctgcagaaaacaatggcaacctagaaaacattattctgcacagagacccagagcacactgcagcctggttaactgtctgttggatctatcgggctatgttcttcttgattgtgcaaacaagagttctactggatggatggagctgtccaatcaaactactacctccgtcccaaaataagtgcaactatggatatccgtgcccaacgtttgaccgtccgtcttatttgaaaattttgtgaaaaaattgaaaatatttagtcacacataaagtactattcatattttatcatctaatagcaataaaaatactaatcataaaaaaatttaaataagacgaacgatcaaacgttgaacgtgaatagtgcaaaactgcacttattttgggacggagggagtatcagttgcagacttgcagttagatgatgcatggaacgacacacttctgtcggcaagcctgacaagctattgcattctggaactggtgtcctcaggcggtagtttcaagattgtgcagtgacgagaggtaaattccatatccaggtaattcaccgaaggaactgagagatctcccagatacattacctttccacttgcaagtagcaaccaatggactagttgatgctgccatgctgggtcctccactgcagagtagtaacaacaaacaagttgagattgccagcaagaactgacgagctgttcagctagcacttgtgtactccacttatccactactcctccaccagtttgctgcagcttgctttgctcctacgcccgtgcagctcgcgcgattccggctgcagcgcacgttgggatcgatggagtcggtggccgttgaagcggcgcggtggatggtcggcaaggcgctgagcccgctgtcgggagggctcgtcgaggcgtggctggcctgctcggagctcggcaccaatgtcggcgccgtcaagctggagctgctctacgcgcaggtgatgctcgacaacgcccgcggcagggagacccgcagccccgcgctgaagcagctgctcctgcagctgcgtggcctcgcctacgacgccgaggacgtgctggacgagctggactacttccgcatccaggacgagctcgacggcaccgacgaggccgccgacgagcacaccagaggctgcctccatggcctcctcctcaacacccgccacaccgccagaaacattaagaagaggtacctttctgcttgttgctcgggcggaggtgacgagaaagctgttgccggcagtgacctctctttagctggtgaacatgatgccgatgacgactgtaccgatgaagacgacaacgacaccggctctactgatatcgaccacagctctactgcaacgcacatgcctagaaaagaaaaacagtggggatcacagagggaggacactatgaaaacaccaaagctgaagttcgatagggtggatctgtccacaagaacgaagcacatctctgagcagctgaagctagtctgtgccaaagtctctaccattcttaatctagagttgccggaatcaaatcgcaccattcgaagcagcattgctatgcttcgtcctgtgaccacttcagcgactatagagcctgaattttatgggaggaagggtgagaaggatagaattattaaagacataactcatggtgattgctgtgtcaaggacctgaccgtcattccaattactggtccaggaggaatagggaagacagctctcactcagcaaatttacaaagcagtaaagaacctttttgatgttaatgtttgggtatgtatctctctcaatttcaatgcgtacagattgaaacaagagattgctgattcaatacctaaagttgagaatgagcaactgggtgacctagatgagaatgagcaactgggtgacctagatgacttgattgagcgaagattgaagtcaaagaagattttgcttgtcttggatgatatgtggaattgcagtaatgaggatgattggaaaaggctattagcacccctcagaaacgcacaaacaaagggaaatgtgattctagtcaccactcgttttccagcagttgcagaaatagtacaaaagacttatcgtccaatacaattggaagggctggaatttgaagagttatgggaattgttccaagcatatgtgtttggtgatgagaaattaataaaccatcatgctatcttacaacagactggagaaatgatagccaaaaaactaaagggctcccctttggcagcaaaaactgtaggtcgattgttgagaaatcaccttgatttcaatcattggacaagtgtcctagaaagtaaagaatgggaattacaaactggtgacaatgatattatgccagcattaaagcttagctatgactatctccctttccatctgcaacaatgttttatatattgtgctttgttccctgaagattacaagtttgacagtgatgagttgattcacctatggataggactagacattttacaatcacatcaggaccaaaacaaacgaactgaagatatagcattgagttgtttgaatcatttggttgattttggatttttcaaaaaaaatgtgaatgaagatgggtctccttattacagtatgcatgatctactacatgagttagcattgaaggtttcatcctgtgaatgtcttgctgtcagtagttctaacgtaaggtttgtgcaaattccaccatctatacgccatttgtctattgtgatagatgacatggatgtaaatgatagagtgacttttgaaagcatcaagacggatttcagcacactaagtaagagactggatgttgaaaagctacactcttttatgctatttggacgattccatggaagctttatcagtcctcttggtgatttgttaagtaacgcaaaatcactccgcgtcatcttgttgtctactccatcatatgcagtggagaatatgttgcacaacttttcaaatctcgtccacttgcgctacttaaggattattaggggatattttccagaaataaggctacccaacaccatttcaaggttttatcacttgaggatccttgatgtacgaaaatgcaatggtcactttggtttaccaagagatatagataatcttgtaaggctacgccattttcttgtccccgatgacaatctccactctgacgttgctaatgtgggtaagttaaaatgtttacaagaactaaggagatttaaagtgaaaagacaaagtgagccatttgcattaagacagttaggacagttggagctgaacggaacactaggcatttataatcttgaaaatgcacaggcggcggacgaagcaaaacttttaaacaaaagtcatttgcacaagttaatattacattggtcaacaaaggattgttcccaagatgaacatattcttgaaagtcttaagccacataacaatcttcaggagctacaaattgaagggcatggaggtgccacttgcccatcatggttaggttttaacttgtcaatcaaaggcctgcaatctcttagtctgcatggtctagactggaacaaattcccacctataggggagttatggttggttaaccagcacagtgaaaaatccttgagttgtatagaaggccaaagcttttggaatttaaaaaggttagagctagttggcataccgcgactagaaaaatggaccggaaatgatgcttcccgtgtgttctctcagctagaagtgttcatagtaagagattgcccagaacttatagagttgccatattcaaagatggacagcactcaattccctacactaaaggagcttgagattgtaaaatgcccaacgctatcatcattgcctcccgttccttggacaaactctccatgccgtgctctgattgaagaagtgagatcagattttcagcacttgaagtactcaaatttataccaatctaaatcacacttgtgggttgcgggaaagaagggccatctgaattgtgcattctcaaaagtacttgcatctagtaatttaactgagatgaaatatttgatcttgacaaaatgcccttttttgccgttggaacacctccagatgttatcatgtttgaagaagcttgaaataaatggttcaagtagttccttgttgatggttgaaggtgggagcgctgttagataccagtttccagtaaagaaacttgtgatcagaaagtgtggtgctagcgggaaggaattgacgctgctgctgtcccatttccccaaactctctgacttgacaatgtatagattggagaagatagcaatgcttggtgtggctgagcagcagataacggcaacatcggcatcttcaccatcactttctggtaataagttggagaatgcacgtttcggacaagagcaacaacagccaagaggagaggacgagaaagcagcggcatcttcaggactgctgctcttgcctacccagctacaggagttgttcatctcctgttgctcaaagctgatcctccaccacgattcacttggagaaaacatggaaggacgcctaagaggcatagaaggagggttacaaggcctgcgctccctcgtatcattgactattatcgattgccctgatttcttctcctcctactcatcatcttcctcatctttcccatttccttcctccctgaaatatctgtctattgaccgtgtaagtggcatggagactctgtcgctcctctctaacctcagctctctcaccaacttaggcatagaatgtggtgatttaagaggcgaggatttgtgttctctgctcgcccaaggccaactcacaaggctgcgagtcaacaagaaccccaaattcttcgtcgggatcaacccctcatcactgcagcaccttgtaacggatgacatcgcaggagtgcttgttgtgcccatctgcagactcctctccccctcactcaccaagctaaccattttttgcaataacgaggtgaaacgcttcaccaaggagcaaaacatggcccttgagcacctctcctcccttcaggagctcagttttagtttttgccggctgcagttcctcccctctgtgttacacaggcttgttagcctcaagagattagagatctcgtgcagtgagttcatcagttcgttgcccaagagtggtcttccaagttcactagaaatactagatgtctctggaggcagcgaggagctcaaaaggcagtgccgcaagctaagaggaaccattccaatcatcaaagacagcgactgggatttgattggtaatgaacattctcttgtttgagccatcccggttcactttctgtttggcgcaacgttaatactgtgtgattcatctacctgaaaaacctgattgttctgaaatcctgtgcagattctttcttggattagtatgtgccttattctagtcttggagaatcttctctgcatccatctccattgagttgataatcaacttgtgctgcttccatcacgtgtacaaaaactggtctgtcatttcatacgagttcatatctgatgctttagatgctcattttttggttatctgtctgatcgcactcttctctttttgcaatctttcagctgttctgaataggtattggcagtgagagaattgtgggatttaatcccctgcacacagaaagaacttcaccttgtcgccgcctccaccgtctgtcagctaggtaacgagcaaacaatccttttccgggaggacaattggttgcaaggaggaaccatccgagctattgcaccctccatctacgatcatgtctctactcgtatccggaagcgccggatggtggctgaagcgctgtctaaccgtagatggatcaaggacataagtggcgcgcttgggactcaggcaatactcgaatacctcaaactttggtcgctgattcagtcagttgattgttcttccgcagagcccgactcactctcctggaagtgggaaagctcaagcaaatacacttcaaaatctacctaccgagctttgttccttggacgaattgcctttgaatccacaccgatctagaactcgttggcaccacctcgctgtcatttcttcctctggctggtcgcgttgaatagatgctggacagccgaccgattgcggagtcggggattgccgcatcccgaccgctgcattctctgtgatcagcaggatgagagcattgatcatatcctagtcggctgcccagaatcaaggcagctttggtggtggactttgagagcaatcggccaccccaactgcctgctggtgaatgaagcttcttttcaccaatggatgtgcgatagcagaatggtgctaagtgagtcacatcgttgaggcttcgacacggtggtgacattggtagcatggacaatatggaaggaacggaacggtcggatcttcaatcagcagtgtagatcttgggcggatgtggccagagggatggtggacgaagcctctctttggcgtaaagcaaacccggcgatccttgcgctgtaattcaggagggagtttggtcgccaaaattagcgtgagagatagacttaggattgtctgttattgtcctgtatcagtcccgtgctgtttttttttctttcaaatgtaaataacttttatttctcttaatggaaaaaatgcgctccttgcgtattcccgaaaaaagaattgtgggatttcatggtaatttatttatcgctgggcatggctgaaggacgccgaccaaattttattagattggaggagaaaaggttacaaagtgatttcaatcacaacaggcaaggccgggacctgtgcaacagaaaaaacactgatcccgaccactgaaactacccccaggccctggctactccagtactctgctatgtcatcgctattgtgccatccgcaaggagcccacctcctgccattgacactgtccgtcgacgatcttgctattgttaaatttgatactgggccgactctgggcctactggctgagactcgctgtacaaaataactagtttctgatgaactgaaacttatacaatatgttatcagtttgacagattgtattgtttcaaggaacgcaggtcaatatgtcatttgcatgtcatttgatctttcatattcttcaatttaacacagtggagtaattcttaacatttcacagtaggcaaaaattctttatcattgaatgcaagcctcattattgccctcagcctcttagaacaaataactcatcacttgttgatcaggaagcggtaaggtacttaactctgccatagtttttttaaccttttcaggcacatgatataaatcagctgacttagttttgctcggctccttaagttcagatatattttgtgaaaggtgctgctaaagtttcgttttttttgggaatacgcaaggagcgcatatttgtattaaggatggaaaaaaagtttaattacaggaaatacaagaagtgaaggggagatgcaggaatacaattgccccaaaagatctattctcctatccgatgttgcgacctctcgacagttggctgtggcaagaactccggaatggctgctcgcgcaagtctccagagttctgcttcggcggccattgcccttgccacttccgcccaagtcttttgctgctgattgaaaacgctgctattcctctctttccagattgtccaggcgacgagggttgcaatggtgtcgaaaccacgccgagctgccttggtcaatctctttcggctatcgcaaagctagaggtggaaggagacttcgttcgtcggcagagaacttgtttgtccaatggccctcagtgccatccaccacaactagcgggactttgggcaagcgaccaggagatgatcgatgctttcatcgcattgatcgcataggacacattggtcggggtgtggcagtccgcgcctcctcaatcgatcacccgtccagcacctgttaagcgccactaaccagacgaagtactagcatcgaggtggagcgagagatttccagatcggggtagactggaaccgggttatccctaggaacaatgcttgataagccgatcgggaagagtaattgcccgacccctcccatctccacgaaagcacatcgggctggtccgtgaggtgcactgcacgaatgtcttgccacagggataaatactcaagaatggcttgaataccaagggcaccagagatgtccttgatccaccgcctatcagacagagcttctgcgaccgttctttttttgcgaatgcgagccgggatagcagcatagagagccggcgccttgcagcggatggattctccctgcagccagttatcctcccagaacaaggccttcacgccgttccccacaacgcacaagtttcgttgtttcaaacattttttcgctgggacgttgtttcaaacattcagaacatgattcttctgctgcctgcagtggctgtggcatgtcattcctacaataacaagcaatcacctcgtaacaaggtacagtttcttcaatcttcatccctatccttgcctggtacaaaatctgcagttcagtgtcgtctaaagaattgtgtgcagtttgttgtttcactagcagttgtctacgagcttattgaattgtcttgtggttacaccttggtggtgtcaaaacaaaagagttcactccaattatttatccacatgcccttttgtatgtgttttttttttcaggatcttagtcatcctgttagaagtgttgcaatcaaaaagaaaatcagaagtgctgctaaacaagtgcacagccaatccattcgggcactcctgttgtgtgtaccaacagcagttatgctgtatgtacatgtactctatgtatactagtttgaatccattatctaaaaaaaactagtttgaatccagttctgtgcatatgaatgtactctatgtatacgggaagcttgattgaagcttcaaattaaatcaggtgagtggatgcagagacagtgagagggggggggggggggggtgttgatctattttgattctgaaaattttcagtgcctctgggacgctggatatgacttggttgggcgtatgtgttcctgggctgttttggagcctggacggacggcgataccgcaatgcacaaagaaatatcagatgatgatggctgcagatcatgaacttggcaacgcattctctctgacttttttttccggagaattcgcataaatattacgcatcattgtattaagacttgggtgactttctattttttatgtatccataagctccagggaaaaacgttggcatcttgttgctatcaaacgtgacaggtgtgcattatatgtgggagtgtgcgcttgtatatgaactgtttgtattgtttttataagaaaaaaagtgcactaaagatgttttatggttgcagattaacatttctctatccaacttctcgtataattgctttgacatatgccagtactaataaagtcattcgcatacaaaaactgctgtccagcaatggtagacaaagtgcaatataggagaggttggtgagcccaaatactgggccgtcggaaaggagtgaggccttaattgggccttcagcccggcccatttgcatgctggagatgcggagcggaaaatctctccgtctcgggcctcccgagcggcgtggctccttctcgcggcggatggcggtcgacggcgacgcggtgaggcggcgcccgcctcagccaccgccgcgctccggcggctctaggcgggacgcctccacgggcttcgcagaatccgcgctccgcgtccccggcagcaatgtgcggaactccagaatccaccctgcttttgaagcgtaagttccgtttggtttggtttggcttcgctgttcatggctgtattggttactgatgcggcatgtgttattgcttattgtagtgcacattttacgagaggttcatttgtgtgcgcttaattgggagtagtaccagcagttattagcagtagcaattgtccaagtaatcctacagcatcagcaatggcagaaaggggatttcaggatctcttctttttggggattttttttaaagctagcattttctggagtctggatgcctcaatgacctttttttctatgcatacagtcaatcagttcttcatgtctacatctacacttagctcttatagaaaaatagttcgcagtttagtacgcatcgatttgtggtttgtttaaggccaagtggccaaccaactaaccgaggtagaatagtgaattcctttggtttcaatagcatgactatgatgctgctttctgtgctcccttattctatctaggatcaactgaacagatctcatattgtgttcccatgtccatgtaaacagtttagttgaaattgacactatcttcagttctggacacaatgtctgcatggaagttctattttaagaacatgagcttctgttagagcacatccaatatcttcatatacaatcagttatgattggatccttcatttctccattttaacttccagaatgcaggtaaaagcttactttgttttgaattgttaaattaacatataaaacggtgtctgtaacatgcagtgtatgctatgagtagcatgtttttgggtggtcatgcatgtcttgatctctgggtttagtatcctcatcgaacacaatgaacagttagttcaaaagtcagccattcacttactaattagtagagacagtaatacttttgttggaaccatcagttgctcaaatgatattatccaacatgccaaatggacgaagctggtatcgtactggtcacgagcgaagatatgtatattctcaagctgataaagaagttccattggacgtttccattttagaaacctgattttttcccccataggttgtctagggcatacaccaagcatggtgcacaaactaggattcgtcaggtctagtacagtatatgttgacatatacatatggtctaatcaatcaatgaagttatggcacaaccatattttcatatcctctattcatgaagcagagatctttaagcgagtagattaatcagtgcctgtaagagctcttagaggcgtcaccctatggtgaccgctttttttcctcgactgtctaaagtcgattaatgtaaaacttataactctctttctccttaatacaatttgggtgacctccttcggccgtctcggcaaaaaattcatgatgcatgacattacatgctgcagcagagacttgcatattacttgttcaagttatattgcattttatttatatacattaatcacattctttttgagattttagccttctttgcttatctgctgcattgttctagaaggtcactgcctagcctgagtaggcaacaatgcatatgccaatcaagttcagagttgccgcagcttttagggagaagtaccctgcaagaggagaaaagttcaactgaagtttttgaaaggaatcagcatgagattgtgctataaggtcaactgaagtaggtttttttagataatggatttttcattaatccggcctctatatccacaaaggatatacacaaccaaaacatatacatgagttcttagactctaaacacacacacacacacacaaaaaaaaacctagaagatttagctccaaccttcatcgatgacttattctttccgtcgcagcgcaatatggggaaagaggagaatagaaactagtccgagctacctatcatcgcaccatctctgcctctacggaacacaaccaccatctgctaccaacatttatgccctctgtccgccgtcgccatccaaaacacctacgccgcagccgcattttgaacacccttagtgcgtcacgaagccgccttgccgcaccaccagtcttctctgtagacgatcgatctcactgtcgcttctagagcgtcgtggagccgcctagtatgacacgcgctgcctttacaatcaagaacttgtcaaagatgctccactgccgtcgacccctaaccgcaaccagaccttggcgccgatgctcacttggtacctaccttccctaggatgccatcaccaagagcctccattgccatcgtccttatccgcgttgggcgagccgacgaccattgcatcgtcaactagccctgtcatcgacgatcaccatccctcgtcctcacctggtcatggtcagaaccgggcatcggacctcgtcaagtcgctgccatccctaggatgctgacaccgagagcatctgccatcgtcatcacaaactaccatggccgaaatacaagtccacaactatcaccatacctatttgttgatccgtcgttgcagggggaagctagcccccaccactatccgtcatcaccagccctctcctccggtgacagaggaagggatggatcggaggactagcccccgacaccacccaacttcactactgcccgtcgccgccatcaggagtgccgatgccaccagtcctcgctgccaccacaaccacgatggcacgaccacacatcgatggagtgcaaggccgactggtaaccgcctccactgccacctccctcggccaccaccaatgccatcaccactgtcacgtcggtcgacagccatcaggtggtaccgccatagcatggccgtccaccatccgccgtaccaccctgaacgaccaccatcagatctgaagcttttttggagcgccaccagtggatctggtcctcatcagcatgacagccatcaagtcaccaacaactgatccgccatcccaccgcacgcatgcaggagacgcaagtagcaaccggtgaccagcgcaaccagcacacctccctgccgccacattgccctaaacagctgccttccaatccgtatttctccaggggcgccataggcggatccggccctcgccagcccgacgaccaccaagtcgccagacgacttcaaaaacgcaagaaaacggatctggagtagaaagagagggaaaaaggaaaatgagaggaaaaaggaaggaggtgggaaggagggtggctatggggtgggctttgggggcgccagaaaccacctccttcaaattgagcggcctaggagtccggtcaactgaagttgtagcttccaagaaatacacattcaaatttgtattttttttggagatgatatgaagtttatgtgggataagtaggtaagtaccaaaagagccgaaagggaagtggtcaagcatgtggtagctgaagatcaaagtttttataaaagatgaggtgttataagtgaagcctgaaatattgctgttgaaatggcaatggtacacatgcaatggcacctctggagagaacctgcacaagcggcaagtggcagatcatggtcatactgatgttgcaggcatgaatggcaacctggagatcacaacctgcatgaacataccatgaagagatagcagccaacgcagttgatggtttagtggatccagaaaggtgttgctttcttgatatttactctggcgtttggtgaatgtggcatgttgttctaagccaagaggaggtcacaagtggtaacaagaaaaactgaagttagaaaatgaatactgatgctgatcggagatttctgattattagtagaacctaatggatagtcaactgcgctcaaggagagcacatgttgtacagccatgttaattgctttgaaagtgggcaagttgcccatcaattatttggttatatggcagctttaatattgttcaatgaaaagatgaggcctatgccagatcatggtcgtttcaactgaacaaaccggggaatgcggcatgatgctcgttttcaattgcaacgtctgcacctctgttccgttgccatggtgttctgatgactttgatgaaaaaaataaactgcctgttttataaggaaaaaaaaggtacgtgtattcttgtgagtttaagttatctttaactatcattgtatacactctctgtagctgcagagaattatatatggcgtgtcattgtagaaaataaacctgcttgtttttataagaaatggaaaacagattaccccagtaaggatagtttaatttttattgagaaattttgaatgcttgtgctttcttcccggtctgaatattccaacacttgtttcttctttgttgtataactgttaccttgccattttgtctttcataacaccctctctttcttttttttcttccttttgaagcctctgcagtacttgcacagcaaacagatgtactgtaagcctgcaaaactacttttgctttgtccggcactggatgactggaacgaaaaccacgcatttctaacattcttgctgcaggcaaaaatagggaagcctctgaagattgcagccagcaagccatgcagggagaacatgttactgatttctgattccaaataaaaatgcggcaaggtagtgccgtagtgcctaagcatgttacactcaagccaatttgcccagccagactgacaccgatcggatctcaactctgcagtctgcacgacgtttccttagcccttctctattcgctgtgccagtgtgcttgcttgcttctctcttagccagagtaacattccagcctcttctcccctacacgtctgccactgcttgcttctcatctctaacccagcttgctagcggtgcagggatcagagcaatggagtcggtggccgtgaacgcggcgcggtgggtggtcggcaaggcgctgagcccgctgtccggagggctcgtggaggcgtgggccgctagcacggagctcggccccaacatcggcgccatcaagacggagctgctctacgcgcaggggatgctgcacaatgcccgcggcagagagaccagcaaccccgcgctgcagcagctgctcctggagctccgtggcctcgcctacaacgccgaggatgtgctggacgagctcgactacttccgtatccaggacgagcttgatggcacctatgaggccgccgaagagcacgccaagggctgtctccaaggactcgtgctcaacacacgccacacagtcagaaacatcaagaagaaggcgtgctcatgcggagataatggggaagagagtcgccatgccaatgatgaggaggcacttgcaggcagcggctgtattcacaagctcttttccaatgctcgaggtactacttactatctatctcatcgataatataaaacaccttccacgcctctcttttgtaactgaacatgacggctgtgacaccttcatcaccgttgaaacatttctacagaaagaagccggttcctctgctgcgcttatccctgcaaagcattgcacatagagcacaccacgaaaacaccaaagctgaagtttgatagggtggatctgtcgacaagaatgaagcacatcgtcgagcagctaaaaccagtctgtgccaaggtcgccaccatccttaacctggagttgctggaatcaaaccgcagcattggccagtgcattgcaatgagtctgaattctgagttctctgggaaaatggggcatgcagttgttcttccaagcagcattgctatgaatcgtcctgtgaccacttcagatttcatagaacctaaattttatgggagggagggtgagaaaagtacaattatcaatgacgttattgagggtgattactgtgacgtggacctaaccgtcattccaattgttggtccaggagggataggaaagacaactctcactcagcaaatatacaaagaagtacaaaaccattttgatgttaatatttgggtttgtgtctctctcaatttcaatgtgtatagattgaaagaggagattgccaagtcgataccaaaagtcaatgaagagaactctggttggccggatgatttgattgagcaaaggttgaaatcaaagagatttttgcttgtcctggatgatatatggaatttggtttatgaggatgagtggaagcagctattagcacccctcaaaaaagcacaatcaaagggaaacataattgtagtcaccactcgttttccagcggttgcggaaatggttaaaacaactaattgttcaatacaattggaagggctggaacctaaaatgttttgggaattattcaaagcatatgcttttggcgatgagaaaacagtaaatgatcatggtaacttacaagagactggaaaaatgatagccaaaaaattgaagggctcccctttggcggcaaaaactgtaggaagattgttgagaaagcaccttgatattgatcattggacaggaatcctagatagtaaagaatgggaattacaaactggtaagaatgatattatgccggcattaaagcttagctatgactatctccctttccatctacaacaatgttttacatattgtgctttgttccctgaagattacatctttgacagtgagcaattgattcacttatggataggactagacattttgcattcacatgatcaaaatacaagaaccgaagacataggattgaactatttgaatgacttggttagttatggatttttcaaaaaagatgaacaaaatgatgggtctccttactacgttatgcctgatttgctgcatgagttagcattgaaggtttcatcatatgaatgtcttgctataagtagttctaatgtgagatctattcaagttccaccatctatacggcacttgtctattgtgatagatgatgtggatgtaaatgatagagtgacttttgaaaacatcaagaaggatttcagcacactgcataagcaattggatattgaaaagcttcactctgtgatgctatttggacaataccatggaagctttgtcattcctcttggtaatttgttaagcaaagcaaaagcactccgcgtcgtcttgttgtatgcaccatcttacgtggtggaaaatatgttgcacaacttttcaaatcttattcatttgcgctacttaaggattaataagggatatttcccagaaatgagtctacccaataccatttcaagattttatcacttaaggatccttgatttacaacaatgcaggggtcactttggtttaccaagagacatgaataatcttgtaaggctacggcattttcttgtcccatacgataatctccactccgacattactagtgtgggaaagctgaaatgtttacaagaactaaggagatttgaagtcaaaagacaggttgaggcatttgcattaagacaactagggcagttggaagacctaaaaggatcattgggcatctataatcttgaaaatgtgaaggcagcaaaggaggcagaacttttaaacaaaagtcgcttacacaagctaatattagattgggatattaagcgttcgacaaatgatccttcacaagaagaacatatcctggaaaatcttaaaccacatagcaatctcctggagctacacattaatgggcatggtggcgccacttgcccatcatggttgggtgttaacttgtccatgaaaggtttgaaatctcttcgtctgaattgtgtcgactggaacaatttcccgcctataggggagttgtcattggttaatgagcatggtcataaatccttggattgtacaacagatcggagctttccgaatttaaaaaggttggagctagttgccataccaagattgtcaaaatgggctggaaatgatgcttgccatgtgttctccctgctagaggtgctcatcgtaagagattgccctgaactgatggagttgccattttcacatcccaccacttgctctcggccagaacaagggacaaacctgacccaattccctacactaaagaagcttgagattgtaaattgtcaaaagttgtcatcattgcctcccattccttggacaagctgtccatgccatgcttatattgaagaagtgggatcggattttcagcagttggattactcaacaaataaccatctgaattatgcttgctagttaagggaaaggacgacaatctagatagtgcattctggaggttattggtgttcagtaatctaactgagctaaaagagttgacgttgacaaagtgccctcctttgccattggaacacctacagagtctgtcatcattgaggatgctctgtatgcaagacttgagtaatgtcttgttgcaggacaaagccgagaacactgtcagataccaatttcctgttgagaaacttaggatctttaactgtagttgtagcgggaaggaattgacactgttgtcatcccatttccccaagctctcaatgtttgtaataaggggatgtgagaatataagagggcttggtgtggcgaagcaggggatgacagcaatgtcagcatcgtcattgccgtctgctggtagtaagttggaggatgaatgtctcggacaggagcagcaagaaccaggagaggaggatgagaaagcagccgcagatggagggctgctgctcttacctcagcaacttcagtatttgactatcggggaaatgtcagagctggcattagtatttgacacggcaggaggcctcagaggcgtaggagaaggattacaaggtctgcactccataaaaaatttgaatatatggaattgccccaatttcttgtcctcctactcgtcctcctcgcatcattccccatttccgtcctccctgcaagaactgtttcttagttatatgagtgggatgaatactctgtcacccctctctaacctcaattctcttgctaagttagccatatgggactttggggatttaagagctgatggcttgagttctctcatcgcccatggccaactcaaagagctagatgtccggaggtcccccaacttcttcgtcggatccgacctctcgctattattgcaactaaaaacggatgacatcacatggctccttgttgcccctgtctgcaacattctcgcttcctcactcaccgagctaaccattggctggaacgacgaggtggagcacttcaccaaggggcaaaacgcggcccttctgctcctctcctctctccaggacctccgattttggtgttactcgaagctgcgattcctcccaacagggctacacaggctcacccgcctcaagagattagagatcgccttgtgtccagccatccgtttgctgcccaagggcggtcttccgagatcactaaaagtattagatgtcagtgagagcaaaaacgaggagctcaaaagacagtgccgtaagctaagaggaaccattccgatcatccaagacagaaagtactaataatccaaggtacaggtaacaaacatgccccttttcaactcatacccgattactttctgtttggtaaaatgcacgcactgcttgactcatcgatctgatcaaccttgtaacctgctgtgcaggtttcatcttggattgatatgggccttattctagcgcctctgcataatcttttgcatcctacacagttttgtgttgataagtgtgaagacgtcaacttgttccgcttccagcgtctacactaacatctcatataagttcttcgctgtcgctcctttatttggttatatacttattttgtcactgttctcttttttaatctttcagctgttctgtcagtgagagaattgtttgctttcacggaaattaatgatctgttagttcagctccttgtcaaatttgatgtctgagactcagtgtgcaaagtagttatctgatgaactaaaacttatgcaaaatgttaatgacacggtttgagagattgtattgttttaaggaagacaagtcaatgtgtcattgacaagtcatgtactcttgttgatctttcatattcttctactattcgtaacacttgtttcagttattaattcttaacagttcataattggaacacatattcttcttaaatcatatgaatgcaagcttcatttttgccctcagcctctgagagcaaatagctattacttgttgatcaggaagaggttcttaactttgcaatagtttttctttaccttttcaggcgcatgatatgacgatatcagctcactcaatagtatgtttactctccgctccacttcacttcactagtgagattattagtttttaaatttaaagattattggcaaagtggttttgaatatgattggatttttagatgatgaacggggattgcttataaattaggtatcgaaaaacataaacacacttttctagagataaaagaaaactaacatactattcttaattaatagatatacttgtcatgccgcatcctccttgaactcggactcttttggataaattttctttaattgatccgacttcatatagaacacaattgctggcgacttgacaactcccatcggccgattccaagactctgaagccgatagtgactctatgccgatgatgacttcgggcttaccaaattttggtgttaatagcacgccgctccattcccgccctgtcgctagaggagacaaggagctaggcgtcggtgggggcgacggagatgacctcgactgcgttctcgccatgggcagggctcccaccctatcccctcgcatctcctctgccttttcggtgtgttgtcgtcgatagcggcactgcctcggtgaagagattgaggagatagagtgaggtggaggaagtgggacccatcgacatgtgagtcccactatttttatcttatttgactgacatggggaccccatattttgttttaattatttagttttcaattttgctcctttcattttttttcccgaattaaactaccacgtaagcgccatgtcaatcaatgccacgtaggacgaagacctagtcaaattagccacgtaggtgtatgtgagttaaaattagggataatattattgagggatcttgtttgtaccggttttataagttgagagacttgttgtatctggtttttcggttccgggatgaaaataggattcggtgtaagttaagggacctgaaatgggacgactcctggtcaggcgcccaatcgggagggggtgaaatcgggcgctaatgtcagcatgacgtcagcgtccaatttacgtgcaaaattactttaaactgttttttctcttaaattacttatccaaatcatgatccgattgcaccattaaattcgttgcaattaaatctttaaaacaagaccacacatggatatattccgacgaattttttttagcttattattgaattatttttaaatgttgcacgatgttctaccaggtatatcggaattgtttcactaagtagactgaaaatgtttcactcgtttaaatcgggtgttatttcaccttatataaaaacaatgtttcagcaaatagcgaaagaatgtttcaatttactgcaacatttgatccatacatattgaaacattataagtacactaggtgaaacatttttcggtggaacaaaaaataaaacgaattcccttaatagggggtttccaaaatatgtgggtttttttgttgcaatggaatatttcagttcactgcaacattagatctatacatagtgaaacattgtgagtacactaggtgaaatattttttgtggaacaaaaaataaaccgaattcccttaatagaggggttccaaaatatgtgggtttttttttgcaatagagttgtttgtgtgtggacacgtggtgagccaggggagtgtaggcatggtgaaacattacaagtacactaggtgaaacattttttggtggaaaaaaaaataaaacgaattcccttaatagggggtttccaaaatatgtgggcttttttgttgcaatggaatatttcagttcactgcaacattagatctatacacagtaaaacattgtgagtatactaggtgaaatatttttttgtgaaacaaaaataaaccgaattctcttaatagaggtgtttcaaaatatatgggttttttttaatagagttatttgtgtgtgtacatgtggtggggtggcctagggagtggaggcatacatgcgcacgcgggactgtttggttgttggggttggactcgaccatcggagactcactcgagactcgagagtggtagacacggagaatctcggcgggtgggcggtcggcgaggggctccgctcccgccgccggccttgctccggcaacgagcacacgcgcctccacacgatcgccgccgctgcgccggccacgatgtacgtgaggctactcttcttgtgtgcctgcacccccagagcgcaaatcgctttgaagcgtatgttccttaagctctctgcatctacactacagttacttccatttggttgcttgcaggtttctgttcatgcctactttgatcactgatacagcacaggctgttgcttatcagatctgttcttcctctgtgccacatcccacatgcaggcaaattgctctatcccggtagtttactgaatgaacagtggcgaatctggcattatgcacctttgcaatcgcaacagatttaagtaaatccattggctgtaccgcctgtacctttactattgcgttctaattatggttttgggggctgattagacgtttagtttttttcttatcttccaaatggcacggaatggcatcagattcaagaagagcaggacgactttggtttttttaaatccatttttgagaacaccatttggtaaagttcgaacagagggttcagaaaacaaacaatacttctgccgtggtttggtagtccttcacttcactgtctgctcgctattcaccattcccttctctactactcctggactgctttgttctctcgcagtccacagctcttccatccctcccactctcctcagcttagctagcggagtagagaccagacagatcaatggagtcggcggccgtgaacgcggcgcggtgggtggttggcaaggcgctgagcccgctgtcgggagggttcgtggaggcgtgggcggccagcacggagctcgggccaaacgtcggcgccatcaagatggagctgctctacgcgcaggggatgctgcacaacacccgtggcagagaaaccagcaaccccgcgctgcagcagctgctcctggagctccgtggcctcgcctatgatgccgacgacgtgctcgacgagctcgactacttccgcatccaggacgagctcgatggcacctacgaggccgccgatgagcatgccagcggctgtctccttggccttgtgctcaacgctcaccacactgccagaaacatcaagagaaggtacctctctgcctcttgctcgtgcggtggtgacgaggaagcgagtcgccacgccaacgaagaggaggctgttgctggcagcggctgcatgcgcatcctcgcttgcagtgctcagagcaccatccatctcgttggtaaacaccttccatgcttcccttttgcacctggtcttgacaattgtgatgactccggtgccttgcacatatctaccatgaaaacaccaaagctgaagttcgatagggtggatctgtccacaagaatgaagcacatcgtcgaacaattgaagcccgtatgtgccaaagtctctacaatccttaatctagagctgttggaatcatgcattgccatcagtatcaatgctgaattttcaaggaaaccagggcaaacgctagttcatccaagcaacgttgctatgaatcgtcctgtaactacttcagggattatagaccctgaattttatgggaggaagggtgatagaagtagaattattgaggacattactcggggtgattactgtgacaaggatttgaccgtcattccaattgttggtccagggggaatagggaagacaactctcactcagcacatatacaaggaagtacataaccattttgatgttaaggtttgggtatgcgtctctctcaatttcaatctgtatagattgaaagaagagatctcaaagtggatacctaaactcaaggatgatgagaaatatgtcgacatggatgattcaattgagcaaagattgaaatctaagaagcttcttcttgtcttggatgatatgtggaagtgtgataatgaggatgagtggaaaaagttcttagctcccctcagaaaagcaatgacaaagggaaacataattctagtcaccactcgatttccagtggttgcagaaatggtgaaaacatttgatcgaccaatacaattggaagggctagaacctgaagagttctgggaattattccaagcatgtgtttttggtgatgacaaatcaatagatgatcatgctaacttacttgagacaggagaaaagatagtgaaaaaacttaagggctctcctttggcagcaaaaacggtgggtagattgctgagaaatcaccttgatttggatgattggatgagggtcctagaaagtaaggaatgggaatcacaaactagtgaaaatgatattatgccagctttgaagcttagctatgactatctatctttccatctacaacaatgtttcacatattgtgctttgttccctgaagattacaagtttgatagtgaggagatgattcacttgtggatagggcaaggcattttacattcccaggatgaaaacaaaacaattgaagatattgggttgagatatttgaatgatttggttaattatggatttttcataaaagatgtgaatgaagatgggtcaccttactacactatgcatgacctactacatgagttagcattgaaggtttcatcatatgaatatctttctataagtaatactaaagtaatgtctatgcaaattccgccatctatacggcacttatctattgtgatagatgacatggacgtaaacgacagagcaacttttgaaaatattaagaaggattttggcacactaagtaagaggcttgatgtcgaaaagctacactctctaatgatatttggaaaaaacaatggaagctttgtcattccttttggtaatttgttaagtaaagcaaaagccctccgtgtcatcttgttgtctgtagcatcttatgctgtggagaatatgttgcacaacttttcaaatcttgttcatcttcgttacttaaggattaataagggatattttcctgaactaagtctgtccaacattatttcaagattttatcacctgaggatccttgatgtgagacaatgcagtggtcactttggtttaccaagagatatgaatcaccttgtaaggatgcggcattttcttgtcccaaatgataatcttcactctgaaattgctagtgtgggaaagctaaaatgtttacaagagttaaggagatttgaagttcaaagacaagttgaggcatttgcactaagacagctggggcagttggaagacctaaaagggtcattgggcatctataatcttgaaaatgcgcaggcaccagaggaagcagaactttcaaacaaaagtcgcttacacaagttgatattagattgtgatattaaacgtttgacaaaggattctttacaagaagagcatatccttgaaagtcttaaaccacatagcaatcttcgggagctacacattaatgggcgtgggggcactacttgcccttcatggttgggtgttaacttgtccatcaaaggcttgcaaactcttcgtcttgatggtgtagactggaacaaatttcctcctctagggaagttgttgttgattaatgagcatggtgaagaatccctggtttgtacaacagagaggagctttccgaatttaaaaaggttagagcttgttggcatacagagactagcaaaatgggttggaaatgattcttgctttgtgttctctctgctaaaggtgctcatcataagagattgtccagaactcacggagttgccattttcacattccacatgccctcgatcggagcaagagatgaacttgacccaactccgtacactaaaggagcttgagattgttaattgtccaaagctgtcatcattccctcccattccttggagaggctctccatgccgtgcgctgattgaaggagttggattggattttcagcagttggattactcaaaaaataagcaatatgaattatgcatgctagtcaagggaaaggatgaacatctagatggtgcattctggaggagattggtttttggtaatctaactgatctgaaagagttggatttgaagaaatgccctcctttgccgctggaatacctcctaatgctatcatgtttgaggagactcactatatctgactcaagcaatgtcatgtcacatcttgaatctgagaacactgtcagctaccagtttccaatcgagaaattggagatctttgagtgtggttgtagcgggaaggaattgacgttgtttctatctcatttccccaaactctccatgtttatttcaaggagatgtaataagataagagggcttggtgtgctggggaagcagatgacaacaatgttggcatcgtcatcatcaccttgtggtaataagttggaggatgctcgtttcggactggagcagcaacaaccaagaggagaggatgagaaagtgtcagctgaagcaggactattgctcttgcctcaccaacttcaggagttgaacatcagcgaaatcccagagctgatcctgcagatccattctcttgtagatggcatggaaggaggcttaagaggcataggaggaggattacaaggcctgcactccctacgagcattctctatttggggttgccccactttcctctcctcctactactcgacctccttgtcttgtttcccgtttccatcctcccttcaaaagatgtatctgagtgatgtgagaggcatggagactcttgctcccctctcaaacctcagctctctcaccagattaaccatatggaaatgtatggacttaagtggtgagggcttgtcttctctgctcgaccatggccaactcacagaccttcgcatccaaatgacccccaaattcttcgtcaggtctgacccctcgcggctgcagcagcttcaaacggatgacattgcaagggtccttgcaccaccaatctgcagcctcatttcttcatcactcaccaagctaaccattggttttaatcatgaggtggagcgcatcaccaaggagcagagtgaggcccttctgctcctctcctccctccaggacctcgagttttactcctgccggaagctgcagtccctccccactgggttacacagactcgtcggcctcaagatattagagatcgactggtgtccagccatctgttcactgcccaagggtggccttccgagttcattgcaagaactagatgtctgtcgttgtgagaacgaggagctcaaaaggcagtgccgcaagctaagaggaacaattccgatcatcaaagatagagagtactaatccaaggtactcctattttatccctctcagaatctcttcttttctttgcatccatgcacaaccttttttttatgttgataggtgtggtagtgttggattgtgcttcttccttcgtctgtacacaaaagatgttgttgttgttgttgttttgaaaaacatacacaaagctggttgatgataccatacaagttcatcagatctttaaccggttccaggttttaatagaattattagctttgagaaaactgttgcctttcactgcaattttactagttagtttgatcattgaatttgacaccatgagattcgatgcacaaaatagctgtctgatgaactggaactaataacactgtgtaagcctagttcgagaaacgggttaaaacttatcagcatgccatgctagtttttcttcttctttagttcatcaaggtggtgcaatgtattcagacattcagttaaaacttcacagtagaaacagacattctttttgaatcatatgaaatacgatcttcattatttccctcagcctctgacagcgaacaacttccacttgtttgtcagcaggagtgatttaactaatctcaacagtttcagaagtactatggcatccttagctggatagtttgctcctgcattaactttctttttttcatgtaagttgctttctaaagataattgtttcatctcttttgccaaggaaagactgtaaaacacacctaagttctgttttccctgcagtaggtgtagcctgcaagtccctaacgaaggagtcaaggaggctgctggttacaagggacattttctacaccctgtctggtaaattttacaattttaaacatatgtactttgttatttcactagtaatatagccatataggttgtggtggtgcagcggctgatatatctttccattattataagtaaaccgggaggatgacgcgcatggttatctgacttggcccgggctgttttgcagactggccagaaggggatacggcaaatgttcaaagaaaaaaaatcagatgatggctgcagatatcatatcactcttctctatctctctttgtaaaatggcctgttctctggctttcttttttctcttcttttttaacttatataggagtatatgctttaggagttcagggaaaaaagaaggcatccttttgccactaaaccagacagagtactgattttggggacagatgttttattgttgcagattactaccatttctctatcgaacttctcccatagttgcatcgacatgcctgtaaaattattcgcagacaaagctgcagggcggcgtcatcaagcaagttgaaatgtgcaatctgtaaccatctacacgcacgtcattcagacagtgcaatgtcggaaagggttgtgatgcatcagtctggtaacaagtctgattaatgaaatggctgacagaagtcgagctgaagctcagaagctgaatgaacattacctgaatattttttttcataacacgcaaaagttttgcatgtcaatatgttagaagctgtgaaaaatacatttacacgatcgcgctatgctagcagcaacctcctgcaagatctcatcaaccaccgcctgaattgaggataggttgttgtcgaagacccgagcattcctctccttccacaggcaccaggacacaaagtagcatgagagagtcgaggctaggcaaggtgcatttgtccactgatcatcgagcactggaccaccagtcgacgaggtcgtcttggtccattggcgcagcaagagtgagcctcgcgatggccaacaccttctgccagacttgcctcaagaagacaaaacagataagaacgtgattgacgtcctcggcatcttggctgcacaagggcaggatgtgtgtctaggccatgccatgctttaggagtcgatccaccatccagcatctcttctgaagtgcgagccagaggaagaacttacatcgaggcagtgcccaagcccgccaaagctctttccagcaggggaacggctgcatgccggagaagaagagctggtaggccgaactcgacaagtattgatgatcactagaccatcgccggaccatctggtcgccgacgtcggggatcagagtagtagcctcgatcactggccaaagacagaggtaatcaacgatcagtcacatggtcagtgcaccttggattatgtccctcgtccactgcctatggaggatggcctccgccaccattcgggagcgtcgcagtcgagctgaaactacctccacaaggtgaggtgcttgttgggcaatcgattgctcattaatccaagcatcagacccttaggacggaaaacagagcagctcattagagtataattaattaagcattatttaaaaattaagaaatggattaatatgatttttttcaagcaatttttttataactagcataatgcacgtgcgttgcaatggattagcattcattgacacaaattaaaatcctaaaccatatatcacaattagacataaatgatgaagaaaatataatcaataaaataacaacatgaaactgcaaataactttggccggaatgatatttcaatattaggaaaattatataactaaatccccatttttttatttagctataaataattcaatacagagaaaaattataaattataataaatttttaatggatcaaatagtgctaaaactaatacagcaaatagaaaaaaactgaaattagctagaaattgaaaaaaaaaacttattttacctcatagatgaaaacctaatccattaattttggatgagtgcccgtttcattgacataattagaatttttcatgttctatttttatgatctcaatattatgtgagtggtctagaagcatggttggactggaccaagaaggaatagtgcacaatacgcaatgttcattgtctttcataaccaaaggtgagaaacaaaagaggaggaaagatgggcgccggtgctcgggcgaccaaatggtgctgaggaagatggaagaatgtgtcccatgatgtgtcttgtccatagatggtggaggttggcaacgaataaaataagaatagcatgaacgcgactggcaacgacatggtcctgaaagagagagagagggaggcggaagcaaagtgtcacgccccgaactagtcccgaccggaactagcccgtgacgctccaaattaacctgttaatcgataccagtcccaggaaacagtgctggtatcacagggagacagagtatcacagcaacagaggtctctttattatagagtagatgtacagtcatgttgggctgcggacagatcccgagctcacaactgcattacaaaaggaaagcggaagccaggacttggaccaatcaacacaggcgcgacttgggaactaggccgaaaccctaaaactcattgtagccggcttgctcctggaagaactcctcatcagcaggacccgcttcatcttcttcagcaactaggggggggattatttatatagtgcaagggtgagtacgggagtactcagcaagccatgggaagtaagtgtttaatgcaggcttcaaggaaaggctgatgtttctgcaattaattttatttgaactcttttctgaaacaactaagtgagtgcttctcaaacgacacggatgagacagtgcgtctcgtccggtcggagtatgtgcaatgtatcagtctttagaatttaaacaaggttggcacccggccaacagctttttcaacggccacccggctaacaacttttcaaacggccacccaggccaacaacttttcaaacggccacccgggcctagctgatcccatcagctgcagatttttcaaacaccgaaccccttttcacacagcaatttcacaagcagtagtcaaacaaaactacgctaggaatcacctcacatccgcccgtgaccgtgggcacggctgttcgaacagtttaatgacctctgaagagggggtacgctttacccacacgacattactaacccgggtcacccagcccgtggggatcagccacgtcgggagacctccaagctttcatgacaaggcatttcgaaagccgatacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacacccggtacattccccggtccgcggttttggaaattcatttagttcgcaagcaccgacccaggtgtcgggttttccaagtcttttgtaaaactccagttttacccaagttgttactcagattttaagtttgaaggcgaccgtcgatactggcacagggtgcacgaatatcgaggcacaactggatggttacaaggggacatggtatagcaattaacaatggaaggatcaaatgcaacaagttaggtaggtctgccaatctgccttgcagacggaacaacagattaagtgcaatcctatcaatgcataatattttgcaagcaatataattagatttcaaatataggctcaagatgttcaaaggtggcttgccttgctcgagatctggggcttgatcctcgaaatcctcgcactgcgggtcttcgggctccgaaactacacgcgaaatggggcaactcaacaaacagcgaaaataaagccctattaacgacctctaagcgtgccattagatagatctcgagatttgatgaattttggaagttgaacggagtcaaacggatttacggttgggaagatattgaatttctaagattattggatttttggtctaacggaaaaaaggattaaattaaatccctttttttttggaaaagagaaagaaaaggaaggagggaggaaatttagactttcctcgggcggctagggtgcggcccaagggatctggggcggctcggccgagcttaatgggccggccggcccaaaacggcccaagcgcgcgcgcgcgcgggggaggggagagagagtccggtggaccgggctcaccacgcgcggtcccgggtgggacccgcttgtcaacggctcggctcgccgtgcggagggagcacgcggcgcacgcgcgcgggcggggaggaacgcggtgcacgcgcgcggtttgcggtggacgcggatgcgacgggcccacgcgcagcctcacggctcgcggtggaacgcgcgcacggggagggaccgaccggggtcggctcgacccggtctaggctgagctggcgccgacgtggcgcctacgtggctgccatgcaggccggcggaaggtagacgacgacccggccgcgaatggacggcgggcggcggcggcgagcggcgaagcgaaccatggtgatacgggcagaagcgagcacaccgggcggttgttcgcgacagggggaggcgagccaatggctcggattcaccggaggtttgctcgacggcggcggattgcggcggcggcaaccggcggcgggagaagagggaaacggcgacgaggctacgaggggtcgattcccgtcggtgagagcatctacgcggcttcgggaactcgacgctatcgtcggattgggcggaactacgccgagcgaggccggcgacgagcgggtgctacggagctcgggcggcgacggcggcgagcacacggcgagcgaaggcgacggttggggcggcgccggctagctacggggggtctactcgagctactaccgaaagctagggggaggagacggagcgaggagggagaacggagagagacatcaccgagaagaggaggggcgctgtgacgagaggccgacggcgcgggagtaatctctccggcctcgggccggggaaggggaaggagagggcgcggccgaagtccccttccgcgtcctcgaatgcaccggctctcccggcgctcggcgaaggacggcggaggcgagacagagcacggggcggcggcaacagcgcggagacgaatggaagaggaggggtaaggggaggccgggggtttaaaggggacggcaatgtcggttcgaggactgacttgcgcggtcaaggcgcgagctgacgctccggctagcggccaaattggcgacagggaggatgacgccggcgggaggaaaagggaaaaaggagggggagaaagggggcttgcccctttgccgg

SEQ ID NO: 45158 - DNA, 3448 bp, Oryza sativa
gggagcggcagcgagggacggggagacggagagcgagggggcgctcggcgcggcggcacacgcgctcacgcgcgcgcggcgcgcgggcggggcggagcggggcggagggagagaggcgctcggggcggctctcgcacgcgcgggcagcgcgcgggtgaggctgagcgggggtgaaggagcgcgccgggggagggagagagagagagagaaagagagcccgggagagagagagagagagatgggccgagcggaattcggcccatcgaaccccgggggaggcaaactaaactttgcggagggaaatcgatttggaaggatttggattcggatttgaactcgacgatagatcggggattgagatcttgagatggcacgggcactagacaacaagcaaggaaacaaatttcgcaattagggtttttaagagataattttcccgctaggcgccacgacggaacgggcgctacacatccgcccatgaccgtgggcacggctgttcgaacagtttgttaacctctgcagagggggtacactttacccacacgacattactaacccggatcacccagcccgtggggatcagccacgtcgggagacctccaagctttcatgacaaggcatttccaaagccgacacaggtttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggatgaaattccaaggaatcggtccttaagtgcgagagcgggaaaccgtacactcggtacgttccccggtccgcggttttggaaattcatttagttcgcaagcaccgacccaagtgtcgggttttccaagtcttttgtaaaactccagttttacccaagttgttactcagattttaagtttgaaggcgaccgtcgatactcgcacagagtgcgcgagtatcgaggcgcaactgggtggttacaaggggacatggtatagcaattaacaatggaaggatcaaatgcgacaaattaagtaagtccgccaatctgcttcgcagatgggacaacagattaagtgtgatcctatcaatgcataatattttgcaagcaacataattgaatttcaaatataggctcaagatgttcaaaggtggcttgccttgctcgagatctggagcttgatcctcaaaatcctcgcactgcgggtcttcgggctccgaaactacacgcgaaacggggcaactcaacaaacagcgaaaataaagccctattaacgacctctaagcgtgccattagatagatctcgagatttgatgaattttggaagttgaacggagtcaaacggatttacggttggaaagatattgaatttctaagattattggatttttggtctaaaggaaaaggatttaattaaatcccttttttttggaaaagaaaagaaaagaaaaggggagagggagggaatatagacttccctcgggcggctagggcgcggcccgagagaaagggcggctcggccgagcttaacgggccggccggcccaagaaggtggcccagagcggcccaagacgcgcgcgcgcgggagggaggagagagagagccggtggaccgggctcaccatgcgcggtcccgggtgggacccgcttgtcagcggctcggctcaccgtgcggagggagtacgcggctcatgcgcgcgagcgggggagggacgcggtgcacgcgcgcgtttcgcggtggacgcggatgcagcgggcccacgcgcagcctcacggctcgcggtggaacgcgcgcacggggagggactgaccggggtcggctcgacccggtctaggctgagctggcgccgacgtggcgcctacgtggctgccacgcgggccggcgggaggtagacgacgacccggccgcgaatggacggcgggcggcggcggcgagcggcggagcgaaccacggcgatacgggcaaaagctagcacaccgggcggttgttcgtgatgaggggagacgagccaacggctcggattcgccagagggagttcgacggcggcgaatcgcggcggcgacaaccggcggggagggaagagggaaacgccgacgaggtcacgagggaccgattcccggcggtgagagcatctacgcggtttcgggaactcgatgctagcgtcggattggacggagctacaccgagcgaggctggcgacgtgtgggtgctacggagctcgagcggcgacggcggcgagcacacggcgagcgacggcaacggtcggggcggcgccggctaactacggggagtctactcgagctactaccgaaagctagggggaggagatggagcgaggaggaagaacggagggaggcatcacgaggtgaggaggggcgctgtgacgagaggccgacggcgcgggagggatctctccggcatcgggccggttaagaggaggaagacgagcgcccggagtccccttccgcgtcctagtgcgcaccggctcctccggcacacacgcgacggctgcggtcggcgagagggacggcaatggcgcgggcgagaaacagggaagaatgggagaaaagggaagggagggcgcttgggtttatagggggcggcaatgtcagtttggaaaccgactttggcggtcaaggcgcgagctgtcgctccggctagcggccaaaacggcgacaggagggagggaggatgacgccggcgggaggaaaaggggaaaaaggagggagagaaaggggggctcgcccctttcttctttgggaaaaggggaaggggagcgggggcgtcgaggcagagggaggagggctcggcctccgtcccttggcggcttgcgcgcggagtggcggggccgaggcgatgacgacggcgatgacggcggggcggtttggagcggcgcgacgacacgggcgataggcgcgggctggcgcggtagagggtgacggcggcggcgaccagatggtcggccactcggcacgcgcgcgcggcttgcaatgggagggcgcagcggatggagaggcgcggctcgagcacgcgcgctggctgcggggccgagcggctgcaggcgcggcagggcagcggggccgggcggcgaccacgcggtgcgggcgaggaccacgcgggcgcgcgcgcgaacaacagcgcgcgggggccggctttgcgagcggggagctcgccagggagaggagaaggaaagcgaggggaggaggcgctcggcgcggtgactcacgcgcacgcgcgcggacagagcggaggaggaggagcgctcggcgccgctcccgcgcacgtgcgcgcggcgcgcgggcggagcggagcggagctgagggagaggggagaggcagcgcgccgg

SEQ ID NO: 45159 - DNA, 4869 bp, Oryza sativa
ccgcccccgagggggagatgggccgggaggaaatcggcccatcgaccccccgggggaggcaaaatagacttttgcggaggaatttgatttggaaggatttggattcggatttgaactcgacgatagatcggggtttgagatcttgagatggcacggacactagacaacaagcaaataaacaaatttcgcaattagattttttaagagataattttcccgctaggcgccacgacggaacgggcgctacacaaaggcgcacgggagggagggagggacgaaaagagatggggcgccgggaaggagggcgctgtgtgggagggagggaggaagggattgacgaaaataggtgtgaaagccatatgcattttttagttaggtatagatttaaaaaacacatggtttagctgttcaggaaatgtgcacgcagcgaaaaaacaagggagtagaaattggaaaatgcaagatgtgcaggcaacactgctatcaaattggactgatgatagaaacaagtgactggtaagctgatgtggatcagggagaatcattactcactagtgatcagtactgctatgttgctttcaataaaagcaaagattctccttttaaaagagaaagtggtaattagcgggaactattcaaagctctcgaggggacatccccgttgtttgcatgtcacttaaatgattatgaaaaaccataaaagaagataataatatgtaatagatcactctacaaacgtgtaatattaaatttaacttctacatgttacaacgaaaataataaattttattgtgaatagctatagtttaacttttatgtttgtagagtgatatatcacatattaatacgtcttctttaatttttgttttcataactatttggattacccagacaatgaggagatgttccgcgagagtttaaaatgcactatcgtaggtagccaatcaatttaacatttcactcaaggagaggccaccatttccgaaatgtaccatctttaaatcaagcaatgggcactgtttggttatatttcctgtttgctctgtgttttcttccaccttccatttctgaatcctcttgagaacttgcatagtgcatcatctactttagaacaattttgttggttcggcactgggaaaaagagtctccatgctgctctagcgtttcgtctgcaggcaaaatttttactgtgcaaaccaggtttgtctatcttttcctcagagaagcagctgaagaggaacacaaaacttcttggttgcgcagcaggtagtgcagcacaagcagcagcctggcactgtgattcccaaggaattcatgcctgtgactgtgtgacatgcccatcggcacatggagatttcacgatcagggtagcgaaggaagcatcgaacagatgcttgattgctggcctgctgccgcatcggatgtccagacatgaaccatctcaaacgaagcgaagcagatgctgccgcagtcccaggctgtctttgatcgtaggagtcaaggtgcaaccaaagtttttttttttttttttagaataagagggcaagagtactgccccttttcattgactgcctcttttttttagaataaaggtgcaaccaaagttgccacaaggataaagcaggagggaatcaaaacaaaggcctttattgctttgccactgctactactacctctctgtgaatctgtgcagtttcattgtacgctgatctctctggtcgaccaccggcttagctgagagatcctactcgtgcccggtgtcgaggagagcgcgcgatggagtcggtggccgtgaacgcggcgcgatgggtggtcggcaaggcgctgagcccgctgtcgggagggttcgtcgaggcgtgggctgccaccacggagctcggccctaatgtcgacgccatcaagatggagctgctctatgcgcaggggatgctgcacaacgctcgcagcagagagaccagcaaccccgcgctgcagcagctgctcctgaagctccgcggcctggcctacgacgccgaggacgtgctggacgagctcgactacttccgcatccaggacgagcttgatggcacctacgaggccgccgaagagcacgccaagggctgcctctatggcctcgtgctcaacacacgccgcacagtcagaaacatcaagaagaaggcgtgctcatgcggagataatggggaagcgagtcgccataccaacgatggggaagcacttgcaggcagcagctgcattcacaagctcttttccaatgctcgaggtacttactatccatctcattgataatataaacaccttccacgcctctcttttgtaactgaacatgacggttgtgacacctttatcaccattgcaacattcctacagaaagaagccagttcctctgctgcgcctatccttgcaaagcatcgcacatagagcacaccatgaaaacaccaaagctgaagtttgacagggtggatctgtccacaagaatgaagcacatcgtcgagcagctaaaaccagtctgcgccaaggtctccaccatccttaatctggagttgttggaatcaaaccgcaacattggcctcatgagtctcaatgctgcgctttcccggatgccagggcaagcaccttttcttccaagcagcgttgctatgagccggcctgtaaccacttcagagtttatagaccctaaatttcatgggaggatgagtgagataaataaaattattggcattactcggggtgattattgtggcaaagacctgaccatcattccaattgttggttcaggtgggatatgaaagacaactctcactcagcatatatacaaggaggtacagaaccattttgatgttaaggtttgggtctgtgtctctctcaatttcaatgtgtatagattgaaagaggagattgccaagttaatgcctgaactcaaagatgagaaatctggtggcccagacgatttaattgagcaaaggttgaaatcaaagaggtttttacttgtcttggatgatatgtggaattgtggtaatgaggatgagtggagaaggctcttagcacccctaagaaaagcacaatcaacgggaaatataattctagtcaccactcgttttctagcagtcgcagaaatggttaaaacaattgatcattcaatacagttggaagggctagaatctgaagtgttttgggaactattccaagcatgtgtatttggtgatgagaaatcaataggcaatcacgtggacttacttgtcactgggaagaagatagcggaaaaattgaagggctcccctttggcagcaaaaactgtaggacggttattgagaaatcaccttgacttggagcattggacaagtgtcctcgaaagtagagaatgggaactgcaaaccggtgagaatgatattatgccagcgctaaagcttagctatgactatctcccttttcatctacagcattgttttacatattgtgctctgttccctgaagattacagatttgaaagtgacgagatgattcacttgtggataggactagacatattacaatcgcggaatcaaaacaaaaaagtcgaagagataggactgagctatttgaatgatttggttaattatggattttttagaaaagacatgaacaaaaatgggtctccgtactatacaatgcatgacctactacatgagttagcactaaaggtttcatcatatgaatatcttgctataagtagttctagtgtgagaagtgtgcaaattccaccatctgtacgacatttgtctattgtgatagacgacacggatgtaaatcatagagtgacttttgaaaatgttaagaaggattttagcactctacataagagactagatgttgaaaaactacagtctttgatgctatttggacaatatcatgggagctttgtcattccttttggtaatttgttgagtaaagcaaaagcactccgtgtcatcttgatgtttaatgcatcttatgatatggagaatatgttgcgtaacttctcgaaacttgtccatctacgctatctgttgatgtaatatgcacttgtattggggaccttcttgcatatgtagctaagtgaaatagtgtgtgtgtgtggctgtgaacaacacaccagaaaaaatccccaaaactgaactttatggtatcagagccctaaccctagcttgctgccgccgccgccgccgtccatcgccgccaccgtcgccgctgccgtcgtcgcacgtcgcccctgctctcatccggcctgaccagcctctacacacagccacgttgaggggctggtgagcgcgcgctgcgcgcggccgcgcgggcgcagcgcgtgtgttgtaacctgctgctcacgcaggaaatgtgaggagctcagctaagggaaaaggaggatggtggcttggctgcagacttggtgacataggaggattgtttgctgcaggaactaggaaggaggtggtacgtctcttgtttttgcttgttttttggctactgcctggatggaggagcatttgacttgtggtctgtgaggggaagaagcctggtccttttttcttttatccaagattagaggagagtttttcctaccattgttgataaggggaagcaggggaagtggggtaccagtgatctattgagagtggtttttggagtgcagagaagatggtgaacaccgagggtactcaagaacaaagaaaggctgaggaggatgctgcactgcaggctgggaagaaggaaagtgtggcaggagaatcttcttttttcactaaaggtgagatgaaaagtctgttgcaggacctcatagctacaggtatgatgggtcttaggagtgggataggaccatctgagataaaattggaagtaatgccaatgaagtgaggttgg

SEQ ID NO: 45160 - DNA, 1246 bp, Oryza sativa
agtatatcaaagaaggaacaagaaccaagttgataaggtgacagggaaggagcaagtgcaccagaggagccaaattcagaatcagggggagagaagtggtgagcctatgcaagagcaagacaaggagtcacaacagctgcagcagtttgagtacccagtcccagattcctcctctagcctctctccaacaagttcctccctccttgagacaagtggtaacatttctcctacctttaaacaagtagagttacctcttgcacaacgtagagaaactagatctaatgctggaagacctcctatacgccttggttttgaacaccttagttctagacatgacattgcaaactatatctcatactctcatatttcacctgcatataaagcattcattgcatcattgcaaatagtgcctattccaaaggactggagatgtgcaaaacaagatccaagatggaaggatgcaatgaaggaggagttgcgtgcccttgaaaagaataagacatgggaacttgtgaaactaccaatggggaaaagagcagtgggatgtaaatgggtatttacagtgaagcaaacccctgaagggaaaagtggatagatataaagcaagattagttgcaaaaggttatagtcaaacatatggaattgactatgatgaaacatttgcacctgtggctaagatgagtacggtgaggattttgatatcatgtgcagttaactttggatggcctcttcatcagttagatgtcaagaatgcttttctacatggtgatttacaagaggaggtatatatggagattccccctggatttggaaatagccagactgttgggaaggtatgtaggctcaagaagtccttgtacggtttgaaacaatccccacgtgcatggtttgacaggtttaggcgtgcattgtgcaatatgggatattcacaatgtaatggagatcacacagttttctatagacataggggggcacacatcactatcttggctgtttatgttgatgatatagtgatcactagagatgatgtagaagagatcaaatgcttaaagcagcgattaggagaggcctttgaggtgaaggatcttggacctcttcgatactttcttgggattgaggttgctcgatcatcaaaggggatagttctctctcaaagaaagtatgtccttgatttgttaacagaaaccggaatgcttggatgtcgacaagtgctactcccattgataggaatcaccaattgagtgca

SEQ ID NO: 45161 - DNA, 21670 bp, Oryza sativa
  unsure (1)..(21670): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaagagaggcaaggttgatttgcaaatcctttgtttgaaatcattttgaaatcactaagtgattcacttcttgttaagtttgggctgaaaagagactcgcgtctcaaatcgacttaagagatgcttttcaacaactcaattggtaatgtaccgacctcccgggtcagatcattacctctcggctcccagagtcatttcacttgattaatcggctcccaaagcctttctcattttctcggactcccagagtccagctgcccagcagcaaagcaatccgcttccactcgggaagcctagtctatgatgcccgcagacatcccgaaccacacagattcgtttctgaccactcaggtcatccatctgccacgtaggctgattctggttacgattcccacaccacaacaacttttcacaaagcacaggcaaacaaatctatgaaacgggaaccacctcacatccgcccatgaccgtgggcacggctgttcgaacagttagttaatcctctgcagaggggcacactttacccacaagatacgaacttattccgaacacccgtcggtatcggaggctcgcaacaaagcctttcccaagccgacccagggatacctcatgccacatagaaggatcaaatcatcacataaatataggtcattttagttttcacaaatcaaactccaaccatctcgatcggtaatctggcaagcttctcttccttgccttaccaggaacccggtttggctccaaccgaccccgccccggctttcccaactattggcatgcgaggtttccctgaaccgactagttacttagccagggtgtcccattccaccttgtggttgcactttgattatgttcgatgagtttcctacaggaatcggtccttatatgcgaatacgggacagtgccacgtaggcacaacccccgcatcgcgagttttcgcagctcattttattttcaaacccaccgacgccacatgtcgggttttcaaggcttctcaaacccatttcccaaattttcgacaatcaacggtgtatgtgggatatttggtatacacgctcagagagcacggataccgaggtaccacaagggtggagcgacaaggaattagggtagtacagcctacaggaattagtgcgactactaggtaggtccgtcggtttgacatgcaaaccgaggccaagcatgttataggagtgattctaataatgcaagttgcaaacaaaataatattgatttttcaattataggagcaattgatcaaagggtgacttgccttgctcaaggtcttcacgaagcttcacgaatcttcaagaaaacccgcgatcgacggaaatccggtaaccgcaactatacgcaaacaatcgaaaacctaaacaaagaccaaaagaaagatcctatttagactaattagtagtgccattaaatagatctcaattttatggaaatactggaagtaaaacggagtcaatcagagctacggattgagagatatgaattttggaagtttaattggaatttctgggcaaaggaagatatttgtggaacaaggggaaattgatttatgaaatttatagaaataatattctcaagaatattattgaccgtcactgacgtgcgggaccaaggaaatgatttacggaattttgggaataaggaattgatttatgaaaaagggaaaaggatttattaatccctttggataagaaaaggaaggagggatgagatttagacttcctttggcggctcgggtacggcccaagggataagcgcggcgtggtcgagccaatgggccgggcgcgggcgcgaggaggcggcccatggccgggcaaggcgcggcccaagcgggcggggcgcgcaggaagagagagggggatgggtccgggtggaccggatccatcgtgccgggtcccgggacgggcccacgagtcagcgactcggcacacggggaagggttcatgcggcgcggggcgctagggttttacggtcgcggctcacggcgcggcacgcgggtggaccaagaggtggagggcccatgcgcagcctaagggctctccgtggaccgcgcgcacagaagaaagggcggtgggggcggctgactaggtgcttgacccggtcaagcgggcccggggctgaggttgctgccacgtggtcggccacgcgggcaggggcgaaaggggaggaggaggaggaggcgcccgagatggacggcggacggcggccgagttcaccggagctcgtcgcgacgattcgagagagagggagtacatttgaacgataggacggacgagagggagtgagccaccggatcggattcgccggagggaggccggcgacgacgaatcgcggcgacgcttgccggcggcggcaaaagagggaaacgacgacgatgcgacgagagctcgattcctagggacttgagcatctacgcgacctcctgagttcatttctagagtcggattgggtggagctacaccgaggaaggccgacgacgagcggctactaccgagtttgggcggcgacggcggcgagcctacggcgagcagcggcggcggtcggggcggcgccagcttactactggaaggctactcgcactactgcccagagctaaggagaggagagggagcgaggagggagaacgggagaggcactaccgagccgagacggacgctgtgacgagcggccgccgacgcgggagcgagttctccggcctcgggccggggaaggggaaggagacggcgcctggagtcccgcgtcagctcctcgcgcacacgccggattcaccagcacgcgcaatggaggagggaggcgaggacggcggtagcaaggcggcaagggcacggtggtggcgagggaatgaacgagagggagatggggcggcttggtttaatagatggcaatgtcgatttagagaggaagaaccgacattggcggtcaaggagagcgagctggcggtcatcgacgcgtgcagcaaaggcggcgacaggtgatgacgccggcggtggtcggggaaagggaaaaagaagggggaaaaagagaggctcgctccaagccgattcgggaaaggagtaggagggagagggagagctcggcctccgggttttggcaggacgcgcgtggagcggctcgggcatgcgcgcggggccgtgcggctgcgtggtgcagcgcggcagggcagcggggccggccggcgcaggcgcggcaggcgcggcagggccgacgcggcggcgaccgggcggtcggccacgcgcgagcgcgcgcgcgcggacgtgagggcgcggccggattcaaacagcgacgacgggaaatcgacgccggggagagggagttcgacgagggagagagagaaacagagagaaagaaagagagagagagagagagccgagagagaaggagaaacagagagagctcggctcggcttggcacgtgcaacgcacgtgcgaggctgagggaggagaaacggttgagggagggaggtgggctgagggggaatacggcccacaacacccgagggaggtaaaatagacttttgtagagaagactgattaggagtggattcaaattcaaatttgatattcgaactcaagggtttagggatgtatcaagggaaactcaaggagaagtcatggaaaatattcaaaaggaatacttgggtatttgttcttgggagcataaggtgaggtcaaggaaatgattcggatgaggatcgatcctctcgaaatcgagagaaggatttggcaacgagttcaaggaagggagagattgacttccggaattgggatttggatgagagggaggagtcgccaacgggattcaaaaaaggggatttgaatctaaatttgatacttgtacacaagggttcaaggagacgagtaaggaaacaaagtgggagtttgatactttcgggaatgggaacaattatttggagaggattcaagggaagggattgactttcggaatttgatttcggagactcgaatcggaagaggaatttttgaggtggaggattttgatttcgatgaggaggaacaacgggattaaattgagatccttggcacaacttagactctcacacaaagaactaaattttcgcatataagattttgtcgaattagtttttaacgtctcgcgaaaagcggagcgttacaaacaccaccacctttgccgccacctattcaattgtggccatatctaccaccacattcttatttttttttagataatgaaatagagtatcccggcctttgctcaaaaagctacagccaattattacaacctcacacttaaaatgagtgaagttcaaagaaacttaaaagacgaaaccaaccatcaagaaaaaacaaactaaagactgccaacccaagattaagagtacacaattattgaattctgtttgtgaacctccgtccaaaattgataaaaagttgcataacggttgtcttaagaatacggcatgtagcctttaaaagctcactatcttcctcacacttttgtagttgtgcctaagaccggagccaatgggttgccctgaaaattacctgcgtatatatatgaaatagatgaccaccccattcttctagcttgcttgaccaatcaaagaaatatcttatagaggaattacatgttaaaaaaaacatttgagagcctttggatgatatgattgcttcaaaggaattcgtaggacaggaaaatttcctctatattttggagtgtttctagcaaaaggtttagccaaaatttcaatggatttcctctctaaattatctcaataggaaatcaatgtaacatatatttttgaattaagttttcgttacttttcttatgagacaccaaacagttattttatacaaataatgtggttttgttcctgttgggtttaataagccgtgatatgccaaccttatatattcattttattgctatgctttctatattattgtgttttaaagaagctctcaacgcaatcatataatctgaactgttagttccagccaaaaagaaactaacagttcacaataaaaaaaaggaaaaagaaaagccaagccaaatatcacatccaaatcaatgtcatcggaaaagaagtcaaagagataaggtgttacatctaggcatattcagtttaggctgtgtttttgttcacaccaaaattgaaagtttggttgaaattggatcgatgtgatggaaaaattgaaagttcatgtgtgtagaaaagttttgatgtgataaaaaagttagaagtttgaagaattattttggaactaaacacggccttagtcacagcacatgggttgctatcattaccatttaccaatgaaagttaggtcctgtttagttccaaataaaaatttttcacctgtcacaattatgcatggagtattaaatatgaaaaaaaaattacacagtttacgtgtaaattgcgagatgaatctcttaagcctaatagcgtcatgatttgacaatgtgatgctacagtaaacatttgctaacgacgaattaattaggcttaataaatttgtagaatatgtaattttttttgttattagtctacgtttaatacttcaatgtgtgaccgtgtatccgatgtgacacgctaaaaaatttctcgtgaactaaacaggcccttaccaaacttgtcaaaggttgtgtgcttaacatcattgccacgcctgaaatactttcaccacaccttagcaagttcaagaaaatcttagcaaaaatttccaagttattgatgtatgagatttattttgttggaagataatcttgttataaccatatagagccaaactatctaagttagtcaccagaatatatttcagtgtgacaaaaagtaacaggcaactagacgaacccatagtgtaattcggatcaggtgcagttgcagtagtaactgcaacttagcaactgcatgcaacatcggccgtccatccattgtcaccagataccattcatatacaaattttaaccattcattagcaacagtttcatatttaaagtcatcgaagtaccttatatgcttaatataagtttatatactacttgcatctatcaaattacacgataaaatttagatgtttttagtggttgatagaaatgaaaccacacgggtcaacgctaaggacaagggaacggaggtagtatcacggcactgtgtaggtcagaaatatctgcttctcgcatacaagaaacaaaaggaaacgtccaagaataaatcggtgcggatagtgacactactgactaaagaaatcaaaaggaacaagggatttctcagtcttgttcaagaaatagacgctagtacagccagcaacaataatttccgaggcttcaatgtcgcagaaaccacaattaattatgcatgccgaggtaattaataatatactccttcgtatctaaattaacttgtatactaatctttattcgctttattttccttttgggtctctgatagagttggtacgggataaggttgtcctgtatatcctctcgaggtcttgattagcttgtacagtttgtcctcgagctctcgaccggctccggcaatggcgtccacggacactgagcagcaggaacacgcagtggcgctgctacaacccgaggtaattaattaatcgctgttcataatctccttactgctagccttatgccgatttccacgatgcagtttgtttaatttctcatcagtttccctgcagaaaaatattgattgagccttgcctgaactagctactcctagttaatttgaagcagccgctcatggatacgttcagtgctaactaggctggggattttggttgctgcaggttgaagaagcatacaccactgatgggtctcttggcgtcgatggcaacccggcgctgaagcatcgcacaggcggatggatggcatgccgcccgattcttggtaataaacttcattagatatccctgcagctctattaattatttcctaaccttttttacttgccaattttttgatgattaatgtgtctctcactttgtgtgttcttgttccaaaaaagaaaaaaatgaaaaaaaaaataaatgaggaacttctttgttgatgtggttatctgagctatgacaacactgaggagagatgcttattctgcttgctttgtgattgtggataggcaccgagttctgctactgcctggcctactacggcatcacgttcaacctcgtcacctacctcaccgccgagctgcaccagagcaacgtcgccgccgccaacaacgtgtcgacgtggcaggccacctgcttcctcacgccgctggccggagccgtcgccgccgattcctactggggaaggtaccgcaccatggtcgtcagctgctgcatcggcgtcgctgttagtcccctccatttcattcgatccgggttgtgtttagttccaaattttttttttcaaacttctaactttccatcacattaaatttttcatacacacaatttttttcagtcacgtcgtcttcaatttcaaccaaaatctaaactttataccaatctaaacacagccttaattagaattagtcactgtgtccttcctgccgtgaatttatggctgatggcaagtaatcagtcactgtgtgggatgtggatttttatcccttgagagaacatttaattttatattaatattaatttatgttaatttatgttgtcatttaattttatattttatattaatttatgttgtccattttttttaatttttttatgactaattagttggcatggatgaaacgagggatatttcctggagggatgaaatcactttccccactgtgtgctgccatgaatgcaaatccaatcagcttcatggctgtacgtacctaatctgtggtgcagggcatgctcatggcggctctgtcggcgcttctgccgctgctgatcaaggacacgtcgtccatggcttcagctcaagtgatcatcctgtttcttggcctgtacatgatcgcatttggggtgggtggtctccggccgtgcctgatgtccttcggcgccgaccagttcgacgacggcgacacgtcggagcgcatcagcaagggctcctacttcaactggtacatcttcaccatgaactgcgcgtccgtgatatccaccaccgccatggtgtgggtgcaagaccactacgggtgggcattggggttggggattccggcgatggtcctcgccgtcgggctctcctgccttgtcgccgcgtctcgggcgtacaggtttcagacaacccgcggtagcccgctcaccagagtctgccaggtcgtcgtcgccgccgtccgcaagttcaacgtcgcgccgccggccgacatggcccttctctacgacctatcggaggatgcctcctccatgaagggagttcagaggatcgagcacaccgccgatctccggtcagttcatgtctctcgttgcatctggtgtttgtgatgctgtaggtgtaatgtaattggctaattcttgagatgcaactgctcgatcagattcttcgacaaggccgccgtcgtgacggcgtcggacgaggaggcggagggcgccgcgccgcgcaatccatggaggctttgcgtggtgacgcaggtggaggagctcaagattctcgtcaggatgctgcccctgtgggcgtgcgtcgccttctactacaccgcgacggcgcaggccaattcgacgttcgtcgagcagggcatggcgatggacacgcgcgtcggctccttccacgtcccgccggcatccctggccaccttccagatcatcaccacgatcgtgttgatcccgctgtacgaccgcgcgttcgtgccggcggcgaggaggctgacggggagagagaagggcatctccgaccttctcaggatcggcggcggcctcgccatggccgcgctcgccatggccgcggcggcgctggtcgagacgaggcgcgcccgcgcggcgcacgccgggatggagccgacgagcatcctgtggcaggcgccgcagtacgtgctggtgggcgtcggcgagctgctcgccaccgtggggcagctggacttcttctacagccaggcgccgccggccatgaagacggtgtgcacggcgctcgggttcatctccgtcgcggcgggggagtacctgagctcgctcgtcgtgacggccgtgtcgtgggcgacggcgaccggcggccggccggggtggatccccgacgacctcaacgaggggcacctgatcgcttcttctggatgatggctgggctcggttgcctcaatcttgtggtgtttacgagctgtgccatgaggtacaaatccaggaaggcctgttgatacttctgggcttgtttggtaggctcgaaattccggcccatgcactctgacgggccattatgtatgggaataagtccatccgacctccctcatctcttgcacttggtcgaatcgcatccctcagccgcaaaaaactgggtaaaacgcctcctgaatctcccaaaaccggtgcaaatagactcctcgagtggtttggaaggtggtttcagctgacgtggcacattgaccgtgattgactagctgaatcagcaactaggacccacatgtcatcctaatattatcttcttcctctatgtcaacccgtggcagtgccgcctcctttgctatcgcatgcgcgcactcgctcaccgccatccccgagaggttcgcaccgagctctccttctacgagctggtggtcgtggccaccaccaggaaggggtttacgcgcagatgtgcacaatgttcctcacctctccctttctcgcgcggggagcggcggcggctgcgccgtcgctgttcgtgacggcctcgattggcgtggtcggagctacaatgccaccggcgccctcggggggctagggtgcaagtgcgccgatgcatgtgcctgagccagcgggaggacgacaagctcggtgaagaggcgctcggcagtggtgtccgattagttggcggcagcgacccagatgacggcggcgccaacatcacaaccacctccccaacgtgtcgaaacaaattttcggtaatatgaaaagggggtagcgtacgagacctaaaagtggatggatgcagatacagggatttagacaggttcaggccctctcaatgagaggtaataccctactcctgtttggggatttgaatccaccgggtgtttatttatctgacgatcaggttgtctcatgccccctagagggcctcctgcccaccttatataggatgggaggcaggattacaagataaaaaccttaaccaacacggtatcagtttcctaaatctactttacaatattaccaaactaggactttaggccgttctgtaatatacaaggaaacgtaatacccaagtcatgaactgttacatattccataaatataagttatcccctataactagtcggataaccatgccgtgtgggtatggggtacccataatctccacagtagcccctgagaccttcacagtcgaaaagataatcttctctcgaactagattactccaaagccgagtgcttcaatcatctttgccatggtctcccgagtacttttaccaaatctgaagactgtggagggctgaaaaataaagtcaggtgcatcgactagatgcacctaataggtgtagcccccgactatgtggttaattgaacaaaccaagcatatagttaaggaaaaaataatccaaccaaccgagtggctttgataattatagtcaaccaagtgacttgatattaatatgtagcatatgcggtgtgaatccctgaataacatgatccgagtgatataccaaccgctttgtaaaatatgatgagtgtaacctaaagttggctatatcattgaaaattcacatagcaaaacaactataaagaagcttgtatgttgtgaataaagaaattttcaaagtattgggcatacgccatacgcacattgctttaacagatgtgcttaagtccctagaagacacatggttccaccacacctggaaatatatggcatatgtggtataaaatccgagtaaataaactcataaaggatttaccaaccgcctggaaaatgaccaaaatatataatcagcctaaaccataatattggtcaataaaagtgcacacttacgtggcaaaacgcaatgatattgtatccaatcaattgctttatgaacccaaacagcgccttgacttatataaaaaagtcagcggggagccatataaagcattactgtttggcaccttttaaattgcattgtaccaactcctaaaaagttgaataactgcggtataaaaggattttaaggtattgggcacataatcacgcgcacttttgcctaagcaaaaagatgcctaagtccctaaaaaacgtgacaggctacacctgaaaatatgggctgcagacatattaggcctaggccaaaaaatatgccttcgacaccctttaaaggatgacgcatgtaacatattcccgagtaataaatctttcgggttatatagaccaagtgcagctcatatgaatagcttctgatctgaatgattatcctttatgggatactccaaaatagatataataattgaattctgactggcgcaagtattcggttgataacccttacagggaataataaatagtccagtctttgagcgtagaaaatagacccatgatcatcaaattcatgttgcatgtatccggaacaagtccaaattgaagatataaccctcgcgcttgtgtcgatgagcccctaagcatgtagcttatccttctgttatagtcacaattgtccattgatggtagctgacgtagtcggcatggagacgaaatgaccaacatgaagataatatcatccatcaaagctgacgaagatgttggtggtggtaaaaacagtgacgccaattaaaggtgatgaagtcgcatagccgtggagacgaagaaaccagtcggcagcaatcaaatcagctagcagtgaagatgaagacgcccaacaacaccgatagagcagtcggtggcaacgaaagcaagtcgacgacgaagacgtagacacgcatcaacggtgatggcgaaatccaccaatcatgaagatgaagaaaatagtcggtaataatgatgaagacgctcatcagtgtttgcgtagtaggtcaaccgtgaatgtgaaataataagtcggcgaagacataatcatccattagcaacaacggagatgtcagggccgatgaagcagaggtgctggtgatgatgttagtgacaataatccatcaaactgttgacaagatatcaaagctcgagtagtttccttgatgcgagcgtgtgcataaagaaggctgatgcaacgcttcttgatttacgaagatgactgcagaacttagtgttatagatgttgtagatgcttcacttggaggaaagtagatgctgttgtccaactcattgaatcagtgtaataattggagtcgctgaaataaaatgtcggctctgaagcgaagacgaaaataataactcccagagttgacttgtcgattgattgattgcttcatcttgacataaaacttgtcgaattttgagtcttgtatttgtgtatcccctgactctttggttagttggaaagcaattgaacatagagtcgagaactgtagcttcttgtcatcgagtagtcattgcttgagtaaagatatgtgttgaggatgtccgagtaggaatcttgaaaattgtagaaccacttgtagtagtaaaatgacacggcatcatatttggtgacgcataccgagatgcccaagctcttgtagacgtcgtggctggtgaagtagcaaaacttgcgaagtagaggcaatagtgtttgctagtgccaaagataataaatatgaagtcgctccaccatggcgacaaagttgcatagccgtgatgacgtgaacaggagttggcggcaacagaagcaaaccggtggcgaagatgcgcagtcatgaagataaaaacaccagttggcggcggcataaccagtcggcaacggaagaagtagaatgatgatgaaaacgaagacgttttttaacagcgcaaaataggccagccatgaacgtgaagacatcatgggcagcgccgaaggcaaaccggcgatgacgatgacgccagtcaatgatgatgaagacgcgcagccgtggaggtgaacaagccagtcggcgtcagacaagtcggccaacaatgaaaacaataacgtccatcagtagtggtagcaatataaaccagcagtagaggcgacggcactagtcaacagcagaagagacgaccggcagtgaagacgataaggccaatcaacattggcagaatcatgcagccatggaagtgaagaaaccagtcggcagcagacgtagacagcttgcattgaagatgatgacgccgattagcggtgacggcgacgaggccagccgtgaagatgataacaccagttggcgtcatacgaggcggccggtcggtgaagatatagacgtccaacaacggcggcataataggccagccgtgcaggcggagacaccagtcggcggcagacgaggcggccggtcggtgaagacgtagacacccaacaacggcggcataataggccagccgtgcaggcggagacaccagtcggcggcagatggccggtcggtgaagacgtagacgcccaacaacggcagcataataggccagccgtgcaggcggagacaccagccgacggcagacgaggcggccggtcggtgaagacgtagacgcccaacaacgacggcataataggccagccgtgcaggcggagacaccagtcggtggtagacgaggcggccggtcggtgaagacgtagacgcccaacaacggcggcataataggccagccgtgcagacggagacaccagtcgacggcagacgaggcggccggtcggtgaagacgtagacgcccaacaacggcggcataataggccagccgtgcaggcggagacaccagtcggcggcagacgaggcggccggtcggtgaagacgtagacgcccaacaatggcggcataataggccagccgtgtaggcgaagacaccagtcggcggcggcgaaggcaagccggtcagtgaagacgtagacacccaacagacggcggcataataggccagccgtgcaggcggagacaccagtcggcggcggcgaaggcaagccgatggtgatgttctgactgatccattcctgaagcgtaggagataagcttaaagccatgaattccttttatgcatatctggatctggatcccacagaacaaacagataggatgagtagtatctgatgtaaatataatactcgagaaaaattcaagcattttaaaatatttataaatatgtatttctcctctcgtcaattttgatttcctcgagtagatgactcattacgtttaaacactctgcccgactagtcatagccaccaagcaccgggagtcggcctaggcacttcccaaacatgcatatgagtaacatgagttcgtcattaatggaacaaagtttcacggatcagaatttactactcgggtacttttgcaattattaagagcagaaaataaattatcttatctctatgcttttgatttattccgaataatacttagcaccttgcgttattcggtccatccaacaagccctcgggtgctaggaatcggcccaaaggcaactatccattggcaaaccaaacggaaagcataggaagatggaaatccataactcgataggcacttttgtactcagattatgtcacgagcaatcaagataaatattatgaaagttatttaaaaaatatgatataacatctgtagcccctgactcactagtcaacgacgaaccagttgatgtagtgaggcagaggaaaagaaaaatatcatataaggaaaaatgatgacttagctttgtaatatctctcttaatgacggcagaggtggctgatgtgggaacaaagtcgcctattaatggcaatgaaaacaccagtcggcggcgaaagaaggcggtcgatggtgaaagcgaagatgcccaccaacggcggcataataggccagccgtataggcgaggacaccagtcggcggcgacggaggcaggccgacagtgaagtcgtagatgcccaacaacgacggtataataggccagccgtgcaggcggaaacaccaatcggcaacagcagtgccacagcattacatgtaaacaacaggaaataccaagagattaatctgatatttagagatcaatctaataaacaacaataagttggaagggaaaaaacccggcggagtcggagatttaaattgttgaactcgccgagattgattttctcgaccggactgactccgagacggagaaaattggttgctggtgttgcactctgtcgctaggactaatcaagcgatccatggctcggcgtgcttacagaacaagacaacaaaccaacttggttaatgataaaaatatataggcatgattaagtaaattaatggtgcttgttgatcggtaagatcaactttctgcacgtgttctctcctgattagccataggctggctgttcccatgtgtggcccgtggtggccatagcccgcaggacgtccatcggtgatgctccgagattcacatggaaacaaataaaataaatctgattaatatcagcaaattaaatgtataaatctcagcgattgaatgcatgtatggctggattaattaatccatgcatggcggttgaatcgacacatcctgtacatctccagcgatctcgtcatgtgaactttcgtgcatgcctgtccagcccacgagttggattcgctcagagagtggacggcttcgccttgcgtagcgacggcttaatcataccgtgcctaattgaacaccttggtcgccggcaacatgcatacaccagaagaaagagcaaagaggaaaaagaccatcaatcaatctgatttaataatcaatctaattagcaggaagaagattagatgcatatgccatagtcttgctccctgcttgaccctcgtcatgtgatgcacatgcggatcgatctgacgcgtggactatacagccgcatggatgtagatcgatcgaggtggtcggccggattgaattagaccaagcgacgtcgacggagatcatgcgccggcggctggttgctgccggtcacgcgtagctgctcgccgatccggaagtccaaacagcacacgaccgatcggcgcgatctctcgatctggcaggcgctcaacgctctgatgagacgcgccctccgtgcttcttgcggcggtgaatgacgcgcgtgtacgatccggtcatgttggtgattgattccaacgcactttaccgacgggaaactcgacgcacccctccctggcgcgccaactgtcgaaacaaattttcggcaatatgaaaagggggtagcgcacgagagctaaaagtggatggatgcagagacagggatctagacaggttcagaccctctcaatgagaggtaataccctactcctgtttggggatttgaatccaccgggtgtttattgatctgacaatcagattgtctcatgccccctagagggcctcctgcccaccttatataggatgagaggcaggattacaagataaaaattttaaccaacacggtatcaatttcctaaatctactttacaatattaccaaactaggactttacgccattctgtaatatacaaggaaatgtaatacccaagtcatgatctgttacatattccatatatataagttatcccctataactagtcggataataatgccgtgtgggtatggggtacccataatctccacacaaccagatcgccggccctcccgtccaagaagatttttcaggccaagaatcgtttccaaggtcctagatctcgtagctccaatccacaccgatggcagagcgaccaattctcatagtgattgcggtgttctgtagttgtgtatgtctaaccaagtaattggcctatctctttctttcttaggtgcgtgtccgcctctgcgcgtgcatggacgatctacttctcgcgcgtgtcactgccggccgacgagatcctcctcccgtgcaaagccggccggtgagatcctcccccatgtgcgccgcttcgctgacatgccaggagcgtcgcttctgcttccacgatgaagacgacaacacgccatgaccgccgcttccgctgctagttgcgaggggagagagaggaagatatgaaagaggaatggggaaggacagcagaggcggcgcgtggaagcgggcgcgcatgcgcacgcgatgccgacgttgcaggtggccaatctgctgttaccgtgggacgggctgtcgccggcggctcctggtgagggggggaggggggagaggtgaggaagaaagataagattaggatgacatgcgggtcctacttgctaattcaactagtcaactacccacgtcagctcaaaaccaccttccaaaccacttgaggagtctatttgcaacggttttcggagatgtgggaggtgttatatccgattttgcagttgagggatgcaattcgaccaagggcaagaaatgagggagccaaaatagacttattccttatgtatgtgggttatgggaattgattacgggcctctcaaacaaggcatctgagcatcggcataggtactaggccagctcggtacaaagaaaggcattttattagaccatcaacaaagttattagtctaaactgtacagcatttgagtaaatattattttttgagaactgcagttaagtaattagagaggaaaaaatagcaggattgttgtaataaatggaatcgtttcgcttattcgcggaataagcaaaacatcttatttacaaacgaaaagaaatatgtgaataaaatttttatatgcgtattcttagtgatctaaaagcaaaagtaaaggctgaaaaataaacttcgatgaaaaaaaccttaaaatcagcttcaaatttaaagttaaaaattcaaattttagctgataagtataaatataagcgaaaagatgagaccctaatatcttcgctctgttcgtattgagcaggaaattaatttggctacagcgttaccatagtgactacaagtctacaagtcatactaccttcctctcgtataacttgtaattctagtttgtttagcaaatattaaggtttaagaagaaagactataatgtgtcccttattaaatactccttccgtttcataatgtaagtcattctagcatttctcacatttatattgatgttaataaatctagatagaatacattgtgaaacggaggaagtagtgtatactatataagagtggaaaggtaatcgagggtaaaatagaaagaaatttaaatgagaagtgattaatgagactattagtactctattgtgataattattttgggacaaattcaaattctagaaatacaattattatgggacggaggtagtacattttatcaaaccgaggagaagaagagacatgactcaaatttcaaactgacgcaacactattctctaattcaaatttcagtatccgctactactggtggcgtccacttcaaaactgatactttccggcgagtcgctgagcaaacaccgcacctcgtcgagctcgacgacgtcctgcgtccatggatgctggtgcagcttccgcagtccgcccagcctctcggcgacctccttcatcgccggcctgtcgccgccgcacatctgcaggcactccagagccagcagcgtgatctcctccagcaactcaccgctcgcctcgctcttcacctgctcatccagtatcaaatcggctctgttctccctcatggcggccaagaacctcgccgacaagctccgcccctcatccggcccgtcgaggcagagcggcttcttgccggtgagcagctcgagcaggacaacgccgaagctgtacacgtcgctcttctccgtgagctggcatgtctgcatgtattctgggtcgaggtaaccgcacgtcccctgcaccatggtaaaaaaagacacgaatattaggaaatgacctaatattaaaaaaattaagtaattatttattcttttcatatcatttgatttattgttaaatatactttcatgtacacatatggttttacatatttcacaaaattttttgaataagacgaacggtcaaacatatgctaaaaagtcaacggtgtcaaatattttgaaacggagggagtaattagaaagggtgaggctttaaactcaggtcgtctaacccactaccttgtggagctagccggaaaacctctgggcatttctcacctgcaccatggtcatcatttgggcttcgtcagtgggagccaagatggaggcgccgaagtcggacaccttggccatgatgctctcgtcgaggaggatgttggaggacttgacatcgccatggaggatcggcggcgacgcgaaggagtgcaggtacgcgagtgactccgccgactcgtgggcgatccggagacgggaagcgaaggagatggcgccggcagatccgccatggatgagctggtacaaggtgccattggggacgtactcgtagaccaacatggggacgtcgacctcgaggcagcagccgagtagcttgacgatgttcttgtggttgacctgggagaggatcagcatctccttcccgaattccttcttgttcctctcgtccattagcttgcaccgcttgatggcgacaacgaggtcgtcggaggctgcagccacccagcccttgtacacggtgccgtggccgccgcggccgaggacgttgctctcgtcgaagccgttggtcgcctgctcgagctgctcctcggtgtatatggtgaacgcgttgctcttcctcgcgttcagctcctcgtacagaagcaggccgccatgtcgcttgaagtagctgcgcttgatgtcggcaagcgctcttcgctggtgtactaggtatgagctcaggaagctcatcacgatgatagcgatgccaccggtgacgcctgtttacgagggaaaaatatgatagtctaagagcaagtatatatcgagaagagaaataagaagagaagagtagcgggttacagatttatagtcagctgtatcacaaactacaagacacaatatgtttatgataggtgggaccacatattactaatgcgatatatatttattggtaactatgtgtatgagttggctattaaattgactatagatgatttaaagttagtggttggctatattattaaacttgctctaagttacgcttgaaatactttatatgtatatacatcatgtttgacttttttttgcgcttttcaaaatacaaatttgaccacaatatattctatattgaattaagcatataaaaattatcgaacttattaaagtccatgcgtgctagctgtgcgtgcatatattagagtagatgatgacagggcaagctcaattgcatttgtgaaagtgcatgtagcctaatggttacagtgacatgagtagcaccctaagattctgagtcaaatctctatgggagcaaatttttatttaagggctaagttttatattcgataggctaaattcctaatttaaatgactgcatatattcggttgaatatagaggctgggtaaaaaatatacccttctctgaaaaaaaaatttgctcaattgcatttttgttacgtaccgatagctatgatcgctgagaccgggagccggtaagatcgtttaaatttcaggtccggcaaagatcgtttcaggtccggctcgcagatgagtactccactcttgttgctcttgtgctctccttctggacacgagcagttgtgtccgccgggaaaattactgcaaatcatcccgtccggacacccgtcatttccaggagcacatacgtcaatatctgcatataggatggcattggaaccagaccaaattaagagcttgtttggtttgtaggatttttaaaacataggaataaagaaaacatagaaatagtatagaaatgcatgtataaacttaaggattgaaaaacatagaaaatttttctatggttgtgtagcaaacaatccaaaggattgaaaacattgggttggagtggattatttttttcctttgttttccctaaaaaagtggagggataggaatttttagtttggtgcattcctttgaaacgaatgacagtatagtgtccatttcaaaggattgcctattcctgtacttttcctttacaattcctttgaaacgaataagtcctaagcatatagaaaattttttgaaatccagatgacactatataatacagttagatgcatgttacgtgtgcattcatataagttcacagggatgaatacgtgcacatggtgagtgttttgtttgcgtttttctttgtttctta

SEQ ID NO: 45162 - DNA, 5452 bp, Oryza sativa
atcatgtgatacctgtcaggtatcagacgatttctaccacgtatcgtgtgatactcgtgaggtatcatgtcaggtataagatgatttatacttatatatcgcgtgatacttaagagttatcggatgatacttaccaggtatcaggtgattcctagtagatataattgtgcatcccgttgggggagagcatcccgacgcgctgccggccacctgcagccctccccctgtagacgaggatggcgacggcgacggcaggggacgggcgcggcggcggcggcgagggacgacgacggtggcgggtgcgggcgtggcgacgactgtaggggacgggcgcggcggcggtgggggacggggacggcggcggcgggggacgggcgcggcggcgagggatgctgacggcggcggcagcggcggtaggggacaaggacagggatgggcgcgcgctgatggcttcggccgcgtcgcatgagtgagaatcgcatttgtggaggaggagtatcccattggggaacggtatcccgtcccctagcattcccgtaaaaaaaaattatagtacagttaaatgtacatgcaactcaggcttggtttagttcctaattttttttcccaaaaacatcacattgaatctttgaatcttgtatggagcattaaatataatttaaaaaaactaattatatagttaggggttaaatcgcgagacaaatcttttcaatctaattagtccataattagccataagtgctatagtaacacatatatgctaagggcatgtacaaaggtagagttagatatgaactctacattatttagagactagcatcctacaacaattagagacaatatagtctctaataattaatgtatcaaaatactttttcttactcttctttcctttctttcaacaccatgcaacaaaatttgctctaataaatgctaagaatcgactctgagccgttgtcatgcataacaaccgtactcctttctctttcttccatgtcatcaaatttacttgcatggcaattgagagagaccactaataaacaccattgtacatgccctaatgacggattaattaggctcaaaagattcgtctcgcggtttccagacgagttatgaaattagttttttcattcgtatccgaaaaccccttccgacatccggtcaaacatccgatgtgacatccaaaaattttcttttcgtgaactaaacaggcttcagtaggactaaaagatatacttagtaccgattttcattattaaaataaaaaatcacgtgcaactccccacaaatcattctaaaaaaaaactctccacaaatccgggaactcaaatcagtggtattggagacggacggacgtacctgtgcatccgccggggaggtaggggttgcccttgtacccactcgtgcagttgcacacgtagccatcagccgtgccgacgcacgcgctgtggtcgctgacgcacgcgtaggtatctttcattcttgcttccttgcacttctcgctgcccgccgcgaagttgagcacgacggggaccgtgccgttcttgtttctgaaaaacttatcggtggtcgcgtagtccctctcgaagctgaagcttttagcctccatcaacacggcgtggctgcaccaggtgtaattgtccggcaaccagctgttattaaataataatggcccgctgaattcaagccggtaggatttgagtcccacggggatggccatctcgcagcatcccgcgccagagcagtagccgttcctgatgttgctcccgttgccgaagcatgtggacatgcagacgttcaggatcgggtcgactgacgcctcctctccggatagcaagacgagcacgttgcagccgacggtgacgaattggttgtcctcgtaggagaagcggtacggcagctccgtcacgtcgaggcccatccacgagctgttcttcaacggggcgccggttgggtcgttctcgtccttgcactgccaggagatgctgttggcatccggatcttgccgtggagcaggttgatgtcgagcacggccaccacctgctaaaaagaacacgaatattagggaaagaccagtggcggagccaaaaattatataagactaagaataaggtagggctcgactaatggagttttagttttctgaaaaatttacatggtgaatcaacaaaatttaagcaagtttttggagacaggcctagggctcaagccttagctgctctaggcctgtctccgcccccgaaagacctaatatcaaatataattagaaggggtgaggcttcgaacccagatcgtccagcccactactttgtgaagctagccaaaatatccctaggtgtttctggcaccacttgctgccgatcggtgccgaggcgaagctgcggggtgtcgtggacgcactcgaggctgaaatcgtcggacagcgagcagtttggcccgatgccgaacgggtactcgatgtcgacgttgccgcacttcttcggacacagcggcgacggcggcggccgccgtgatgcggccgcgatcagaggctgcagggcgagcaaagctaggccaaggaagagcagcattggatgatgcttcgtcatccgtgcctggaggtggctgtcgtagcagatgctaatttttgagaggagaatgtataggcgtgttaaattcttgagaaacttgacatctatgctaagctagcttcatgcatgttatatagtacttgggcgaacccgatgacttgagtgttagaataattgggctaggcccaacttataatattaaatctcaaaggcccataataagtgttgaggataataataccacctcaggatttaagcgagaaatatctcaacctaaatagggagttattggaggctccctgttgaccagttgaggtaggggtcggaataccacacgcgcgcgccgggccgtgggcgagggcgagggcgagggcgtggatggcggcgggcgggcgtcactatccttttgcaggcactaacccacgttcccacgattccctccgcaacagcgcgtccacgttccacgttcccacgattccctccgcaacagcgcgtccatgttctttctcctgatagataaggaggccgcgagtccgatccattttcttagcttctttcccggtgttagtttcttcttctccgcgcctgagttgctctcgcttcctcgcttctgatctcttgcgcgcacgagagattggaaggagcagtgcctccgaaaccacaccttcgcctgagatctgcaccgggtaggcgggtgatcaggtttttggggagtgcctcccgcacgactgctcgactgctcatcgccatgtctggagttgccgccgccactgctggcggtggtggtacgccgccgacaggagctggatccggagctggtgcgccaggaggtgccgtgaacgacaacaacaacggaggcaattctgcctcaccatccagcggagggccattctcggggtatactcttctcctcctgctactgttgttagcgctattcctgttcccattgttagcgctatcgctatactatgtgcgctatgttcttgttcctgttctacataatgcctctagcatgttatcgtgttactggtatgttcctgttcctgacattcatgatgcgcatagtatgctactggttatgttaagatcaccctacactgcttatgccatgatcattgctttaactttttggattaaaatatgccgattaatgactatatttccaacaatccaaaaacctgataggtcattttcggtagttggctttgctgctgcactgaaaccacatgcttttgatggttcaaactataagagatggaaagcacgtgcactattgtggttgacagcgatgcagtgcttctatgtttcacggggcaaacgaagtgaaccacctctttctcctgaggaagaggctaagttcgaggcttcggattgcctgttccgtggagcattgatcagtgtactcgctgacaacatagtggacgtgtacatgcacatgccttctgggaaggacatgtgggatgcacttgaggccaagttcggagtttctgacgccggcagtgagctgtatgtcatggagcagttctatgactacaagatggtcgatgaccgttctgtagtagaacaagctcatgagattcagatgctggctaaagaacttgagaacaacaactgtgagttgccggacaagtttgtggcgggtggcattattgccaaactaccaccttcttggtcggactttgccacttctctaaagcacaagagacaagagttcagtgttcctgatctcattggctctttgggtgttgaggagaaggcgagggcaaaggacgtgcggggcaaaaaggttgagggaggttctagtgccaatatggtacagaagaagaaccctcatgcatccacaacaacaagaaagtcaagcctgatgtcaaacccaaggctgcaaccaattttaagaagaaaggcaagggaaaggcaaagggagactgctttgtgtgtggcaagtatgggcattgggccaaggactgtcctgagcgcaaagacagaagtctgccaacatggtcattagcgagggcggaggaacatcggggtacggtaaaatattacctacagttctctctgtttttcattcacctgattggtgggtggatactggtgctaatattcatgtatgtgctgacatttctctgttttcttcttatcaggtcgggagaggttcctccttgttgatgggaaacgggtcgcttgcggctgttcatggtgttggtacggtcgatctgaagtttacttcgggaaagaccgtgcagctgaagaacgtgcagcatgtcccttcaataaagaagaatctagttagcggctctctattgtgtagagaaggttttagacttgtgtttgagtccaataaatgtgtcgtttctaaatatgggacttttgttggaaaaggttatgacagcggaggcttgttccgcttttctttgaatgacatgtgtaataatcataatgctgtgaaccatattagcgagaatgatgagtctaatgtgtggcattcgtgactctgtcatgtgaatttcggttgtatgacgcgcttagctaacatgagtttaattccaaaattcactttggtcaaaggttccaagtgccatacttgtgttcaatcgaaacaacctcgcaaggctcacaaggcgtctgaggcgaggaatttggcacctctagaacttgttcattccgatttgtgcgaaatgaacggcgtgttgactaaagggggaaagaaatatttcatgacactgatagatgattgcactagattttgctatgtgtatctattgaaaacaaaggatgaggcattgcattactttaaaatctataaagctgaggtagaaaaccaacttgaaaggaaaatcaaacggttgaggtctgatagaggtggggagtatttttccaat

SEQ ID NO: 45163 - DNA, 806 bp, Oryza sativa
tagtaaagaaactgtcatgccccatgagcactttgcaccgatagaacacaatgatcaaacgcctgaggaaaatcctgaggaggacaacattgtagatactcgcaagcgtaagagacaaagggttgcaaaatcctttggagatgactacattgtatacctcgtggatgacaccccaagaaccatagaagaggcatattcatctcctgacgctgactactggaaggaagcagtacgcagtgaaatggactcgattatgtctaatggtacttgggaagtcgttgagcgtccatatgggtgcaagcccgtaggatgcaaatgggttttcaagaaaaaacttaggcctgatggtacaatcgaaaagtacaaggcaagacttgtggccaagggttatacccaaaaggaaggcgaggacttcttcgacacatactcaccagttgctcgcttgaccacgattcgagtactacttgctctggcagcctctcatggtcttctcgtccatcagatggacgttaagacagctttcctaaacggagagctggaggaggagatctatatggatcaaccagacaggtatgtactagaaggtcaggagggaatggtgtgtaaactattgaaatccttgtatggcctcaagcaagcaccaaagcaatggcatgagaagtttgacaccacgcttacatctgcaggctttgttgtgaacgaagctgacaaatgtctatactatcgctatggtgggggagaaggggtgatcttgtgcttatatgtcgatgacatactgatctttgggaccagccttaatgtgattg

SEQ ID NO: 45164 - DNA, 2077 bp, Oryza sativa
tgatcccagcgtgctattaaggaaaaaccgaacaatagtaagggatcaactgagatactctcaaatcattggttcattgatgtacttggctagcgcaacgaggcctgacatctcatttgctgtaagcaagctgagccggtttgtctcaaatccgggagatgatcattggcaggctctggaaagagtaatgcgctatttaaagggcactacgagctatggaattcactataccgggtatccaaaagtactagaagggtatagtgactcaaactggatatctgatgctgatgagataaaagccacaagtggatatgtgttcacacttggaggtggcgctgtttcctggaagtcttgcaagtagaccatcttaacgaggtcaacaatggaagcagaacttacagcactagatactgcgacagttgaggccgagtggcttcgtgaactcctgatggatttgccggtggttgaaaaaccagtgccagctatcctaatgaactgcgataatcaaacagtgattattaaagtgaacagttcaaaggacaacatgaagtcatctagacacatcaagagaagactgaaatctgtcagaaagcagaaaaactccggagtgatagcattggactatgtccaaacggctagaaatctggcagatcagtttaccaagggctaccacgtaatgtgatagacagtgcatcgagggaaatgggcttgatacccacctaagggtgtataatagtggaaacctgtccattgggatcggagatcccgtgaatttggatggtgaaacaaactattgtgtgactgagagaagagacccttgaaaggggctcattttcatgatgtgcttatcttctttcctgcatggtaggatggcttatgtattaatgtgatccgagtggcttttccaagcagagatgttgacctgcaaaacatctcagaaggaacacacctatatgagttcgactgctagtcacagtctatgaggtttgggcgatctctaaatactcatgaaagggctggagtttgacttatatgctccaaacagaggggataccaacggcagtccagtaccagtcaaggttttagtgaaatttgatcacacaaaactcacaattcaaggcatagtccattgttcagttgtggtctgatgtagctcatttcctaggtggaagttcaacttaacagtctccaccaaaaccctggtatatcaaacaggcacaacattgagaacatttcttatgagccttgaaatttggtggggattgttagaataattgggctaggcccaacttataatattaaatctcaaaggcccataataagtgttgaggataataataccacctcaggatttaagcgagaaatatctcaacctaaatagggagttattggaggctccctgttgaccagttgaggcaggggtcggaatgccacacgcgcgcgcgcgctccgggccgtgggcgtgggcgagggcgagggcgagggcgtgggcgtgggcgtgggcgtggctggtgtcacaccctgaagttctcctcctaagcctaaaattgaattaataagagactctaagaaaacaccggtgcaaagcaagagtaaaccctgctaaatcaatgcaaataataatcggaattggcatgtggaatttttcttgagttatacatgtcgaaattcactaacaagatttttagtggaattttcagagctctcaaaataattttaaccatttaaaatcgagcttgcaatattttaaatcccagggaaattcttttcctccttttcttttgttttcctttcccctccttttcctcttcttgggccgtcggcccaatccacctgtagcgcccgttccgtcgtggcgcctaacgggaaaattatctcttaaaaaacctaattgcgaaatttgtttctttgcttgttgtctagtgtccgtgccatctcaagatctcaatccccgatctatcgtcgagttcaaatccaaatccaaatccttccaaatcaaattcctccgcaaaagtctattttgcctcccccgggggtcgatgggccgatttcctcccggcccatctacccctggggg

SEQ ID NO: 45165 - DNA, 3778 bp, Oryza sativa
ttaatttattcagagatcgatcgacaagagaacaatcctacgaaattttaggtgttatctcaattttacgatccctacgatactacaaaatattatttaaaataagctggtttcaaaatattataaataaatatgctcaagtttatataaaaatcagttaaatatatcaaaaccaacgtgattcctgttgataaatgtccctatttgcatgacatatattattactatatttttatatagaatggccatatgtaaataatataaatattaattaaactttaaaaaaaaatttcatagtatcccggtactacgatacgatcatacgatacgatattactttgagcaaaacgatactgtctaggatcccgatcctgacaaccttgatagaaataggcggtttgtatgagcggattgtacatcggtgtatgaaaatccatttttacgggccacctctaaaaataaattttatcttttcaaaaaataattgttaatttgcaaaagcctgataaaatattttgtattttactagaggctctatatacactatgtgcatgtgaatagaacatttcacattttagtgggtgcaaaaatattttcataagttacatgattttccatacgagatatgtacaaagtttatcgactacaaagctataagtcttgtcgaactctaaaatttttatatagaacttgtattaatctaaggtctcaaatatttgtatttcaaaatagacgtaggaccttgtaccgaatatacagaacactaatcgatctcaaataaaaaaaataactacaaagctggagatctcgtcaagagctatactttcatataaatatgtcttcatctgacttcatatacgaagtttgaaacttttttcttaaaatatgttgtttgtttcaatttttagagtctgttctttaagaaccacctatgaaaaacattttttcattattctttgaaataactaaagttaataaaaatatttttaagttcaattgagatgaatcgatctctatgatcattacaatgttttctttgttatggccaggtccatatttctatagattatttggaaaaggattgatcacttacgtcatgtttcctccaatatgagttggcatgttatctatttcgacattagtaaatgactatatctctactattataaaaattgaagttgtttttgccggtagcttgttacgtcatctgtgtatgagtcggtttttaacttcgtttgcttttagaaatacatatccgtatttgagtcagtttttaggttcgttcgcttttgaaaatacaaaaggagtcatataagaaatgtctttaaaaaactcgcatattaacttgagatgatcggacttctaattgcagcttatgattttctaaaaatatatatatatattcaagcaaattcacatagtaaacttcaccttaattaaaccgtataacaatgataagattaaaataacctcacccattgcaacgttgcaacgcacaggcattttttctagttatagtaaatattttaagaaaatattggttaaacaatgtaaggaaaatactgaaagaatctcggagaattttggttcaccttaattagagttaaaatcacttttcaaagtatggaattattttcttagtgtttcaacaacattttttttaacatagtaaaattcagtgcgataacgtttaacttgttattagcaattttatttgtgaaatttccataaaagtgttaagattgtacttttaaaaatatttaattttggtaaagaccatactgacatcttacaatttatgaaaacatgttgatttggttaagcacgtgtgaacttgagtggttttttaggaaaactaagtaggtaggggtgcatttgtaataaaatgacttgtgggtgaaatactgaacttcatgcgacttatggggtggattttacaaaattcccaaaaatttatctacattggacttggttacaatttgttaacgacagtttcttatgagaaccacccttaaaaatttgatttatacttaaatcttgcctaaaaatggggtaaaaatattttcctaaaaaattggctataaaaatgatatttgcaggcggtttttttttaggaaaaccactcggggaaatagactaatttctacatacagtttccttaatgacccgaccgtaaaaatatgtgttttcacgggtgttctattacccaaaaacaatctcaattatttcgtactcccttcgtctaaaaataaaccaagaacaaacctggtacagtgaatctgaataagcccgatctagatgctttattttgagaacataggagtaaacggctttaaaaaaaaagatagttgtctagggcatccataatgtggctggtgaaatagtgggaaataagcattgaatgcatccctattactaggtaatatacattgtggaggtggtaacaactactatcagggtataagtttactactaggtattagcacttcatatagatctcgtcttttttttaattgtggcattacacatgtttgaaaaaaaaatttagatgggtcatatcttactacccactctacgtatatatattataatacatcttcaacctatttattatcatctgacacagatccatcttattacctagttttacaataataaatattgacaatgtcaaaaaaacatagcataagtgaaaactgtttttttaagtagtgtgtaggccacaggctgctgggctaggccgtggctgccaggaagacgggggtgtcgacgtcccttcgacaccgccgccgaatgggagaaaagtccccgtcaaaattaacactccgctcgcgtacgtgaatgcgccgccggtagccgtcgccgacatgcctgcactgcatgcgcagcacatcgatagcaacagtacctaccctaactaccccggtggtcaatactaccatttcaatagctaatcataatcgcacgtttcgcaaatcgaggcaaagcattttaaattcggagtaattccgatccatcggtttggtttgacgcatttgtggaggagcaagaaagagtgtaatacttcgtaataggatagggttagtatggtccaatatatatgtgcagcctgctatccatgttgattaataattgatgtactgacgtatactccatatatctatactactgaagaaaaaaaaacaaagtgagacagtgaatctcctaccaccttccatatcaatggcatgtgggttcttatctagtattccctccatactcataaaggaagtcgtttaggacaatgtttaagtcaaaccttgagaatataaatcatgaaaaactctcaagttattgagtttgaaaatgtaaaaattatatgaatagatttgtcttgaaaaatactttcataaaagtatacatatatcacttttcaataaatatttttaggggcaattgcttatttgacctcgttttgaattgtaattaccgatttgaccctactttttgaactttgcttatttgaccctcattttcgagtacgaaggtcttgtctgacctaattccgtttgtgtgaggtgacggtgttaattttggggtaaatagtccattttgcccttgcttatttggccctgttatatcttgtttgtttgcttgtttgacctaaagtttggataatataaaaaaaaatctctttccccggcggcggcggcggcggcgcacccgcagaggaagacggaggccggcgcgcgctggggggagagagcggcgccctgtgctcttcgccacagcggcgtcg

SEQ ID NO: 45166 - DNA, 2562 bp, Oryza sativa
aagaaaagtggaaaaaaaaatctacatacaactattcttaaaaaaatcaaagttcaaaactattatatttcgggtaatgtacaatgatgcatcatattaattttccccaagtctaatatattcatttaaatcttttaccgcgtttcaaggcgtttgaaagttttgcatactttcccattttttcaaaaaaaaatgtcctgtttagtacccttagcagcgtgccgcatcgaactatttttccattccttcaagaggaacatgcccggagggtgttatcaacacactcacaaccgtcgtatcgctagggatgcaagtggataatctcactacccgtataaaaacctacttgctagttcattttctatatggtagtacaaaatttcaaagaaaaaataaactaaaagtgagataagcggacaaaaaaaatccgcttgcccgccccgcttgtatccctacgtatcgccaaggttgtcaggatcgggatactaggtagtattattttgttcaaagtaatatcatatcgtagggtcgtatcgtagtatcgggatactaagagattttctttttttaactttaattaatatttatattaattatatatagccattttgtataaaaaaatatagtaatgatatatatcatgcaaatagagacatttatcaagagaaaccacgttggttttgatatatttaactgatttttatataaatttgagcatatttagttacattattttcaaaccatgttatttaaaataatattttatagtatcgtagggatcgtagaatcgggataccacctaaaatttcgtaggatcgtgtagtaatgaatagtaggatcgagatactatgaaaattaagatattatgtggaatcggtatcgtttcggcttggtaggattgtagtatcgtaagatactaggatacgaatcgggatactgacaaccttgcgtatcgcccggctgaccaagcaaactctatgaatcatcactgtcttgtatttggtttgatgaacctcctatcctttcttttttctttctgggtataatctatgggatgatgcaattattgtgtgatattaataaagcttgcaaaaggaaaaaaaacttgtactcatatgagcatgttgtaaaatattttgtctgtatcgaacgcaagttggaaaaatcgatctctcctgccaatctgatatctgtatttgtacagttagtagcagcattatattattgactttatatggatgaataatatattcatatatagttcactgccttgcttaacgcaattgtgttatgaaaaatatgaatttttttctcctatcttcggttgaaacaatgaacaaatactctttaccaatagcaacaacaggaatattatttttttatgtaccgaagaaaaaaaccaagcacgtcataggtcgacgtgtatatgttcgtctttcatatctctgctctataaaatcgtgtatataggctcgattatactcctaatacatttgaaatcaagacaggcataactcatccccaattatatataactgtatacggaaatgccctgcgtcgggcgcccgatgggcaccgtgcctccggcgcctccgtgccgtccccaccacacacaccgttataacaaatcacccacataatacaaaaatgttctattaagggaatacctttcattttttttccaccaacaatattttagcaagtatactcgtgtgtgtttcactatgtataaatcaaatgttacattgaattgtaatatcctttcgctattttgctgaaacattgtttttatatatggtgaaacaacttcaaaaaccattgttctatacattatagcaaaatgttttatgaggtgatttggttgtgtttcaactttttaaacgattgaaacattttcgatccacctaatgaaacaattccgatctatttggtggaacatcagatttttgcaaaaaaataaaaataaaaaataatcggacgtgtaggtggccccaactatataagcacatttgcaatacaagaacgggaaaaaagaacaaaaagcatcaaccctcccaaaggcccaaaatagaggcctggcccatccacccaagaaggcccagctatcttcttttccctttctttttacctttccagttccccttcagacaaaggggaaaaaaatcgcatccgatccgaatccggcgagccgaatcaaatccttccctcgagcaccagcggagcggaggagccaattcgccggagacgagacccctcggcgtcgtcgattccccaggcgagcccgtgcattcgttcctccgcggcgagcagaagcggtgcgcctgcctgcgatggcggcggagaagccggctccggtgagggtgctgtactgcggcgtctgcggcctccccgcggagtactgcgagttcggcccggacttcgagcgctgcaagccgtggttccgcgccaacgccccgggcgtttaccccgacgagctcctcgcctcctcctcctccgccgccgccgacgtcgacaaggtcggggagcggcttcagggcgtcgggatctcccccgccgatggct

SEQ ID NO: 45167 - DNA, 2130 bp, Oryza sativa
ttgctggaagtgtagtgcgtggtatggtcattttaatacacatgagctattgtattggtgccttctggtttgagtccaagcgagtcaaagtccacgtgtatgaaattttgggtgataataacatcgtttatgatgagtacccttttgtcttacaggataaaccagagggtgtgattgagaagattgtccccaacaagcgccaatgtgttactgtggtgaagggtctggaattaattggtaagtggtgttttcataaacattaaatgactgtttaccaactgaaagcttaaaccggtaaggtgaccaaaatgaacatgactgtattgttaaccctatagaagaagatgtattttcaatattgaatccccgttcatactgaagctatggtatatttttatgaattatactttgtttcctggacaattaggtgtccagctgagtgatgcttcaaagaagctggggaaaaagtttggtccaggagcatctgttgttaaggtataccagtaatcagggctcatatagtacaatggcctttgatatcaatgtaagcatttttttaacacctgttctttattgcctttcttagggccccactgagaaggagcaaattgatgtgcaaggggatatatcgtatgatatcgtggagttcattacagatacttggcctgatgtaattcatccatcttctcttcaatttattgtggtttaaagttttctctctttttatttactcacatgtttgatatcatttatgatattctgtccaggtgtgaattcatttagtttcataacaatagatagaaacctattcaattggattataacatttagtttcacatttaaaaataaaaaaatcgagtaataatatacttctctagtccgtctatatgtgatgttccttgaatgtatataggagtagagaaccatggtaacatttggtgactacatattcagtgaaaagttatatcctgtagaggttttggtttgtacatggagttcctaactcccattcattaactaactgggaaggtctaaagttgagtcccaaggcccaagggcaaggaggaagtcttatggaccaccagagcttgatatacttttctataacacaaatttggaaaattgtgacctggaagtgtggtaatcaccaccatttgaaggcttcagttgtaaaattggaagatttttcatcaaaaaggaattaaggcaattaatggaataatggtcattcattaatcccttccaggacctgagtcagccatttttttcattgaagatgaaaggaaggttcttgctgcttgatgtttaatggccccaaggcagaataccaatggagttacaaatatagtagaaatataagacaagagtatgcctgcagctaaggcatgggccttgcatgagctcatcaatgctactactccttcaaagacaaaaaactgttttctttcatttctggtcttaagttcatcacaactggtgttttatcgaggactggtcccatgtgtatcaactttatcctgcaagttagtttggtattgctaagccattggaagtggcaaatgttttgtgcgagcatcaggcttcatatttaacgacatgcaaagaagagtgcaaattagtagtgtctctgccctttctgctttcacagagaggttgtttcacactgcaagtttggatttgaatttgatctttcgttgagttctcgttcatcagggctactgactgcggtttgtaattggggttgtaattgtagaattcaggatgatcataatagggtgtttttgtttgcaagaactacatatcatacgggctgtagaataggcagagacgagtctgatgggcttctattaggctgtattgggtcggcttctattttacttttccagctaaccaagcccaaattacgtctatttagaacagaaattcggcaggcaattttaacagcgatttttatttcaaagtgcattcctagaggagcttcgcaattgtgatctacctcaagtcataaagaaataaaataaaaataaaacatgttaaaaatggtgaagataaataaaatgtggttttaaaaaaaattatcttcaccgttataagtattttttctaaaacaacccacagaagatagtggct

SEQ ID NO: 45168 - DNA, 811 bp, Oryza sativa
tgtatgtatatatgtatatgtagtatgtatgtatatatatgtatgtatgtatatgtatatgtatgtatgtatgtatatatatatgtgtgtgtgtgtgtgtgtgtgtgtgtgtgtctatatatatatatatatatatatatatatatatatatatatatatatatacccgcgtgttgcagggaattaataatttagatgtactcgagaaaagaaacttatggaagaaaattggtaaatcatgtcacttgtgatatctatctaaagcattgtaataattgatatgaaattgtaattattaatataatcaagcaatttaatataaaatataaaattttaatccgttagtataatttaatatacaaacttcaaacccaatgtacaaaacaatgtctttctttttcagttacagagataataagaggtatacacataattgtgaatgtgtctctttaaatacacgttcaaataaatgaagactattaatatatctcattgttaacgaccaaatttggtaatatcggcatcggaaaggaagattagatcgaagcggaatcagagataaggattatcgcggaaacagagtaaaaatcggctggagtccggatcagctacgattggatcggctaagttcgagtcagacttggtttggtgatgcagccgattccgacaatacgacttggtgtacgatattgggttgggtcgatatgcttcaagatgattgccacgcgtggatagagtcctgagaaggcaactgtatctattaattagtatattttatgtaatttccttagagatatgtttgggcaaaagt

SEQ ID NO: 45169 - DNA, 2089 bp, Oryza sativa
atttggggatttgttatttttagtaaatttgtactccaaatttatctgaatgtggcatcgcacgagtaacataatattcccagatactctttctttgaattacttttttactttttaaaaaatgtgtaaatgagatgagagagaggggtgtcggtgaggctccatgctagtagctgagtttgactgaattttgtacgcaagggaaaggtgtgagatattaaattcatgtgtagccttttcatgtgaagcaagcacaaatgtagagcacaaatgcggaggtgccggctgcaactgtgcaatgaattgcgtgacatttttaattccgggcgttacgtgacttgtgaagaattagtgggtcactagtcataacagtggcagtagtgtagtagcaaccgttaggcttaattgtgtagtactagaaaattaagagtttgatgtaaactaatcagtactggtacttaaatagagtaggtgttgagctgagcaagcatacagtcagatatatgagtatgcaacaacattaattaagctttaatatatgacaaatatttcactagctttatcatgaaaattgctttcatgtttaacattttcttggtactactcatatataagtggtactgtggtagagaaacaatgatcaaaacatagaattgctcatatgtagttttaatatatgaaaatgaatcggagcatagtttgtggtaatgagtgaggagacgattgtttaccgggattggtgaggccttaacataaaggtcaacacaatcattaaagcgggtgggccccccctctgcgggccccaccaactttctccccccccccaaaaattttcgccaagtctgttctgtctccgggcaacggctggcgcccccccagaccgcggcgccacggtggctggcgccgccctcctcccccaatcgaagcccttctgtgcgcgggacattaactatccctgtcacatatgcaattctgtgcgcgggaaaagttgcatgcatgcagctgcccgggagaagtttgcatcgaacagtgacgacgcgctatcaatggtcgagatttaatccctcgatccgatggctgggacgagcgtccgatttttttctcctgatcggacgtccgatccgtaggtctctcctcttctttctccctgtaaagagaccgcaccagcttctgtaatagtgttggaaagtcttctcttaatatagtcaactgtcgtagttaacagtttaatacgattggtggtggggggggggggggcattagagcaagtgtaatagtagagctaattatatagatccacattagagttaatatgtacagtagatgagctatacatatttaatgcatttatcttgaaatatagtagcaaaatactcaacctttgctttggacaaaataaaatatattataatatgtaatagacaaaagaattattgtgtaagaggtaattttttctgggcctgtattctttttctaggttcaataggattcttagtggttggggctttcagttatcttggtaagaatattatatctgtacttccatctcaacaaattcttttttttctacagggggtcgtgatgtctttctacggaatcgcaggcctattcattagtgcttacttgtggtgcactattttgtggaatgtaggcagtggttatgaccgattcgatagaaaagagggagtatcacctgtttgcatttttgaatatatggtattcacgtgttttaactaaatatttagattgtttcataatattagaaaatatcattggtaaatttgtaaaaactataaaccgtggtggagtgccagatttactatcaccaccactagagacttttaaatgagtatatatacgtagagagttagcttttatatgaaagctaatcattttaatttttcaagttctattctccgaataactttataattgatttaggcttagtactccatattaaacttgaactcatcatcgtcatgtcggctgacgacccagcaaaactccggtccaaagccggagggcatccgcgacgacgaacacgcacttgtacttgctatatagctcattagcttgtactccctgcagg

SEQ ID NO: 45170 - DNA, 1222 bp, Oryza sativa
ataggacggaggaagacgacgatgggacacgtggcggccccgcgggctaggtgcagagggcgccgacctctctgaggcgcgggacgaggcggccgctgaggtggaggcccatgaggccctcgaggccgccgacggggtcgccgccgacgaagagcgcggggagcgcggcgccgccgcccagcgccgcctcctcctcctccgccgcgccgccctccagctcgatgacggtggcgtgcgcgccgacggcggcgaggaggcgcctcatgacgtgcgccatgtagcacccccgccgcgcgaacaccaccacggggctctcccgcaccagccgccccaccctctcggccggcgcctcctcctcccccgccgggtctatcgtcaggctcccccgccgcatcatccccgccgccgccgccaccgcctgcatctccggccggccaccgcgcgcaccgtgaaatcaaaaaacacgaaaatagcggcggcggcggcggtggcgcgcgctgtctctcacctcgcccgtcgatccggagaagggggtgtatatataagctggagaggggggagacgacgagagcacatgggggagggtgacgtcacgggaggaggaggaggtggggccctgggtggcgtctcgtggccggactatggaagcggccattaataacttgtcgaggtgacgacgacgacgcattgagctaatcgtggaggagaaattaaaatagtttaaatttgatttagagattgacctgacccggcctgattaaaattttcttatctctgtcctgtttgtttcgttagtgacagaaattttatcgtttttattattgggatccacagtttcgtctgtttatttttaatttagcgaggaagagagatggaacaaatctggtggctgatgtgtatgctgggcgccatcggaattcgacgacggcaggtagagtagattgttcctcagcacatggcatgcaactgggggtcatcatctcgtcaaacaaagaactgtactgtgccacgtaccgtgcgtgtacctgcatgcttagtagtacatgctagcagagctggagctgaggtgaggttacaattactctctccgtccaaaaaaaacatgataaatatttatgtgtccgtcttatataaattttttttataattaagattggcattggtggtagatgataaaacctgattaataatttatgggggaattatctttttaatttttttc

SEQ ID NO: 45171 - DNA, 1603 bp, Oryza sativa
attcaacatgaccgcaccaaacatatcgaaattgataggttcttcatcaaagagaagatcgataatggggctcttagactacaatacattaaatcttctgagcagctagctgattgtttaaccaagggattaggtcctagtgagagtgagtcaatgtgtaacaagatgggcatgattgatatcttttgcccatcttgagggggagtgctgatgtaatatgcacttgtattggggaccttcttgcatatgtagctaagtgaaatagtgtgtgtgtgtggctgtgaacaacacaccagaaaaaatccccaaaactgaactttactatctaaggattgtgaaagggtattttcaagaattaagtctatccaacatcatttcaagattttatcacttgaggatccttgatgtacggcaatgcagtggtcactttaatttaccgagtgatatgagtaaccttataaagctgcggcattttcttgacccaaatgattcttttcactctgccattgctaatgtgggaaagctgaaatgcttacaagaattaaagagatttgaagtcaaaggacaagctgaggcatttgcattaagacagatagggcagttggaagagctaaaaggatcactgtgcatttataatcttgaaaatgcacagacaggggaggaagcaaaccttttaaacaaaaggcacttacacaagttagtattagtttggtctgatgattcttcacaagcagaacatgttcttgaaaatcttaaaccacatagcaatcttgcccatcatggttgggtgttaacttgtctaccaaaaacttgcaagctcttcgtttggatagcatacagtggaacaaatttccccctctaggtgagttgtggttggttaatgcgtccggtgaagaatccttgggttgtacaacaagtcagagctttcaaaaattaaaaaggttagagctgcttggcataccacagctagcaaaatgggttggaaatgatgcttcccatgtgttctccctgctagaggtgttcattataagagattgcccagaacttatggagttgccattttcacattcaacttgccctcgatcaggacaggagatgaacttgacccaattccctacactaagggagcttgaggttgtaaattgtccaaagctgtcatcatttcctcacattccttggacaagctctccatgtcgtgttcttattgatgaagtgggatcagattttcagcggttggattactcaaaaaataaccaatctgaattttgcttgaaagttgtgggaaaggatggccatctagatatgtcattctggaatgtattggcatttagtaatctaactgaactgaaagtgttgtatttgaagaaatgtcctcctttgccactgaaacatctcctagtgctatcatgtttgaggagtccctcgatacatgattcaagtaatgtcttgttgaatgttgaagctgagaacactgtcggctgccaatttcagattgagggtctcagtatcgatgactgtaggtgtagcgggaaggaactgacgctgttgctgtctcttttccccaagctgtcaatggtttcattacacggttgtgggaagataa

SEQ ID NO: 45172 - DNA, 19501 bp, Oryza sativa
tcccatttccatcctccctgcaatatctgcatcttgatggtgtgggaggcatggagactctggcgcctctctcaaacctcagctctctcaccagattaaccatacggaaatgtatggatttaagaggtgaggacttgtcttctctcctcgcccatggccaactcacaaacctgaacatcttcgagacccccaaattcttcgtcgggtgtggctctgactccttgcggctgcagtgcctccaaacagatgacatcacaaaggtccttgccgcgcccatctgcagcctccttgcttcctcactcaccagcctaaccattagttggaacgacgaggtggagcgcttcacaaaggagcaaagcgcggcacttctgctcctctcctccctccaggaccttgaattttggtactgctcggagctgcagtccctccccactgggttacacagactcaccagcctcaagagattaaagatctggtcctgtccagccatccgttcgctgcccaagggcggccttccgagttcactggaagtactagatgtccgttctagcaacaacgaggagctcaaaaggcagtgccgcgacctgagaggaaccattccgatcatcaaagacagacgatactactaatccaaggtaatggtaacaaaacacacccttgtttgacatgacacatccccagttcacattctgtttggcacaccactgctattgtttaattcatctatctgaccaacctgcttgttctgatctactgtgcaggcctccttttggattaggacatgccttaccttcacagttgtttccatgcacaatataagttaataaatgacttgtgcctcttccaccgtgtgtattattacacaaaaactgcttggtgaaagcatacaagttcatctctgcagctgattgtttggtcagtcaacttttcctatttatcatatctttcagcggttccgggttttaatggaactattaactttgagaaaactgttgtgtttcactgaaattttccttgtgtcagttcttatcgttgaatttggcactcttagactcgatatgtaaagtacctttctgattaactgaaatttataccctgttttggcctagttcagttaaccgaaatttatacgttgcgttggcctagttcagttaaaatatgttatcagcgtgctatactaatttttcttcttcttcagttcatcaaggtagtgcaatgtattcatatagtcagttaatacttgtcggtagaaacagacattcttcttgaactatatgaagtacaatcttcattatttccctcagcttctgacagcaaacagcttccacttgtttatcagcaggaggtacttaacaatgtcaacaatttcaaaagtatggtggcttcacctggagagttctctcctgctcaattgcctgcagttggtgtggcctgcaattccatgacaaatgagtcaaggaggctgatgtttacaaaggacattttccacaacttgtaagcttgcagtttgtaacatatgtacttctgttatttcactagcaaataatgcatatgtggccgtcagtagttgtgcataacttgcttgaattgacttgtcacttgtggctacctcaatatgctgtaaaagagctcacttcaatcatatatatgttcatttttgcagatctctagctgatactgtatttttttccctctgtttctagagaaaggaaggagtggatgaactgaacatgcagctctggtagaagttcacaacctttcttccttgtaaccacagctgcaagtctcaggtctgcaacagcaggtcgcatgcccctgtttgttctagtgcttgcagttatttaatcagctccattacaatcacatgctcttactccatggaaactattaaagtaatagcatgcttagttggagaggatcaaagaggactggaagagtatcaagcaagggcaaatctacaggtcatcagtgacctgtacgcatacagattgcctaatcctttgatccttatctggggttatctccggtgcatctcgagctggaacacgccacttgctataacaaatacgcagatatgtatatagcgcgcgaaggtgctctgaacccaagtttacccaatgaacagcgtcaacggagcagccgtcagaatcaggataactcgaaggaggaggttgatttggttgatttggttgatttggtccctcgacttttaatcaatgcttactttagtccctcagttttcagaagagtctgtttgtgtgtaattggatcaaatttatccttctgtttgtgtggcgtgatgagggaatttatatggctcgtctctaaatctattttttttactcgtttctaaacctaaattttttgaccatcccattctcattggcatggtaaggatttgaccatcccattatcattttagtaaattttaaagtagatctagccgtgtaaatgcgcatgccaccctattggttagtattgtcaagccatgagtagtaccgcaacattagcttgccaagtgaccattatgccttcatgctatagaaaaaaaaatgaagcgggccaaggtgcactgaactgaatgaacaggattgcactgtcacagagctgccatttaaaaaaaaagatgatgagctataaaaaagtaaatgaagcaacaaaattaatttatgggtaaaaacattatattgttcggggttataacccaatgatgaaaattagtaggctacgataaaatgacaaaatcagatctaagattaagtttcaaattttaaattttggatactgcttgagcatcaccaacagattatctataatctccccctaaaaaattgtttttggtttcctaaactgaaaataggaagtgaaaaaactccaacatatagcctaaattcaatccccaaaacttaaaagtggactcttctgttaaactatcaacagaaaatttcgtttttttctttcacgcgcagaaagatcgctatctcccatgcacgggaacaggaggagaggggcgggagtgcgaaattggaagcacaactttcgcgtccgcatataaacggagcgagaaatcggaagaagggaactctaaaactttggtaatagagtaggagatctgttagagctgttttttggactaaaatctattaaattagttttgggaatcagataagtagtctgttggtgatgctcttaagtcaacaatcaaacgacgaaattcagataattacaaggagaaaagggttactgatcagtttttttttaaaaaaaaaagaagaaaaactacagatcagcttggtcccctgactttaatcaacgatcggtttcgtctggtggagaattcaaaaaaaaaaaagcctgagcaaatttaactatattaagtatttaccataaaaacacaccgaaatacttttgtgcggctactaatgaactcgggctgtttggttaaagagctagtactccctccatcctaaaatgcttgacaccgttgacttttttaaaaatgtttgactgttcgtcttattcaaaaaatttaagtaattattagtttttatcctatcatttgatttattgttaaatatacttttattatacatatagttttatacatttcacaaaagtttttgaataagacgaacatttaaatatgtttaaaaaagtcaacagcgtcaaacatttaggaaaggtgggagtacttagtttggtttctcgaattgattttttaattggtgtgacttgatgagaagcagattgggtatggacgtgtatggataagaagcaatgttctctttctccatctctcagtggtacttataaatagcatttcttgtaaccagttaataaaatccaatcttaaatatttcacagaaaacccacagaaacaagtcgagaaacaacctgggagatatcttatttttatgttttgaacatctacatagtctcaaaacaaatattcgatcattaatgtttataataatttgtgaacaaaaattattgaagataactactccagtgcttacggccagtttggcaagagaagggaagaggaatgggagtttcaaggagggagttaatggtgggattggtcatgggagttacatttttagtcctcatcccttgtttggtttcacattgaattccctccaagtctcacgaattaacatgcctctcccaggtaagagattggtgggaattcgacattttaattccccatcattccccatcctaaaccccctcgaattctcaagtcttccaaccaaactacagacttaaactcccagatatcataaactcccattccccatcaccaactccctccaaccaaacaggccgttaatgaatccattttttttcaaacggtttggttgttgccaatgttttatataaagaagacatcccatttttttaaaaaaaaaggaaaccaaaccatacaacgcacaattaattaggggaaactggacgaaaaccaccactacaaccacataatgaatctattaagaatattttgacatactacaccttaacatttaatttacatactaataattagaaatgtcaagtttcactacattctataagcctcatctatttaacaatcgacaaaatatctggacgaccaaaatatctgaaacaaaagggcaaaaagcgaagaagttcatgaaccaaattggcccttttaggaccaaagtgagacgagtaagaaagttggaggaccaaattgctcatcatcccgtccaaaatcagctgcccgcgccgacgacctgttcgacgttttaccaccagcgcccacgggattttcaccgtgtcacgccgcgcgttcgcgtgccttcccgttcgcaccacccgcctctctccctctcagtcccatgctgcgaccgcacccaaaactagtagccgtctctgaccgccgcgcctgcggcatcccacaaatacacgggccgcgccgcacgtcggaacggcgcgacatggccattgttaagccgcgacctcgcctcgcgtttcttgcaatcccaacaagcaaaccgtctcatcttcttcttcctcctcctctgatcttctcctccttgtcatgcgatcgagctttgctctgctctggcaatggcgatgaacaagctagtcggcgccgcggtgaggcggcctgggtgggccgacctcccgcgggacctcctcgagtccgtgctcggccgcctccccgtgccggaccgcctccgcttccccggcgtgtgcacggcgtggcagtcggctgatgcggcctccgccaccgcacggtttcgcgccgcgcagccgccgtggctcatgctcccgttcaacccgacggcgcgcaggcagagcccgagcggcggcggcggtggggatggtaggttcttggaggcgaggttcttgagcctctccgatggcagggcgtacgccatcccgcagccggcgccgccggtgtctgagcggctatgtgttggctcgtccgacgggtggctcgtcaccgccgacgccgcctccgagctccacctcctgaacccgctcaccggcgcgcaggtccagctaccctcggtcaccacgctgcccttcgtcgacgccagccgcgacgccgacggccgtgtcgcgagctacgacctccgctgctgcttcggcgatggagacaacgacggcgacgaggtgctcgtcccgccggagtcgttcgcgccggacaggctcaggtacgagctctacgagaaggccatcctcgttgcaccgccgcggaggcagacgacgccgccggggtcttggggcggctacgccgtgctgctcatctgccagccactgtaccgtctcgccattgccagagcaggggacacgaagtggactctcctcgacatgccatcacgatgctgggtcgacgccgtgcgcgccgcctccgcccccgccgccgacgggcaccaagcggtgtacacgctggactccgtgggtcgcgtcgaggcatgggacatggacgtcacggcggcgggcacgacgccgccgccgcccagggagatcgcgccgccgtgctgctgctccggccgcgcgtgctccatgtcgatcccctgcagcaaatacctcgtcgagctctcgccgggacacctgctccaggtgcaccggctcagggacaaggcgcacgcgcggtccaagtgggagccccggcaagaacgcgtcgagtacaccaccgtcaaggccgagctcttcgagtggaacgccgccggcggcggccatggcgagtgggcgcgggtggacggcgccggcgccggcatcctcgccgggcgcgcgctgttcttgggcaagagcgcgtcgctgtgcgtcccggcggattgctgcccggaggtgaagggcaactgcgtctacttcaccgacgacgggccatggtcgcacgagaggtgccacgaggtggttcccgacgtcggcgtgctcgacctcgccgacgggagctacaaggtgccacgcggcgccgtgcgcgacctgctctggaagtggccgccgccggtgtgggtcttcccttcctgcaccaactgacgaacgccaatccgtcagtctgaattctgaaatgttcagagttttttcctttttttcagacaaagttcagatatcttcatttcttcagcatctgcagctcaactttttgttgacctgcttgctgcttgtaaaaagtttttttagcttccgaatgcgtgggtgaggtcaacgtcttgttgacctgtttgcaataagttgtaaaaatggatgtgcttgtcagtgtgagaacgaggtcaatctctggttgacctcttgtaacaacaaattgctagttgtggccaagacaggttgccctgtcaggatcacaatgtactaatctggttcattattcaagataccagtgccatctgtgagttttaatgtgcaaaacagatcaaatttcgtagaaactgaaaaaatattcagtgatagtattggtgaaactcacaatattcatgcaaagaagggattttattttgggaataagatcactttgactccatcaactgactaccgaatctaaatcgtatacctcaaccgcaataccagaaatattgacccccgaacttgcaaaaccggtgcaatttgactcccttgatggttttggatggcggtttcgctgatgtggcgcacacgtggcagtgttgacttggtctttgttccacgtggcattgacgtggcgcttatgtgacattaaaataaaaaaatatatgcgggacccatttgtcattcacacaaaaaaaatttgtgggacccactgacatgtggatcccataggtcaccctctcctatctcttcttcctcctccccctcctcccttctctatctctccctctttctcttcgtgcgtggggagcggcggcggcgggcaatggacggagcggcagccgacggtcttcgcgccgcctccgccgccgccctcgccgccgcagtagcaaggattcagcttcggcaggtccgggactggagcggcgctggcgccacggaaaattgggattgttgccggggcgagggcatggcgcgaagggcacaacagcgatgagcaggatgattccggcgacgatggcgcgggctggccgtggtggggagggagcgagccgggcacggtggcacgaaggaatgtgcgcggcggaggacaccgagcgcaccgaggaggaggtggaggagcgcaagaacgctgccgccccggcggccaccgagccccctactcctgctgccaacttcccgagcctccgcgaggccgccgcgggcacggctggcggcaagtccaagaggaagaaggggcggtctcgcggcggacgtggtcggggagggggcccgtgtcggaggaggaggagctccagtcgctgttccgcatcatggccaggtcgacgccggagcgctcgaggccagtccgccgccgcgcgttggggcgtgcaagctattgctccaaggtccaccgcccaccacagccaccactccgggcacccactcgctgatgccgccaccgagcccccgcctgccatcggctcttgtcaaggggagagagagagagagataagggagagaggaggaagaaggatagtgagagagaagatgacatgtcccacaatttttttttgtgtgaatgataaatgggccccgcatatatttttttattttaatgccacataaacgccacgtcaaatgccacgtggaacaaagatcaggtcaacactgccacgtgtgcaccacgtcagcgaaaccgccatccaaaaccaccaagggagtaaaattacaccggttttacaagttcaggggataagatttctggtattgcgcttgagggatacgatttagattcgttggtcagttgagggagtcaaagtgatcttattcctttattttgcaagcattggaaaggcccggatcccaaattcatggcccgccgtgataaaccttgctaggcctcattgagccactttagaaaatgaggcccataaattgacagcccaacataaatgggccgcaagtaagaggaaagcccagcgcacgtaggacctcaatctagttcttgggcttcacaaaatcgtaatcccgttacgaccgtctaaccaacatgggccgcaagtaagaatgtacttgtatgtatacgcgtacacatcatcatcacatgtaagtacatcctccctccgtattttaatgtacgacaccgtttactttttagccaatgtttaatcattcgtcttattcaaaatttttgtgcaaatataaaaatatttatgttatacttaaagaacatttgatgataaatcaagtcataataaaatattactcggtctcaaaatataagtatttttagagttggacatggttattaagaaagtaggtagaagtgaatgataaatggttgtgattggttaagtaatggaggtaggtgggaaagtgaatggtggaggggtgtgattggttggaaagagaatgttagtggagaagttatattttgggacaaatcttgagggctaaaagttgttatattttgggacggatggagtaaatgataattacatttttttgaataagacaaatggctaaacgttggtcaaaaagtaaacggcgtcatacattaaaatacggaaggaatacttgtttgtaatcgtatctctaacacatcctcaataggcacatcaatatgtaatccataaattttgagaacatttgtttaaaaaaaaggcctgttcactttgatgtcattttcaaccttaccaattttggtaaagttaccataaaagtggctacatttagtttgttgctgaattttggtaattatataagaaatcctaccaaaatattggcaagttgctaagggcctgtttactttgatgccattttcaacattaccaaattttgataaagctgtaaaaaaagtggctgcatttagtttgctgtcaaattttggtaaccatataaaaaatcctgcctatgccaaaattttggtaatgccaaattttggtaatgctaaaatttggtaatgtttttttacatcaaagtgaacagacctaaaattgagaacctgctgtgtgtaatcatatatcatgattttttaacctttatgataaaggtgctttccccttatgattgactttgtttattcacacatggaaagttgtcgaacgtgattatgaaacgaccaacgcagacgcagtcttcgatttgattaactccgttttttgtagccttgtgatcgactgattgttaatcccacgacaaatcggtttggtacgctggatcgctggccaatttgtacgagatagcccccacaaaacacatgctgcccagggcattggtgctgggagttcatggctgtctgatcgagcaacatcttatattcccaattcctccaagtcgctagcaatgttgcttttgcttcaattcatcaagcaaggcccattctgtagccagctctagcaaatttgcatcagaagcaacagttttattttcagtgcgactacatagttaagtatttaacaaggacatgtcaattaacaaaaggagaaatagaggcagagcagagagtagatgaaagcaaagatccaaggcaaatggtccatccatttgggacttatataaagaagccattcacctgccacagagatggacacttgaaagcaacccttttcatcgtagcaacgacgacagtaagctccgctgtctctctcagttctttttctgaatccctgaaacagatggtggtagtacatcgctacaggttaataaaacggtgcaagaactgaacgagtgatccaaaattccaaatgcaggcataggttcagtgtattattttgtcgttggaaaatgttggttctcgatttggtgagattggattggagaacatgaattggcattgcttgtcgagtgattggtcaagtggttgcatatatacaggtttgttcttgcgttcaggttgatgagaatgaccgagcaactaattgggtggataaatgggttccttttctccctcaagtttcatgtgtccactactatgcagttaagcttgtaggtttgtacaagctaagctctatgcctgattactagtacatgatttatgatcaatttagcaaattaacatcatggttgaaagaaggagtcaactttaatttaatccagcccccggttgtgttggattccggcgtttgaaagccaatgcgaaacgggaaaaacacgtgagcgcgcgtgcattgacaccgcagcatcctgacaaaaattcagttgagatttgaggatgaacatgcctgagacacgagtgttcctctcgctgcccggcgccgccgcgagcaactctgaattaatcaggcaccatctgctgtacatttttatgccatttattccacactgctgtacgtgtcgctgcagcttggtacgtgtacttggtaggctcaaacgtttggtagatctgtgaatctgttgtgatcaccattctgtagccaacgccaacgccaacgccaacgcgtgaatgaaccaacctacctctcgtcatgaagcacgaggcaggcgaccgtttcttcaccaacatcacatataatcgacgcaaagaaaaacaccgggttgacggaaggagcgtcccaaaaaaaaaattgaaaagtgaacgaagcttaactggtttgatttttttgttgaaccacgtacccatcaacaacaaagcgttgttgcgtttgcgctgcctccaaacattttttaagaaaaaaaattatgaacgtgttaggggtagaggttaaacattgtacctcagccttgaaaccatacaccctttatcactgcagtacatctgtgaataagcgatcttatctgcctcggccaatcgacggcgagcgatcggcgatcgggttgttgttggtggtgcactggtgcgctagctgggccactgctttgtctactcgtccccacccctgtagctgtagctgcctgctctgctttgccgtttgcactgtgcagcagctgctgctgcttgtgcttgtagtgagtggttgcgccgttgcgagctccgacccaccacacgacgccaccaacctctggttgccatcgcctcgccatcatccactcgacgcgacgccaccccgaccccgcctttaatactactaacctctctctgctgctcacgcccgatcgtttttgcttccttcagatccaaaccaaaccaccacctgcggcgcgcgccgcccgcggcgagagcccggcgccgatgaagcaccatcatgtggcgcgggggcgcgccgagccgcggcggatgggcaacgccgccatggtcatcaccatgctcctctccctctgcgtcctcacctacatcaaggctcgctactgctccacccccttccgtacgcttcttcctcctcctcctcctcctcctcctcctcctccttgttcttgatcgattcatggagtgatgagctttgattgatgcatggagtgatgagctgtgagtaattgtggttgcagccaaggcggcggaggagatggaggtggtggagatcgacgaggattacgacagcacgaggtacaagatgacggggccgataggggaggaggacttcgacccgaccaggccgacgtgctacgtcacgagcaagcggtcggagcggtgcgccgccgtgggcgacatccgcgtcgacggcaaccactccaagatctacatcaacccgctcgacaaggagtggagaaccaagccgtacgcgcgcctccacgacgccgtcgccatggacgacgtgcgggagttcacgctcgtccccttcggcggcgccaaccacaccgccgtgccgccgctctgcacgcgcaaccactccgtcccggcgttcctcttctccagcggcggcttcgccggcaacctgtaccatgactacaccgacgtgctcgtcccgctcttcaccagcaccaaccacttcggcggcgaggtgcagttcttgctcagcgggatcaaggattggtggctcgacaagttcacgccgctgttccggcagctctcccggtacgacgtcatcgacgtcgacaacgaccaggaggtgcactgcttcccgcggatcttcatcggcgccacgttccaccgcgccatgggcatcgacccggcgcgctccccgggcggcgtcaccgtcgccgacttcaagcgcctcctccgccgcaccttccgcctggagcgcgccgtcgcgtcgcgcacgggcgcgccgcggcgcgacaagccgcgcctcctcatcatctcccgcaagagctcgcgccgcttcctcaacgagcgcgccatggcgcacgccgccgcgctcgccaggttcgacgtgcgcatcgccgagccggacaaccacaccgacatgcccaacttcgcgcgcctcgtcaactccgccgacgtgatgatgggcgtccatggcgccggcctcaccaacatggtgttcctccccagccgcgccgtgctcatccaggtggtgccattcggggggctcgaatggctcacccgtgtcaccttcaaggatccagccaaggacatggatgtcaactacatggagtacaatgtctccttcgacgagagctcgctgagagagctctacccgagagaccatttctacatccagcatccatacgatgtgcacaagaaaggctgggacgccatcaagacggtgtacctggacaagcagaatgtggagctcaacctcaccaagctcaccaacacgctggaacgggcgcgcgacttcttgccagagccctgacaccatggctggggatcttgatgatgctgatggtagataggagagctcttctgtttttgattcgctttttttctccttcttcttcttgtggtgagattcatttctttcattgttttttgataaaaaggaggagacgagtaagatcgtgtcatagacaagtgtccaaaggttaatttacacttgcacactttgtaaattggttgttgtcgataaaatgtcaacatgaaaaatgctaattatttgtttgtggggagtgatgaacaattcacttttgccaccaccaatagtgttcttccaagatcttggcagtctttaattctgacaacctgccaagcaaatggtgatgatcaataatatgagatgacgatcaatagtatgtaaatctgaatagtccgagcaattttgtaaaacaaggcaatgttcaacttatatcgagaaaagaatgagcaaaaaaacaaatttcagctataccaatctggcctttctgaaacaaaaaagaaatggttaaccatgccccccttgttctcaatcaagaacatagttttcagatatgcattcagtcggaagtctgacattaccttaaaagtacctagagactagtctctttaagcacccactgacattatgtcgttagttgtagctcatagggtaaactgaaacactacctgtacagacaacgaaatattcagagttcatctgagaagccagtttgcaagagctttaaggtaagcactgccaaacaagaccaccacagaaaaggtcttaaaagaatccatgaacccaggtacccaacaagctgcagtggttgttgaactgtttcccacaagaaaaagactgcacgacaagacagtaaaacaacttgaaggagccgtttccctctcatttcctcattactgaaccgacccagagatataatcagtagaaatgtgatcattagatgccatcaatcatatgtggaaaacgcccaaataaccgacaatcgtggccttaatcatagaactttgcctatttacacattctcatttttttcgttattcagaaatgatcagtggtatctttcagataagagacgattagtaggtgtagtattgggatttggaaacagctcagcttccacgataatctccactttggaggagctaccaaatttctgttgcttcctcgcctttcacggtgggatcattgagctgccgaaaccagaaagaaagcactccagaatcatctcctgtaagcaaagtactatctgctttgtggctgatagctgtgtctcaccagctcaagggtgaccgtgtgttgcatttcatggttactgacagaaggacagcaaaatgcttgtctatgcagttaaaaccagctgagtttcgtctactacttatgtagaagagaacggcacctagcttggttggcagggagagctcggctgacagggagcagcatgcttgcctgagttcgaatccctttgatcacaggttttctcattattttcttctctaacaacaacagatgctaaattcctcaacagatgctaagttcctccttagtactccaaacatatgctcaacatagataatgctttatctgtctcctttctagtgggtttcaactttcaaaggtggaacttcattgttttacatttgcaaaagcctcatttgtctctgatcatatgtaaaggagtctttccagggaaatgttactgtacaatagaaatgcagtctttgaaaattctgcactgagatgaaggttctgtggtcagaaatctgtctctgcttttgccaggttcatcagacctttgacctcacagacctaattggcagaggaaatgtagcttttggatgccatcaataagggtggtttgtgcacgttcttctgataaatgcattcttaattggccttgtatattaagctagccaagcagggaagcaattatgatatgcgtccagaagctctgactcaggtcaggtgctgctttatctaaagctttacgtgccgaagacttctggtccaacaatacagggacacatgtatgataaatgataacatctgaggatgctgagtggcggaaagtgagtgaaaaacaagatggagccaggaattttaaccacgaaatatcatattagagcagctatatatatatatatatatgtatatagtactccaaagaaaaatgaagacagaggcgatagagaataaccagaaccatgaataattataaacttagaaccagaacccagatgatgatctaagtaccattgggcctatagaaacaccactacagcaccagctaacgtaaaagcatgtgttttaaagaacaatttttgaatgggaaaaccagagaggaagttccagaatctctgcagacttttttgtgctgtgccatctaccaggagacatagggaagaacgggtgggttattattatccatgagttgtaaaaccagaactgtttgttttaacataagagggcgtgccttaattttcaaggatgttgacaaattataacggtgtggtttatgctgtattttcttcatgaaccttgtttttaggaatgcacaaaagctttccatgtctttgcattaaaaggaggaaattcctgaactttgtttctttttcgcattatacatctactataactgagagaggagtagcaacaactaaagcatgtaggaatgtaatatggtactcgtcgactctcagatcgaagctagactagcttggtaccttcctcaggaaaagaacatcgaattaggtaggccagtgtctcataatagtaatttaatgattactcctctttgtcttcaaaagataacaatagcaatctgatctggtatggagggggaaataaaaataaatttgcagtaccctgccctagttatgctttggtgacttcaatttcagtttctgatggtttagtttcatctactccaataattccacttgggcactaattgtagaaaaatgttcgaaaaagcttttcaaacacggaaatagaattgtgttggaaaagatggttaggagttacctttatcctgtgttgcagggcgaactatgcagaatttcattcacagcacaccatatcaactatacaaaagaaaagaagtcacatgcccaatcagttacaattattgaatgtacagcaaacaagtttcaaataatcaacagtatcaattactctatatatagtactatggtatcaataactgcttttgtggtggtataatcatgactcaaaactggtgaaatccatgttcaggccaatgtgattcttccatctgaaccctgaactctagcccgggccttttcagcctataaagaaaacaaaagtaaacgcatcaaggacaagttagttatagacaacatagtaagacaaagactgctagcatatcatgtcatctcagcacagcaggaaggactggtgaggtaaggctcaacaggtatgccacgcagactcaatcaaaccagacttccatgtcataccaaaccagttagaaggaaacgattgatatgcatttctccatgcaaattaatttcagaggaaagaataattgcaagttagtttcttgtgacaaagcagaaaaccagcaattcatagatatcagttatgcatccccttccccaatccccactgaggcactgagaagcattcaccaggtgtaaagtcctgtgctgcttcagcaattttgtggaggtcaatgtagccagtggcgaagccaccgtaggggccagggagggccaacacccccctaacccctatgtgacctcccctcccttttcttctcccaaggatgattagcccttatattcaagctattaattatatcataagttcagaatgagcctactaaaatagaaaataagacgacttgcttaatgaaatgattaagttaatgaattaatcattttaaaagtgattgcaagactccaattaatggaacaaactgttcaatcatccatatattaaaaatattactgaattttaaattggcgaatcatgatatatgggttcttgttctctcttgtagctaatcgctgtaacatgtatgatatcgagttaccgatcatgcatcaacactacaaaatcactgttcattgaaccttaagtgaattaccatgtctcgtagatggcaccccccatctctaaatcctggctttgccactgaacgtagctactgcccaatctcaatttttcatactactggaacagtgcatgtccttctgttcctagttcctactgggctagagggagatcttgtgccttcgatttttttttttaaaaaagggaaaaaataagcatcaattctttgactgtaaaggttataagtttaagggtgtacctcttcattccagcttgtacgaagcagcatgacaaccagcgctaaaatttgcactgtcatggcgcatattattcccaaccaaagtccctgcacagaaaaccaactcagagtgggattacgacagaacttgcacaacaatgtcatgccagaattgcatataaaaaataaaatttaccttaccatcgatcttcagaacaaatgcaaaagtaacagctgaagggataccaattgtatagtaagcgcacaggttgataacagaacagactttttgccagccacaccctctagcagcaccttaagagtcataaaaaaaataaacaaatggtgactaagatcaataatattgaggtttgttggcatcatggttactatggatgtgatataataaaggcaacataaaatatttgaccaaggttaaaaaaaactaaattatgtagaaatatcatgaacaataacaagtctaaaatatcaaaagattacatcaccccccagaaaatggcatatgaactagcactctttgttctttaaaaaaaaaaacagaacaaaaaaaaactagcactccaatggtattaagataggagaagccacatatttttccatcccttcatttaatccagtggaatatgagcaggtcaaggggtcgaacctgggtctgctgggtgaaagcaatcaacccataccaaccgagctaggcacagttctctacacagtacttatatggtcagccttctttaacacaagcattgctggtagcttgcatagtaaaactcctacataatacttacattaccatccttctacagtagaataatttctcgtaatcacacactaaaacttctatactatctctcttaatgctggtgttgctggtagattgcatagtgaaatcgttgggcgttggaatggtagtggtactgagtctaattggattgtacaaggcacgtcagtaaagctcttaaacaggccgtgacatgcaacatataaacaattcaagggctttattattattagaagtggcactgtaatggggcaaaacggccaactgcaagattggcaacaatgtaaaaagatatgcaatctggtattctggttacatgtatgattaaaaacagggagtgtaggcactacgtgataaatgcagaattgtcatatttggatgtgtgttttatcccaaacctgatagtgtgcattgtattccatccatgaagtcagataaagcaagaattggcatcattgctgcgacatatttcacaacttcttcttcattgctgtacaagtaaccccagatatcccgtaccaaaactgtgatgatagctacaagtatgccttcggttaggcacatgattcctgaaacaaagactgataggcgtgctgcttgcggattcctagcacctagttcgttggaaactcttatactgcaaagagacatgagccatgggccaaaattagataagctttgaggtgtcaaatctcataaaatgaaaggaaaagtcatcccaaatttctgctctgctgaccttattgcactgctgaggccacttggaattgtataaaccatccacattgtattcaggctggaaacaaaccattcattacttcacattatcaagtgtctgaaagcataatccattgaacatgctaagttgctagctgtgtatttcatggttatcacagaaaatttaaaaagcaaatgcatgtaataccatgaatttgaaatgtacagcctattatttatgttttggaacaactttggaactaaactcatttgctagaaactatactgaaaggaatgcagacattctgtttgctcaccttattgacaaaatcgaagtttccagtttcggattaggtagaaagcctgcaaggagaaccaccatctcaaatgcccaatactccaagctgagttatgtcacaagtcaaataattatttccatgcagaaagaacaaggtatttcatgtaacttatctgttaaatcat

SEQ ID NO: 45173 - DNA, 10861 bp, Oryza sativa
ccaaggtcaaaacaatgaaccataacccagcacagcaaaatgtgaattaccaaggtggccccagaacaaactaccagtggatggacaatgttttgagtttgcagaaacttggtaaggcactgaagcaaaccgtatgcaaaaagaccaggaatcaaccacacggcatatagtccagcttcagatgatatctcaggattttgaccaagagcgataagaatttggccagcgaatgccaaaacaaaagccagcgggacacccataagcataagaacaaagatagccctttgcgcatgtgtcccaagcatatcatattgttttgctccatatgattgtccacagaatgtatccagcgcgcttcccattcccagcttgtcatggaataaacagatatgcagttttcattgaaattttcttgcaagtaaaagatcaggcatcatatagtagaacaaaggagaatccatacatattctttaagaaaaacaaacgagattccatacattttataaagaaatgccagtcaccataattccataagcacaatacaactacaagcatatacaaggcctctttagatcattggatggattgtatttttgtagaacttgaactaatttttggatatgatgtcctaccataaagcaaacgcgccgtactttgtactgattttcacttcccaaatttttttgccgaacaaaggagtaactattcatactaaaagaatttaccaacccgaagttaaagtatatgtaattatggtttagtgttaccaggacgctgaagccggtgacgttggcgaaggaggaggcgacggaggcgccggagagggagagctcgccgagatgtccggcgaacatgacggagaccacctgcaagctgtactgcagaaggctacacgccaccagcggcgccgcgagccccacctgcctccgcacctccgcccccaccgccggctgagggtcgtgggggacgaggagaggggccgcctccgccgccgcctcgacctcgccgccgccgccgctcatttcgccgctgctccgcgccctcgaattccgatggtggctgggtttgactcgtggaggcgatggccatggccggagcagtttcctctcggagtcgcatcgtacgggccgttgactacagcgcatacatggcccgacccacttcggcctcgtctggtagggcccaaattatggcccatatctgaggaaagcccgtaaattggcaccgttttcccggcccatcatggatgggacttatttgggcgaaaatctcaaatgaggccttactatatatgggccttggcctccaaagctagggcctgtttgggggagcttctagctgcagtagagatgcaagtgggtagtcccactacccgtataaaaacccgcttgttaatttatttttcacatggtagtacaaattttagaagaaaaataaactagaagtgagataaactggataaaaaacctgcttgcatccctagctacagcttctcctagaatcaggatcagaaactcctcaaacagcttttggtctaaaaaagaactagaagccagaagttaggaaactcagcttttctagattcttataagttggctaacaaccagctgcttctcagaatcttaagcttcccaaacagtccataagcttcacactacagttttctaactttactctcattttcgatgcgcacttttaaattgtgtgttttttaaataattttacagaaaaattattttaaaaattatattaatttattttttattaatacttaattaatcatatgttaatccgttgctctgtttttaagcgtcgggaaagggttcccagccccaaacaacacagccaaaccctgcctcgggctattaattaactcaggtcttctcttcctctctctgaaaaaaaaactcagagcaagtagcaagagttcttgataagttaaacacaggaatctcgtacggatggatagaaataatgccttatccatctggattagcaggaaaaattgaattaaaatcatccaaagagataagaaattttctaatccaaacaagtgtattggtccagccctccagctggtttgatatacgtttcatgaatttggacgggattgtatgggctaactaaaatcatccaaagagataagaaattgttttaatccaaacaagtgtaatggtccagcactccagctggtcgatatatgtttgatgaatttggacgggattgtatggactgttatagttcagatagtgcttcgaaaagaattcagggttaagtaagaagaacttcagagaggtgtcagcaaatttggatggaaaggattaaagaaacgtgtaatcgccccactgcatattgatttcctaagtacatcactgcagaatctctgtggacatggatagcaacgttttcactgtcatctggtaagcaggcaaggtcagacatggtggcaactgacgagtgtcaattgggcaaatatgaaattgcagctaactgactctaatcatagtcaatcatcctattttaaggattggtcaaccatcctaagataaatgtatgatccatacatcagaaccaacgtggatcagaattaaagaaaattccccatgctattcgcgagatgatctcgcgctgtgtacatgttagctagatgctcatttgttcatggatcctggcgtttacttcttgatccttgtatattgctcatgccagagtgttaatccaggatatccagcttgcagtttttattggtgtctgcaattgttttcttttgtcatgaccagacagcaaaagacgcagttttgagtcattgtatatgcagaagcacaggatgcaaaagcctcagccattatgattatgcaaaatgcaggattagcaagtgtttcacttatgaacaaataatctcccactttatataaagtgcacaaagttcatccaaaatataaatacatataaagtacaaacttgcaatctgagcaatctcccctaccatttcgttgcgtttgctccgcgattcccttaccccccatgtgctcctgtgctatcaaacaattcccttttgctagagcagaatcatgaaatgccaaactgatagatctgaggggtacttatcacgctttttattctttttcagatgtagccttgcagtgtaacggatctggcctctgaactcatcccgggttttcaagtgcaaaacaccattagatggcacatgtcacacattgacttcacaaattatatcgggcagatttgccacttgagattaaaacagtcgaaatcgccaccacaaactggagttttcttgaaatcttgcttctgaattctagctgtttcagagaaaagaaataacagcataaagacgaagaagcaacgtcagttctcgtgacgaaaaaaaaaagaacaaaaaggaaaaggacgcgaataaacgtggtttccatgaactgcccagctggttcaaccgaccaaggcctgattaattaattgatcacttccaaatcatgtagcagtactgttcttcacggtcactattgctcgctgctgcttcgctgggtccatcgattaataatctggtttgttaattcccctggacttaactaatcaacttgcctagcaatgtactaatacatgcaaatgtgatgcatttatggatacctgcatcagagagggagctaagctctatgttttgtatatagttgtaaagctgctgttctgttcttgtccctggtgtgtgggtagttgctgtttcagagatgaaggcagctgtgaggagcaagaagagcaagggctctttctgccaccctcctctgctcctgctcatcgtggcaatccagttcttggtgatttactcaccaacccttgatcagtacatggtgatgctaaccacaggtacgccgtaatcataatcgttttgtattcttcagtttgtatgttgattagtagtactgtcagagaagcatatgctgtttgtcttgtcgatactccattcctgtgcatatttggaaacagttgctgaatcctttcaagaaaacaagttcctttatttgttgggataaaatggtaacagttgctgaatgatgaattgattagttcgttgacaatgtccatcatggattcatgataggctactgctcacgttaggatatcagcatctgttgttattcccatgttcttgtgatcgaaatgggttaactgacattgatgggttgtccctgcaggcaagcctggtttcccatcaatgttgattgatggtaggaggagcttcaaacaagtaggtatgtgtcacataatcttgggaatttcaaaccccacaatgtgattaatttctgacgttgttgattctgagtttatcttggagaaaagattctgattttgttttaatttgctcgatgaaattcttgatgcagatgagttcatcccggagcctcacctgcgatgcgacttcagagacaatagatccgacgtgtgcgagatggagggcgccatccgcatcctcggccgcacgtcggaggtgttcctggtggcgccgagcctcgcctccatctccggcggcggcggcggcgtgaacgcgacgggcgtggacgcgaacgcgacgaggtggaagatccagccgtacacccgcaagggcgagtcccgcgtgatgcccggcatcacggaggtgacggtgcggctggtgaccgccgacgaggcgccgccgtgcgacgagtggcacgacgtcccggcgatcgtgtactccaacggcggctactgcggcaactactaccacgacttcaacgacaacatcatcccgctgttcatcacgtcgcgccacctcgccggcgaggtccagctgctggtgacgcagaagcagcggtggtggttcggcaagtacagggagatcgtggagggcctgaccaagtacgagcccgtcgacctcgacgccgagcagcgcgtccgctgctaccgccgcgccaccgtcgggctccacagccacaaggacctcagcatcgacccgcggcgagctccgaacaactactccatggtggacttcaagcggttcttgatgtggcggtacgcgctgccgcgggagcacgcgatccggatggaggaggaggacaagagcaagaagccgcggctgctggtgatcaaccggcgctcccgccgccggttcgtgaacctggacgagatcgtggcggcggcggagggggtcgggttcgaggtggcggcggcggagctggacgcccacatcccggcggcggcgtcggcggtgaactcgtacgacgcgatggtgcggtgcacgggtcggggctgaccaacctggtgttcctccccatgaacgcggtggtgatccaggtggtgccgctggggaggatggaggggctcgccatggacgagtacggcgtgccgccgcgcgacatgaacatgaggtacctgcagtacaacatcacggcggaggagagcacgctgtcggaggtgtacccgcgggcgcacccggtgttcctcgacccgctccccatccacaagcagagctggtcgctcgtcaaggacatctacctcgggcagcaggacgtccgcctcgacgtccgccgcttccgccccgtcctcctcaaggccctccacctcctccggtgatcgccggcgatcgatatatatatactccggtgaggcgatcatgcatacagaacacacgtacacaggattaattacagcagaagatggagttcattaattaattaattacagtggtagatgatgatgtagtttaattaattttggtggttgcgcaaggcggcaacgtttttgtatgataattaatcgatcctgtttcttttttttttcttttttttctgttgcggagccgtgttgcgacgtgcgtacgtgtgtgttacggtaagttggcctgctgcaattagctggttcaacatgacagaaatgcatgtgacacttccatcctttcttgtacagttgtactgttgttaccttacaagctacgattattggctggaagcctgtgaggaggatactggcccaggtgatctatgggccacagcccatagaaggagctgggctgtgtgctgttgctcgtaatggcccagatcagtctatagtcttgggctctacaaatacggcctgtttctcggcttctcgcaacgccgttgctgatgatgattcagccgaacggtcagggtccaactcgacctttgaattttcacggattaaaactctcgggagtttggccggagtagtaaattctgattcattcttcgcgttggtaatgggcatatgcatggctcagacgtgatatgcgaggcgtcgccatgaacgcggctttgattgctcgcgcttatcccggtggacgtcgtcctctataaaacaaagcactccagctcgatacagcataacgcagttcgcaagttcaatcgcaagagtactctacttctgcaagcttattcttcgactgatcaagcaaggtagagacatgggcggcaagggtggcggcggaggcggaggcggcaagggtggtggtggaggaggtggaggcggcaaaggaggtggaggcggcagcggaggtgggggcaggagcggcggtggcggaggaggaggaggaggaaagggaggtggcgaaggaggttcaggcaagtacggcggcggatacagcggcgggcacgctggtggcggcggtggcgcaggcaagtccggcggctaccacggcggcggtgggggcgacagcatgaaggctcccggcggcgacggatcgtacatctcccgctccggcttcgagtccaacccgcagggctacttccagggcctccatggcgatggcaagtagaggttttggagcgctccaaaagttaggctgctaatcgatcagaattcgcgattatggcccatgaatggtggcttctaaataatgtattatcgagtctgtaaggcagtctactttctccaaatctctgttatgtatcggattatcgtggaaatctaagtgaatgcgttcgataattttatgtcttttaggttggtacgtaatttcagcaagatcaccgatgttcttcttgttactcccctgcagtgtattggaaacttctcgaggggatgtcttctcgtttgtttaaaaaccatccaaactgttttaaaaatttctaaaaaaaaatttaaagcactcatgacatgtctatatgtacaatttcatgaaatcttaggtccaaactcaactcacatgtcgatatataaaaaagataaaaaaaattgttaaacaattactccctccattccataatataaggcacaaccactttttttaagatattccataatataaggcatacatgtatgtatgccattaactataacaattctccattaaattactatttttttaaatccttcactcacattctctaactctattggatggatgcattacatttattaggatgatctaaactacaaggtgataataactatttcttggtctttgggttaagggtggttgtgacttatattttgaaatggagggagtatttgtattcagttcgaaagaaaaaaaaagtacatgagaaatatcccatcgagagtttagaacccacccttatcatagtatgtcttcttttcaataaaagtatgatactccctccatcccaaaatgatatgatatatatttatgtaccaacgttaaggataatttaaatcacatcaatcaagatactatacatacattctttcataatgatgatcaatttaagaaattttggatttcattatatgattatcaatttgggaaggagagagtagtattttattaacaagatatctttgaatatgtgatattttaattgaaatgaggaatttgtgtaaacaattagttatgaatgtgattttaacgttcaaatttgggtttattattttttagttgcaaggtgtttaaaaggtagcagtatttagtttgttcttaagataacttattgattttctcatttcttttagtttggggtctcatggtttatctgccctaatataagtttgggcctcatggtttgctgtttgtgcttatgctagaaactgacccaacctggttcagttgccaatgtgcatcagtgcatctcaggcggataggcacgagcagcggaggaggctacgcacaggcgtttactagcgtttcttttgccatcttcgatgcgtaagccgtcgcgtcaattaagtcttttttttatcaggagtcaaccaagactggacacgatcgagccgattatgcgtgcatggtcatggagggcgagggccgttcaaaattgaaaacgaccacgtcaaaggtcggctcttcgatagttcgatcatctacgtccactaggcccaattgatcggccagattgaacaaaaaaatgaagtcggctatgctagaattctagatgcatcgcacggcatcatttgcattaaatttcatcactgatcaagaacactgaacactcaatgttggaaatatagtcattaatcgacatattttaatccaaaaagttaaagcaatgatcatggcataagcagtatagggtgatcttaacataaccagtagcatactatgcgcatcatgaatgtcaggaacaggaatataccagtaacgcgataacatgctagaggcatcatgtagaacaggaacaaaaacatagcgcacatagtatagcgatagcgctaacaatgggaacaggaatagcgctaacaacagtagcaggaggagaagagtatactccgagaatagccctccgctggatggtgaggcagaattgcctccgttgttgttgtcgttcacggcacctcctggcgcaccagctccggatccagctcccgtcggcggcgtaccacctccgccagcagtggcggcggcaactccagacatggcgatgagcagtcgtgcgggaggcactccccaaaaatctgatcacccgcctacctggtgcagatttcaggcgaaggtgtggtttcggaggcactgctccttccattctctcgtgcgcgcaagagatcagaagcgaggaagcgagagcaattcaggcgcggagaagaagaaactaacaccgggaaagaagctaagaaaacggatcggactcgcggcctccttatctatcaggagaaagaacgtggacgcgctgttgcggagggaatcgtgggaacgtgggttagtgcctgcaaaaggatagcgacgtgacgcacgcacgcacgccgccatctgtcacgcccagaaattcccgaatagaattccaagcagaatgtgcattaaaatccccgtccaggaccggccggggtacacaaacgacaatgttgacattcagatccacgtcttacaaacatcataaaagtcttacataaatgcagcggaaaaacgaaagacaacaggagctaagccttgactagaactgcagcgggaacaccactccacaggcatcctcgacggcacggacgaagcctactcctcggagaaacctccatctgacacatactcgaactctgggggggttgggaaaaatagagcaagactgagtactacccactgtactcagcaagtcataccggaataggggtatgatgcagggaattatcaaagaagagctagagtggttcatttgcataaagcgagcatttataaacagaagttaaaagatttaagcagttgtaataattaattaatattgatcatccgctgtccaacgctatcccacgttgcaacaggcccaaccatccacctaaaccatccaaattcaaaagattacactagggtgagactaatcacggtgaatctggttgaccgcccataaccgcgggcacggctattcgaatagttttactctgatcagaggtatacaactgtacccacaagacacagccccacaacacgtttccgtgcgccgacatgccaccacgacacatcggaaagaggccgtgacaggacccttcgcataaccccctctagccaagcacaccacacctcaggtttcacccccgttcccagcgggcaacgggcagtcccctctcgtgcctaggtgaatccggaagcgacagaggccgtcgcagggcccgccccgctccatcacgcccacccttgcctggatgcgtcgactagaggaaggctacactacaagcccagccgttgcccacgctagcttgtggtaagtacgataagttcttccagggcatcccgcgaaccggtccttaactgccatgggtgcgaccagcgaaaccatgcacccacagcccaccatgtgatttattttaattaaccagcaccaaagcggtggcactaatccaacactaccattagaaccaacagtctaaacattaataagattttccccattgtgcactagttgaactaagcatggctaagcaatccctagtccaatctctagtcatgttataaccccaagctgacaaaagggacatggtgcaacaatagcatggctatgacaataggtaaacaccccatagaaatattataaaacaatgcagtatttgaaggaaaacaatagagcatttgcaatataggatcaacatgttcaagtgacaagcatgacttgccttgctctgctgctggaggaacctcggcgactatttcgaagtacaccggagcgtcggaagaaccggaatctagcgacatacaaggcaaacattgcaaacaggctataagactactgaaacagagaacaaaaccatttttaatggattctacacatttttcttgatttactgatacttgaatgggcttaaacggatctcggatgaattagttatgaattttagaagattcactgtgtttattactataaaagaaaaaccttaaatcattcattgcgcaataaatcccagggctgacatcagcacggggggggggggggggggaagc

SEQ ID NO: 45174 - DNA, 12780 bp, Oryza sativa
  unsure (1)..(12780): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcttgtccaatcggttcggccggtgacgcaagagacttgacgtgtacgtgtgtttgtgtgtgcagtacacgaatccatgcgtgcgtggtcgagcgcgttgggacaacgtggctcacgaacaccaagggctatacatcccggtgaggtacggtggcagttgtcaggcatgcagcagctgacgccgcccggaagcctgatctgatctgccgacgacaaggcgaaggcgagatttgagtttagaactactagcatcatcatttcgtacaagttttatgcgtaaattattttttataagcataagtatatgttaaatgatgggctataatgctagagtgacgtatatatatctcatggctcgtttggatctaaggggctccctgaaaattcttatcatttaagagtatttaataaagtttatgtataaaactacttggagaacctcttagctaatttgcaagacgaatctgtcagggttacgggttagatataccctttgcccttcgatatacgttacatatcgatatggcatacccacgcgcatgcggatatttcctgtatattctaaggaaacctttcacggaatctatagatgaaaagaatcctactcggacagaactgggtcgttgacgtatcgtatagggtctgatacctccgagttctatgaggagacctccacatctgctatataaaagaggcccccgggggggtttagacatcgaatctcagagccaacacaacctccacagcctacgaagccggagcttacgaggagccaagtcatcgagagctagtcgaatcaactcgactacaatctcgccggatccgacaagttcccttgttctctttgtaacctttgttttctaccatataatcccatatcaactggattagggctattacctatcaaggggcctgaaccagtataattcttgtcttttgtttgcttgatgtcgtactacgtagatccttgtaccaacgtactccaataccctctatatccggtctacgggtatcacccgtcaacagtggcgcgccaggtaggggtccttggtactcaaggttctactactatgtcatccaacttcgtcgacaacaacgtcagcaccagcctcagccaagtactccctgcttcaacaatgctggtatggactcaagtcggcgaaatcgtcttcccggtttacaccacgacgccgatctcaaccagtcctccaatgaccgtagacgagaacgcagtggctacgaaccaaggcgattccatgtcgaaaaatcctcccgtcgagacggagaacagaatatcgacgacatccaagctcaagaaggattctgatacggccaaaccttgtccttccgacatgaaccacgagccgacaaagatgacttccgaagccacaaggtcttggtgtcctatccacaaaaccaagaaacacaccctgcaagattgctgggttttccttaacgtccgtgctgaaattcgcgcctgcaaagaacgtggaattcagcgtacttctccaactcgggatgtctattgtcctattcacaagacaaagaatcacgacctctcgagctgcaaagtctttctcggcgccatgaaagctcagtctcctaagtcatatatccccatcagggataacggcaaggaacaaggagcgactccaacttcagatcgattcgttggggtaatcgatatcgatcctcacgaaccatcggtcttacatctcctcgaggactatgggtcatcgacaacgagcgcgccgcgggaggtattggctatcgatgacgttggcacgtcagcgcacgccaacacagtagcggggaatcaatcgactactccagcccagcacatcagggccgttcaagcgatactgagggaaactccctacgatcccgttctgaacgttgacctcgagcgttggacagaacgactacgggaatcggtgactaacctcagcaacgcgtttgaagaagccgctaccgcagcacaccaggagcagccaccaactagcgaggccaatggtgaagatccggaatggagggaatcacctcaacaagctacccctccacctcgcggcactggcgatcttcgagatcaaatcaacggccgctgggaagcacgacgcacacgagacaacgtgaatcgctctcggcgtcatgtctcttcacggcgccatgataacagaaatcgaggaaatcgctcaaacgaggaccgggaccacggcaatcaccacgatcacaacgatcgagaacgacgggggccagataatactggtcatggccgccgccgtatcgacgacgacgatggagatcggcaccgagacaacagtgcaagacgacgacaggattcccgagatccaggccgtcatcctcgtaatcgtacgccggaaccaagtgtaggatcaaggaggccgactagagggggggtgaataggcggttttaaaacttaatggcacttaaacaaaactaatctaagttgctaggcaaggtgaggtgcaaggttaactaagcaactaagttaagttttgcaaacctaggtgatatgggctcaaatatgtctctatgaatgtaaattgcacaaatgtaaatgcaacaaataaatgagacaagagacaaggaatttttcaccgaggttcggaaactcgccggtttcctaatcctcgttgaggcgagcccaactccactgctcaaccacgaagccaccgcacgcccccttcatcaaggggtgggcaaggtgggagccggcccacggagaggactacccaagcctcgatcactagggtagttcttccttcactccgaaggtggtgaactctaaaccactcacaaacagcgccgggcctcctccacaatctcctcggagaggtcaccgggcaacacctccacaagccgtctaggaggcggcaacctccaagagtaacaagtctaggatgcttgccgaggatgatcaagtgccacactagctataacaatgaagcaatgcacttggattggcttaactcactctctaacacctcactagataaactaagtgcacaagggtgtgagagctcttgcaagggttcaagataatgcaatggagtgccaaaaccttacccttactactggggagtgggtatatatacccccaaccaccaaaactagccgttggagtcgaaatactcaactctgtgctccgccggtcagaccgccatagagtggccggtcagaccggactactatgtaacggctagttacagggcaatcattgagcccactcaacctggccggtctgaccgcagtgtagcggccggtcagaccgtccacggctcggtcagaccgtcatcggctcggtctgaccggttgcagctctggcggctctgtatcgccaccaaaaaacagaccagtgcaacagaccagtggggccggtcagaccggccttaccaggtcggtcagaccggctaacagctccggtcagaccgacctaaggcccacggtcagaccgcaggtcacttttcagcacaaccaaccgttagtaaaacgacgatatctcttgactcgagtctcggaatttgacgttcttggactctatggaaagcttattcaaagggctatccaacccatgaaaaatccatccaagaaacataacttaagtcaaggataaagggctcacactccaaaggatatccaccggacatagccacaagatgtcactcactcctattggacatgcccacttctctcttggtttaggacttgagaaaactcatcacacttggttagacaagccccaaaaatgcacctacatgcatatgaactaatatggcacaagatcatccacaagctcgcttcatagactcctcttgatagtacggcgtctatctagcaaatccggtctacaccaaacaccaagaccgggaaaagactaagaaaacattcttagctacattatacctttgccttgcgccatccatcttggggtcaagcttgagccgagatcaacacttgtgaccatccggttgaaccatgtttatgccgaggtcttgtccatactttgtcaagactttattctcatcacaagcttgacttcattcttgccaacatgacgatgcatttggcttggcgaccactaacccatggtgtcattcattagcctcatcgtagtgggacctattccttttcacacctcaaaggagaacattagtctcaacaaatcagttgtcatccttcacttgatgaccaaccggttgcatatgaaagatatggatatgtttgttgagtattcgttaacatcacaagtgtcacatactcgtatgcaagctcaggtgtaaagatccgatataaataataggtgaacaacatggatctagaacatgcacaataaatgtataggatttgctccccctaaatatatgcatacaaataaatatacaagagatgcaagtgtatgcataattagagaatgaccaatgggggtttatcctatacatatagagaaggcatatgtagtaatgatgtagaccaacataaaacatataccttcatgatctccatgttctcaatgtaaatgagactaaataagataagactcgagtaaacattagtctcacacttatatatcaataacatagaaatcatatatatgaacctatcaaaaagtaggagataagaagtagtacatatcgttttatcttcatgtatttcatccttgtcatgattaaggtccatcacaaaagaatgcatgtcttccacatctcattatcaggaaataacctagtagacaacttatgcaaaagagaggttaatcccataaacatcggtttatcatctatcaccaaagtaacaattacacaaattgtttaatccaagatctttcaatcttttctctctttggtgatggataataacccgatataaacaatatagagagatgagatgaaaaatgatttcaaatcaagataaaaatcttataataaacaaaatatagaataagctccccctcaagatgtgcatacatatggatatgaaggaacgcatatgcacataatcaataaagatcaaataggaagctcacactatattttggatccacaagagagaccaagttagaatatgtgaagtttaatacatacctctcatcatttttactttcatatccaaatgagactagtcaaagaaaggctcataaaaacgttagtctcatataattaaatttgtcattaatcaccgaaaccaaattaaggcatttaaacatacaccaagcgacccatcgtcatcgtcatcatccgcatcctcctcatcgtcagacagacatccacgaaggacacacgaccgccggcaacccaccgcccccaacgctgggtgtagagctttcggtcgttccctacgtgatgtccgatggcctgagagattccgacccggagcaatagaaaagtatgatgggagcaccgacccaaaggagttccttcaagtctactccacagtactctatgctgccggagcagacgacaacgcgttagcgaactatttaccaactgcgttgaagggttctgcacgttcatggctgatgcatcttcctccctactcaatctcttcgtgggcagacctgcggcaacaattcatcgccaatttccaaggaacatacaagcgccacgcgatcgaagacgacctacacgcgttgacacagaactcgggtgaatcattgagggaatatgttcgacgtttaaacgagtgcagaaacacaattcctgaaatcaccgacgcttctgtaattcgcgccttcaaatccggtgtcagagatcgctacactacccaggagttggcgacaagacgcatcacaaccactcggagattattcgagattgttgagcaatgcgcctacgctgatgatgcgctaagacgcaagaacgataggccgaagaccgggggagagaagaaaccagccacggatacatctgagtcaagcaagaagaaaaatcgcaaaaatgggaaaaggaaagctcaagcggaagtcctcgcagcagaatacgcgaaccctcccaaacgtctagacccacaaagcagcgacacaaagaaatcatggtgcctcatacacaagacggatagacattctctggaagattgccttgttttcaaaaagtcgctcgagaagcacatggcatttgaaaaaggcaagcgagtacgcgttgtcgagatgaacgaagagacggctcctcacgaaccggactcagcgtatccagactccgacctccacgtctcacacatcttcggcggttccacaacgtactcctcaaagcgagaatataagaaagtggaacgtgaagtctgctcgacatggcaaggggctgcacccaagatgaagtggtctgagcagaagatagagttctcggaagaagaccaccccaagaccgccgttatcccaggacaatatccgatcgtggtcgaacctactattcggaacttcaaggtagcgcgagttctcattgacggtggtagctcaatcaatcttcttttcgccagcactttggacacgatgggaattccgcaaagcgagttgacaccaactgatcaacccttccatggaattactccccaatcatcgtccagacctttgggcaagattatgttgcccatgactttcggccaagccaacaacttccgaacagaacagatcacctttgatgttgctgaattcgatacagcttacaacgccatcatcgggagaactgcacttgcgaaattcatggccgcatctcactacgcatatcaagtgcttaagatgccgggaccgaagggaacaatcactattcaggggaacacaaagctggcggtgcaatgcgacaagcggagcctcgacatggtcgagcaaacgcccagcccacccgccacgaccgagccacccaagaaagtgaccaagacaaacaagacgccgaaaccagacggcgccatcaagattgttccactctccagtgccaaccccgacaagactgtcaagatcggagtgacactaaacgagaaataggaactcgcgctcatcaccttcctctgcgacaacgccgacgtgttcgcttggcagccgtccgacatgccgggggtccccagggaggtgattgagcacaaactcatggtgcgacccgatgccaagccagtaaagcaaagactgcggagatttgcaccagaccggaaacaagccaaacgagaagagctcgacaaacttctcaaagctggcttcatcagagaagtatttcatccagagtggctagccaatccagtcatggtgcggaagtccaacggaaaatggagaatgtgcgtcgacttcaccgacctcaacaaggcgtgccccaaggatcactttccacttcctcgaatagaccaactggtggattcaacagccggttgcgagttattgagcttcctcgacgcttactctggctaccaccaaatcagcatggcaaaagaggacaaagagaagacagcattcatcacgccgttcgaggtattttgctatgttaagatgccgttcggattgataacagctgggaatactttccagcgcacggtccagggcgcacttagcaaccagcttggcaataatgtcgaggcttacgtcgacgacatcgttgtcaaaaccaagacaggcgactcattgattgacgatctgcgggaaacgttcgacaacctccgacgatatcgcctcatgctcaatcttgagaagtgcacgttcactttctgagatgacgccacctgatggtccgcgagcggtccgatgatatcagtcaaaggaagggcctacgctcaatcaagtcataaagtgatttcgaaaggagaatgcgggatgttcatcgaatatacttatgttgatggcttcatcatgttccgctgcccccttttcacaaaggggcacagggatgtcactcgccgtggtcgggccattggtcatcacttggccgacgcggcgctccacggtttcgccgctcagacctgttaattaagaaccaacctttgataagtcaagaggaatgcgaacacaagtatgtcaagataaatgcgagaaagataccccgaggagaaacccgggtcacgtcctctggctcagaatagttataagctggatgggcccgagcctgaagcagatggatccgcctaccaacgaagtctgcaacgacttcatatcccgacaaaccccgtactcggagatcgtcgatgatgtcgataaacgactgaagagagggggtcaaggggggctttgcggtccaagacggaatcttgtccggttgatcttcgggaaccacgaagacagggttcgagtccttgatctcaagataaaaccacctattcctccacttgctgcgagaagaagggcactggaagggaatgtaatgcgacttcaggccatcccgaagtcggaacccgacgcaaccagataccctattggattccatccaacgcagttcgtagtaaaagcgaaaaagatcaaggaaatgctctaccccaatgtaggcctcacaaagatgcacaaagatgctaaggaaggcgatggaattggggttcaaatggagaagagagaggccatagaaattcaaaaccaggagaagaaattcggaaggtggagggagaaaaccgcagagaacataatcttcgatcgcaaccatgcgacccaagatgggctgaggattagtacctcctgcttccctctccatggttccacggccaggaagagcgccatcctcctggagtttcttcaacgttgcattggtggaagctgatttgccgaggtccattgctgatcgaaggtcgccgaaaagcgagcttaggttgatgaactagggtttcttgcggcggcagagaaggcaaagagtgcttggaggtggtgtgtgtttaacaggtttggcggacttcaagatggactcccaaaattcctttaaataggcgcactaccgacggtgcgaattccagggaacagagagagatacccgccggaaatttctggtcccgttacgcgtggcggttttttggacttcagtttaaaattcgctcacgaccattgagcttcgaatggcgtgctcgactacggtctatctccgcggttctcgcaccgggaatgacagcagtctcgacacccgaagtcgcaaatggttgcacgagttcattttaagcagaagtcgggggctactgtcagggttacgggttaggcataccctttgcccttcgatatacgttacatatcgatatggcatacccacgcgcatgcggatatttcctgtatattctaaggaaacctttcacggaatctatagatgggaagaatcctactcgggcagaactgggtcgttggcatatagtatagggtctgatacctccgagttctatgaggagacctccacatctgcgatataaaaggggccccccgggggggttagacatcgaatctcagagccaacacaacctccacagcctacgaagccggagcttacgaggagccaagtcatcgagagctagtcgaatcaactcgactgcaatctcgccggatccgacaagttcccttgttctctttgtaacctgtgttttctaccatataatcccatatcaactggattagggctattacctatcaaggggcctgaaccagtataattcttgtcttttgtttgcttgatgccgtactacgtagatccttgtaccaacgtaccccaataccctctaacaagatatattaatctatgattagcggatgattactatagcatcactacaacagatcatggattaattaggctcgttagattcgtctcgcaaattagccttggggttatgaaatgagttttgtcggtaataaaacctaataatgccacgaacttacttaaaatatgacacaaatttagcaataatatatatttcatagcattacaaatccactaaaagcaacatttgagttcaaagtgcaacttaaatagtttcaaagttgctttagcaaaaaccattccatacgaattttaaaggaattggtagaaaataatcatttatttcaaagtaacctatataattatttttcataggataaaattctctagaatttctctgcctttttccattgtttcaaaagagagcctaattacatggttgctggtctccgtcgacgtccatttggcggccgtagagcaagttgggggcggtcgatcggtcggactgtccaggccgggggcggggtcttctctgccgcgatcgacgtacgacgtgacgtgtgcggttgcgcgcgcgtcgtcgtgcatgcatgatattatgatatggtgggtgacgcagctacggatcatgccgcgatgtgcttccgtgtccgccttggaaattattaactggccccttgttagttaaccggccgccttttggttttgaagcaattaaccgcaatcaacacgagcaaatgattttgggggggtgggggggggggggaaggtgaatcacatcggagctggattaattagcgtcagactctacacaggtgcatgcatattgggatgcagttacgagtacctaactcattattctgcaggtaagtttaccatgacaaaaaatcgaccgtggtaattgtcaggaaacttatatagatacacttcatcatgcgcttcaataattaatgagttttgagaagcggacggcatggagtacgtacgtgtgacgactaaacaatctttaattgtcgcaagccaacgactgatgttcgatcgatgaagatgccagctcgatgccgctcgccctatctgaacagagggaggaatggttcagccagcagaagccaactgtttacgtcacccatgatctgtatcctttttagctcgccatggacacgcgaaaaacaagcacataccaacaccaatacgtcgtcagacacttactacacgtcgtgcgagcatgcacacacgtacacatatccattcttacatacgtgatcaacgaagcaatcaattaatccagaaaacaaatgaaaacccagcggccgatcgactgaatggatcaaattaaccatttacagatcgattaagcctctatctagatcccactactaatttgtgagacgaatcttttaaacctaattgctccatgatttgataatttggtgctataaacatttgctagtaacggattaactagacttaataaattcgtctcatggtttactgacggattctataattatatttttgttagtgtccgaacacctcgtacgacattctatataataaccgatgttacatgtcaaaatttaaacacctctaatagatcgaattggatgagatagtactgtagctgcaagaggagatgtccaagtccaatcaaatcacgtcatcgtctcgaacgagcgcatcgatctgccgacgccgtattgcaatcgaaaccttgggcggatcgatcgacgtccgcatccgatcccatacctgctgctgcggcgaacacccggtgctgatgatgatgcagagctgatcaattgatgattggattctttccccaacttggccatggcaaccgatgaagtgacatggtacaatgggcctgtttggttttcagggacttatttctaattcttgtcatatcggatgtttggacactaatttggagtattaaacatatactaattacaaaactcattccataagcttggactaattcgcgagacgaatcttttgagtctaattacgccatgattttgacaatgtgatgctacagtaaacttttgataattatggattaattaggcttaaaaaaatcgtctcgcggattagctctcatttatgaaattaattttttttattagtctatgtttaatactctaaattagcgtccaaacatccgatgtgacataggctaaaaagttttagtcccatctaaacaccccctatactagttgcacttgcacggcttggaagttggaacaggagctgtttgaacgtgtgaggatgatcaacagttgataattaattagtgtcataatccaatgttgccgtgcttactacaccaaattgacactgttggtatactttagcagcagaagcagatcatatcttttttttttaagacttaagcagattacttacttctatatcattgtcaggtcggctcagtgctaccacgacgttcaaatcaaatctaccacgacgtcctcgtggcgattaatcccggccgtccatgtgggcaccagggccccacacgagaccccatccgcacgtcaccctccacgtcatggattcggcgggcgcgcgcgcgcgcgtcgggtgggccccgcagccccctcccccaaaccgcggctgacgccccgccacgtcacgcccgacccgccgcggttgggcgcgaaccgggtcgccgtcctctccagcctttgcgcgtgggacccaccgaaaccgaccggccggctggcgtcacgaccccccgccgtgacgtcaccggcctatatatatcgcggtggctctcggtgcgctctgcccagcacaatttgcatttcgcacgcagagaagagaaaaaaaaagggaaaaagaaaatgtaccaggcgatcccgtacaacgcgaaccgggcttggccggcggcgagccggccggcgacggcgg

SEQ ID NO: 45175 - DNA, 29353 bp, Oryza sativa
  unsure (1)..(29353): unsure at all n locations
tttttttttctttttctctcctattaggttcaaatcatctgatgcttttagcttcttttttttttcatggcattaataatggtgttgtaattagataggacgaaaaacttgaattcttttaggattttaataaggatgattaggagaagtgtgtgtccgttaacgctactgtacttaattaccttgtaactagtacctatacctattttcgaccatgtaaatacgaatgggagaaatgaagagaaatatttgcggtatttacttgtcccaaattcccggtgtttttccggttgagaatctgatgctgcaaagaaaaaatattgctgcacatgcgcttgcaaacatccctttctcttcctgaatgcgttgtcgccgctaccgtgcatgaacggcagcgtattggatgcttgtaattcatggccggctgttggttgttgtgcacctgtgctaatatttttcttttcctagttttgatattctgatatcacaattatatatttagacttccctcaaaaatttatatatttagacactattgttctaaacatatggagtaagtactaaaccttaagtttgattaatatttgcacctctctatatctgtcactgacattttgcagccacctgcaggatttaattcaactaaatctgtagcaatttggaagtaattaagccggacgcaggcaagcctgatcatcagcaaagagaatcaagcttcacacgttggcatgtctgtccatgagcttcagatagcagcattattccacgtcaggaaagcagaaaaccttccaaaactaacgagacacaagccaacctgcagcgtactattgtagtacgtagttgtaccatgtaagaaaaaaatatacaatcctatggaattatagatgttcatattctctactccacctgatcatgcatgcacggctaggccggtgggaaaaatgacaagaggcgaggcacatgagttgtcataacgtcattaacaaaaaccacacgaaatgcatttatatataggtgtcctttttcttccttgctgtcaaatgcgtaccaaataaatcatgcaatagtttggataccctacatttgcactggctggaatggcactagccaactacctaggatcagtcagtcccaaaaatcattatctagaaaaagttagtcccaaaatgaaaaaaaaaatcttgatgctcactttgaatttttttcacacattatgtggaacagatatcaaactgcaacagagaatgtgaatatgcaaaaattatagtggtttgttcgatttgtaggattttcaaaacataaaaatagtatgagaatatatatgcaaatctaagaattgtaaaacataggaaatcctatgcaaatctaagaattgtaaagctcgagtggatttttttttttggtgtgtgtgtgtgttttacatcaagtgaagggataaaatttttctattgtcgattcctttgaaacaatggtagttttagtgcccatttcaaaggatggtataattctatacttttccttcacaattttctcttaaacgaatgagccgtagttctttcgccctgtgggaagccgcaagctggcatgctacaaacctactacaaactgattgctgagttatacgagatgctgattgctgagtgcgtttccctatcatccctatggcactagggcatgaagacagtttacgtcgaaaagtaacccaagtacaaataaaagaagacttgactgaccaatcgagatatttttatatgcatctctcaccgtcccataaagtcataacagttttggagaagcaattgtacaactcaattcttcaaggaaaattgcatgttatgatcaggaaaatgcccttctgttagaagtgattacagcaagctaacacgtcactatcatcacaaattcattgagattttcagatgagctcacgccagagtaaggacgtttacagctcaagaagcacgtggcaagaaagataggggagaaaaggaaaggcggtgaattacaatcaagaaattcagattgttttcaggactgcaaaactttagtgcatgactacatgtctgtgagactctgaccaatcaaataaataaaatatatatggtgtaagaaataaaatgcaaatggaaaagactccgtgttaaccagtccagagtaactgacaaatacatgcatggtttcagtttcagcttgctacaaattgtgggcggtggatagatgtaattatgtaaaagcttaagctaactcttgcatatgattggcgttatgaatttttcttggtaggcatactaatcgcgcacacaaaaataaaataaaataaaaacaaatgatgccttccagaattcagattcagcaaagaaccaaccatgagacgtgctgacatatcagtggcatgataagagcgtctcagcttaacaataaaataaacaaacaagcatgtcgatgtaatccgatgacgattgcaaatgtacttagtctcatcgacgtggcacgagcaaggccacagtacgacgtgagataaagatctgcgagatcacgcagtgacatcaacatgtttgacaagttagctagcagttgggcggcaaatagtgctagtaaatggtttgcaaaagacacctacttgacgtcacgactttgcatatgtactcatcaatatacgtcatactcatccttaataaaccacaatctcccccttatgatggtttccagcaacaccctaagtggatgactttggctacatctaggatctggtctctttgttcaaccttgtcaaaaacttcggttcagaaatctagatgccttgtttcttaagtggattgttctttttgcactaattccatggaatctatttctccttttccaattagctgtgaatattggagtttggccgaccacaacttccttttgaagcttattatgaggcctaaagaaaaacgggccaccttttagcgttagggacttgagtgaaacagaagcgtagaggaaagaagagataagctatggtcaggcagaccagctgaccaggtggcaggtgcatatgttagtatggaatacggtgttgaatataaaaacaaacaaacttggaggcagtcaggagtcaggacgcaggagaaacgtgtttaaggtgtaaagtatggtaaaattgcatggcttaaagtcagcaacttaagtttctagatgaagtgatacagaatttggtattatggtaacatagcctgccattttcttttttttaaaaaaagtagaaattatgtagatccatttgagtaccgactttggggtgtggattctactccttctgttaaaaaaaactaatttaatattggatggaacttttcctagtatgttgttcagattcattgtactagaaaaagtctcatccaatactaaattggttttttatgggacggatgaagtaatgcaaaagagaaccatcaaattaaataaagtatatacacactatttccattgaatgctatgaattgatctacaatgctgagttcaagtatcttaccaaaacacacagctgaagtcatgggatgggcaagagtcatcatgttgtcatgcagatggcccatgaaagcaaccagtttggctgcaggccacacatagcccttggagtgatgcaagagccatctctgtgtatatcctcataataaaatgcggatttttcatggacagggtgtcaagatatgctcacatctgcgaaccataaacatgagagtaaatggcgatgaacacccaccaaaataatatcattactgagcaaatgatcaaggcaaaccccccaaaaaactcaattgtatttctttttccaaattaaatgaaagtgccagcaacaaactttcataaaatccttgtttttcttatggtttatggatcataaaattctcagtagcaagggaaaagacagataggactctcacatttacctttttccacagagagctggcacatcatgttccatcataatcgtgcattagtctgtttgatcctacaaatcattggcagggctgcagcattatataggaaaaaatctgaatcggttagcaagcgctactactaaaaagaagatagcaagtactaacaagcagaaacagtcggtggcccaaattttacagtttggacgatttgagtccattttagcccctgtcggctgaatagcatgtagcatgaaagataagcatcagtatgaacttgaatacatttgtagtgaaaagaaagtaggtaagtaatacatataaaacatggcatggataaaaaatggagaccagactgttagaattagctccgtttcagtaaaaaacaacaaagtactccatccgtttcacaatgtaagactttctagcgttgtccatattcatatagacgttaatgaatctagacacacatatgaatctagattcattaatatctatatgaatgcgggcgatactagaaagtctacattgtgaaacggaggaagtatgctacaggatacacaaaggtgactataatcagataatcagttcaagaaggcacatgtagatgtaggggagctttaggttttacagcagtaagcttcctgcattccagtcattaagcaacagtgtgacaccatagcaaagtctttgccttgaactaacacgtgcagagtggaaaaagtggaagccatggggtgatgggggccaggcttttagactatcactgtatcaactcttgttccccagtgaacctccatactgattggtatgtgagcttcaaaagacagcttcctgaaagctataaactagatcttgaagtcaacataagtgcaatgggcttctgcgctgcagtaaaggatccaactgaaacttcatcatggcaattgtctctagagagaatcaaaccatgaatcaaaatcgtccgacgcatttgagggtccggaattaggaggaacactgacacttgagatgttgtctttgcccttagcagatgtagtttgtttctgtccattcaagcacagtgaagtgtcagtgagcaagtcgtccaccaaatcatcaatagatgtagatatatctatctggttagcatatctgatgtcaatattgtggtcattcttggaagttgagcctggttcagcaaaaccttcattctggacagaaggagaagtctctgaaagcaagtcatctagagcatcgtcacaagcagcagtcacaagcagcagtcaccgatgatttggatgaagtgctaggtgtaactttcttatctggttgattgactttcacatcttgcaatgttgatttgtttccaaatgattcatctaaattggagccagaaagatgagttccaccaagcgtattaagaagcatatcaagttcttcttctgcagcaaccacctcaaactttgccccttcactattgttattatcttctccagtgtccaaatgcacagagtgagaactagtcttgggtgatgatgtggatttatcttcttcaaaacatttcaactgacaatctgctttcatttgatcatcacaacgaatgctgtcatggtcatgaatcaagctgcctttagcatcactatccacatctgtgcctctttgaatctgtatttgattgacctcagatgcaacagcctataacaatcaggcaaaaccatgaatacacaatgaaaaaaaaaatagcaaaagaaaatgatcttaatggcaagtaaagtaggcatatacaaagcttgcaattaaaacatcaatagataaaagcatccaaggcagggagaaacagctaacttactaagatgaatactaacagatcaaaaacctttatgaaccaacgacctaacaattgcatgaaccatgcacaaagctaagtaataagggctctaaatcatcccagttggctgtgtatatctacatgtgggtatagaggccagatttcagtccattatctaaaaataattccaatcgtcccagtacaataggtaaaatagacatagtttactagggtttaaatacccagtgaaattcattactctatctaatcctatgcagatggctattgtactgtacaaaaaataatcctcccaccactcagaaagtttggaagctaaaaataagctatgtggctgatggcagaactaagagatcgtagtgcagacagttaccatgatgggccactggcaaaaggtgcattagtgaaatatgaaaggtagatatcaaaccatagtgtggttaatgcacaaaatagagtgcctagaggaatggccaataggcagatggatatcaataataccagcagcaaatatcaaccagagcattgaaaggctgcattgcaggcagacctgccatggcaaggcatatgagctacaggcattaacagcagagattaacttgtagcaagtggaggtcaaaagggtaggcacctaggtgatgatgactactacagatcaaccataagggtaccagcccaaattgtccttttaagggtttgttttatcacatggaaatcagaataaggaacattgcacattttcattgtatacagattgggtgtcgccatagacccgtagacacttcaagaataatgtttgcatgaagtaagttaaacccctacttgaacatagtgtaaaggaccgtttgttcataacgattttttaaattgaactttagaaaaaacaaaacaagggtatatacaatttctcacggaaaagcaaaactacagttacagtttactaaaagtagacaatgtagcacatgatcaaatacatttgagtacttggaaaattagcaaaactaaagaaaattgctataaacagacgtaccagatcctcaggtagcagatctttctctaagaaaagcctctcagaaagcttaagcttcgaaagatgggtggccaatgcatgcagatccatggagagaaaaggtacctaaaagttgaggggaaacaaattctcacataaatatctaaaaatgtgatatgaagctgcccaaattcacaaggttttaagagttgatacacaaattgtaaggtacataatcaaaactacatgagggtctacaaatcaaaataaagtctaaattccacatccctgtctgttcggactactatcatcaagctatccagacaaatttcactctgtaaactgacaatagtctcgatgcaagaaacaaagagaggtttcagtcatagccccaaccatgctcaaacaaaacattttaatcatgtacatgtcattcgtctcactaagaccaaacattacaatagtttacttgatgtggcagcacaagacaagtaacaaacgtaatatcacagcaccaaattttacctcgaaatcgggtgctaaatcatcttctaagatgaagttgtcatcttcacaccaggacaaaatctcttcccctttagcttcaagcatagaggttgaagcctgcataaaatctaaaaaaaaaagaaaaataaaattaacaaacttagcaacagtggagaaagcaatcacaaatagtaggcccacttcccaaaggacacatcacatgatcatcatcaaaataaccgattacagacatcaattttccaaaactctcaaaccaaaatgtaagttgtggttatatactaactgacacagcagaaactccgtttgaactacctagcggcctacgagatgtatgctcaactcaaattctataaacaaaggagtacctcatgatgtttggtatgctcaactggcttcttaagtgaggtttaatatgactaagaacaaaatatttctcagtttagctagtgccctcgtttcgtgtgatcgtgtctatgtaatggtaagcaaggatcgcagttcatgcttgaagcgattctcccgatgagctttgtcaatgaggtagtggaggtagggtcactcaccgaatggcgaatcctgggaggagagacgctgcgcctcgcggggctgagcccgagcctgctcgagcaggaagccgaagtctgcgcccttgctgcgcggcgccacctcgccggtccactccgagggggccgcggattcatcggcatcgtcctcgccgtcgtagcggtcccagttcgacgggaggttgcggccgcgggggccggaggcggaggcggcggcggcggcttccgcgcgcttctgcctgtgagcgacggcggcggcgggagtctggtgggcgcgccgcccccgcaccgtgtgcgagcgcttcgccttcgccgccgccttgggatccattggagggagaagggagggagagggtttcggcggcgtgtttttatttgcagttaagtccctgtaggttcgcgattatttcatctaactccctgagatttgggggaaagtttgctttaggtgtctacttgcatatatttgttgataaattttcttctaaaaatttaatagtattttttaataaaaacatatgtaattacattatagcctgcatgtaattataatgtaatgaacctttagattttcaagagtttaaggaggaaaagaaatcacagcgcacgcatactattttactataaaattgatactcactaacttttaaatcacaatatataagtgtgtcgcatcatcacccaataccaattattatatatagtattttaaatcatatgtaagtgtgttacatcatcattcactagcaattattatctagagtattttaaatatcatgcaagcatgacatcattacaatttagttattatttctaaaactcaatatgcaagcaatcaaatcattatcttcacatcattttcatatttatcaaccatatatatctatcgtttctataatatataacatgcatttatttatctatgccgtaataaaacgtggggtatcaactagtatgtgagaagattcggccccacgaccttcgtttcacgaaaatattatttatgaatgattttctaaagttatatataagttacattataagtacatgcaaattacaatataattataccatgattgttgtgctataattgcatatatcacttttttttaaaaaaaaattgtcaacaaatagtattagtactatataggtagtccttcaggggtgtgtttgtaatttaaaactttatcgagggcctaatgaggacgccgactccccgccgcgggatcggctgccactccagtcccttcgcttccgaggcttgacggcggcggcggaggaggatgcgcttcacggcgtctccggtggtggagctgccggtgggcggcgcggtgctgacgttcgagcaggacaacgactccttcgaggtgggcacctccgtgtggccttcctccctcgtcctcgtcaagttcgccgagcgctgcctccgcgacccggcgctccccttcgccgacgtcctccgcttcccgggcacccgcgccgtcgagctcggctcgggctgcggccccgccggcctcggcctctcccgcctcggcctcgccgacctcgtcctcacggacatcgccgcggtgctccccgcgctccgccgcaacctccggcgcaaccgccgccacctcccgcgcgccccacgcctcgcccagctccactggaactgccccgggcaccttgcctccctcgcctccccgcgccgcttagacctcgtcgtcgccgccgacgtcgtctacgtcccggaatccgtgccccacctcgtcgctgccatggacgtgctcgccgacgccgaccgcggggtggtgctgctcgggtaccaggtccggtcgccggaggcgcatcaggccttctgggacgccgtgccggcggccttcccggtgatcgagaagattccacgggagcatctggacccggattacgcctacgaggaatccgatgtgttcgttcttcgcaggaggccgcgacagtgaactggtgagcaatttgcttaccatttgctcctcaatgactctgcaggtttgcaagaattgtttgttcagctccaaagttattatgatcatttggttgtgatagaaactgatgaaatttgcctcaatgtgttgatgcagtcagtggattagtgttagccgatatcgcgacggattcgaccgcgttgatgagtggatctctgccatgagttatggttgacgatacattttgttgctatttttgctactagaactctactagaagagcatattaagtggtattgatggatgttcatgattgattttcttcgtgctgttctgtgattgacaaaacaaaaattaacttgtagatttatcctcgctgaggatatccatgctcaacctttatctgtcagtttttattcgttttatggttgctacctttctgtctgaacttgtagaaactgtgaatgcttgtcttgatctcttcctaatgggctaataactgataagatatcagaaggtgtgacattatgcatcgcttcattgtgttttgtgcctgcaatgtacagccgatctagctcaaactgattacattggcacttggtagatattgctattgtggtttatgaaagactggtagtttggtaccgtgtaatgcttgaacttgtcgcttaattgtagactagtaagaattttgcaagcaccaattctgctgtgtctgtccataagcttgaaaactgaatgtctcaatgcagtatgaagcgtgtccaaggatgtgtgcatgaggtggatggggtttccatttggcatttttattgaatgtgtggttttgtgggaatgagcacggaattcgcaaccaaaactgacactccattctccacgcattgttcatttcttggatgcgtgatgtagatgattctctgctcattattcatcgacttgtggctgaatgttgaaaccaattgtagtcctgaatggatttgctcatatgcataggtccatcaagcctgtatggctgtatgtatctcttcgctttttagggatataatgctgaatgggtttgcacagatgcattgatgtccagttgaatgttgaaaccagttgtgatgctacttgcaggcatcgattgctggaacatgttttgtttcagaggaaatccgcgaagcactgagtgctatggaggaacattctgcagaggattcaaccttatgatgaactatttagcgtattttctgtgggtcccatttaccacgtcagcaaaaaccatttcccaaaacatcgaatgagttgatttataccaggtttctaagggactgtttggtagagcttcaactttgatccgttggtgtcataacgtgtctattggtgtctgtatgctaattatacttagatcatggtgtcatatatatggataagctatttagctataggttttgccaaaagtcgttagtatcgcctgacacctgccattatactatagatccgctcctgctcttccatttagctctaggagctgggtctagaatggagttgtggaactgcctaaactccacttcacatctctagttcattttgtgagagagttccacttagttctgctcctattttagggacatttaactatttgtcacttttaagatgtggcatctaaagatttgccacttgttgtctattacatgtgggtcctcatgtgcctataacatgtaggttctgtggcaaatctttatcatcactcataagaggggtaaatagttaattattcctctattttgggtggagctaaaactgtttggttgagctctagcttcagaagaagtgccaaataggctctaagataggggaggccttatacctggttttacggtcgagggaggttattcgatcagaagcaagggaggagggaggccggtgggcaaatccatttttaggtgggccaaatggaggcccaactttgtgtggcggtatacaggccgtgcagttgggctgggactccgccttccacaccgaaacggcccacgcgtaccgacgcacctcgctcatcccatcctagccgtcggttccaaatctgacggcatcaaggccctccaggccgtgctcatataggtttcctctccacctccagcccggactctcccgatccttccccaactcggcgtcgcgccgcctcaaccgaagcaaggtgcgtctcatctctctcgcaatcctctcctcctcttccaaatccctcgccctcctcctcgccttcgaaaatcgaggcccgattttttttttttgttcttcctcgcaggagcaaagcggggattcagaacgggaaggagaaggtccggttcgtccgctctcgaggttcgtgttcgtcgcccaaaccctaggttccctcccctcttctcgtttgtcgatctatgtatgttgttgcggtaggttttgatttttttttcggggttcggtgtgaacgatctgtgcctggttgatttcggtatgagagatgcaaatagaccgtagctgatgaaaaccgtagcagatcgaggctgctttgctgctactgctgctgtaaatttcctgtagatttacgttcgggtgtaaatattgaacaaattgatgcgattttccattggaggaaattgaatctacggtgactgctgctcacggttgctgctgagtgctgcttcttgcagtggggagcccgccatggttggattagatgggcggagcttgttttgtgggttacatgggtggttccttcaaccggccaaatcattttttatcatcagtggatggaagagacccttaggctagatatgtagttatgtgattggtcggtgtattacaaattatgtctaggtttctactgtttcattgtcttgggttgttttcttcgattgaagattaatgatctaaaatggtttgcagcttaggtttttaaaacggatcaaatagtattctttgtcgggcggatatttcaaggcctactccggaaggaatgcccttgtgcaacaggcaaaaaaaagtgcctctgtgccatgttgtttgatcttttttgcagttgcaggggggagaaatactaaactttctagtggaagagacacctctatgttgttaacagtgtccagatataggttaaaacttatcatgagcaacatctagcttcatgatttcttgaagtggattacagtcgtttgtttttgttctttctattcactttgttcttctaatattaacggctttgaataagtgtgcagattaggttaaaaggtactgggattagggttttcttgcgagagctttataatgttccaatcacacactgatcgtttcaggggtaaagtcacaggaatcatacttgttggtgatctcaaaagttaaaaatgataacatatgaacttgtttttatttagcatatgctccctttgttgtctactttttctgtatgtaatgcgctatgacgactctaaatcgaggtatttctttctccctgtagttaccagataagccattcatatacatatatatagaagcacttcttgagatttggacaataaattctgacaattttttttaatctttttgttatgtacagctcaagtgtcagttgaagtgttttgaaagtcatggcggagcatttggcttcaatatttgggactgagaaggatagggttaactgccccttttacttcaagattggggcttgccgtcatggggatcgttgctcccgtctgcacaacaggccaactgtgtcgccgacaattgtgcttgctaacatgtatcagcgccctgatatgatcacaccaggagtcgatgctcaaggccaacctattgatcctgaaaagatgcaggagcactttgaggatttctatgaggatatctatgaggagctgagcaagtttggtgaggttgagaccctcaatgtctgtgataaccttgctgaccacatgataggcaatgtgtatgtccagttcagggaggaagaacaggcagtcgctgcgcataatgcccttcaaggtcgcttctactcagggcgcccaataattgttgagtattcccctgtgactgatttccgtgaggcgacctgtaggcagtttgaggagaacagctgcaaccgtgggggctactgtaattttatgcatgtaaagcagattggcagggagctcaggaggaagctttatggggggcgatccaggaggagccatgggagaagccgcagcccaagcccacgccacaggaggggcaatcgtgaccgtgatgatttccgccgtgaacgtgatggttatcgtggtggtggtgatggttaccgtggcggcggcggtggcggtggtggtgacggttaccgcggcggtgatagttaccgtggtggtggtggtggtggacgcaggggtgggggcagcaggtatgacaggtatgatgatggaggaaggcgcaggcatggcagccccccaaggcgtgcaaggagcccagtcagggaaagcagcgaggaacgcagggcgaagattgaacagtggaaccgtgaacgggaggaaaagccttgaacgaaagcagtgatatctctatggatggccggttcatgccttcatggcaatcactatccgctggagtcgtggtgtgctgctatgttctaagtggatatttagtgtgtgtcgtttggtactcatgcttggctgagtaacccttttaaatgcaggattctggattctatttacattgtgtttcgtttgacgtgtaaaccgccgtttgtttttaaatatgcaatattggatcttttgtcagtctattatcctgtcaatgcgcttagaaatctgtgattctctactgaccatattgcttctcatgttatagcggttcaagctggcacctgttgtcttggaaaaaagaaccccattctttcttttgctcgtttcaactttgctgcctgttatttgtttggccttttgctacctgttgttgcttgaaactctataagtgtatatacttacgtgctgtacgctttgctcatagcagcctcaaaagctatacgaacgatacggcagcacgcagttcatggagtgcccgttgcaccagcagataaaaggcaaaataaagcccagcttggactgaacacaagcttcacatgaaattcgcaggatcaccccagaaaagcttaattcacagaatctcccaaaaaaagaggaaattttgtttttgttttttttaaggaattggggcatatgattatgtgaactttggccgagtttagatccaaactttttttttaaacttttaactttttcatcacatcaaaactttcctacacacacaaacttttaattttttcatcacatcgttccaatttcatccaaacttccaattttaacgtgaactaaacacaccctgagtataaactctgggcatacaaaccgaannnnnnnnnnnnnnnnnnnnnnnnnnnnggcatatgagctgggaatcctcgtaatattcctctttggcatatgggctgggaatcctggtacgacgaataatcgaatatccctcttcctgtgtgtggtactgtggttctccacgaaacaaggaacagtctggctctcctggacgaaatcgcaaagcaaagctggggctgtgcagtgcagtgtgcagctgctgtcactacgccgtgtgctcacgccgttgtctcaaccaatctcctctactactgtacgcgtgccgctgccggtattgctgccaaaaccagcacctcttcttgttctaagcaaaaaagtcgccgtcttgttcttcgaaaaaagaaattatacactaccgtgtatagctttctttgagaaacaagcttgagataaactaaacattattataagcaaagtgtgttacacttttcactgacgtgctagtgacaaaaccaattcgaaaccagaatcacttcgcagtgccaaaagctggggcttttcttgcggggaaaaatatatgggtgttgtcatccatctgatggctatgctagtgaataaacgtacttcatcatcttccggatcgtgatatggagtaattatgtttagctctagtatttgtctacgcgtcgtaaaaactgattattattattattcttttttttttgggttgctagccgcttgtgacaattgccatgacggcattgcattcttggaagttggatatgtgttccgcgcagatataaagacaagataatcagataagcatagtacttaaccattgaatatatcgtcttgcagacaaaatacatgatgtttctactcttcccttaacgatggcaaacgaggggaaagagcacatatagtggttttcttgatagaacgatgtatattttcttttcaaaaaaaaaaaagaaactatcgtcggtggctagctagtacggctaagtatgcgaaggttaagagaaggaacaatggtagcttatgaagaagagcgagggtagcggtgtgtggaggagagcattggcagttagagggtgccggcggtggagaagtttgttgtcgccacccatacctaatgaagttccttacatttttctcaccaaatagttctgacacgtggcgcactagttattgtaaagaatggtaatatagcttgttttatataaaagaaaaatttgagaaatatatgctttaaagggatacttggttaattatagtcagatcaattttattttctactattcaaattttatgaaaaatatatatttggatgaggataacttgtgtcccgttgtctcatcttttcatctaatgctcaagaatagggctgaactagaataatctacataaatttgttttattcttccttttttataattttaaagtacaattttaatggatatctggacataggggtagggtctagtcctaactatcatactcttatatccgcccccgttttcatccttatctatatcaatattttttttgtcttacgtaggtaagtagggttattatagttatttgtgtatatattgtttgaatatgtccaaaaactttagaaatataatcattttgggggttggaggaagttaaaaaagagagaggaaaatatcagcgtccaaaatcattgtgcctcgagtgtctcccgtacgtctcgcctcgcctgcgccgatccccatctcgcgagcagagcagggaagagggaagaggcgccgtcgtcgcgctgcatcctggtgagcatccgcatcctcttcctcgctcatccgtcccttccgcccactcttgtctcgattttgctcgcgttaaccctagcttctcttctagatctggaagaagcttttctcttaatttcggagccttaaccttaatacagcttgtttttcctccacaaaagtttggggggttcaacttattccaagttggatccgccactgattagtgagcaacttttagttcggagggtgaatggaagataaactttgacagctatgagttaccactgataacgtgtattgttttggtgagttgagtgtggttttatgtggaagttttctgtgcttatactatgtaatgcttaaatgtattatgagacacttatactttggtcactttcttgtgggttgtcagttgaagtgattttttctttaggcttcttaaaattgtcgccagtagatgaaccattatttagatgagcatgataagaattggttttctcagggggaaaaaatgcatgaaactagtccttttttgggtacagttctggtgcttttatggaaaaatggagttgtgataatagtttcatgtcattaatactttagaaaacttctgtgcggaataactctcaaatgcatagttaggaggagatactgtggattggataagtgtgtctttgtgggtaatgttgttcaaaacttgaaatatcagtctatatgagagcagcagcctcagaattgccttcttttttgttttatgcaactgcgttcttatggttcataggtggtttcacaatggattacactgtatatgcaacagcgctgttgactgagtatttgattttactgcaagaatggcttaagttaataagtaacacattgccttggaccctttgattgacgcaagtaaataatagtgactcattttttcttttgattgcaatttgcttacccagtctcttatttacactgtggtatgatatctatagagttgattattcagatggctgcacattgtcattttactcttttctgatatagcaaattatctcagatgtcaactgttatgtgccttgcctccttcatatccctatactttttgagcccacaaagttattaaaatttctaagatattgagcacacagagcatttagtcatggattcaccaaggcttttagatatactccagttttattctatgcttgatacatgtgcataaggtataagagaaatttattatgttgttaactgtttcttttacgatgagatggagtactactactttgaagtatattgtttttctcttattcaaagccttccaaaattagaacactcatatgcttgctttattggtaatgccattttattgttgtcatataaatgttattttaaaggcattagatttgttacatattcatcctctgatttggatataatttttatcaacattgacacccatcaagatcaagattttcttatggttattcatgttatgtctgttgtttgtttatagatgaaaatgaatgtatccatgtagatgtatcttaatgtaacaaataaatatgtctctgatcattattgtttattagtttttgcttccagctataggaaatttaatacacataattttttatgccttggtgttactcatcaaagcatgtgatcattgtgtcattgatgtttgtcaatatatctctccaatactataaacaattcattggagtgtaaactatgaatctgaaagtgatgattcaccatctaacacatgaattcatgtcaatgtttttcagtcatgtttcttgagtttataaagttaacattagtatgtgatatagaaattactaaattacatgggtcgccactcgccagcacaacggctgcagttgaggacagtttggttaggaaggttatctggtaacatatatgtacgtacctgccattcaactgctgtgtggcatactcttggagtggaagatgggaaactcgataattgaactttgcaatatactccatccgtttcaggttataagactttctagcattgcccacattcatagagatgttaatgaatctaagcacacatatatgtctagattcattaacatatatatgaatgtgggtaatgttagaaagtcttataatatgaaacggaggaagtataactgaaggaggcaacaaaagtgaagaaattttttgtacttggtgtatgctttttataggaaatggttttgtaaatcatgctatcatagtatattgtaaatcttatgccttaagaatcctgaaccttctacttgagatagacctgtctatcaaatgtgttagatgtgtctgcttttggcatattcgagcttttaggtctaagttaatagtgttctttatttctacaaatatgtagatttttcaacagatatatcccgaagctggatttcatttagtgtcaatctcctgctattgccaacactcaatgttgcatattttagttttgcttccaccctttcatgctactcatctgattgaactttttttaacctggatttgaagtacgaggtaatcaagtatgttgcttgttttgcaggacagatgatctaactaatcaactagccctttgcaacgaaaccttactaaccttgtattactagaccaatgtggggttttactaggctgaagtcttatggcagaatggcatattttatgttgtagtatgttgttatcaactgtacagttcaccaaaatgtgatcaaatcctgagattccactgataccaagcaactccagtataaatagcccatgttatagcagcagttgttcgcataccaagtttccgaccatgctagaggacatcatacttgatgcctttgaggttcattgttgggattgttggttatactggagacttaatatacgggattacagatgtttgaaaacaatacggacatgaggaattaggaaacgaaggtactaactggacgtcgctaggtggtcaccggttagcagactcagcacctatttgtcagtaagaggcagtaaccagtctacctggggttcggtacatggatgggatcagcattcaagcaattcaggcggtggcgatgcatgaccatcagagttagtgtgcctccgtaagcctagctagctgtagcaacacagggggtctttggtcctgggcagtcaatcgggtactgccttctggagtgatctcttgattgttgtgtttttattagtcaggttccatgtgctactgcacattattcgagagactggaaaggtgagtaattgagaactaggttaggaataaacccaatcaaatctctttttgcccatttcttcctaaatcaatctatgttatattcacttaaaatccaagcctcttttgggtatgccttccattcctggttaacatgtaaatactgcatttaatgatcaatgtcattcagttggagattttgtagatgctccttttcgaacataatatcctgcatgtaggttaataaatgagtagcctaacaatgcataaccagtacttgattatattggtggtaattgagataaattgttcatagttaatgttcggatcagttgaaagatttcacttgtagaaatatatggaggaataattttatgataaaatggttaagggagagagggagggttttgtttcaacgttagccggccaaacaattccatatatgggaaacatggttatgtttaggggcaagtgcaatcaccacagttcatagtggatggccgatgatgtcggaacataactctggagttgaaacttcaatatatttctgcgaaatgatatattccacaggccataaggtggtatgcttccattagtacatggcctcaacttaatcttttcagtgagaaactggacaaacatttctgttactttagtggcgaactggcaaaatagaactttgtaatgctttggtgaagtagttgaggtgcctcaagaatcaagatcagccaaatgtgtcttcttctctaaatttctgaagtacaaagtctttccttgcattttgcatgtctacttacgcgtcttggattgcactgcattgcatgctaatcatgtttgttactccagtttgcaggataggtgatgataaagcataatagttgaccaaactcgctgtacttctccttaatcaattatgttacaaagaaatatggtgtggacacatcaagttgccagtcctgaaaaccaagttcaacctgaaagtttctatcatggaggtgctgggagcaacttatctaacctgagtgtgcaagttgctgttggagttccaggaaatactgatttccggagtcactatgagagcattaatcttcagcaccagcatgttcagaatccatacccacatgtgggtgttgcttcaagttctgtgttcccatctactatgcacaacccctgcatatcaacaacagcagtggacagatatgttcctcctattcaaagttttggattgggcaatccactactactgcctttatatcatcaacttgctcaaggatccatggatgagaacggcagcagtggcaatttttgtgacagcgtcagggaatttatcaagaggaaaaatgcattacttgtgggtggccatcattttgttaatagttttgcaagctcaagctcatctgcttatgtgcctccaaatcctttacataggtcatggaacgcttcatttgaagcaaatatcctacccagcactggagtttccaatccaccagagtactcttctgcagattcactgaacaattccaattcgatggcttcacatccagaattggtgcatcatggcaattatgtatttccagctggtcacatgagccaatacaatgcatggattgcacaggcaagcagaactggtggagtaccacagtgggaacatggcaatgcagcggctaatcctccaggtaagtaaaccttgtaaatagatcaagtggaagttatgatattttttaaaatgatggtttgagggatcattttatggttagcagtggatttggattgctaaaattgtgaattgggaatagaatagaaaatagtgaagtgagtgtgatttgaatttgtaattggaaaaccttgctttcaacaggtggatttgttcattctggaaccatagacatgccaaatggaggtcttcagggataccaagctggcccttttgccaattattatgggcctctgccccatttccaccaaaatcctctgaatagcatgcagcatcctgctctatttaatcatatccaaatgcaagtacctcatcaacattgcctcagtaacaatttattgcatcacccttctggcaatggcctccccttggatccaagaattctggcaatttcatccaattctgggcatacctttgggcctacagctcagccatctttagcaaaccaagttaatgctgggagttcgagaattcagccatatgaggtgattcacatttcctctgttttcctcatagaacaatggcatatataactaattagatgattaatgctggatgatatatctgatcactgttttttcaacagttcctgtttttcaaactggacaatactaaatttaaaggatatcagaatttagttgaaaaatatcacctgatattgttcctggtacaattcatagtttttgaaaccttttaaggtttttttttccttgtgaaatgatttaaacatacattggctgtcatgttccagaaattaaattccctcgctttcttagcaaaccatataccatatctgacttttccctgcaacctttttatcttgtgtaccttttcctacaaaataaatgaaaacatatagttttcattgcggggtatataatctgcctattgctgtgcctggcaacctgctgaccctagtttggaaattaagtacctaatgctcagttgtttttttttttggctatgcataccatgtacatgaaaaatggtatccttggagttggctcactgaagctgaatgcctactctctttttttcgataaaggaagctttatttgtttcccatttgtgagccattttgtaattcatttcccattaatacggatatatgaagtaataaatttgtctctatagaatgctccgttcgtggatctttcgagattgtatgaagcaggagttattgatgaacatagagatatgcggcttgatgtagacagcatgacttatgaggtatggaatggaatgttagctcatttgggttgtgggttacatttagttgatagatttatttgctttcttctcctacaggagcttgtagcgttggaggagcggaggggaaatgttaatagtggttttacagaaagctacattgaggaaaatttgaagtcaagttcttatgtcccggacgctgattgcatgcctgatcagtcttctgtggagaaggatgcttgcataatctgccaggtcttcctcctttgtcattagtctattgtagttttcactactgtatataaatttgtatatcactagctatcagatgcatgatcaataccacaattgttccacaataatgataagcttcactcactatttttagaaacactacttttgcgtaagatagtgtacatatatccagttagttttgacatttgacagcaaagtagttaaatatacatttgcagccaatacatattttatgtttaaaaagggagtttgctctttgctatgtaggaggaatatgaggctaaagaactcgttggaacccttggttgtggtcacaagtaccatgcgatgtgcataaaagggtggctgatggtgaagaacctgtgccccatctgcaaaacaacagctttgccagctgatagaagaaacggatgatggatgccaataacatttattggtcatttgcagcaacaaacattcagctcagttttgtacataagacatgctggataatggttgtgcctgtatttccgttgttgtgatacctaaagctgtacagtgagaatcgctcatcttgtagattgttttagacactaaatgttccatgatgcgcgaacagctatcatcatggcatagctattagatcgctcaatttttccctttttattgtacatgatatttatctttattcttttcccaaaaagaaaaaagagaacttgtagttcttctgtacattgtgaaattcaaagaactaaaggagtttctcagctctggagtgataattctatagcagggcaatctttgttttaaatgtgcgaataatcattcatgcaggtatttaattgttcccatgtattttttttttgtttaaccaatcggctgtttggtttgaggattgagatggtcaattgaccatttgattctaaattgtttgtttcgtacgaggaataaaacaggtttgttcatcacttcattcctcaatatatttaaagaatgatcccacgatggatcttcatcctagatggcctgaatcctcaaaccaaacaactttttatgtgataaactgagaacattttgattgttccatgtcaaatgtacagcattacggatacaatgcaaagcaagcatgaaaagaacaagcatgaaaagaactagataactgtagcagcaaaaaattcatgagtagcagtctagctagcagaagagagaaactgtacagacaatgaactgtgctactgaaaaatagacagcaacatataaataaatcaagcggtcaaaccataatagaagcaaacaaatggcctgtatgaaaatctgacggcctcacaatttcatatccctaaactataccggcaagattatgtcctgaatgaattaatgtttcaaatggcaaaacgaaggagacacttagtaacacatgaatacagatgaggtctatgaatgcaataacatcctgtgtcctactgcatagtatcaaccacctcgggtatctccatgtttgtcaagtcctttcgatctacgctgatgaacaacaagcagactttttcactgcagagacatcatctttgccaccaacattgatggtctgcccctttggtggtgcagctgggtcatcgccgatgtcaagagccttcttgctcactacatgatatatctgggtgagcacttcagtgaaggcattctccacattcattgactccagggccgacgtctccatgaagaaagtgttctctttctcagcaaatgctttcgcatcctcagtcgagacagccctaaggtggcgcaaatctgccttgttccccacaagcatgatcacgatgttggcgtccgtgtgatccttgagctccctcatccacctctccacattctcaaaggtgacatgtcgcgtgacatcatagacaacgagtgcccctactgctccgcgatagtatgcgcttgtaatagctcgatatctacagaagcaacacaaaattatgataatttgctgtgcaggaactaattaataaacagcaaaagcgcatgaaacaacattccatcaagcacagcaggcaataatatgccgcatactccatgactccatcaatctaactnnnnnnnnnnnnnnnnnnnncataaagaactttttgtccccaatctacacacttcctaactccatgataatctagatgtctgtacaataacaatttcctatgataatctagatgccagtacgacaacaacctattctatgccaatgcctggtcctacacaatctttgcctacaatatcttaaaatttatataaaaatgtcatggcctggggcattttagggtgtaatcaaggaagtctatgaattgaaagaatgccaaattatcactcttcttcttaatcctacacaaggatttaatcacgccaatcatatgagcgcggcaattaaatatcacccgaaatcagagatccacacgagagaaacccactaatcgccaacgattaacgaatggcctagcctaatctaacaagcagatcaggatgagcggagctcgcgggggcacaggcggatctggggtggtgtttacctttcttgcccggcggtgtcccagatctgggccttgacgaccttgtcgtccacgtggatgctgcgggtggcgaactcgacgccgatggtggacttggactcgaggctgaactcgttgcgcgtgaagcgggacagcaggttcgacttcccgaccccggagtccccgatgagcaccaccttgaagaggtagtcgtagtcgtcgtccgcccggtacgccatcgttcggtcacaccccccacgaactcaaccttctcgccgccggcgctgcgcggcgagggggcggagcggatgggagcgaagggcggagggggaggggaggggaggggaaagcgtttgtcgcggtgggtgcggatcgatctcggtctctcctctccccaacttttttgggtggctttgtttgtgcgggaagggaatgcagttggttggggttgggttgggttagtcgcgcgcacgccgaaaattcacgggcaaaaacggctcgttttggtcttttttgtgtgtgcgtgtgcctcctgcctgatgcggacgcggttgggttgggccacgttttctttcaaacaggctgcgttcgttcgggtaacatttgagggagataacatcttgtttttcgcgcgcacgctttctaagctactaaatggtgcgttttaaaaaaaaatcctatagaaaagttgcttttaaaaatcatattaatctatttttgaaatttaaaataattaatactcaattaatcatgagctaatgtctcacctcgttttgcgtatcttcccaatctcgtcaatcaccttctcctcaaactcaccctaagttaaattgcaaaaactactccattcatctcataatataagggattttgggtgaatctggacaagaagggaggatctcataaattattttgttactaatgatatattatatcacaagttattttgttacaaatgttcatcaacttactcaaatttattgcaaaaatcactctagtacgtgtgcttaaccgaatcagaaaatgtgagccatcaatgttgttttaccaaaattaaatacttgattccacggatagaaatgttgagaaggatttaaatattatcgcactaagttttgctatatggagttttttaaaaaagttttgctatatgcaaagaaaaaagttcaatcaaatatgaaaaaaaaagtccaacgcaagcacttagaaaaagaacttaggtctagttctttttctctactcaaaacttcaactacctcgttttccgttagcacatttttcaataaatggtatgtttttgacaaaaaaattctatatagaaattgtttttaaaaagcaaacaaattcatttttaatttataatagttaatacttaattaatattatgctaatgagatttctcgttttgcttgcaacaaaaatatgtctccacaactccatatggaacagagccggtatgcagtgactacatagcgaaaggtttaaattaataaacggtacattttgtttagaagttaattttaaataatagataaatacatttttttagttttgtaaaaattaaaagttatttaattatatgctaatggttttttctatcctaacctcacctctatcttcggtagaaaccaacggcaccttaatcgcgtgtgtcaaatcacagaaaaaaaattggctcgtttgggggtaattttcgggcgttttcgcagggttatacatacggcaagcgaaacgcgtctgaagctgcgccgagtcaaggttgtcgacgtcgagaaatcgaaaagtctctctcgctcagaacaaaccgataccaggtcgcatcagcaacgcggcagcgcgcggcaaagtgagaattgtgctacgaagtttggaacacgcttgcttgttgttggctgcgtgctacgtaccacgtaccaccgcgcaccgaattgaagacgaaaaagaaaaattcggacgatcgagagtaccggcacacgatcgctaccagacaagataaagttttccgtgccacggatcaactcatggatcgatcattcagtttggagtaacaaaaattacgctgtggcgagatcgaaatgcatggagcagagaggattccgcgtcatgggccgtgccgcatgtggacgcatttggtgcttgcctgcctgcgccttttctgtttctttcctggccgtgtatcatcttacgccacattgttgtatgcagagtatgtatgtacatatagtaggagtatagtaatacacggtagtactagtataaaatgctacacagcgatttcccaaacgtatctggccatgcaagcattcatgtgttccccggaagtatttacttgggcaacccatgtggtggttagcagttggtgctcctctacctgtatttagctgcatgcatgagaatatatacatactatacagatcacaatttcagtcgacactaactcgatccagctagcgagcgcttcactgcagccaggaaggaaggaggtaaacgtacgttaacgatgtgtgttaatttgcctgcctcccacgtactactgtactacaggaacaaaaaaaatgtcgcgtctggcacggcaacaggcagggagattcccgacgcggatggcttgaatggtgtactggagtaggggtggcccgaccgggttggtcgttccttcgtcccgacgtgcccaaatccccatgtatatatgtgtgcattggcaatgggcattccattgccatggctgtggtcctggtcccccaaaaggcagtcccaattcgtgtctcgcccaaaggaggcaagcctgtcaggcacttcagcaaaatggcacgctgcctagcttcgccgtgtctgcatccttgcatatgcatgctgccatggtgaacacgctgttatggcccggcccagccagcccaaagatcgatcggttgtgcacgcacagccgggtgaaaacggaatcagaatcagtagcatctctttagaaacgacgatcaaccggtaattgattatatttaccattttaactactactaagtattgatattaatatgataaaaaagatattagaaaaaaataaaatgtaaaaataaaaaaaatgatatggttaaaaacggtacctaatataaaaaatagtgattgatcgatcgagaatttccgtagttcatccctatccacggatgaaccgtgaacgaaccaacttcgacgagacccaaagataccggggaaaaaagaacacatcagagcgtgcaaacgtgcacgtacccacccagccacccacggacccgcgcgccgtgtggccgtgtgtcgcatccacctcgagtcaatgccactgcaagacacgcacacgtacgtacgcgcgcatcacacgtacgcgcacgggtgcgtgcggatggtgcggtgcccggaatcgcgctgctccgcaattactccgaccccaatcagaaggcctcctcctcggtcgcccaccgcggaagggagggaagaaacaaacggacgcgcgtgcgtgcgtgcgtgagatccggcctggctacc

SEQ ID NO: 45176 - DNA, 19029 bp, Oryza sativa
ctgcgtatccgtcgaagtatgcattgcatctcgtcttcactggccggcctgcatgcccggcacttctcccggcctcccgttctccatatcgtcatacattatatatcccccacattgccatttaataccaacaagaaaccatcggatgatgactatgacggagactgagagaccgtgcgtgcaattgctgactcttgctgcgtgcgactgcgagaggaaacgggagtagtacgtggtagaatcctatcgatctcgatcgatcggtcggtctccgtctgctgctggaagggagagacgttgatcgatgtgctctctttcgcgtgtgcagctacgctgaattgaaggggagagggactaggagagagcatggtaagatgggatgggattgacgctgtacatgcacgttttgacctttcattggaaggtctacggtgagagaaggatatgcatatcagaagatggtgctgataagtgataaatctccaaattgttcgcagcagacttgatctatcgatcgggatctagggtgtgtttagttcacgtcaaaattaaaagtttggttaaaattaaaacgatgtgatagaaaagttagaattttacgtgtgtaggaaagttttgatgtgatgaaaaagttgaaagtttaaagaaaaagtttagaactaaacaatgcctagtcctatcattgcattatcagagagactcagaggaaatatatcaggtttttttttttgccgtaatactagttgctctctcttctttctttcttttatttttttgccaggccatatcaaaaaagcattctgattttccttttcagcttctaaccattactgcatttcgtttttttttttgcccccaactgattccatgtcaccttccgtcagttaaccgcggcgttgagagttcaacgaacagtgccagatgatggatggtacagaccgtgctaaaaacaaaatgaactgatgaacgctactgacagtctgacacagaaacaaaacacaacgtttcaaaacaaaatttagaaactccttgatccagtgatacagatacggtggtacgaatagtagttgcgattggggttaatctctagcacctcctgatattctcccatgcaaaagtactggtactaatagaaggccaggcagaaagtcatttgccttgtcttccttccttgacgatcgaactggacgaatcaatcacacctactagcgcgtacttccctacctgatatagccaccaagctatcaacagtgtaggcaggcaatgcatgtttgtatccatgatgggagtggattctaaactattagggcttcttcggttaatttatatgagggagagattggagaggagactaattccatacctattgtagtgtggaattattccccttcaatcgtcccctccatcttttcaatcccctctaaaccgaacaagacttaagaggatatcttttagttgtttacatgccatccaaatgattatgaaaatatttgaaaaaaattaacaagataaattaatatgtaataaatcattctatggagatgcaagttaaaatctaacttctacaagttgcaacgaaaaaaaattaaactacggttagtcagttaacatatatacgcaatcaaatttattttttgttgcaacttgtatgagttaaatttgactttacatgtttgtggagtgattcataacatattaatctgtcttgttgaattttttaaaaaaattataaccatctgtatgacacgtaaacaatgaggggatgtccttacgagagtttaaaatagttccccatccattattccacatatccacaaccatttttacgctgcaataatgtatcatttcaattactacaggactgtttgacggagagctctggagtctaagaagcagccgaagagaattcagcttgtgagaatggagaaaacgaaaaccatcttatggcttctcatgtattttttgagttctacaactacaatttctcataatctcgacgaaaagctgaacggttaggaacaacacatgattctcggagaagctctagctaccacaagcttcccaatagctttcactcttcatgtacttagtctatgcaacaagattcaacacctcccccatctcatcagccatcactgatctagctccccaaggtgcacatcaagtagtccaagggagcaaaacaaaaggaaggaggaagagtgatggcattaattaactgtgctgtgtaaccctgcacacatgtactggggtaggtgaggccattataagcttagcttcagcagagacaggaatactacacaggaagaaagccatagccagatccatagggttcttttcttccccctcactgttcttctacagacttcagagttcagagctgtagacgacgacacacaccggccggccggccccctactccctctctcatcatctcgccatcatccatccatctgatttgatcgttcgttcgttgcaaagcatatctcgatcgccagcagcagcagcatggcctcaccgaacaggcactggccgagcatgttcaggtccaatcttgcctgcaacatccagcagcagcagcagcctgacatgaacggcaacggcagctcgtcctcttccttcctcctctcgccacctactgctgcgaccaccggcaacggcaagccctccttgctctcctcaggtagtacatgcatgtcactgttcagttcttgcctaggttagggtttctttggggagttcttggttaatttgatcggtgtaatttgcagggtgtgaggaggggacgaggaatccggagccgaagccgcggtggaacccgaggccggagcagataaggatactggaggggatcttcaactccgggatggtgaacccgccgcgcgacgagatccgccgcatccgcctgcagctgcaggagtacggccaggtcggcgacgccaacgtcttctactggttccagaaccgcaagtcccgcaccaagaacaagctgcgcgccgccggccaccaccaccaccacgggcgcgccgccgccctgccgcgcgcgtcggcgccgccgtcgacgaacatcgtactcccctctgcagcggcggcggcgcccttgacgccgccgcggcgccatctcctcgccgcgacctcctcctcgtcctcctcctccgaccgctcctccgggtccagcaagtcggtgaaaccagctgctgccgcgctgctgacgtcagccgccatcgaccttttctcgccggcgccggcgccgacgacccagctgcccgcgtgccagctctactaccatagccatcccacgccgctggcacgtgatgatcagctcatcacctcgccggagtcgtcgtcgctcctcctgcagtggccggcgagccagtacatgccggcgacggagctcggcggcgtcctcggctcgtcgtcccacacgcaaaccccggcagcgatcaccacccacccatcgacgatctcacccagcgtgctcctcggcctatgcaacgaggcactagggcagcatcagcaagagaccatggacgacatgatgatcacctgctccaacccctccaaggtgttcgaccaccattccatggacgacatgagctgcaccgacgcggtgagcgccgtgaacagggacgacgagaaggcgaggctggggttactgcactacggcatcggcgtcactgctgctgcaaatccggcaccacatcatcatcatcatcatcatcatcttgcctctcctgtgcatgatgctgtctcggctgcagatgctagtacggcggccatgatccttccattcaccaccactgctgctgcgacgccgagcaacgtcgtcgctacaagctctgcactcgctgatcagttgcaaggtatgtttaattattagtactatgttcatgcatgcacggatgcccctgcaaaacaaagttcaattggaacaactagccatgcatagcacattcatggtcatgttgcaagtcgtactactactgctactgcttccccgtcccaagatataatcattttttattctgacacgatcttcgagatgctactttgaccaacaacatctatataaaagtaagatgttttaaataaaatgagttgcatattatgataaattatttaatgataaatttaataatatcaattttacgtggttgatatttctattattttgctattaattaatagtcaaaattaaaaatatttgacttgaaaatatgctaaaaatatttatattttggatggatggagtactatactctggccatagctagtacaacttgtctcttcccttttttgttggttatcatatgcatggattggatgctagctcagcagtttgcattgttcatgtttgtaagcatgtgcatagaagtgtctcctcacggggggtcaccaccaagctcagctcagctcagctcagcttggtgtagtgcatgaaacgttgtgcatgcatggccatggccatggctagctatggcctgtctcgatctacctgcaaccttggctctagcaagccttggcataattggagaaagcagagagtactcttgccgccctgatgattcgagtaatggctagagacagtgcaacaacgtgtccttttgtgtgttagctttgaacagttgcagcattggattgtgttgcattgcgtgcagccacaacagtgggcgtttatatgtagtacacggttggctccaatctcgatcttgcgatcacatgggaatgccaacagctacatatgtacgcatgcatggttgcaggcaatgagacaaggttaggctatgtaaaaatctcctgttccatgcaccgatcttgtcatgctatatgcagcatatatgctagctgttgatgcaaagagggacatttccatgacagaagggtagagggggacttggcagcttgtatgtgtgttatatgcatatgcatgcacgcgtagatctaggctgttgaaactatagcatagaaagggccgataactgtgagctgttctagccccccaagagtggacaaatatggatggtttcactaagaaagagtaattatattggctgttcaatttcttgatgggaaagcatcacatagacggatagacatagaccatgcatgcacatatctatatatatggtactcctacattccacacacattttgggtgtattccaaatgaacacttttatgtcatgaaaacaacagcaaattaagcacagaacacgttatgcatcttgagcatctaggagtgtagtacagtagttgtaacttcgtcacacaaaagacttcgtaacctggataagtacagctagcttgttggttgttgccttgttcacagttcacatgcatagtagaaccataagctaaccgagagaacctagatattaactgagaaattaaagggtcatgcatgatcatgtattgtacaatatgaaagtgatttcatatccctcgagagttatcccatcgttttgtgtatgccatctaaatagtcataaaaaaatttggtaagatagattaatataaaatatatcactttataaatatgcaagttaaaattcaacttctacaagttgtaacaaaaataacaaatatagcttattttgtttttttggtaacttatagaagttgaatttggtctataaatctttttaaaaaagttttataactatttaaatgacatgtaaataatgaggacgtcccctcgaggatgaaaattcatatccattgtacagtatgagaagagattagatgctataaaatatttataaaaaacaaactgaaaaaataatagatggataaattaatcatgagacagaacaaagagtggagtatcgatcaacagtgtcgtagtccagcttaggtctgggacgtggatcgagatcataaatggcacccttgtatggtcatgtcgcagtgcttcttttcaagaggcgataccggggttggggtaaaaagatctatcgaaggcttttttgatcaatttgcatgcgtacgttgttgaaaggattgaaggcgacggtgctcaatcaaaatcctctcttcttggttgttgctgctcgatctccaagcaaacacttgacttgaaagctggtagctctatctttcagggcgtttgttccgagattggacgtgtgcatggcatccttcttctcaaaaagatgctttcaacatcgcctctctctctggcttggatttccgcatgcatagatatgctagctttttggcagtcataaacttgccagaggtttgaatagcagactgactttttgcatgcacagatcagattattggtttgaggtttggaataggagagttttatataggattgaagtatatgaatttttcccatatgccgccctttggtttgaagtttttgagcgaaaatttttatatccttgattttttttttgaggatttcaaatgtaagctcaatacaccatcgtctatcttcaatcttcatctctccttgcaactatattctaatagtaatattttttcctctaaaatttctctaaatttcatgcaaaggatctgaatgaccaattggactagttgttgtgttttcagttcgtgtaagcctatatatatatacatatgtcatgacatcccggagtcctaaagatgttaattaaatttggtttgaatatataggtttaattaaagtttggtttgaaaatacaattccttgcaagctgcagggctgttggatgctgggttgctgcagggaggggcggcgccgccgccgccctcggcgacggtggtggcggtgagccgcgacgacgagacgatgtgcaccaagaccacgagctacagcttcccggcgacgatgcacctcaacgtgaagatgttcggcgaggcggccgtgctggtgcgctacagcggcgagccggtgctcgtcgacgactccggcgtcaccgtcgagccgctgcagcagggcgcgacctactacgtgctggtaattaaacctcaatttgctcacattaactcatataatatgtcgtgctaataaataatcaaaaaattaactagcattttctcgagctaattaattgagtgactttacagtcgttataaagagaagttatcatattttctaatgtaaaatttagtaactctcgttatcttcagtattattaaaagatatcaaaatttgcattaaaaatattaatacctattaagtactataaaattactctaattaatatgtggcttaatttatttatcatttttatgtactttcttatgcatgcaggtatctgaggaagctgtgcattgaagccgtattaccttgattacatccacaattcggcactgatcatgcttgctgcatgcgatcgaatcatcgatcatctaagagattctaagttaattagtaattcgctcactagtttggtaatagctagctagcaaccttcatcgatctgttatttcattcagtacgtacatgtctacttaaaatcactgtcgtgtagtactgtacgtgttttgctcgtctgatcaaacagcaacatgcatgacggttttaattttgatgcaataaccagtggagtaaaccacataaatctatcattgcaagcactgaaacttttggactctctttgaagcctgaactctgaacatgtatacatgcacggcgtgcatggatggtctgctgaaaactgcacacgctgtgggattcagagagaggcaggaagggaaacgaaaacattggtatggtctgcagggcgcatgcatgcagattcagagccttttcgcgcacttgaatgcatatgcatgagttaatttgcacactgtggacgcaggggaacacaagaacaatggcatgcatgcatacgtttcgtgtagggcagctgctggctagcttctcccgtacagtgtgctcgtgcgtgtgtgctgctagctgggaaagtgaaatcatccctcgatatcttctcgtttggtgcatgtcacctaaatagtcaaaaaattattaaaaaattatcaacatatattaatatgaaatatattactccacaaacatgaaaatttgaattcaatttctacaagttgtaacaaaaataacaaatatagtcgaatgtgtgataactgttttcagtttaatttgttattattgtagcaacttgtagaagttgaatttggccttgcatgtttgtggagtgatatatttagtattaatctatgttgtcaatttttttcaaattttttagtaactatttagatgacatgaaaaaacgaggggatgtgtcctcgagggatgaaaatccacatccgtgctagcttagctttcaccggtgaggttagctagcaggcaggcagacaggcacagggcaacggcagccagagccagggctgggctacgcagaccaactctctgtacatgtttaacatcactcgctcgcttcctcagaattaaaagcgaagctttgtcgtcagtaaagtaaacagcgggaaagtctttttagaacctagctagccaccatatgcttacatcaagattcgggcgtagagctcaagtgaaaacaatgttgcgagtgagaaatatatagcacgtatcacgaaagagaatttaatagtttttctcttaaggtacctaaaatttacactacataattttataccttgatatacttaatgtttatgtaggtaacaaattttatataaaaaatatgatatattctggtatctttttaaagatgataaaattatccatatacaagcgcgctaggtgcatccagtaaacagctactagcacgagcatgagaggtgagtagctcgtatgaattgtgttaagggtataatcctatgcatgtgaatggtaagctgcgttggtttttgatggaatataagccagtcgtcattgctaagaatttgatcgagttttcggtgctaaaaatatgtccttagaaaatgtccataaattaaagagtaaacttcactctagcttgtgtatactgatatatgttccgtaggtattactactcctttatttattggattcatactagattattaattagctgattatggatgtaattcctccgttcaaagatgtacttctagcataataattttgtctcaaaacgaagctatttcttcactcactctttcctctcaaccaatcacaaccattccctatttaattttttcacctactttcttttctcaaccaattaattacgatcttccttcaattaattctatatacttttttaatatccgtgctaaccggatgtagtaaaaaaaaaggcaaattgacgacgatgattacgtgtacagtacaaatttaacctctccgatattcatttctaatggcctgcaaaaggcctcaaaatgaatactatatacatacatgttacataccttgaacaaatcccctaaataaatgcagaataagttcgccttgggtctctctatttgttgtccagtccaattttcgtcccttgaccgcaaaaccgggtaccttccgtccctcaacttagaaaaaccaggcaaactttgtcctatggcagtatggtaggcggttttgacctatgtggcgcattgaccatcccacgtgtcgcgctgaccacgtttctcctcttcttttaccgcgtcgctgcgtcggcgcttcaggatggtcctctcctgcgtcagcgcggcgggagcgggagcagcggaggacggcaaggacagcgggagcgggtgccgcggcgctcgcggcggaggacggcggagtgtggcccactccagcacgaagatggcggcgccgaggccaccgacgagcttaaggatgacctcgccgtcctcctcccggacgtaggaccgcagctcggcgaggaagtcgccggttcgtgtaaaggcgagcaacgtggcggcgccctggaagatggcggtgaggacggcgggagagggagcagcggaggatgacgaggacggcgggagctgccgccgcggcgcttgcggcggaggacggcgaggacgtagaagccgaagccctcgtgcgcgatggcggcggtgaggtcggtcccctcctcgaggggggtgcggcgcagatggaaaatttggtggtctggtaatcgatcacaccaagaagaagaagaaagccaaaggcaccgtcattggctcctcagctctggagcagctatcctctgtgccggaggtaggatcaggtgcactgtcaggatgggattagttgtaatgagctgcgagtctgatgattggcgattaatgctttatggaatgttggaactccttatttttcctttatttgcaaaccgagcttttgtatgcaccatctgcttgtttttgtcactttaaacgtgcaaactgactggaaattttgtagaagttcaggttagaagttttgtaaaagttcagatgatggggagcttaatttccctgaactcaacagtgttgctgcttttcatcctgttcagcaaagacgcaacatttcgtactagttttttctgaagatttgctttgcaatacattaagagaaacagaaaatatgctgggctttcaccagatacatgatgtttgaagatgatagcaaaaatctaatctcatcaagtgatgtgtataaagagggcaatttctaagataaggcccagatatagcgcgagaattggattatacaacatcgtaaacaaaatcccatcttcatgtccactacagatcattgtgtgtcggagcacttcaaaacctcttgcaaacaaattcatatggaggaactttatcaaccgcagaaggagcaagtcaataactccacggccgtgggcggcggcggcggtggggggaggcacggcggggtgcccgctcgccgcgacgctggccgatcctggcggcggccgcgtgctggtgctggagcggggcggcgcgcccgcggagttcccgccgctcgccaccgcgggcggattcgttaggacgctggccatggcggacccggcgcccgagttggacgcgcccgcgcagaccttcgtctccgaggacggcgtgccgaacgtccgcgcccgcgtcctcggcggcgccacctccgtcaacgcgcccatcctgttccacaaccacggcgagaagcgtcagaggcgcaacgaggaagaagagggagagccgagaccaccatatttatttttttatcgctgacatgtgagccccgctatttttaaattattcttttgtatgtggctgacaggtgggcccatggtttttattattttttcaagatataattgccacgtaagcgccacgtgggacggagacctagtcaaataagccacgtagacgccacgtcagccaaaaccgccttcaaaatcaccgagggaccatatttgcctggttttcataagttgggggatgggtcgttcccgaatcagcctggacgacaaatagagggacccaaaataaacttattcaaataaatgcatatacacgctaaagaacaaccaatcttacggcccatttgtaaaagcccaaatcccccaatattttccagcccaatccccaggaaattgatttaaactgacttgggctgtcatccccatagattgacccttccaattgggcctgtagtctgtagcagtatcttagacttcagcacttcggatagctacctagcctagctacttgaccatctagcttaccttgccatgaacacatcactagctaattaattgatcatcctcttaattatacaagaggcgggaacaaataatcccaatactcgccaccaatctcctcgaaatcgatcactcctgcgtcacttttcgagcattcttgcatcgaaacttgatctttttctgaagcgaacgacaccatgtgatcacagttcgtcgcggtctgcacgccggagaagacgacgcttcttgctgcggcatcggtggtggtgttcgctctcggcctcctcctgcggcgcgcgcgggtggaggtctgatcggaggaggagcggccgccggcgaggtcgcgctcgaggtgcttctgcacggtggcgagcgggaagttgaggtgggcgcggtggccgcgcatgcggagcgccgccatgtcgtacgccagcgcggcctcgtccgccgtcgcgaacgtcccgagccacacccgcgcgcccctcctccgcgtgtcgcgtatctccgcggcgaacttgccccacggccgccgcctcaccccgcggtagctcctccgcgccgcggccgtcgccgtcgtcctgtagttggcgccgccgccgccaccgacgacctggttgtgatcaccgggggaggcggcgacgagctgtagctcgccggaggattccgacgcgagcgccgccccgctgagcagcagctcgtcccactcctctgcgcccatggatattcacctccccaagctcggcaacctctgcaagatcgccgaattctcctcctgaccggtcaccgccgacgacgacaccgccaccgacgacgacaccgccggcgacgacgacgacgtcatgatgctggcccacacgttctcgagtatgttgctcgtgtcatgaggctgattggaagctggagccgctccgatcgccatgaccgatcgatcaagctctgaagattttttctcttcttcttctgaagattagcacagtccatttgcaccgtgcaatatatatctatcttgatcgaggtggctgtgtcatagctgagctgacaatggctggctggctgctttgccgatttctgacaaagcaagtcagcgcgtgtggctcgtttgtgaagccagctaaggaatttgcatgagagggagaattcggtggcctgaaaatgagtgaacccgaattaattcagtcgcggcgcaagatctctgcagaaatccagggatgttcacgcgtgcatggtatcttgaggtggttgattttgtgctctggaatgcattcttttctccagcttggttgaccagatgcatggctaccatgtaatgcttaggtcagctccagtgtttcggagttcagatatcaaagttgcaggtgttctcgttaaagaatttccagctcatattcagaatgtcctttaagaaaaaggcatgtattcagaaaatatgtacaaatacttctttgggcacaataaatgtatttgccatttcattcatactttcattcgtgaaattggtgcaattttgagggagatgagtcatgtgaattctgaagagaatttgacacattcatgcatggcaaagtattttattcttatgtcagccatgtaattgcactgttgcagtactagactattggttatgacatacgacatccccatcgattacacaaaagaactatattaaacactaaacattgatcaggagcaaagcatctccttaatcaaattccttaacgaacaagataatcacataatgattgcgtcatcacaatagcagaggagggtttctttcctgaatccagttgcttgatctgcttcacaagccatgcatgttcatgcgtaccgtaggcgccgcatgcattcaggcacaagacccacttgttcctatcattgcatccacttgttaaaatcattgcatctgaatcgatctgtgggtcttatctttgaacacgctctaatataaatttataataatccttacctgacaagtcaaccgagctgaaaatatcactcaatccgaacaccgttttcaattcttcaggctagcatgcaagtcgctttctgataaaactgaaacagcttagtttatctgaccgcttgatcttgaagctaaatactagctaactaggcaccgtttagtataatctggagtttggggctggaacatggaagcagtgtggttgaagcctgactttctggaggaaatcgcgtgtttcccatcgttgcattgctcgtacgttggagcaggagatgtcacaagtgataagatgcttctgggtgcaggaactgaccgtgatatgctgcgatctctgatggtggccattgctcgtccacaaagggcagatagcttgggcaggttggaacagaatgttttgtgatcttttgcctctgggtcaactcatgcagtaatgcatgtatgacgcgatggttagcttgctaattggaatcgagaaataaaatgagcatccattttcacaacaactttgcactaccaagtacaatcgtttccgcaatcttcccgaactgcaaatcagggtcttgaaatcagcccaaacccccaaaaccactcttcatcgtgcgtggtgagttttgacttgaaaggccacacatttgacagttcagattgatgaattatctgatttttcctcatagctatttgagagtataaacgagtgaattaactattatgaaatagaaaagttgctttagaaaaatatattccaatatttattttacacgaaaatgcgttgattaatagcttgggaaacatctataagaaaatctaaaatatagaataataaaagagaacagggcataagccagtcataataaaagagagcagtctaagtcaatggttgtgtttagttcacatcaaaattggtagtttggttgaaattagaacgatgtgacggaaaagttggaagtttatgtgtgtaaaaaatttttgagtgatggaaaagttgaaagtttgaagaattactttggaactgtccaatatctcttccatttttcagacgaaacgtgtagctttattttttgatttttttaggctaatctgaactctgaaggcagtcatatggttgaaccggcccatcaacacaaatacaccatgggctcgaaccataacaagtcaagccagaacaaggcccacactatcatgggccggatcacggcccatctaaacaagcctttccacaagtcagcgacgcagtctgctctttcctgtcttctcctccacctttttatacaacgcaaatcgcctcgtcactactccgtacaaattttcttctggatcccacctctgctctgcccattcgacggcaacgcgctgccgcgccatcgcgccacgtcgcctcgtcttgcctcgcctcgtccaaggtcaacgagagcatgggaggaggccgggaggaggaggcggcggcggcggcgagcaaggtggggtactcctccggcgacctcccgccgtcggcgccgccgcacctgcagggccaggacccgcagcagtaccagtacggcaccttccagccgccgccccatcaccatgccgcctcgggcgagctcgcccgcccccccgtcgggttcccccagcccgccccgcctccaggcttcgccggcgccagcggcggcggcggccactaccaccaccaccatcagcagcagccctacgcgccggcggagccctactacgcgcagggctaccagaccgggccaggtatggccggtctctctcacactgactcctgctttgcttgtgctgctttgattaggtttggtggggaaatatggggaattgcaaatcgcaattggaaatttggaggtcttcatgagcctcacagcatcgctatgctctcaatttctcatgtccaactacaaattttcgatgcttttgtgcttgtggatgattcagaagcctgaccaatatgcgtgatccgaattcctaaccctcttatttctcttcacggatgggaaaacctacttagatttttgacttgggaaggaagatgaactagtcatcagctcaactacgacctggtctgctaaaatgtaaataggaaagtataaaccaagtttatggtaggaaaagagacaggatagctgatttaaacaactagactttcacttcctgcacacacgacgcacctttgatgattgaagtgttgctcatgacattggagaaactttgaggcgtgcaaattcatctaatttggtgaatttgaagtcagctgaatcactgaccataaacagattcagctgaatcttattgtgattctctgcccccccccaacacacacacacacacaaaaaaaaaagataaaagaatatcgtctttaacctcttattgtcgcatacacaatgatcaccatatccttctctatttttccttttgagataatgtaacttcagatcagatttgcatttattacattgaaaaacaaacaagtgaacccctagcatggaagtagaaattgttatatgatcatatggttcgtggtttctcaggttatggtcctattgctgagggaaggccagtaagaatgcgccgccttccttgttgtggtcttgggttaggctggcttctgtgagtgtccatgctttcgttattcttgccatactactgaagttaagtccaactccttaccgagtttatcttttgttcaaaaaggtttattgctggatttttccttgctgccatcccatggtatgttggggctttcatactaatatgtgtccgagtacatgactacagagagaaaccaggatatgttgcctgcactgttgctgtaagtatatttctactgatgcgctgcaatcacattgttatattctccctccgtcacaaaatgtagctatttctggctaagaatctggatcagaaatagctacattttgggatggagggagtattatcacaaatttagaggtgaatatgcaccttttgtagatggaatttcagtttatcttggatttttttattgtgaaccacatagaagtagagaaatgcagtcgcatggttatattattgtcaataattcagaggtgaacttggaccttacgtaaatgaaatttcacttcaccttggaactttcatttaactacatataaactactaggtcatcttctagatcatcactattgctttaaatataaattgcccacctgattagttcttcatagtagatgtccagttttttttgttcataaacggttgtgcttataacatgaattgccttcttaatgcttgaattgacttcgttttgaattcttctgcatcacaaacaggctgtaattgccgcaattgtcatccccttggggttaaccaaaggagcacacgtatggtgagctgcctccgagtttctaaggagtcactgcatgtaaatggcctgttattatttgagaccctgcactgggtcatatgatcatatcacttgtatatgtgtatggatggtaatatagtgagcaacttcagtgtggtaatcttatatcgaaccattggaccctcggtgttcatatactttgtaataaaggatcaatcatacaagaaccttaataaggagtaatatactgcgtcatatcagatcttaccctcgatgctgaaacgacctgaatattttcgtgttcatggataataataaatcaggtgagatgcatactcatatctattatattattaaaggaatagaaaaaggagcctccacgttcgctctcatggcctagaaattctcacattaatcggagaaaaagaaaagacagagttcatatagaaatacaatttagaaatagctaaaattaaaggaatagaaaaagaagcctccacgttcgctctcatggtctagaaattctcacattaatcggagaaaaaaaaaaagcagagttcatatagaaatacaatttataaatagctgaaatttggaattaaaaaataaggaatattagaagaggagacatagaaatacaatttagaaatagttgaaattcggaattaaaaaacaaggaatattagaagaggagactagagtccatatagaaatacaattaggaaataactgaaattcggaattaaaaataaggaatattagaactagagtccatatagaaatacaattaggaaataactgaaattcggaattaaaaataaggaattttagaagtagagtatagagtccatgtagaaatacaattaggaaataataaaaatttggaattaaaaacaaggaatattagaagtagagtatagagtccatatagaaatacaattaagaaaaaaatagaaattcggaattaaaaaataaggaatattagaagtagagtatagagtcgatataggaatttaaaactaactaaaatttggaataaacataataaaattaaaagtagagatataaagatacaatttacaaataactaaaattgcaaattaagaaaaacatgggaagaagagtttaaagtcaatataggaatacaatttagaagtaactgaaattcgaaattaaaaattaaagaatattgaaagatgagtttagagttcacatagaaatacaattagaaataataaaaatttaaaaataaaaataaataatattggaagaagagtatagagtctatctagaaatacaatttacagaaaattcggaattaaaaaaaggaaatattaaaagacaagtctagagtccatataagaatatatataatttataaataactaaaatttgatagtaaaaataattaataactaacacttaatattatataagatataatatgaatattacccattagtagttttgtaaagttattgcaaaatttaaaattatgttgtcattttaatatatttgaataatataatgaggaaacatatatgctattatatgagagaaaatataatgatgctagccgcgcaatctgcgcgggccactgtgctagttgtagctaatccgaagtaggaataagttcaccggaggtctctcaacttaacagcgagattttttgaggtaccttaaccataaaaccagaaatgtctacccctaaacttactcaaaccgttcaccggaggtccctcgacagtattttttgtccgattttgctgacgtggcatcctagtcagcaaaaaaagtttaaaaagtacgtggagcccacatgtcagctgcacatatttttttcttctcttttcttctccttctcttctcttttcttctctcccctctcttctccttcaggctggcggcgggcgcagacgtgatggccgagcgcggatgcgggcggcaggcgagcgcggcagcagagcggtggcgggcggtgggcggagcggacggcgggcgagcccggcggcggagcggaggctacgggaggagcagccgcgcaccgtggccgccgtcgtcgtcgccgtgggcgaggcggcacggcgcggccgttcagcggcatcggccaggcgtcgcagtggccccgcataggtggctcgaagtgc

SEQ ID NO: 45177 - DNA, 4945 bp, Oryza sativa
tgccccgcctgaatccgtgctcgccgctccgccgccgcactccgctccgccgccacgctccgccacctccgctccgacgctgcacggccgcgccgcgttgcctcgcccacggcgacgacgacggtggagagccgaagatgacggcggccacggcgcgcggctgctccgcccgcagcctgaaggagaagagaagagagagaaaagaaaagagaagaggagaggagaagaaaacagaagaaaaaaatatgtgtagctgacatgtgggctccacgtgtttttttaattatttttgctgactaagatgccacgtcagcaaaaccgggcaaaaatactgccaagggacctccggtgaacggtttgagtgagtgtaggggtacacatttcttgttttgtggttaagggatctaagaaaaatctcgctgttaagttgagggacctccggtgaacttattcctccgaagtaacatgaaccaaaaagctacggcccaacttcatccggcccaaacttgaaaatgaatcgaacaggaaattcagccccagaaaggccgaagcccacggcccattagggtttctcgtcccccacacataaatacctcctccgcctccgcctcctccctcgacggccgccaccccgcttaggtttaggtcttctccgcctccggtttctccctccgccgtcgaaatggtcgcctacagggtaagcttctcctcgccgccgccgccgcctcctccctcgcgttccgtcgatccatcgagcgtggctgatctcttcgtttccgtgtttgtgtgttgcgaatttttccggcggcgcagttccatcagtaccaggtggtgggtcgcgcgctcccgacccccggcgatgagcaccccaagatctaccgcatgaagctctgggccaccaacgaggtccgcgccaagtccaagttctggttggtgtcgcaagaactcttatctatgatgccttgatccttcgtgtaatttcgttgatgatttcgtgttgtttgtttgcgcgcaggtacttcctgaggaagctgaagaaggtgaagaagagcaatggacagatgctcgccatcaacgaggtaccgctcaatttgctcactttcaatttgactgccttgtccatgcgtatcaattgccatgacgtcgttacagatccgcaggctgccactttgatattagtttgtgctgtggtttatcttcctatctaattaggcagtgataagtatccaactcagtgacattgaccaaatttgatagatcaattttgtctccatggctggcagttattctctactggagatgctcggttacatataggacagatcgtggatacttatgttaggtctatctgtgcgccttatgactttgtgatacgaccgaaatgcttgattttgtgtgtctaaaaggtttgatcacaaggaagctgttaggcatttaataaacaattaaatacctttgctaaaacaattaaattctttatagagggaaatgtaatttaagcatgctgctaagttgctagtcttttttaattatttgtgtacagccacccatgttgatagtgattccactgtgtgccctcatcccaactcttttccgcattgtctttcgcagggtgtatgtagcatgtgccaagtcaatacatcatgcatttctgaaaaatcagttgtgttcattagtacttgaaactgtcaaattggtgtgattataatgttcgcacctgttgacaatgtgtcgatggtgttctaataaaccatcatctatggcaacaaattttgtaatgaattgattcagtaacattactaacatccgttataacaaattgtcaattgactgttgtgatgttgctaaagtattcttttttgttaattgtattttagtgtagttgcatcctaacaaaggtcatgcacgttgtagccatgaaatagtaataaattacctatattgcatcttgctggcagctgtatttttccttgaataatgtttacttatgtattcactgtaaatgaaaagattggcttgctaagagtctagtgtgatactacatatcttggagttgaatagttaaaacagtgcaacccttctaaacattctgattgtatctcagatctttgagcgtaaccctacaacgatcaagaactacggcatctggctgcgttaccagagcagaacaggttaccacaacatgtacaaggaataccgtgacactactctgaatggtgctgtggagcagatgtacaccgagatggcctctcgtcaccgtgtgaggttcccctgcattcagatcatcaagaccgcaacagttcacttcaagctctgcaagagggacaacactaagcagttccacaactcgaatatcaagttcccgctcgtgtaccgcaaggtcaggccgcccaccaggaagctgaagaccaccttcaaggcatctaggccgaacttgttcatgtgatctaccagtgtgtacccatgttctgcaatttagcccaagaatcaaaagattttgtctgtggaagttttggtgccctgctggttaggcatttccagtttcatatccaaatgatgcttaggcatttccagttacccttccaaatgatgctttgcaaacccttgaatttcctcgtattagtaatcagcagacttcttgttacttcaacctggctcacttggaagtgttgatccctgatgtgctattatttatctctgtaatttgtgatggcactgtctttctggtctggtcgaacgattacatattttacttcctgttcctgggtgttaagtcgctttgcattttattgattgcacccatcaatgctacattggcgtcaaatttggtcggagcactaagtatggcatgtacctaaccaaagggaatcagattcgcagctaattatgcgtccatggtttggtttcaggttgtttgaaaaagcatatgagtgaagagttggctttcgcagcctactctaaactattcccaggcaggacctattactcgattagccaattgatgcttttcgtgagctaacaattagagaacggtggttgttggaaaggagatcatgggcatgattacgcttcagatagctgcatttttcatgatatagtaactgacttttagcccaagatagtaataattccttaatgaagtagtatttgtgtagttagcatccgttagcacacttaagaagcagtgcagaaagaaggcacatttcagtcaggtgttaacaactcaatggtggttcaattcgaagaatcttcgcaagaatgcaaactaggaaagctcctcgcagctggtaaaatcatcagaactcacgaatttgtaccccaaaaggaggggacaggcgtggtgttcttgcagtgaaatgatccttcatcattttctcgaaggtttgaccatactgacttgtcaatttcactacaaactacgaagtaaaggatggtggtaacagcaaatgtactgatggtccatagagaaatagcatcaatttttcacctccactcaaaagagtggaagcagataatagtggcgtgaaccatttggtactgcaaggctgcagaaatttcacctttttctcatttgattcgtatggattcagtgtgagtgctttctggcccatttggccatgacctaatgagtgcaattgcagaaaccatagaacatatatgtcgtgtcttttctgaatttttcttcctgtctctgaactatttcttcttggcctttcatgcatgtgcatgtgagtgcagaattacagatatgtgcagcacgaatgcacaatctctcgtgtgcgtgtgtgtgtgtgtgagtgagtgagtgagagagagagagagagagagatgattgctcctatggagaaaaggctaaaaagaaggctgaattggtcggtcggtcatcataagagagtagcatttgcaaactgctgatccagtttcagagtctcagttatctctgaactctgaacccatcatttgcctctacacggatttgatctcctaatcaagaaacgcacgtacatttaccctgcacatcacggcatccaattaagccacagctacacaagtacaatcctaaaagaacaaaccaagaaaacctgtgtgctagcctacacgagtcgatagaaaacgagaagcaagaaagcgattagggaatggtgctgatcatgcttagctcgtcactttccgcttatacagcgaaatcccttgaccaaagcaggaccatctctgtccgtgcctgacaatgactgcttaacagttcatcccattaacaacaacttctacagaaataaagctctgaattctgttacgccatgcaaatctgaaatctttcagctctcctggtcagactttttcacatctttttttttatgctcacctctttttgttcgaggagaaatcacatgaaataaagcgatggatggatactcttgatcatacaatcaaaagagggtatctcgcaacatttccatgcacattgtagagtagagttggcatcaaacatgcagacatggagttggtaggagaccaagaggacgagattgctgggcctatggctcactagtcactactttctactactactactagctcctgtcaatggctgaggtgatgctgtttacattagcccgctgtttaagcattctgaactgctccactgagcagatccgaatcccagttcttttggtcaagacttcagataacatatcagagttgctaattgaaagcaaatactgcagatcgtctgagcttgaacgcactcaaaaacgactcatttgaaaatgaccaggtttagctagatgcaactgtactttaattgcaaggttaacgacatctagttgttggtgataaaatcatgcaataccattgacactgccatatgctaatctgtcggacaaatgaacagtaacaaggaaatgacacatggtggattactattttttttagtacaacacatggt

SEQ ID NO: 45178 - DNA, 890 bp, Oryza sativa
aaacaaggggctatgccccctctgtcgtaggacaaacgaatcggcaagccacctattcgcccactgtagatacacctgaagaatttgaagcctaatcgtctcctgggtggcataccaacagctgtacccgagccactgggaacaagccatagcgtacgaaaaccagtggaaaatgctgccaacgaaaaaggaagtacccaaaaaaggacttcataccataatcctgttggtcgtttggtgatctggaaggaaaaagaccaacaagttttcaagcacaagaagaccacagctcctagcctcctggcgaaaataaaggaggaagcgagaacatgggctttggcgggagcaaagtggcttcaagtgtttctaccaaatactacatagcctctgtatagctcggtacagcttcctcattgacggagcgtggggctcctcaccgggagaccgcgcaggcccccctttgccggttcggccggggacgctgagtgaggttcttcgccctcgatctgaggaaagtcagcgggagaggaagtgcacaagacacgggtgacgtagacagattcgggccgctgagaagcgtaacaccctactcctgtgttctggtggatctgtgcgtgaaggaatacagagaaccggagagcgagagtgagttcaggctctcgcccctcttccccagagtcccaaccccctttctcctaggcctgggcctcctttttatctggtcaggggtcaccacatgggcctctagttgcctaagaagggaaacatgctttttacaatgagggctagtctacagccggaaatgacctctgacaagcagagcacacgcctcctgccccgctcgcccgctttcccggtgacgcacatttcaaccttcatttaatggccag

SEQ ID NO: 45179 - DNA, 10377 bp, Oryza sativa
tgtgaggtttagctgaattttggaaatcatttttgaattttgggacatggtatcatccttatattgatgctccctgttttgatgcatgtaacaatctgagacggaattgcaacaggcgttgtgttgcactgaatatctgagtaaacaaaaggaaacttggagagtgataaccttttgtgctttataatgcagttatgcagaatagcctatgactatgagactggaaagttaaagagacattctaatatgtgttttcctacttgcgttgattgttagttgttgtactgtactgagccggctgctgttcatttatctgaactgtggggaattactctcttgatccagatgaaaggtttaactttgctgttaatgtgttattgattcagatcgatgttttgacttgccaactcaaattcatagaaattttgacactaactccctatgaagcattctgtatctaccaggattttaggctggaaattgccatgttccaaacaaggtcaaatgatttgtacttttgaaacgcatcaaagtccagggtgaacaagagcttcagaactaatcctatatctgatgtttgtattcagaacctctaacatttccttatatccctatggtttgtgttcgactcttttatctcttagagtaaatttcacaaaactacatattttatggttcaagttgtagaaaaccacacatattttgatacttggcacttaattacatatattttggtagtttagtttcacaaaaccacactatcgatgaatggattcactcgtgatatgacgacgtggttgtttcatctagtataaggacgtggcatcgtattaatttcgtgcgatggctggtaataggatgccatgtcctcgtcctaggtgaaacagccacatcatcttgtgggtgaatctatacatcgatagtgtagttttgtgaaactacacgaccaaaatatatgtactcaagtgacaagtgtcaaagtgcgtgtggttttctacaacttggaccacaaaatatgtaattttgtgaaatttactctatctcttatcatgtatatctatacctctaacaaaccaccctgtatcaaaccggagttataggctggaaattaccgtgttctaaacatggccaagtgatgctcgcaaacaagttaaggctgaataagaaacatttcagaactaatccatcgcaaaatttgtactaatcaagtacttccaccatccacaaataaatatagttagtactataagtctgaacatcatatgattaggatatatcacatctcattatattatatgtttgtttattttggaatgaagaaaatgaatgggtgataccgagactcttgagtcctgatgggctaaaaacccagaggcttacgtgtgggccacacagaagatatgtgggccgggctccaagtcgctaagtcgatgccccttaaatattaggaaaaaaaaatcctatttccaaaccctaaattccccactcttcctcccctctccctccccacccaaaccctcgcgccgccacccccagcctccgcccggatccagaccgcctccgccgccgagcaccatgggcttcgacgtcggcgtcgtcgccttcaacccggagggctggggccctcccgacaccgcgccggcgccggcatcccttggcggtggcgccgccgcggcctccatccccttcgcgcccttctcccgctcggacaagctgggacggatcgccgactggacgcgcaacccggcgggccccgccgccctcgccgccgcctcccgcgactccgtcttcaacttcacctccggcgacgactccctcgccggccgccgcggaggactcctcgttccgcctcgtcgacgccaagccgccgccgcgccacccgcggttcggccccaagtggcgcttcaaccagcgtccgcagctcccgcagcgccgcgacgaggaggtggaggcgcgccgccgcgaggccgagaaggagcgcgcccgccgcgagcgccacttccagaacaaccgtccaccacaccccggcttccgcggcaaccagtcctcgtcggccaagtcctccgtcgacatccagcccgactggaccatgcgtgagcagatccccttcgccaactttaccaagctctccttctccgtcgccgaccagcccgaggacctcctcttgtgcggcgccgtcgagtactacgaccgcgccttcgatcgcgtcaaccccaaggccgcacgccgcctcgagcgcttcaagtctcgcaacttcttcaaggtcaccaccaccgacgaccctgtcatccgccgcctggctgaggaggacaaggccacggtgttcgccaccgacgccatcctcgccgcgcttatgtgcacaccccgcagcatccactcgtgggacatcgtcgtgcagcgcgtcggcaacaagctcttctttgacaagcgtgatggttcccagctcgatctgctatctgtcaacgagaccgcgcaggagcagctcccagaaaacaaggatgatatcaactccgcgcactccctggctgtcgaggctacctacatcaaccagaacttctcgcagcaggtgcttcttcgcgatggtgagaaggttacctttgatgagcctaacccgtttgcttctgagggcgaggaggcagcatctgttggctaccgctaccgccgctggaagctggatgatgagatcagcattgttgctcgctgtgaagtgcatgctgtgaatgctgatccaggtggtggtcgtcagttccttactctcaatgcgctcaatgagtttgatcctaagattactggtgttgactggaggcagaagcttgagacacagcgtggggctgtgctcgctacagagctcaagaacaatgccaacaaacttgctcgctggacttgccaggctttgcttgctggtgctgacatgatgaagttgggatatgtgtcacgtgtgcacccccgtgatcactacaaccatgccatactcactgttatgggatacaagccaagggattttgctacacagatcaacctcaacacatcaaacatgtggggaattgtcaagtcgatcgtggacatctgcatgaagtttgaggagggaaagtatgtgcttgtaaaagatccagcgaagccacaagtgaggatctatgaggtgccttctgatgcatttgagaatgactatgtggaagagccacttccggaggaggaacaggttcggccgccatcagatgatgttgatgctaccgcggaggaaatggatgcagcggcagaggctgaggcgaacaatgcagcagcttctgcaggtggtgagggcgagaagagcgcagaagctgctgccgcttgaagggctcctcttcaggttgccagctagatcctttttggtttaattatctgtttttatggtttacatttaagagttgaactgcctgttatcgatacagtggtcttgtttggtcgatgataaaactgttctgtttttcatcttaaagatgctaagttgcccgctcaatgactatgttggtactcctagtttgatatcacttctggctgtttattgaccatgttactatgtttaaaccattacatgtgcctcattgtttcctcaaattacttttagggctcattcggttgtttttcataggattattgtaggaattgaatccttaggattttttcctatatgcatcatttgtttcataggaatggatcctaccaaattccaaaggatcgtggtattacaagctaattccgtaggattgttagcatgaggtgagatctcttggaaaaattcccaaggaatgtagtgcatgtgacatcctaatccttcacttttcctattcctttgatttggaaatcatatgaactgaataagccctagtcgttaataagcttgcatttgattattttatatggctttaatacgtttctgctggtgcggtgctgcgagcaagtagcaagtgtggtgagagccatgatgcccttaatcctgttctttgtacccccgaagttttttgaacgaactgtaccccaaagttaggattgcaatatttgcaactgggagaaatgaagcttggattttactgctacatggctttttgatacaccgcaggcatatatagcacacatgagtaatccaagttgattgctactgaagctgtcgtttatctgtatttcatttcaagctgctagacttaacagagcgtatcagtctttgccttgtgttttgattagtgtcttggctgcaaatgttacagattttaagtatgcttgtttcatcttcagattttaccttccttgaagagttgagactgttggttatgttaatttttgtttcttactctttgcattagtctgaagaatgaattcagttctgtagtcatatacgctttcacagttcaataaacttattgacaaccagaacatatgcaaccatctgtcatctgtgggctgcgattctgcaagctctccctaaactggcctttccatttggacaagttttcagtcgttgcatatcctttcttgggctgcatttctccctgtgttgctagctttgctaggcttattagatgtgactgttgagtctgtgacacattcaacacgcaggatcacgcagtccatccattccatccctttcccaaccaagatgacctactggctactagccgatcctgtttgcgtttgtttatgccttgctcaacttctctctcgatcgttgtcaccacggctggtgagaatcggatcgtacgcacccatcaacaaccttgcagtgcagaacccgtttactcgcgtcagtttcacagcattattctactgcctgcataacgctgtcaaccaatgccgtttcaaacccatcatatttataatcccatacgcatcatcatcgataagccacctgtttgttcctgggttaatttacgtgtcagggttatccgatacacacgctcgctgcatcactgtcacgatggcattgtactaccactcgtcacggccagccttgactactcttacaattattgtacttattgcttgtaaattggcatgatgtatgtatccttggagccaaagcgtgtcaagcgtggctgaaatgcccatttcctacgtgcactcgaatggatggccaaatcgctattactacagtattatcccaagcattagcaaaacagattggccaggaggcaaccatggctggtccactcaactcagaccaggcatgatggtacaagggaaagtaccaacaaatagcgtgctatcgcactaagcaccgatacagaaagaaaccgctggaaatggccatatgccttggatttcagtagcagtgaagcaccagcgtggattgtctgcagtcctgcagctgcagtagcagccgctgacatatgagaccggatccacctgtcagtcactgctgcagaggatttatatccgtgaagcacacatctatggagagagagagacaaggaatctaagaggttgcatcgcaggaaaggcagcagcaactggctgctattattccctcgtggagagccaaggtaagctacactagtagcctaaaacggaggttgttggttcagtaatcagtagagttcacacactgcctgctgcactcatcgagctctcctctctgtggtccttcctgtccatacgtagatacctcacgtcgcattcaagaataatttggattcgagtgccccccaagtgacccgaccccacgacgctgacgccaacgaaacaacctcttctgctgttcttcatcatggaaaattgcctggagccctggaccctgagcaaaacaaggaaacgtgaaaaatcctagtagtaggagtaggttctcatcggataactatttggactaaaacttttcagccgaagcacatcatctcactgattaggttaagtactttcaaccaaatatagatagtagatccttcatcaagccatttaagcaaagtaagctactttctccgttttacaatgtaagtcattctagcatttttcacatttatattgatgttaataaatctagatagatatatacgtctagattcattaatatcagtattaatgtggaaaatgctagaataactttcactgttaaacagatggagtaaccaataaaattgctttggttaaattggaaaagaaaactttgaccgatcaatccaagcaagttacttaccgatgaggcccatagtaactttttttcaggttcgtcggcgtggttttcagccggattcgccgatacgggcgtgcacggacagcggcgagcccggattccgtagcatgggcaattgggatggcatgggatgggacctcatttccttgtccatgtccgggctccaaaaacgtggccatccaccggcgtgttgccgtgtcatgcaccgatcgtccgggacatggacagccagcagatggagcggctgggctgcggttggagggagaaaaatcacggggagatactttgggtggctcaggtttgtgcgtactctcatggacccatcatttcgtttattcgggaaataagtaaaatggtatatttgtaaacggaagataatttataaataaaattgttatgtacgtgttcttatctcgatatgtaagcaaaggctaaaaaataaactttaataaaaaactttaaaatcacctctaaatttaagatcgaaaatttaaattttagctgataagtacaagcataagcaaaaacgaggtcctcggtttcgtggtgctgtctgatagtatgatgtagtgtacaggcaatcatgcatactatacgcagttgagcgtaggcaaagcgattactgtcgtgtaagtgaggaaacgtagggtggcaagagaggagagccagccatttcttttggatagaggtaaggagtgggcaagggaaaaaagttgaccaaaataataatggccgaccattaatcacgccttagcataaataagctacgagtactctagctagccgctggtgatggagtgcgatagcctgaaagggacgccgttctagtgtagtgcagctacgctagctgctcccgcgcgcgtcgtctcgttcttctcgtgttcccgtctcgtacgttcctcctcaaaatctccaattcttttagccgagaccgagagagggttagctcacgtgaaatccacccgcgaaaacggctctcgcgtccgcaagccgcggttggtggtcgcatcatcccgtactcgctcgcgtctgctccaaaccgattggttttcacggtttttcgatgttttgatatggctttggaattaatttttcggttgaaaaaaaatttcaaatgcttttggaaacttcaaacgttaaataataaatttcgatcaaaactcaatcgaaatctgttgaaaagccgtcaaaatctatcgaaaaccgtgataccgatcacgagttgaaatgcacggaagcaccgcgcgcgcggcagcgtggatgagcgccgcgtacgcgtacgcgaacgcgaacagagtagcagaaatcgtcgagcagatcatatccatcatcagatcacatgtgggcggtgacggaggagggaatcacgggccacacgcgcacacggcacaggcaggctgtcattttgattcgggcgacgtagctaagccaccagcctcctcctcggcatacgctacgtacgtcggtgcatggcagtattattggcaccgatttgatcaccgaaacgtgtgtactcccgagaaaatatctcttcttcttcctgcaggtgaggcgagagcggtggaggagtgcatttttcacgttcacaatgtggcgctactactactactgattggcaacaacgaccacacagccaacgtacgcgtcatgcgtgttccacgccgccaattctttactctttcacacttcactgatcactactactagtagtgtagttgcagctgctgctgctgctctcaacgactaattaacaatctattactattatatattgaattattgatccaattgatctacacatcgatctcaactttatatgggaaaatatgtagtgcaaaccatatatatagtgaaaacttggaaactaccattagatcgagaaatggatgtccgatattcgtccacatcaccatgagttaaaatttaactcggagtgactctacgagttaaattttaactcatggtgacgtggataaatctcggacgtccatttcttgatccaacggtagtttctaagtttccactgtatatgtggtttgtactacatattttctcactttatatggcctcgtctactacttggattatgtaatagacgaggccatagacggcgtattaatagaggaaaggtgactaggccgtccatcaaccgatccacacgtacctcgtcctattaattagacgatcaagacgcatacatatacttgttgaccgcgtttgattggcgccccaagatatcacatccgggtaactgtttactcggaaattaaaactacatgttttgccgtgtgtggctcgtgcttgattcgttagtactagctagcttgcaaacattgcattgcatgatgctatactgtttctctaatagggcgatcgcaaattcacatgttgtgcacgtatatttctctatcgatccaacggcacgacatcgatgtaaatatttcctttggtttttaatagatggtccaatttacttttatacatttaattagccatttatcctattaaaaaataaagtaataattatttactttgttgtgttttatcactagaggtattctaagcatggcctatattttttatatttaccaaaaaaaaatgaatggtcacaatatggttgccatcgagtcagattctaactcatatttttgttcaagttcagaaccaaatacggttagtaccggataacatgatactcacccctcctatattttttcctccgtattgaatttgagaacagacatctacatgtatctctaattaataaatattacattaggaagataattagagtattaaaaacataaatcatggagaaatatacaatattacttgtgagctcgtaaaatagtgctaacgaatcttttatcatgtttatagatgcatttataatatatttcatatatatttgataatatgagagatacggacggatacaactctctatatcctcggatagaaggatattcttatttttctctcccatatccttcccgcgagaatcgggtctaatggatgaaaatacccattccattttgccccaagttcaaatataggaagtaatttaaaaaggatatggtacaatttagctgtagcaggtgtgacaaaattgccggcacagcaatttggtgccaccgacgacgcttctgatccaccttggcgtattcaacagtgatatatatatatatatatatatatatatacttatatatactagctagggcactcaactgctcaagaaaagaaaaggagggagagttgccttatatatttatagagcagataaccgctcaaggtatattggtatattgtagtagtggacaaagatataatcaatattaattaacaacttggtcacaattaatatattccatttccaaaatatggtgataaagtacaatatacttttactccctttgttccataattcttgacgttttgaataataatacgttctccaaaatgttaggaaacgatagacaaacaaacgataaaaaacaatagatcaatcacagaagacacgggatttaatgtggaaaaccctcccaaagtaggagagaaaaaccacggtcgtgagccagcaaaatatattcgctatatcgagatgaggttacaacaccgcatggcggcttacaagaggtgtatatgtgtatatatatatatatatatatatatatatatatatattgaggtgaaaccctaaaaggtattacgatcctgcccagcctctggcagggcctccacttcgcttcggcagaatctagcctttattaaatgcagatgaatttggatatctttgactatgtttttcaattacaatgtacacaataaataaaaacaattttacttttattatagtattttgtaagacaaatctatatatgttgttttagtgcctttaaactaaatattttaaaagatatttataatcaaagttataaaagtttgatattaactttatccaaaacgtcgggaattatgaaactggagggattactactaatcctacttgacgagtgcattcatctacacattgacaacgaatgtgggtgacgaaagaaaaacagattttctgcgtcaccatttgtcatcaaaagtcaagtgagacccatcaaggtaaataccaccctaagcattactaatagtatcctaagcatccgactcacagccctcgtggacttgcttgaaacaaacaaacatgtgaaacacagaaacctatg

SEQ ID NO: 45180 - DNA, 4057 bp, Oryza sativa
gcctgcaggtcgactctagaggatcccctatcctaagcatccgactcacagccctcgtggacttgcttgaaacaaacaaacatgtgaaacacagaaacctaagttatgcttggttacatacatgtgaaagaaagatacagacaaaattatctaagttatcctgcaaaactcaccaccgacttctgcaacttcaactacgatgctacaggttgattgcccggtgcatgagcaccactggtttcttgcttaaatattactgttacctaggcttgcaagttgcttgaacaatatagcaagcaatgaagcgtgtgttgtgtgtggacacaaatcaaattaaatctgcagagagaggggaagaagccaagcaaaagaaattaaaggcagagagattagttttggcagcgtgtgacacatctcggttagttgggggatcggtctcgcggttcggcgccaacggaacgcgccacctactccaccgcgctgacgaagccatcgctgacaaaatacgtcctgtgctcgagtcaccctttagatttaacaaaaaaaatgatcaatttccatcagttttgtttcagaaaataatgctactgtcccatatgattcttttccccggatactactacagagaatcaagattattcttgttggaacctgctctatctgtctcaatataaattaatcttttgtgccagatctagatgtgactttgggtctaaattcaccgtacatcctcacatcccgtacaaaattgatttattttgggacgaagagagtatttcgttgtggtgacatgtatttgcagacattattgctaatatacgtccttttcataatcattctagatataaatcagtgtgattgaaatcttgatcattttggttctccgtaacttctagaatcctattcgaaccgatgcttcttgtcttcttgaccacaatactccctccgtgcaattcgtacacacaatttcacattatgttgcctatacaatattaggttggatcaacccaatatcgaaatgttagcatttgccatttagtttatcttaatagacacttcgatccatcttcacatacaaaaaaacacacaatcccatattaagatttctatacaacaaacgctattctagtcacaccaacaatatccgaatatcacacgagaaaatcccaaatttattcgtcacggaagacgcttggatccttcttcacacgcaaagccaccaaggcggcagcagcagcagcaaccattttcacatggataccgaaaatacccctacaaatacccctaggtccacctcgactcaactgtcatggaagggcaagaccgtccattcccccaaaaaggccacgtcacccaccgtggatggtagagctgcttggtttttaacacaccaccaccaccaccaccaccaccgcaccgctacactactcggctcggctgcttcttcttctccttctcctcatcctccacatcgctgcggattcgagcggcgaggcttggattttctcccggcgagatctccccggcggccgtctcgcgatgcctgaggcaaatgcgggtgggcgggcggcgccggcggcggagcagcggagcaaggtgggtggtggccgtgggagaacactaaagatttcgctgctgcttcgttttgtttctctgggttcttggggttcgtcgccgtgttcatctgaacttggataggctggacgaattggtgtttttttttgttttttttgggggattgtgggttctgatccgaagaagtttggtgtcctgctcctgcgcgtgagcgtaaacggcgtcaggaaattgctcccggatttggagcggattcttgccttgtaggaagatcctatcctatcatatcctatcctacctgagctttgcgagcgtttcctgaaatctttcctgtgcatctgcaagaagccatttatctctttccttaaaacgtagtctcctactacaaggctgattgacttgtataaacgctactattagcccgtaataacacggtaattcttgtttggttcaaaatcttggggtaatgggtaagtttatcctaatccaagcaagctgtattttctttccgggatatagcactgtagatatctttgcccacttaaaaaaaaggaggtatatttttacttataggtttgagccaaaggtgtatcttttccagactgatcattaaacttgtcaagaattagggcgatcattagttcaccacagcgggagccgggagtagaggtcaggtcagtttttgtttggtcaggctgcagtgtatctgtatgtttctgtaatccggttctgtgaattacttgttgcagaccttcagtctgtggtttccagtcgtcgagcatagactaggcaaaggttactgtttcattggtttttgtttttgcctttttggttgtgatgtctttggtgcaaggagtattattaggagttcaattgcaagctgtatgtaattggttaactttttttttttggcaaagctttttagtatcccgataatgcgaaacccttggttttgtgattagttgtgttgcagctgcttaactcttggggaaagatgtaactcagtgaatttgtgctttggtccaattcacatgccattgcctaaattatgtaattgttcttggatgccattgtgttttgagacagagtgctgaattttcaatcttgaattttgtccagaacacaacagagatggatttcttcagtgaatatggtgactccagccgatacaaaattcaagaaatcgttggtaaaggaagttatggagttgtttgttcagctattgaccaacataccggtgacaaagtagcaatcaagaaaatacacaatatctttgagcatctatctgatgctgctaggatcctccgtgagatcaaacttctccggcttttacggcatcctgatattgtcgagatcaaacatataatgttacctccatctagaagggacttcaaagatatttatgttgtcttcgaactgatggatacagacctccaccaggttattaaggctaatgatgacttaacgaaggaacatcatcagttctttctgtatcaaatgcttcgagcattgaaatatatccatactggtaagcatattatgaaatcttacctaccctctgaaagttcttctatcatggtatcacattggagcttctctgagttaggattatgagcaattctaagtagtgcatttgcacaaaaagttacagttttctattaagcaatgcgatagtcttagtcttattgtcctgtgcattcttgaagtagcagtcgaaattttcctagtgccatttcttctgtcttgtctgtatggtgttaaccatgattctattgatttcccaagatagctgtgaggttcagattatatagagctcttctctttgtattgaaatttctttgacataagtgccaattgccaaaaatgtgctctcaattcaatagctatcaagtcgtgttcagttcagaaagtcttctgttgtatgaatcctgttcaaattctgtctttggatctgctagctgcagtaactaaatttattatatctcaattgagcattgagtatttatctatgttctgatgagaagtctttgtgggtgcagctaatgtttatcatcgtgatttaaagcccaaaaatatattagcaaatgctaactgtaagctcaagatatgtgattttggactagcaagagttgcatttaatgacactcctacaacagttttctggacggtatgttattttcaacactaagttctctatggaaaactagatgccatgtcgtgttccataccaaagaatttgtcatgcaacataagtctcactgtctgcttcaccatgcaacaggactacgttgcaactagatggtacagggctcctgagctgtgtgggtctttcttttctaaggtataatcaaatttcccaacctgtgggttgctttatcagagtattatttcgtgtgctcttcattttcatagggctctacagcataagaaattttagcaacatgttccaatttcttcttcttatctattgaaattgaccttg

SEQ ID NO: 45181 - DNA, 9253 bp, Oryza sativa
gttagttttagagtagtgtagcagcatattaatagcaggtggcttgttcaggaacatatttttgccaagccaaaatacactgcttaatgttgcaggtactcctgtaaaatctgctgtagttgttttttgttatccctaccttcatttttacctccattcctatgctaagttggtgatactaaattgattcttttctgcagtattcaccagctatagatacatggagtattggttgcatttttgcggagattttgactggaaaacctttgttccctggtaaaaatgtggttcatcaattggacttgatgactgatctcttgggtacaccatcaatggatgctatttcaagggtatgacttattattattatcagaaacattgacatgtttaattctccagcacaaattattccaggtctgatttttccatgttttgactgcttcagattcggaatgacaaggcaaggaggtatctgagcagcatgaggaggaagcagccagtacctttttcagaaaagttcccaaatgtagatcctttggcactcaagctcttacaaaggcttctagcatttgatccgaaggatcgacctactgcagaagaggcatgcaagctctacttgaattagattagttttcatgctactgttttgcattgtcatctgtgctactaaacatagttatatatgcctactttagatgttattctaacaatctattttgtgtataatcaggcgttggctgatccatattttaaaggccttgcaaaagtggagagagaaccatcatgccacccaatttcaaaaatggagtttgagtttgagcgaagaaaggttaccaaagatgatatcaaggaacttatattccgtgagatattagagtatcatcctcagcttctgaaggattacatgaatggctccgaaaacaagagctttctatatccaaggtttttatcttgacacatcttataaattatttccctgtttatatggctatattcacaacctttatttttgttatgtagcgctgttgataatttccggaggcaatttgccatcttagaggaaaacggaggaaagagtggtgcactagataggaagcatgtttctctttcaaggtaacttacatcgttacagttctttccaatgtgatcataattgccaattcagtgatttgtgctgccatctattgcatctgttaaaattaatacacaagggaagaaaaaatgttttaccattagtattgggttatcttggctgtcagatcctagatattgtgcttgaactttgcagctgacctttgatcggctctttgcagggctacaacagttcactctacatcaattcctccaaatgaaggcctagatgcaacatcccaagttactcaaaggatcccaacaggtatctgtttatctttaccatttgtgacttaatccagtgtacattttaattttgaattcaaagagcattgatctcatatatttcatctttgtcactcacagctagaccaggaagaacggttggtccggtattaccattcgagaatccaggcgccgcagatccgcacagcgcacggagggtggtgaggaatccgatggttcctccagcagctgccaacaagtcaggatacagctacaacctaaagtcagactactctgataggcaacatcaggaagagcttgagaaagatcgtgtgcagtacaggcctgcacaacacttgatggatgctaaagttgctccagatacagccccggacatacggtcttcacaatactactttacgaggagtgctcccagaactgatctaacagacagggctgcactccaggggagcatgctatacggcattgctccgttcaacggcatcgcagcagttgctggtggatacagcaaggttggtgccgttcaatatggtgtttcaaggatgtactagagttttagtcaggcagttgtggaattgctccatagatgagcaagatgggaatgccggagcatggctttgtgttgtgcccatccacccagatataaggctggcaagggaattggtcgcatctggtcatggatgcaggcgaaggttgaagaaaggagaagggaaactcctattccatctcaggcggccattgtccatttgaaatggcagtgagctcgcgatggtgaaagaggaaaagagggagagaaagttcatggtggaatttctcgcactttatttgttgtggagaaaaggagaaaatgtgaataacagcactaggctgggcttgtgtacatacctgcaacccttgatttttttttcttgttttcttgctagaagctgttgcttcttgtgtaaacctgcaaaagcatactccgaaaatgaatcattcgccaaaaaattgagacggcggattatttggtagaatgttatgctagctatccaaagtttaatcttgttgaaatgaggaagcaaaatatgctagtgatatttgagcctccagcccagttaaacaagcaaacaaaagtcaatagaaagagcaatttatttgatgtacctttgtttcagtttcaggcttgggcgcctggtttcctctgctcgcatctcacgcaggatccatattctgacggacaaattggattgcaaaaatatcattcgttgaattttgatgtccaaactcctaagtggatcaagccacaaatattattcacgacccatattctagcgggccatctttctctgtggcatttgccgaagaacatacaagtaggccgcacatgaatgggtcaactggtgttaaatctaccatccaacacttttcaaaaacaaaactactaccttgtgcttactgtatttctatgatacaccttgtcaggtagaacctattgctggacaatctctatgacacacaccttgtcaggagagcagtagttcaagacactagtgacctctgcatgcaagcgatgacagttcgttgcctctggttggacatcgacccattggccatcgacatgctcgacgtgcacatgttgctcctgctgcgcagagaacctgagcttagtaacatctctgcacatcttgtttacgtggttcatggaaagaatcagatcaaaatcatcttctgtttccttgctgctcttgcgaagcatgaggccagcatccgcgccaaaggagctgacagccccaaacagcaacggatgcccaaggtttggcttattggataagctgcatatctgccgtacaggtaagatacatttcaggtaccggtttatgaaggaatagaatcaagaaataacttggataaaataaagaggaagaagtgcaaccttccagcttgcatggtcaaaactcaaaagaaagaaggatttgaaacattagtatactacactcagagatgtgtttcacagtgcagtgtcaagggggtgtgtggttttaacccccaacacgctcacaatttcttcttaaaaaaatgtttggagagacgtctccctccaaatctcgtttgttttattagtatactacactcatcactgcctcactggcagtctggcatttggtagactatatgttttcaggcagcggtagtaacaaatggtaagctacataaaaagggtgtgcttcaagtttctaaagaggtaatcgaaatgaaaatgtaacaattatatcatggctttatataacacagtgttcctcttcattcttgactattgtgtacggagttcccagttcataatgaacagaattattagaaaaaacaaagtaaatgactgaatgccaaatgagtgccaggacaagaaggtgaactgcactggatcttacctgtacatactccacacccatttcatttagagtatctaaaattttatttgatgatagcaagctgaaaatcaccccagttcctgctggcttctgtagtatctcccatggagacttcaacagaatcttcctgctgtttagcttagaggacatactgacaatcggaagtttcatttcttccagaacccatacctgcaaatggattccacaaaaaaattgaaaaaacaaaaggagaatcggtaatatccagattccaagttataaataaagaaataatcactaaaaatatcaaagaatccatgatgaaaccatttatttttcaggaaaaagaataaggcactattaggatctgcaaaggggggaaaagatacgccaactctggagaaggcaggcatgaaaaaaagtacgtgtacaactgtatattgcaagtaagcttgtccccaccataacgaattcgaggttctccatacattttacaaattggaacacaaaacaactatttctttgtactgagttgtgttcaatgggtgaaaaataataacaagattaagtttcaactgatctaatataatatataaaaaaagaaacaactagtcatcttggctgaaacttctttctacgcactacacaaaacatagaaccacgtgaggaccattttaagacaacatttaccttctgagtgtctaaaccaaaatagtcattctctaccaaacaattctgaactgaccccacatgaccagcaggacaaacaataacaaaagggatagagcctcgggtttcttcaacctgtatcaagcaaaagatatatcaattttctccaaacattcataatgaaatagagtctaaggctgtgttcaggaggtgttgggaacccctcctccccggcacacaaaacgaagctcatattattgcatgattaattaagtattaacttttttttgaaaaatggattaatatgattttttataacaactttcatatagaaagtttttgcataaatcacaccgtttagcagtttgaaaagtgtgcgcgcggaaaacgagagaggtgggttaggaaaatgggagaagaacacagcctaaagctcttaacaacaaagcacatgaagcaaacaagcacaaaccaaccagtcataattttaatgtttgttgtagctaaatagattagtactatgaacgatgagagagactgagactaaatcgatcttcaatctctctctccttatggcagcatggcatatataaatttattactggaacaatcagagagaacataaaactgcaaattgggcatgcatatttagttcccatacagaaagaactgcaataaacaatcatgaaatgcataccttcattaacttattaaaagaattaagcaatccctgaaactcagcatccagggtatcagagtcatttgtaataagtatggtggctgctttcgacttctgaatgatcccagcgccttcattgagttcactagcgaagttcgcattctcttcatggttcaagagggtttcgtaaggtattctcatcaattttttcctcgatgaagaggatttgacaaagacatcttttgacaagctgcaaatagtaacatgttcgaaaaaaggaagctagattaagaactagaggcaaattactgacatctatttagtgaaaaattgcagcacaagtcagcttctcttgaaaaggatttaggcagaacagaaaaggttgtcagaagtctgcacctgccaattggtctgctaacactatgcattgcatgtcggaacaactgaaagtcaatggacccaatctgttctgcaagtgaagccttctgaaccttgtccccagatagcaaaccttccagaacatgaccctggtccatttcagatagtatcttctttgctgcaattacacgacgctgtaacctcttcttttccttccattcctgtgatatttcacatctggtcacgctttatttgcaaaatatcaggtggttcatatgattgcatcgttcttggttagcaccacaagcaagagagttcaatgtgtttactgcatctattcattaaaaaaaatgtgacatgtgcattcaatatttgcaaaagctgtgcagctgctgaaataaacgtttgagttttttagaaccttttattttctgaaacaggggtggcccccttctataatgacgtgaaattctttagacctgacatattctttacttttatgtgcgaaagaatgctttatacatggaacataacatgcaagaaaaggatgatgcagacctaaccatagcacgcctttctttctttgatctcttatcagaacgcgcgttgagctcaagaagcccctttggaggtgtaatccacatttctctactctccatatcaatatcaggtacaatatcctcagcaaatggaatccacacatgctcaccagatggggtggaaccttgattttctgaatttggctgagaaacagtatcctcagtgccaccaaccataacctgtagaagatcaccagctccaaagttgaaaacctgaccaactgttccaacaagcttgcccgtgtcctatgatgaaaacagagcaactttaactaattatcaaaacaactttaattaattattagaaattggatgaagaactgcccaatgagaaaacaagcatcattgcatcaatactgtgttcttatgtccatgccagtgcacattttgccagtgttgtttacttttagtaggtgggaaaaaaacttatttaagctggacagagcaattgaagagtaaaagttcctagttccagcattagggaaaaaaccccatataaggcagcgtttttgtaagatagttttattttcaggaatgcatacgctcaataataaaagaatgccacaattattagtctgttggacatggcacatttattgagtatccaaaggcagggtcgaagacaaacagccagagagccagtaatgtattacatgtacacgtcatccagctaccactatatttcagttttactgcctaggcaccaaatagtaggatcatgcctttgctaacgttgtagattcattttgttatttaaaccaacaactaaatcacgaacttgaaaaggaaaatatgtaccttgacaataactctcatgccaacaagatcaagtgaatagatttcatcttcctccatttttggtctatccccaactttcacaagtatagctgaaccaactatttgcctggcctgaaaatagagtaataaacgaattacaccagaagctaggtatatatgccaacttatagtaagcattagttacacattacatactgaatgctattcataaaaggattctgatctagacacatgccgaccataatatacaattcgtgtgcgctaggttgagctgaactaatcatgcagttatactcagtgatggtgtgtaaacttgatctgccagaagccgacaattgatgttgtatgtatggaacaaaatgtacagcatagatgaaacattatatcagttcatttccaacgacctataaatatctcaatgcagccgataattgttgttgtaaagttgtatgtgcgcatgtgcggagcaaaaatacagcatggatgaaacatcaacttagtttgtttccgacgacctacaaataccccaatgcacttctaaactagtatcaactatagcaagctgatttaaggctacgagtcctagaaattaagagcaaatgactgtataggaatgcaatcaaagtaaaaaaccagacctcatccacggaatcgaccccatcaaaggtgacgatccaactcttcttcccggtatgagctcttcctcgaacaagctcaaattcctttacctgctgcttcccagcggcacgggccctcagccatctcttccccggctgtcagcgtggcatgatcgtgatgatcaaacaaccgaacaaaaaacaacgcccgattacatattagctccgaaattggggagcgggatgatggagaacgagggatgggtaccgtggcaaagcggagttgggggaagtcggtgcggggcgacacgaggacgtcgccgcgaaccccgtgcgcgccgctcacgtatcccaccaccactagctcttcctcctcctcgtcatcgtactcctcctcctcctgcgcgtcgccgaggctggagagcagcgcggcgccaagacgggccggcgcgagcgcgaggcggcgcggggggaggtgggtgtgtggcgcggggaggccgcgacacgaggaaggggagagcgggagggagaggaagaggagggagaccggtgccgaggcggaggcggaggcagtggcgggaggcgccattcgcggcgtgcggggaagctgctgggatttggcgctgggagcgtggagaagaggagagcgagcgagaggataggggagggaggaggagggttttttgggttttaggcttttagccatggcccgtgagagcttcttcatcggcccagccttcttggaatccttgcgagcccagtaattttgcaggattccaataattttgtaggatcttcagaaaaaaaaaagagttttacagattttgtgattttgtttttgaattttttttgttttaaaggaagcatgctagatactacacttgtcaagtgctaagttgttacatggaataaagttgtactaagatgcaaaagcaaatcaaattgacttcttctgtccatgcaaatgtaaaatatatcatgcttatgtccgaattgtaatcaaatttggtcgacatgtttcttgtgtttgaaaagaatgtggttttgttacatattacggagcttcagaaatcagaagtaggacaagacaaatattactatggaattactgaattgtcagctaagttaaagcctctgcagtctgcaccaaagaaagaaccatggctactacccatcaataccagctgaaattccagtcactagacaggcaaaattgattgctaccaaggccctaacttctcactgacaaatacatccttgtttactccattaaccgcaaattaacaccaaggaaggaacaacaacaatgggccaaaaaactcatgaatcctgactgatattactgatagacagaaagttttcctatccagtgctaaccataagcaaatttatttatcaagcagcacagatgataccagcttgagcaggcagcacagaagtcgaatacacatgacacatgtataatggatatatctccacctccaccggattcggtgttggcttctccgccggcgccacagcttttccagcgatgacctccttctccgccttcaggtccatcatcttcaacctccctcttcttcatcttcaaagcttgcccgactcatggactaggatgaaggggtgtcagatcaagcaggatgatataatttactcctggacaacatcaatccacttatccacatccatatgatgtagataaatcagaggatgaacttggaaaggaaatactacctccgttttttaatagat

SEQ ID NO: 45182 - DNA, 1359 bp, Oryza sativa
catctattaaaaaacggagggagtataatctttagtctcctatgattgaatttgtttgtacataggctagtttaaggtagacgctacgtacagaactgcaagtacaaaaattaacattcccaccaaaagaattcacaaaatcttgggaatcaaactcggtaaaagaagcaatgggaaactagttcgatgatgtaccacacaggtatcctgttcaactatggggaaaaaattctttgtaaaataagcaaatgagcagtttctgatatttgtcgcaacatctaagcaattgatcttggacggcctaacatttgggcgataattggtcggacgtcatctgcaacagcaatggcttccaggaagggtatcagctcaaccaatgatttgtcagccgggtcgctggtccaactctctataggtataccattttcctcctgtagccggaaaacctacagcacatgtgacagaaaaatattcaggcaccagatgatataggacccttcccgaactcataaattcaggtttcaaactcaaagccaagatccactgaagcaattcaaaaccctaagcattagtatagccataaaaattggacaaaattaaaaggcaccttaagatggattatcacgacgactcacctctggagaattgtcgattatcacaacctttgcgagatcagcaacaataacagtcagatccttaagatagctaccatctacaggcaggcatgaatcccggaaataacgcttggtaaaaaatatgttcttgggatccaacatatcaagcagccgatttgcataggagcttaggctagctgtgaagataacaaccttaaacatctcagacaccttctgaaggaaggtgtcgacatgtggcctcttcttcacgtacacagtgtgctcttttaagccatggtacataggaaatgaaaagtcagcaccatcacggtcaaccgctgatgagtggataagagtttctgtgcagaaagaaaacgaatatgacgttaatctcaagtgcaaggaaagaaacacatgtgtaaaggtcgtcattcattacttaccatcaagatcaagaacaagagtgatgttctttctaggtgttggtaagaaactgtctggatatatgtcaggaagatcagctaaatcaggcaatggaccagttaaattctggtcaatccaatgagagaaatgaacgctattatagcacatggttgcagttgccccaaacgagttagcttcgtcgatggcaatactgccttcttcagttttctcaatggaaggtagtactccatatctcccactcgtgattgctagctcatcaatgggaataaaatcatttaaggtggcattagtcaggactcca

SEQ ID NO: 45183 - DNA, 3409 bp, Oryza sativa
ttggtaagaaactgtctggatatatgtcaggaagatcagctaaatcaggcaatggaccagttaaattctggtcaatccaatgagagaaatgaacgctattatagcacatggttgcagttgccccaaacgagttagcttcgtcgatggcaatactgccttcttcagttttctcaatggaaggtagtactccatatctcccactcgtgattgctagctcatcaatgggaataaaatcatttgaggtggcattagtcaggactccagctgaagtaccaacattgaaaggaacagaatcctctgtcagggaatggttcaacggattgcaactctgagtcaagtcccaggtaggatttgttgttgtaggaatgccatgtccatctgagaaacacacaatacccaaaacccgtatctccattagaaaaaagttatttgactttgaccttaccatggaatttaaatgcaatggcagataaacaattaatactaagtgataaaaataggtaatagtgtgtttaagttgatagatatatggagtaacaattccacaatctttcttgcactaacccatgtccaataacatactacctaatggggctgaggatggcgaagcaaccatcagatgaggacagggatgggaatgcaaaaccacatgcaaatttcacattttgcaagaaggctttggcattggcaataagtgaaaacctaaatgcagtcaaggttattagcatgcccgtagtagcctgatacaggaatccagaatggtcatcattgttgacaatgaaaacccctcaattatgttagctgcatcgattgcagtaaaccagtggcatattaacacagtaataactaaatcaatattcccataaaaaatagattcttggaaggagcattttaatggtctgtttctaaacagattatttaaataggtgtgttctacatacgcaagcaggtcagtgtagtcttgttcaggggaaagggtaactcataactccttaccttgattgacataatttagtgaatttaactgatgatccttctcataatatggtgacgaagttcttgattcagttaccaaatcctgcaagtatatgccacttagttagcactagaggcgagaattccttcaatctagagaaaaacaattatcctgatagagtgatgcagttacaacttcaaaagaaaacggaaataatataacatgtacatatcttttttgagacgaatgcatagttcatgttaaccaaaaggaatgttggtacagagtacacttaataaagttgtcaaaataaaaaaaaacaaatgtacagtatctgcaattctaaatgctacatgatttttggaagcaaacctatcatgtgcaatattacaaaggttaaaaacttttatttgtctaaatttgagtaagatcaacagttgttaatcaaagcatgagacgtgcatttaatcaccatcttagaattttgtcccatcattggatttggccaaaccagtagaacagtgcagcctgtctgggtttacctgttttctagattacatgtatttatagatttcacgtaaccatcttctttatcctagagctatggctagaagaaagtgtagactgcagtggatgggggcatggcaaaccaatggtattaccccactctgcatttttttttcctttcacttgtcaactggatctcatgatcatcctcatctcattgaaggtaaacatggtatgtgcatatgcatgtttttcaacaatcccatactgcatatatcattataacatagatgattttctacaaatgagttagtccctcggagggactaataatattttatgttgtgaatactaagattaatgctcccgacaccaaatattgctgactagagggagtataactttgctaagtcttgattgaagcattttattaataatttactacatcaagtgaactagatggtgcacttgactaaaggaagtagtcattctcacatgttgttccgcaacttgactaaaggaaccaaagataatcatagatgggcaaaaacatggcagatacatcaataaataaaaatgtgttatccaagaacatttcttacttcggcagtgatcttaccaacgggattgaaaaaagcaaataaactttttctgattctttttgaatgacttgatttgtgtacatgaaatagcctccatcaaatcaataaaagttcaaaggaatgcaaataagaacataaatcaagagcaattattaaataataaatgtagaatcaataaatgcaacatatatcaatatcatattaacatatgactaaagaagtacaacattttcatgaagagaaaaaaaagagaggaagaaatagcagaactggtaccttaagcaaagtaaaagttccatcatccataaaatcagcaccttccccactcttattatcctgcccggctatctgagtccttaggtacacatctgaaaaataacagccacagattatagatgcattaaagtggagtttctctaataacatagtacacacagggcattcagaaactgttagttaagtttctcaccatactgcagatctccacaaggcaaagaaaatccggttgtttgctcatattgattgaactctccagttttagccagctccaacttattgttttgtgaatgtacattctctatggtattatctaaattaaaggagtcataaaactcactcccaatatcatcatcattacaattgttcttcatcatcaatgttagcatattaatgaatgctgcggcaatatgaactataatacatacgctgcaaatatttgacaaaagaatattttcattacaaagcaaaccgagtctagaataatattctaaaaacaaaatgaatacaaaatagaacacaaatgaacgtgccatcatcatttctttgtggataaaatacacttaaaagcaacaaaccagtacaagttttcatgtaatgaaaaaataaatgtgtaaacacaaatggataggagaaacctaaaaacatctttcggagacaaaccatgccaagatttaatcattacttggttcatcataatcatacaataagggcaaacaatcatgtattcctattcctggaaaaaaaaaacaaagtatcctcgcccacacaatccataacagcatagaaatctatttcaaatggtaataacagtctttttacactttgctggtgctgatttcaattagtatgtttagtttctacacaaaatatactaactcagattcagtatttagacgtacagcaagtacaattcaatatcatttttttaaaaaaaaagagagaagaaaaccacagtatttagacgtacagcaagtgcaaaatcatgagagcagcgggtagacatctagcaatgctaagttgctacagtaaagcaaagttttttttt

SEQ ID NO: 45184 - DNA, 6789 bp, Oryza sativa
aaaacttaaatttttgagaaaatcacgtgtttgaagttcaaaacgtgccgcacaaattcaaaacgcgagcaaaaaggggataatccgcgcgcaaatcgtattcttcgatccctgcttcgccgaaaatggacggagcgcggaaccccgcggaaggcgcccattcgaatcctcgaatccaccccccaaacaacgcgagggcaccgaatcgcgcaaacgccatcacgaacgataccatccaagcagagacgaccaaagaactcgaaatttagcaaccccggagtcgggagcgacagggctccgagttttaatctaaaacccatttcctccacgaatacaatctactactcccaacaaccaatcccgaagcaaagcacacgaatcaaaccattgctagaactcgaacaggtactcgaaggtctcgcttaccggagataaacgcggatggatcgatacttctctctctctcccccctccctctctctctctctcgtcgcggcgaggtggagagaagcggagtagaggaggagacaccaagagagcggagggaagcagcctggttttattaatggcagttctaagcagagcccaattccacacctacccaacaataacctaccctctgaccctacaacatcactgacatctgggacccacaacaatactcagttttccggacccacatgccattgtctaagtggtgtggattttcaggttgaaccgtttgcttccttgctgtaatttttttcagttttccgccatatgagttaccggggtcaacttacccagggtgacagacaggtgggaccggtaagaatgccgtgggcctgatgtggactagcgtccgacgtgtgaaaaatgatcgcgacgccacgtgccggaatgcggcgggggctccctggtcccacatgtcagtgggggagcgcgtgtgtaagcatgtgggccatgaggaattaaatgctgacgtggcttctcaccagccgtcagcccgtcgctcacagcccatggttaagaggagatgcgagatccgggcggcccatacttacatggaccgggatggcactgcgagctacgtaaggaccatatttgtggggaataagttcatctgaggtccctatacttgtcaacgaattcgattttcgaccctcaaccgaaaaaccagacgcaacgggtccctcaactatcaaaaccagtgcagattagatccctcagtggtttttagagcggttttggctgacttggcgcctacgtagttaatttgacttggtctccatctgatgtggcattgacgtggcgcttacgtggcaatttgatatggaaaaaaataaacctcataggacccacatgtcagtttcatttacaaattaataaaaaaattgcgaagcccacgtgaaccctacatgtcagtccaactcatccctcttcttcctcctctctcccctctcttcatcactcatcagttcatctctctcccctctcctctctcacaatggagaggcagcggcgcgcggcggccggcgggagaggacagaggagggagcgacgcgtggcggcgtaggcacggctccggtgtgtcacgccccgaactagccccgaacggaactagcccgtgacgctccaaattaacctgttaatcgataccagtcccaggaaacaatgctagtatcacagaaagacagaatatcacagcaacagtggtctctttattacagagtaggagtacagtcatgttgggctgtggacagatcccgagctcacaactgcattacaaaagagaaagcggaagccaagacttagaccaatcatcacaggcgcgacttgggaactaggccgaaaccctaaaactcatcgtaaccgacttgctcctggaagaactcatcagcgggatccacatcatcttcttcagcaactgggggggttatttatatagagcaagggtgagtacaggagtactcagcaagccatgggaatttaagtgtttaatgcaggcttcaaggaaagactgttgtttttgcaattaattttatttaaactcctttttgaaaccactaagtgagtgcttctcaaacgacacggatgagacagtgcatcacgcccggtcggagtatgtgcaatatatcagtctttgaattgattcaaggttggcacccagccaacaactttcaaacggccacacgggcctgactgatcccatcagccgccgattttccaaatatcgaacccattccacagcagcaatttcacaaagcagtagtcaaacaaaactacgctaggaatcacctcacatccgcccatgaccgtgggcacggctgttcgaacagtttaataacctctgcagagggggtacactttacccacacggcattactaacccggatcatccagcccgtgcagaacggccacgtctagagaccttaaggctttcatgacagggcattttgaaagccgacacaggttcaccatatgccaacgagaggggtcccagaccaacaccagattaggtcccagaccatactgtgccaggaaacccgggggttctccccggcaccaccccgttgaatccatatgtctcttggcatcatggttccctcgattagctagttactcagccaggggtgtcccattctacccatgtggtcgcacttgtcttatgctcggatgaaattccaaggaaacggtccttaagtgcaagagcgggaaaccgtactcccggtacattctccggtccgcgattttggaaattcatttagttcgcaagcaccgacccaggtgtcgggttttccaagtcttttgtaaaaccccaagttttacccatcgttggatgttttaaatttgaggggaggtgttccaatgcgcgtgcccgaaggcccgtgcatcgaagcacaacagtcaacaaaggaggtctaagtgttcaataattcaaggagggtaattgcagcaattaggatgggggccgacaggctatctcgcaagccgcggccgaattactcgtgttaatcctattcatgcaatatttgcggaaaagaaatacttagatttaaattataggtgcaagatgatcaaaggtgacttgccttgctcgagaccttgagcttgatcctcgaaatcctcgcactgcgggtcttcgggctccgaaactacacgcgaaacgggacaactcaacaaacggcaaaaataaagccctattattgacctctaagcgtgctattagatagatctcgagatttgaggaattttggaagttgaacggagtcaaacggacttacggttgggaagatattgaatttctaagattattggattttttatctaaaggaaaaaggatttaattaaacccttttgaaaaagaaaagaaagagggaggaggaacggacttcgcgggcggcttgagcgcggcccgagaggggttggcacggctcggccttgccattgggccggccggcctgaggggcggcccaagggggctcgcggggaggggaggagagagggagccggtgggccgggtccaccttgtgtggtcccgggtgggacctgcttgtcggcggctcggctcaccgtgagcgaggtgcacgcggggcgtgctagggtttgggaaggggaggcgcggtgcacgcgcggctcgcggtgggcgcggatgtggcgggcccacacgcagtctcacggctcgcggtggaccgcacgcgcgagcggggccgaggagagcggctgaccggggtcggcttgacccggtcgtggccgaggtggcgccgacgtggcgccttcgtggcagccacgcgggccggcgagaggtagacgactacgtcggccggaacggacggcggacggcggctgcgaacggcgggcgaaccacggcgatacaggcgaaagcgagcacaccgggtggttgtacgagacgaggggagacgagtcaacggctcggattcgccggagggagttcgtcggtggaggattgcggcggcggccactggcggcgagagaagaggggaacgacgacgaactagagcatctacacgacctcgggattgcattcctagcaccggattgggcggagctacgccgagagaagctggcgacgagcggcggtttgcggcggcgagcggcaacggcggcgaggccgcgccgggcggtgggaaggtcttgtgcggcgcctgcgagcttctaagggtactacgagtgctaccacacaatctaaggggaggaagaggagcgaagagggagaacggaggagagctctaccgagacgagacggggcgctgtgacgagaggctgacggcacgggagtgatctctccggcctcgggccggggaagaggaagaagacgagctcccggagtccccttccgcatccacgaacgcgccggctcctccggcatgcgtggcaacgaaaggcggcggcgaacagaacacgggaggcgacgagaatggagtggaggcgatgggacaaacaagaggagaaggaagggagggcgcctgggctttataggatggcaatgtcggttcggaacccgaccttgggtggtcaaggagtgagctggcgctccgacgcttgcggccaaaatggcggcagagggcatgacgccggcggcaagagaaaagggaaaaagaagggaagaaagggggggcttgccccttgctactttgggaaaaggaggagggagagagaggacgacggggcagtgggaggaggggctctgcctccatcccttggaagcttacgcggaggtggcggggccgggtcgtgatgacggcgatgacggcgggggcggtgtggagcggaacggcgacacgggcggcaggcgcgggcaggcgcggtaggcgctgacggcggcggcgactaggcggtcggccaccacagcgcgcgcgcgggaagcaacggtgcacggcgatttgagcggcggtggtgggaagcggcaacgagagcgaagagggagggcgctcggctcggcgcggctcacgcgcacgcgcgcccggtgcacgggcagagcgagggagggagagggggggagagagagagagagagaaagagaaagatgggccgagagggaatcggcccaccaaacccgagggaggcaaattaaacttttgcggaggaattcgatttgggaaggaattggattcgggatttgaattcgacgatggattggggatttgagatctggaattggcacggagactgactacaagcaaagaaacaattttcgcaattagggtttttagaatttaaattttcccgctagacgccacgacggaacggacgctacacggtggctgtgggcggaagaggaagggacggcgagagaggtggccctagtcgtcgcgaacgcctccacctccgaatccctcgcggcgctcgatgcccgcaaggccgccgtccccggctccccacgcgccttgccgaggtcgaggcggcactgtccacggccgttgttgagtccccgcccgccgacgtccggggcgcgctctggtggatgtgcgaccgcatggacgccgccgcgctctggtgcttcatggtggcgcttttctgtccatccggtggtccggccactatgccgggcaacggcgccactgcaccttaccacacgaacctgaacaccaccgcagagaagtcttccatgcgactgcgcttgagttccgtcgctgagcccctagtaacctatagcactatcgcttcaagttcagaaattgaagaaccgagccttggtttcttttcatgaatcacgaggaaaaaaagcagttttgattgtgtttgcttatgatattactgtgttaaaagaaaatgtaatgaacattcaagttttggatcctgcgaggtctcgagattgttgagatggtcatcaatcagtttcatctatatacaacaagcggttccgaaagtttaacgacagcatacgaaaccaccactgcaacgttcggcttggcggcggcgatgcaactgtctagcaccgtggccggaggcaacatgaacaggcaagagctagcaggattgctggtgatgctcctccgtgggttgggctctcgtatgcctagccgacgcactggccactgccttgctggccacggtccccacggaggtcaccggtgtggtcgtttccttgccggccacggaggtcgccggtgtggccgcctgcttgccgacggccgaggtcgccgccggagtggctgcgtccttgatggcgtccgaggtccggctgcctctctcacctggagagaggagaggagagagagattaacagaggggagagtcggagagaggaggaagaacaggaggaatgagttggactgacacgtcaggctcacgtgggtcccactatttttttttaatttttttacatgaaactgatatgtgggttccacgagatttattatttttttctatatcaaattgccacgtaagcgccaagtcaatgtcacatcagatgaatatcaagtcaaattagccacgtaggcgccacgtcagccaaaaccgctctaaaaaccgccgaggaacctaatctgcgagattgctattcggcgatcagtcgcgcgccttcctcctcgcgcgactggacacgtgtcgcgcgcggagagggggcggcgatgtgccggagggaggagcgagtttttcggtttttttctccctttttttcgtttatattcggttggttttttcatcggttttttcgtttctgtttggttttttcctccggtttttttgtttctgtttggtttgttatttttcggtttctcttctgttcagcttttttttcctttttttttcaagatgtataaataccaagtttgtattcgtacatac

SEQ ID NO: 45185 - DNA, 2275 bp, Oryza sativa
  unsure (1)..(2275): unsure at all n locations
caagttaagtaacctcagatgaacttattcctatttgttgggctgggatgggatggtgagctcatttaggcccatagtagttgggccgtcacgggattgatatttatgtgcggcccaatgtggaggacgcgatgttctacagtagagaaggtgcactgctattgggcttcttgcaggctgaactgtgggctagataaaaagcccttgaatgccaagttcattttgggtctgttcacctttgataccattttcaaccttaccaaattttggtaaagctgctaaaaaagtggctatatttactttgctggnnnnnnnnnnnnnnnnnnnnnnnnnnnnnnnnnnnnnnnaacagaccctttattccctctgtttatgtattaacgacggtcatgttagattaatgggctaggcccaattaaatcctaataaattccattgccccacattaagtgctatgggtaataataccaccttgaaaatctaagtgaagatgtctcaacttaaatacagagctagtggagagtctctgttgaccggttgagatggtgcgcggacaaccaggcggggtgaggcgaggcgaggcagacagctgctgcgctctctcgttttgtaatagacggtaataaacacggagaattgatttcgtatcaatgaacgcttcggttacggaattaaacgtcgtgaattgatttcgtcggttacggaattaaacaccgtgaattgattccatattaacgagcgcgtcggttacgagattaaacaccgtggttgatgactccgaacgttactctcgcgctcgcatatatatactccgcagcgaccagaaggattgacgaagttcatcccaactcttgcacttccttcaccggttctgttcacctgtgtacacagatatacgggacgagcaggtgcctccggaactccgtccgcttgagaacttgcatgggtagacgggtgatcaagtttttgggtagcgcttcaagcgcgactgctcctgttctttgttcttcgacgacaacgttgcatcttcctctacttctgcttcaccatggcttctactggagagaacagaggagacaacatcaacggaggcaatacgactacctcaaaatccagcggtgggacgttctcggggtatattttcattctcccgattctattagatgtttctttgttaatactcttcgcaatggcagcattgcgttactatgtaaatgttgatgcttatttcatattaagcatgctcaagttgtatacatctagcactgtcactagatttactcatattgcaaatgtcatgtttattgtcttaatattttggattaaaatatgccgaattataaccaaatttccaacaatccaaaaacttgataggtcttttttggtagttagctttgctgcatcactaaaaccacatgctttcgatggttcaaattataaaaaatggaaagcacgtgcacttttgtggttgacggtgatccaatgtttctttgtttcacggggcaaaccgagtgccccgcctctcttccctaaggaggaggctaagttcgaggctacggattgcttgttccgtggagcattgatcagtgtgctcgccgatagtattgtggatgtgtatatgcacatgccttcagggaaggacatgtgggatgctcttgaggccaagttcggggtttccgacgtcgacagcgagctgtatgtcatggagcagttctatgactacaagatggtcgatgactgttctgtagtgggacaggctcatgagaatcagatgttggcaaaggaacttgagaacaacaactgtgagttgccggacaagtttgtggcaggtggcattattgccaaattgccaccttcttggacggactttgctacttctctaaaacacaagaggcaagagttcagtgttactgatcttattggctctttgagtgttgaggagaaggcgagggcacaggacaaccggggcaaaaagatcgagggaggttctagcgccaatttggtgcagaagaagaaccctcacgcatcccacaacaacaacaagaaagtcaaacctgacgtcaaacccaaggctacaaccaattttaagaagaaaggcaagggaaaggcaaaaggagattgctttgtgtgtggcaagcctgggcattgggccaaggattgtcctgagcgcaaggacaagaagtctgcaaacatggttattagtgagggcggaggaacattggggtatggtaaatttttacctacagttctctctgtctgtcactcacttgattgg

SEQ ID NO: 45186 - DNA, 1848 bp, Oryza sativa
cttgttgatgggaaacggatcgcttgtggctgttcatggtgttggagcggtcgatctgaagtttacttcgggaaagatcgtgcagctgaagaacgtgcagcatgtcccttcaataaagaagaatctagttagcggctctctactgtgtagagatggttttagacttgtgtttgaatccaataaatgtgtcgtatctaaatatggaacgtttattggaaaaggttatgatagcggaggtttgtttcgcttttccttggatgatatgtgtaataaagttgtgaaccatgtaagcgatgatgatgatgagtccaatgtgtggcattcgcaactttgccatgtgaattttggttgtatgacacgcttagccaacatgagtttaattccaaaattcactttagtcaaaggctctaagtgccatacttgtgttcaaacgaaacaacctcgcaagcctcacaagtcatctgaggcgaggaagttggcaccactagaaattgttcattccaatctgtgcgaaatgaacggcgtgttgactaaagggggaaagaaatatttcatgacactgatagatgattgcactagattctgctacgtgtacctattgaaaacaaaggatgaagtattacattactttaagatctataaggctgaggtagaaaaccaactggaaaggaaaatcaaacggttaaggtctgataggggtggagagtatttttccaatgagtttacttctttctgcaaagagtatggaattattcatgagaggacgcattcctattcaccccagtcaaacggggtagccgaaagaaagaaccgcactctaactgagatggtgaatgccatgttagacactgcaggactttccaaggaatggtggggtgaggcaatattgactgcgtgtcatgtcctgaatagaattcctactaagcataaggaagtaacatcattcgaggaatgggaaaggaagaaattaaatctctctcacctgcgcacatggggctgtttggccaaggtaaatgtacctatagccaaaaagcgtaaacttggaccaaaaaccgtagattgtgtgttccttcgttatgctatccacagtgtgggatataggttcttaatagtaaattatggagtacctgacatgcgtgttggtacaattactgagtccagagatgccacatttttgagaatgaatttcctatgaaaaatgcacctagcacttctagtcaagaacctattttatcccctgagcactttgtgctgatagaacacattgatcaaacgcttgaggaaaattctgaggagaataacattgtagcaactcgaaagagtaagagacaaaggactgcaaagtcttttggagatgactacattgtatatcttgtggatgatactccaagaaccattgaagaggcatattcatctcctgacgttgactattggaaggaagcggtacgcagtgaaatggactcaattatgtctaatggtacttgggaagtcatcgagtgtccatatgggtgcaagcctgtaggatgcaaatgggttttcaagaaaaagcttaggcctgacggtacaattgaaaagtacaaggcaaggcttgtggccaagggttatacccaaaaaagaaggcgaggatttttttgacacttattcaccggttgctcgcttgaccacgattcgagtactacatgctctggcagcctctcatggtctactcgtccatcagatggatgttaagacagctttcctcaatggagagttggaggaggagatctatatggatcaaccagatgggtatgtactagaaggtcaggagggaatggtatgcaagctgttgaagtccttgtatggtctcaa

SEQ ID NO: 45187 - DNA, 5645 bp, Oryza sativa
agtcattcaggcatgttaaaagaaactgaagtctgtcagaaagcagaaaaactcagagtgatagcattggactatgtctagacggctaaaaatctagcagatcagtttaccaaggggctaccacgtaatgtgatagactgtgcatcgagggagatgggcttgagacccacttagagttgcacaatggtggaaacctgtccattgtgatcggagatcccgtgaatttagatggcgaaacaaactattgtgcaactgagagaagagaccctaaaatgagtttatcttcatgatgcacttctcttctaatctgtatagtaggatggtatacaccttaatgtgatccgagtggcttttcataaagaagagatgttggcctacagaacatcttagaaggaacacacctatatgagtccgactgctagtcacagtctatgagatctgggtgatctctagatactcatgaaaaggccaggagtatgacttatacgctccaaacagaggggatgcaaatggcagcctagtaccagttaagggtttgagtgaaacctgaatcgcacaagactgacaattcaaggcatagtccattattcagttgtgatctagtgtagctcttttcctaggtggaagttcaacttaacagtctccaccgaaacgctggtataacaaacaggatcagaatcgagagcatttcctgtgagccatgaaatttggtggggattgttagattaatggtctaggcccaattaaatcctaataaattccattggcccacattaagtgctatgggtaataataccaccttggaaatctaagtgaagaggtctcaacttaaatacagagctagtggagagtctctgttgaccggttgagatggtgctcggacaaccaggcggggcgaggcgaggcgaggtaaacagctgctgctgcgctctctcgttttgtaacggacggtaataaacacggagaattgattttgtatcaatgaacgcttcggttacggaattaaacgtcgtgaattgattccgtcggttacggaattaaacgtcgtgaattgattccgtcggttacggaattaaacaccgtgaattgattccgtattaacgagcgcatcgattacgaaattaaacaccgtggttgatgactccgaacgttactctcgcgctcgcatatatatactccgcaccgaccagaaggattgacgaagttctttctgactcttgcacttcgagttcctccttctatgttcctgagctgcagaattcttccccggttctgttcacctgcgtgcacaggtgtacgggacgagcaggtgcctctggaactccgttcgcttgagaacttgcacgggtagagcggcgatcaagtttttgggtagcgcttcaagtgtggctgctcctgttctttgttcttcgacgacaacgttgcatcttcctctacttctgcttcaccatggctctactggagagaacagaggagacaacatcaacggaggcaatacgaatgcctcaacatcttctgcaccattctctgggtataagattctaactttatttgattttcttcttgttattacatgttcacaatgttatccatgggacttcaatcctatgtgaatgtcaacgatgtctatacttattttaccttaagcatgctcatatttatgtttagccttatcactagattgcttctcattgtgtatgtcatgtttattgtcttaatattttggattaaaatataccgaattatgaccaaatttccaacaggtcaaatactactgccctttttctgttgagaaatttgcttacatttgaatgtgttcaatggaattatttagtttggaaatactatcgaattattgcaatttgacaattgcttgaatttgacctgaaacagatggccaactgatgtagaccgggcctagtttaagcccgagcaggcaccaaagatttaagctgaattaatattctcgcttgctcaatcactgaattcaaaccgtaaaaattcttataaatgaccagacattaggaagtactggtaaggaagtcaggtgcatcaccattttacagctacaaaagttactcacaaaagcaggcattttagagtctcaagaaatagttcagctccttctccagacccgttctaatctacatttcgccttggctacttcctatgtctaataacacgttttttcatgcaaaatatttctatataaaaatgtttttaaaataacataaatctacttaaaaaattcaataattactccctctggttggacaaggttaaggttaagcttttataactttgaccatcaataactttaaaaatatttagtttaaagaaactagaaaaacatatatagatttgtctttcaaaacaatataataaaagtaaacatacatttatttattgtatatattattatagaaaaataaggtcaaaggtatatcttgtagaacgtgacattgctcaaagcatcaattaaaatgaaaccggagggagtaatacttaattaattctatattaatcattttcttgttttgcgtccggctaataatccgtttcaaaacccactttggaattaacgaagcctgaaattcaggcctggactgtcatcatgctcatcttttttttctctacatccttttatatgttcgatgcgaaagcatattgagtttacgcaaaccattcttgcaggacgatctcggataatggacagttcgtacgtagtagtagtacgttgggataaaatttggcaatcgaacaatcactttccagcactcgcgtctcactcaccctcacctccacattcattaatgctcgataggtgatggtactactactagaagatcccacccttgcaactgcaagatatccactgatgaccaattcatccaccactaattactcatctctacaggctcatgtcgtcgtctagcttcagttctcaagctagctagctagatactacttctacttcctatatatgtactcatatctgaatatctgatacagtagcaggcaggcgattcgtggtcgttgaagcggcgaggcatcgatcgatcgtcgccgtcgtggtcgcccaggtccagcaggctgtgctcgatcgcaattaatccatccatccaggacgtacgacggcgtcgctttcgccggtggcttgcaaaggcagcctctccggctttgatgggacccaaacgccgactcgctgtcgctgatcgttaccacctcgatcggtcgccgccgcgctctggaccaagctagctacccagccaacccttccttttgccgcgtactcgctcgcatgaatcgacctgatcttttttattttcgcaaacgcgcaaaatgatcatcagtatattagaagaaagtaaagttttaattacacaattgccgtggaacaaggacaaaaaaatggtctccaaaaccaccaaaaaccgacgatagaaaaaaattgaaaaccctgaagcgatatgatcatctgatatctccattagaagttcacgagtaattgggggagaatttaacgaaacttgatcaaagatgaatactaacaacaacctgctagcttcagtactgtgtatgcatatattgatatatgggaaacctgatcatgaacgaacggctggtgatttacacgcaacttgaccatttcttggttggtttggacatctcactagctagctgaactgttagatcgttcccaagaaaaaagcagatggatcgatcgatcattttgaccaaggaatatgcatgcagggcctatcaatacaagaacgtttgtacgacgttttgcaagctagtcagccagccaaattaagccttttggattcacctgcacacacgtacatgtcagacagtccgagtcggtgttaactcagtcatggagatttcgatgggtttggatgaagctgactttccttttgattcaaaggtagccatcgatcgacaccagcaagtaatagcagcttgcattggtcgacgccaattaatgaccggtgcaacggcgaccatcgcggcttaattaactagctgttgagaccaagtgtcgttgagtctaagagtggattttaaactgtagatagaacgtttacacgttatttgcatgttactttgagggaatgttcactttgatgtcaaaaaaaaaccttaccaaattttggtattgccaaaattttgataggatttattatataggtgcaaactaaatgtagccacttttttgacaattttatcaaaatttgataagattaaaaatgatatcaaagtgaacatgccctagaaattaacttacctcattggcgattttgatgtaggtatacaagtcagcgagcttgatggatgcaattaagcagatggaaccggcggccgggcgtgtctcgcaagttcagttatctgcccttctgctggggcccttgaatatgctggacaacacagggttaattacgatgcgatgttcttaattagtagtttgcagctggactcatagtctcatatgcggacgtattcactggggccttaattaatgagaacttttactggtacaatatactaccagtatatactggcagtatataaaagggcatattaaaaatttgatagaaaataaaataacactttagtaattttctgttcagattgaatctaattgggagtacccggtcctggatcttatcgtgcgctaggggaggagcatactgaccgccatttgatgacgaagcacgtaatgatagcatgatttgatgatagaataacgaagaaaagacaaaattacccttcaaactttatactgcaatctaattaactaaaaaaatcaaatcaatttacaccgttagatcatatatacttgcagtatatactagcagtacattgtaccataaaagttctataattaattaattccgcttgcagtactgcactgtttccttgagcgctcaattttttgaccttcagagttcagacaacgagtctgcaaagtagcacgatctctcgctcataccaaagtaattaagcattgatctgatgacccagagagaacatatagaagcaattgagtaggagtgtgcgtgtgtgtgtgtttatgtatgaacaatgagctggagtgaggtagaacctcataaggaacataccaacaaagttcatgcatattgaaattggttgtatacacggactaatcatagcttcaattgttaggtccaaacaaatgcacttcctgcaattaattttgtctcagattttcagatatatatatatatatatatatatatatatgacactcatatggggcaccatggtgcccgggcaccatggtatctaatgcacaaaatttttcaaattgtgagtatatacctagttataataatttgattcatacctatacttatcaacaaaacaactcaaatttaactttatttcacaatccatgattacatacctaactaattatatgtatggatgctatatacctataatcaaaatctaacaaaaacaagttcaaattcagttcaaacttgctttaaactagttagtaaagtagttaatgttaatacctaagtaattgaaaaagttttatactcatttgaattgggtatatactcaatttcaacaatagtgcccggacaccatggagcaccaaacaaatttactat

SEQ ID NO: 45188 - DNA, 20240 bp, Oryza sativa
gatctctcgctcataccaaagtaattaagcattgatctgatgacccagagagaacatatagaagcaattgagtaggagtgtgcgtgtgtgtgtgtttatgtatgaacaatgagctggagtgaggtagaacctcataaggaacataccaacaaagttcatgcatattgaaattggttgtatacacggactaatcatagcttcaattgttaggtccaaacaaatgcacttcctgcaattaattttgtctcagattttcagatatatatatatatatatatatatatatatatatatatatatatatatatatatatatatatatatatatatatatatatgacactcatatggggcaccatggtgcccgggcaccatggtatctaatgcacaaaatttttcaaattgtgagtatatacctagttataataatttgattcatacctatacttatcaacaaaacaactcaaatttaactttatttcacaatccatgattacatacctaactaattatatgtatggatgctatatacctataatcaaaatctaacaaaaacaagttcaaattcagttcaaacttgctttaaactagttagtaaagtagttaatgttaatacctaagtaattgaaaaagtttcatactcatttgaattgggtatatactcaatttcaacaatagtgcccggacaccatggagcaccaaacaaatttactatatatatatatagtaaatttgtttggtgtatataggtgtttgttcgttgtagtactagtacatatatatggaagatacttctcaaagtatcggatgaccctccattttcatcaaacaattaattaatgaaaacaaacacatttttgtgtccccttcagtagacggtgatcatagctgtagatcaaagctagcaatctagctagcaatacctgggattgagacccagtgcagttgttaatatgacggtaactctagcagttgcaaggtagctgatggatcaaaaccagcggcccgaatcattaaaaaaaatattgttcacgatttactgtagccaattcctcatgtggcaattactttagcgtctaatgtgcaatagggtgggagagcaaatccaagccgttggctgcatcgatccaacggttataatgtgctccgactgctaaagttttagtactactacgaccgcactagatctcattccaatagctgggtaattaattattgttctataccttgatattgaagtacgtactttattgtatatgaccagggaatggattctaatttctaaaccctcaagagatgtaccctcgtttctgtcattcaatgtaaattttctttaaaaaaattgacaagatggaataatatgtatgtgatatatcacatattaattaagctagcttattattttttaaagaaaaacataacttttaagatggcatatgaaaaacaagagaatgtttgctcgagggattaaaatagtttcatgtacttcatctgcaataacagactcaagaaaccatagatgaacatgaaacagaaacgatttacagacacgcacatgcatgcctcttccctaacaacttctgaacgtactgatgatatgaaggagcaacaacaagtgtctcatcatgatcatgcatgacaaaattataatcgagctagatgcatcgcatgcatggacaatcgtgatgttgataccaagaacaatcatgcatgcatgaacatcagaagctagccctcgatcagctgctagctagctggtcccatgattataacaaacaatcaaaagtactactatgtacatactcctagtagctatcagttggagtcaattaaggaaacaagagcatgaaattaccactgctagctcatcatcagtattcagtactactactgaataatgccccccaaagtgcagtgcaagtctgcacgtacgagctcatgagaatcaggtacatgtacaacaacttctactactagtagtatactactgctgctgccgccgatgctgcatgctacaactaggctacttgctagatcatcatcatagtactacacgtaccatcgtcgtagaatgcatcgtatacagatcaatcgatcagatgttcagaaccaaaaaaaggagaaattaagttaacaagatgcaaatcactatcagagtatatcagtagccggccatccagctcgagctagtgatcatcatcatcatcatcgatcaacggtggttgttgttgttggcgtcgtcgttgtgcaagaacggcgacgggatgaacatgtcctgcaggaggccgtaatcctgcgccatgaagtgctgcatccggagaggagtagtagcagcagcagcgctccccgtcgccggcggcggcggcggcgtggtggaagcaccggtggtagaggcgatgatggcaaccaagccagcatgatcaggctgcggcatctgctgcatggcggcggcgtgcagtgatccgccgctcgccgccgccgccgccgccagctgcatctggtgctgcatggcatggagatgctgcgcatgcggcggcgccaggaggccgccgccgagcgcgtcgtgcggctgcggaggcaaacggtggccgacggcggctgcgaagtggccgggatggtggtactggaggccgccgtggtggtgcgcggcggcggcggcgccgaggaggtgcgccgtgccgcgcagcgtcgccgggatcgggtgcgtgtgcttcccctcgtaggtggtgatcaccaccgccgcgtcctggtacgaccgctccaccctcttcttcaccgggcacttctgcgtcgtgcaccggtagtagctcctgcacccatccatccatccatcacacaaacgtaagaaccctaatcaattatcaatgatccatatatatctcagctaccaaatgcattcatgattcataactaagttcttactcgttccatttcatattataaatcattttaactttttttctaattaaacttttaaaagtttgatcgagtttattatagaaaaatatagctacattaattttcaacacgaaacaaacgtattatcaaacatattaatttaaatgctagttttgatgaagctaatttggtgctatagacgttgctaaacattcctataaatttgatcaaacttaagaaaatttaattaaaaaaaattaaaacgacttataatataaaacgaagtacctgggaaatgggctgttcttgacggctttctggccgtacttgcgccaccggtagccatcctcgaggtggtcgacctcgctcttggtcatgaacgcgaaccgcggctgccgcggcctcttctcccccttccccttccccttacctctgcaaatgaaatttttttttcactcacatcaattcatccagtcatcagttcatcacacatcagctagctatgctaactaattaacagcaaggtcaattcaatgacagtactactatactacccaacaagctacatatttttggtgtgtgccatagatcgagcaagatcatgttcatactagctagcttaattagctgcaaattgagattaattatactaatcgatggatgatcagttgttggtccattcaaacatagtggctgcgtacagagggtagtagtagccgcgtaggtacgtatggacggcacggcggcgcgggcatctacacatgacgacttcagagttcacacggccatacatacatgcgtacgtatgtacggcctggtcatatattttggtaggatctactgatcaatttgtgatttaactgctagctagacaatttggaggaggggtcagggtcacatttacagatgcaacaaaaatctaggagtttaaagttgcaaggtaaattaagtttgccatgaaaacgatagatcgatgtgttcagttaaacttaaaacttggccaccaactgagattgatcgatatcgatcgatcagttgagttgataggctgaatctgcagactggtgtgatatattatcctaattaaatgcaattcatatattgtgtgtgtgtgtgtcgtaatataatgcttgcgaactaagaacgcaccatgcatatctcaaagagatatcagatgaagacaagaggaagagatcaagaaagtgatgcaaagactagcaaaaggcgtgagcaaaaaaacattgatcaacttttttctgaaagaaaaaaactacctaacgatcaagctcttttcgttttgtattaattgctcggcgagcatgtgctagctagtgagaaaccctagcgcatcgagttcacacgtccttgaccgaaaccaaaagaggagccaaaatgcacacatcttgaccaaaccaaagaggaaataaattaaaacgtgaagaaaattaaacatgctcaaatctggatacagtcattcaggaaacagacggaagaaaaatcaacatgaacacaaagagaaaacctgttcctgattattaatctttttttgtcacattaatgtcaccaatagcaccagtcagaacagaaaatcaaagacttcgccaaatcaacctttctaaagctagcaaaatgaatttcaagatacagttcaagatgggatgaatttcaagatccagttcaagatgggatgggatgagatgagatgagatgaaagaactcaccctttcttgttcttgtcttctccatcgccatcccccttggtcgtcgacgatccttccttgccgtcgtcgtcgccgccgtccccctcctcctccttcttgcacttcccggccgactcctcgtcccctccggcgccgccgccgacgccgcacgcctcgctcgacgtcgacgacaccgacatgctgttcggagtcatcggccccgccaccgccgccgccgccgcagcagcagaagcaccacccccagggaacaacccgacgccgtccaccaccagctccctcttcacctcctccagaggcgccacgtcgtcgtcgaactccccggcgaatgcctcgtagtccagcggcggcgtcgtcggcgcgctctcctgcatcaggtggtggtggtagtcgatgaacgaccacggctgctgctgctgcagcatccccggcatggcgccgttcggcggccgctcagcgaacagcgacgccagctcgtcgtggaacgggaagccctcgccgccgccgccgccgcccgacatggagctaattaagcaaactagctagctagctagctcagatcgagctaagctttgctccaaattaaactgatcgaaatcaatcgtgcaagcaagcaagcaagctagccctcttctccttggcgtttgctcacatatagatcgtacttgctagctagctagctagctactggctagtggtgtggtgatgcagtgaatagaaggagatgagaggtagacgacgagagagagatagagaggggaagaagaaagggagaggtgtgtatttgtgtgtaagcgagctagcacaagctgaagctagctagtgtgatcatgtgtggggatagctaggtggttgggtgagaggccaagggcttagttgaaaattcctagttaatcacgggctttgtcgcataattgaaattaacaaaaattaattgatttgatttgctcttgtcatgtgtactatacgccactgtactttgcatgcgcaacactagtttttctacccttagatcgagttagtattcggtcgcaggttttaccttctagtaacatcttgttgtttgctttaccaattctcaatgcttcatgcatttctctatattatcaaccaaacttttgctcttgtttaatctcttatacaaaaaaatgagaagaagaaaaaaagtgagtacaagaccatgtcaaggcttgtgagttactttacctttcactaactttctccacagctttctaattgcagagtcgtggatttattaaatgacatttggaacagtagtaataataaaaattattagggctcaaacaatgtcctaattgcgaacatggtgggaatagctagaaggggagtggtccaaggtcgtatagggtttagtcagcgacggccaccggaggcagccggtcaggtgagtcaacaggacggggctgcgtcaaaccattcaaaccattcaaacccatccctcaccggcacgtgtccgtgtcgctttgaccgggcccactcgcgtgaccgggcccaccgtcgatgggccagcttgatgacgttagcatgacgctgccgatgcctcctcgttccttctccgtccgatggcgatccgacggctgtggcgtcccgacggtggaaaagcgagaggccgtacgtgtcaaagggaaaaaaaacggcgtgcccaataaatcgtaaccgaaatttgcaagccaggaattcatcggctggcacgtattaatgtgactgattttacttgttaatcacatttagtaaaaaaggacactactgctttacagctttctttttttacatgtgtctaatcttcagatttacagctttttttttaaccacgattacatgtgttgcacggaaaaatgcgaccaaatgtaagttgtaattttaaatctcgatcggataatgattcttcatcatgtaaagtggtagcctgtgtcaaaaagaaatgtttcattaattacctctcctaaacctgcacgtaactactactccgtagtaatttgtcagaaaaggcgtttcacctgacgaggcaggcaggccgggccgggccggtgcgacgacggctcacgctacagcgagacatgtcgcgtacgcgtcgtgtcacggtgcgaccgagtccgtgtccgggtcgcgaccgaggttggtcgcgggcgggccgaccacagcctggctcggcgtacgtggccccagatccggccgtccatccatccccccgccgcggaaaggaacccgggaaattttgacttagcttgggggtatagcgaccgatcgagctgttgatttcgctgccgttttcttcttttccggcaaaaaaagtttcggcttaattagtttggtccaacctgcggccgcgacgacgacggcgatgtcactgagatagatgccggtcagctagctccagcgccttcaggtttgtatcccatactgatcgagcagctaggatcgcccgatgaatttgtcatgtgttttctctcctatcaaagttttattagaagtatctcaaatgttttaaacgaaccggtactagatgtgttaatttcattgaataaaacatgagtaaaaagtttggtgaaaggaaggttgtaaacggagatgaaaatttcctaccaagcgtttctgattctagcgatatattgaatttatgtttataagtttttaaaacgttgtattgcaatggtcactaaatagttagatgggtggaaatatttaatttctactcaactgagaatcattttcatagagatgctaccgtttctaactgttttcgttcctcgtatattcataaaaaaaatttgaaacaaaaccaaagttgttttggaggaattatggtgaatgaatcgaatgtgggtactaggtaggtcataattcatacctatttatcacaaagtagttttatctacctgatgaattcggagtttttggtaaggtgaagaagaagaagaagaagaagaaatattcttcatcagtctacaagtggtcctgttggtgctgcggagattccttcgcgtagctagcacaacggattagctataatagaattttatcattctatatttttcagttcagattaacatatgacgtgaatttgactaaaatgacgcctagcttcagtttaagcaagactgctcactagctagccaagtacgatcagcatatataatcgtgatcaggtctatgggttggttggatggacagtttttataatgaaatcgagttgaatcgcaacgaccaaaccgaactgtctctgatgcagctgagctagcgatcttcatgcttgcaagttgcaacagtattccactctcaacaaccatcaataatgctatcgagtctgaaaacctgaacattgcaagaacctgcgaaatatatatataactggaatataaatattttctgcgttcgtacaggcatattttatcttctttatatatgttgattcgttgaaaagttgaatcccatcaacgtttggtccagatggaaatgctgcattcatcagtcaagggtgtatctctaccgttggcacgtcagaacaaccacaatattttcagtttttcagtcactagtagcatcgcatagcatatgcaactgaaaattcagagttcagacttgacaccaacacattgctgaaacagaaagacagatttaatttacaagtgctagaacagtagcactacacaatgggataggaatctttttgcagagtttattaatttggcggttgcttgtcattactgtcatcagttaaactaattaactagcgctagtaggaagctgccaaaccaaagtcaaatgcaaatctgaagatgtattggagaaagattagaaaacgtaccgatcgatatccacaaacaaggaggagattaattacctttatttctagtccaaataaatctcccatctgatgcgacctggtaataacaagcaagcaaaacaacatgcagttaatcagccagcatccaactgctaatctacaaaaaagcactgtctttttgtgactaatttagctagcatgctaacctcagtacaaacatctttttgcttagttaatccagtaagagacactgtgccgcgtgaggctcattggtttgacttgtgccaaagtcccaataggttcgtacataattatggattagaataagtttggtccaactccttgctcgattaagttaggacggtgtctacacctaatccgcaccattacggcaacaagcatcaagcaccgtcctcctagctagatatttcgtaattttttatttctctctagtttgccctaccattcacgtgaatttccatgcatctacatatgaacactcatcaatcatttttatccccacaagtttagctctgtactatacagagaatagtgtgcagtcattgcttcgtctgaaataattttggtgcttattcgcaagaggatttttatagttcttgagaaagtatcttgagatacctaaattttacattaaaattttggtatcttgagatacttagtaatttgagatactaaattttacattagaaaatatggtacctctaaatactttttcaagtacggtaaaattaccctattcacaaagaatgaactcacaaggaaattaaaggcataacttgtccaaaaattaaattctcctaccaagttaagggtaaaatgtactgagaaataccaaattttctagtataaattttgatacctacaaatattttctcaaatactataatatttctaggtattaaacacataatctagggttattcagagagagaattcaaagtgtaagatctttcttgtgctcatctatatagaatcatatatattgagggcccctttgaatcaaaggatttatgtaggaaattcataggattcaaatcctataggaaattttcctatttggccctttgatttaaaggattgaagctttccaaatcctatgaaattcttatggaatggcacattgcatgtggattttggaggaaatttagcaagagctccaacctcttggaaaatttcctttgagtctatctctctcatccgattcctgcgtttttcctgtgctctaatcaaacgaccattcctgtgtttttcctgtgttttgcaatcctctgttttacacttcaattcctgtcataatactatgttttttctattccttcgttttttcaaccctaacattcaaaggccctgatggattttctaggtgggcatggatcatgcatgttgcatggggacctacttaagcctgagaatattgaccacagggataatcaaggtgtacgtcttccgtacttgggtggcggattccaccatgagaaaaaaaaaacccaagcagatgaatgattccgcaggcgccttttgaacagtggaccaagctgcagactccgttcaaccaaacgaccggcgtctctctcgtctccggccagccgacgtgccgccgtcgccgtcgtcgctcgcgccgcaagcgtgtacgaaccttccgagtggtttccactcctcaaactgaatcgatcgaactcaactctcaactagcgctagtgggatctctccgaaatttgcaacttgtgcgggttaattagcatgctaatttgcagctctacggaggttagggttcatcggaatgagtagcctgcttgccgatggacaaggagtgcactgcttgctttcctggaaaaaagaattgttcttttgtctctcttttggatgcagaaagatggatcaaagtgtgtacttgcacgcaagatagacagatatttgtatatctgtacccctgcttaattagctacatcgtgtagatcattaggctgccaaacaaactttccagtgtgagattccaatgcaagcacacaagatcaaaattcttgggaatcatttatcagttctagatcactgtactgtgtcaacaattgtttaatatatggtttttagaggctgggtctgtgtttgcttatggggcaagagatccatagacaggggttagaaaatatcaaaacttatgcttgcaaggcatgaggcaatcatgaacatgacaaaatgtttattaattaattaattttcacaggcttgacttaatccggttaattggacttaacctccccaagtcaagtacagctcttggactgcgttccaacatgttcaacttggactactgaccatcatgtcactgtcttcaaatggtgtgcctttgttaaactaaactaatctacccaaggaaaagggtaattaaacatctcatatgtatatatctattgatctatataacaaccagttaaaaagaaggacacattaccttattttttagataatgaagtggtagttgccaattgcatccattgaactttgaatccttcacaattcaggcatctttggaaatttccttacatattgtactgatcaacaaatcctgaaaccttctagcacatgcatctgttccaacatcctgattcctcgatcgcaagatagattttccgaactattctctgtttgaaatgagcagcatctttgaaaagttcatttgatgaaaacaacatcccatttgcttgccctgccagattggtatgagacagacaaaaaaaaaagagcaaagtttttcctcggagaaaaagccggaatattttccttgttcaaacggggtgtactgatagacagcatcaggcagtacaggccgtataaattccacatttccactgtaacaaaaacatccaaatcgagcacgttttggagccgtcaaaaggctgaaaatgccaaggttttcaactatccggagtttaccatggatcacaagtcacaacctttctcagccaaggcatcgacctgaatgactgagtcgcaaagctggaccgattactctgatgcccgtaagaaaggttcagaaaagtttgcagctttcaagtgctagttgataggcaatgggtaggaatatttcacatttcaatatctcgtcacccccactgagagacaggatgtagaaaggttggctatctctgatccttccatttcaaagagaagccttttctaatctgaaataaaatgcactttctttatatcaggcttttgtaatatgaaaactcttattctgtagattctgaaagtgattttagttcagaattggagctgttggcagtagatggtccaagctaggatcaccttttatttaaagagcttatccatatctctggaaaattagttttaactgtaatcttatatctgtggatcttagaccaatttatccagtgctaagaaaactgaaaagcagctaggttaatagtactgggtgtaactcagtcactgggttgtcttgtgatttatggatgtatttcttttggcagaacatagaacatagtagtactagatatgtttttctcacattgttcataagctctgatgtgattttttagttttggctttaagttacataaaccgttcctgaaacaacaattattagaaaatcagtacctatcagtagtagatgttgtgattggtcagcagaacagatctaaaagttgagagtacggccttgtttagttctaaactttttcttcaaactttcaacttttccatcacatcaaaactttcctacacacaaactttcaactttttcgtcacatcgttccaattttaaccaaacttctaattttggcgtgaactaaacccaccctacatgatctagagaaggaatgcatgctgaactttggtgaacaaagtcaagagatgaccactgttgcaaagagcaattgtgtggagatccacctcctcattgttttctgttcttgtttcccctttggaccagtgccatgagcagcagccaataaaaattggaagctttcagtggtttcagcaaggctctacctcatgtgatctacccttgaaggattgttaaaggagagaccatgatccaggcagagttttttttttgtttaatatgtggcaggtgaatggaatttattctgaaataatcatgcttatgtttggctcttttgacttgctcctagcacatcagtatttcttttttcttctagtagtattatgatattatctgcctctttttctggggcagcagaactgcagggaatctgcttacaagagccccatacttgaaagttttcacactgctaacgctaggtttccaaagattatcttggcttggttctaaagggatggaaaataatttatatatatgtttcttctttcttcctaactgatgaggaattcttgtactttccattctcaactgcctgtcaataatacatcaaacagaaaaatatcgatctgtatgactgtatgataagcaattctttcaggcctccattaaccagctcaacagaaaaatacgaattgatgtgccgtagttggggattcagacagcggttggtcatttttggctagtttcagataactgaaacactgaacttgcagagcacacgtagtactcccggaatagccttcacctcgagtctaggtccacacaaaaattttacaccctatcacatcaaacatttgacatctgcatgaaatattaaatatatgttataaaaataactaattgtacagattgcgactaatttatgagatgaatcttttaagtctaattgctccattatttgataatatagtgctacagttaacatttgctaatgatagattaattatgcttaataaatttgtcttgttatactgatagattatataattagtttttttattagtgtccgaacaccccatacgacaccctatataatatccgatgtgacacgttaaaactttacacacttggatctaaacaccttcttacaattgtgcagatctcacatgaacagttgacacaatttttctgttcgatctgcagcaagctatacacacacgcgcgtgcgccccgcagcagcacagagtgcactcgaagtcaagccccgcgtgccatctccttcacactcgcaacccggttttacacagaggaattcgaacaagaacacagcattattgcaccactccactgtggtcactcactagctcgcatcacagccaccatgcagcagaaggcttagccagaaacgcgtcttgaagagatcgagtagagacaagcgtgtgcgctcgtcgcgcgatgcatatggcccatgccgcgccgatctcgtcagtggcaatgcacatagctagctagattcttctcttgtcgcaaaggtcaacgactccggtaaacttttctccataggtcagtgactctgtattaacagtttcaacccctacacacagtcgcatgcagctagtagtatacagtaatgtcaactgcaaggagttacccgaggattaagatatggtgcatcgatcagaaaaaaggaagtaatagtaaattgatgcacgagcacactcatgagtgacatgagagagatgtctgtccctcctctgagttgctgcatgcgtgacagcgtgatttgtgctagcttagctagctccttggttttggttttagcttgatccatctaaaacaatggacgacatgcctcccaaaaagtcagagcacatgcaagcccaatcagctgctcctgagtccagacagagatgtgtaggggccaaagtggcaaatcaaatctgaagaaaattcttactccgtccgtcctctaatataaatgattttaacattttacttatactatttgaccactcatcttactcaaaatttttttggaattattatttattttatttgtgacttactttattatctaaaatactttaagcacaattttttgttttttatatttgtacaaatttttttaataagacgagtgatcaaacagtgtaagcaaaatatcaaaaaaatttatattaagggacagagggagtatatgagtggatatattcttcagtaaaatgtaaagctcagagtaaaagactgaatctttgatgcagtaaacggaaacaaaaggctggggggtcaaatgctggcatgcagccattgtggcgacaatctattcatcgttttcttggtctaaggcaggatctcaatctcagcaaatggtacgggggcaaatgggttttgggttgttggaagatcgaagctagcagatgcttgccgatggtggtggtcaaaatgcttgactcgacttctctgctcggatcaatcgagctcgcctttaattacttttcgctgcactgtttactcttggactgatttggtttgaacagataagtggccgagattaactgacgaagaagaagaagaagaagaagaagaagaagaagtcgggcgctgtcaatttggattccacgtttcgtgctgcacggcggcgctaagctccggcgaggcacgccatgaacgacggcgtcgatcttgctggaaattgggggctcggagtttaaaattccgaacccccatgggttacagcgactcgattcgtggacaggaaaaatgcgaaataatccgattcgacacgtctgcaaactgtcaatccaagccgaacactcctgactctcgtcctcctcggccggcgccggcgacgacggcgagcgtggggaagcgtcggcgacctggttgggccgtacggcccagatcgagtggaggcctcgaatgggcaggcgacttctgttgggccgagttctgcctgtctttccataagttcactctcttttagttactagatgtgcgttgcaactgatagagccaatttaatttgtacatatgtgtcggtggataaataatccattgttcgtttccccgcaaaaaaaatccattgttcgtttatttatgtgcttatccaaatcatttattaccaaataaaagactatttgtgtgcaaatcttttatatacctgttgttaacgactcaaaaggaaatgctgtaaaataaagtatgataaaaaaacaaaaggttgaattcaaaattaagttctaaaatctaaattttggcttataggaataagcatcagcaaaacaatgagacattcaaacacggctacacgagcttgatttatcgtgcagctttgtctgaagttgggaaggaattgatgacggacagaatcaacaacttcgatcatcctttatttcggttgtcatgttttttccgaaaataaaattgattcttatgaattattgtaacggtatccctgatagtacgtatgagtatgtgtggagactgacttgaaatcatgctaacatgtgacatgaatcgtgccatgtaatacgaatagacgacctacgtgatatttacacggattctgcgagtatcattcgcttggtatccacatcacatggactctcttttgtagtccgcttgtgattcgtgacttcgcaatgaatgttacgtgtgacgggaatcggatatgaatgatgtagcacagttttgacaaaaatatcttcaatttttaaatcatgcagtcccaataggacatgcggcaagggcaaatcgcgcgtgcgagggcgttgcgggcccaatcgcggcggcgcgcaaagacgcatgtggaaaacgaactcaggcgcaacccccgattgctgcggacccaattaatttgcacgcgtctcagataagaggaatactctggtgtaagaaaaaggaaaaagatttgatagaaacataaaattaaaaccgattaaaaaaataacgtatcaaaattctgacagaaacatcttcgaatttcataatagtggagatgggtccaatctaattcgtatgcctcaattgtaatatcggatatgttcatcccccacaattatcaaaacctgtataacctcttctagctgtttgaaagcagttttcgttaacgtaacttatatattgacctaatccaactaatcgagtcagtatgtggctattcttttttacacctctcttacttttatcttcctttgtacaatctcttttctctagagggcggggacacaacgccgtgcatgtgcagtactacataggaccctctctcgacgccgatgagcttgagctggaggaggaaagaagaagtggggcgctgtaaatttggactcctcttgaggcacacggcatgaacggcggtgtcgttcttgcaggccattgggcctcggaatttgaaactccgaacccattgcgttctctgtctgacagccgttcgattcgtaggccaggaaaaatgagaaataatccaacgctacacgtgtggacatgcagtcaattcaatacgaacactccggcggtgccggcgccggcatcggcggcgacgacggacgacaacgacgactggggaatcgtcaaggagctcgacgacggcgtgcatggcgaagcgtcgacgacttgttgcgccgtgaggcccagattctgtggaagcctcgtattgggcggccgatttgtactgggccttgtggtatcatctggcccgtctggctatctttccagcctggcccagattgagccttctctctttacttcttctctaatgggcctcagtgtacctccgtagggcccaacctcgaatggatccaatactcatgggccgtgcggcccacgatatactcagctgcatgatttacatacaactcacacattattgttgttattgttgttgttgtttttctgcatgaattggcttccaaaagcaaaggtgcagtagcaaacaaaaaaaaatggaaacaaaagaaagaagcaaagtgcactgctccacgagttaagtggaaagccgtatctctgtcgccaaagctatatagccgcgtgtcaccggaaaacccaaagaatcaatccattaagccgattaattaattagccaggtttgccatcatcattggagccaattagtttctcatcggagcttgcaagctagctgggtgacagcaaggagcagaaaaatgttgcaaagcacaaagcccctctttgctctgttttgtcatcagtacttcttttttcatatgcatattgtacgagcagaaaaaagtgcttttagtctgaattatattgtacgagctgaatctgaatgtgatgtatggagaattagcaacaatggagtgttcgttgcttacttgctccagcttgttcacggggaatggcctaagtactccggatgcaaatcttctgctataatgcacgtgtagtatgtgtcactaattatgtgggccccacttacttctggtccatatgtcagtgacacctactgcatttgcagtacagcataggcggttcctatccggaacagaatactgatcacagaaaacaggacggtttattagcgcgtgattaattaagtatttgctgattacttttttcaaaaatggattaatttgatttttttaagcaactttcgtatagaaactttttgcaaaaacacaaaccgtttaacagtttaaaaaacatacgcgcgaaaaacaagggagagaagttgggaacatgggattacaaacacaccctcagagtactccattgcatgcactaatgcacacagcacactttcagtttcagcattcagcgagcaggaaaagaaatagggccaatttgaactgctaccctaccaaaatttgcagcaaaccaaacatctctactaaaactttaccaatgatataaatttggctttgcctataaatttgtctcttatgggcaaattttgtctttaatccaaataaacattttcaactctaccctaccaaaattttggtagtaccaaaacttgcccaagatttgacactaccaaaattttgatgggacatcaatccaaacatgcccatggtcttccaccatctggcgcttttgcaccatcctacgcgaaaaagaaagaagataaggggcctgttcactttgttgccaaaaaaaactttaccaaattttggtattgccaaaattttggcaattatgccaaaatgctaaaattttggcaggatttcttatataattaccaaaatttggcagcaaactaaatgtagccatatttttgacaactttatcaaaatttggtaaggttgaaaatggcaccaaagtgaacaggctaagataagaagaggctcttactttttttttctttttttctagaactctgtagaagctagagaaagcgtgaagaccgcgtgattttaagcccaaacgctttggactaaaaaggccctgaagatgtagacgatgagttcccccgccgcgtgaagccgtgaaccatctcagccgctgaagtggctttagcttttgatagcaacaagctagagcaattggctaagcaaaacaccaacttttactttcagtctacgtatcagagattcagagatgtgttcatgaaacagcttcatttcagggcagacaaaaacacatcatatatataacagctaccagatttactcaccggccggcctctgtttctcctaaaagaagcggagagaacagatgccgtccaaaagaggggaacaaaaaaaaggagagaaaatcgaacattcagtgaacacactcgcaaaagagaagcagaggatgtgactaggatacgatgtgataacgatgtgacaaatctgcactcagttcgctaagatggcaagaaaaaaaccaatgggaatttgtgaaatgggcatatatgttccctatctagaaagtgatttcttccactcggtttccgcgcgttaacttcgctttcgttcagctcagctaagctttgccggtcacctaccaaagaatctcctttacttcttttctttctgctgttgctgtccttctcctgcagcttcaggaaaaccaaagaattggaagtggcttagcagtgatcaactgatcactgatcagactagcagagtatgatagtatgatcaattcatcagtgtgattgtgtgaagtgtgtttatgccgaatatgtgttatgctaacaatggagtgtgcattctgcattgcattgcagaggcttgttgatgggaaaataacctggattactccactgcacttccagcattctgcacgcatccagagaaggaaaaaagatagctccaccatcctgcactttcgcatcatcccatgcatgaggccggccatttttgttctcccgaaaagagtagagaagaagacgaacttttctagaactctgcaggggctagggaaagcttttgccctcgtgaatctcctcaagtaacggccttttagcttttgatcaccacaagcttgagcaatttgcttggcaaacagtacaagcaacaaccccgcccccccccccccctccccttttttttttctttttgtgtgtactgataagatcagtgtacaaccgttcatgaaacatcctccctccgtttcaaaatgtttaataccgttgactttttagtatgtgtttgactattcgtcttattcaaaaaaatttaagtaattatttattattttcatatcatttgattcattgttaaatatactttcatgtacacatatagttttacatatttcacaaatttttttgaataagacgaacggttaaacatgtgctaaaaagtcaatggtgtcaaacattttgaaacggagggagtattttaaaataaaatcaacacgtgattgtgctatttcattgagtttagaggtaaaaaaaatacaaccaccaagaatgagtgtcggtgacatggggccgggggtatcgtgactagaggcttgggtagccgcggtcacccacgtggcctgaccccctcgggggggtcgggcctgagggtgacgtggccacccctccctctgtctccccgagggg

SEQ ID NO: 45189 - DNA, 2202 bp, Oryza sativa
cagtatactgaactaatccttttccttttcaatctactgaacggaacatgatcagaacagtgtacatgaaacagattcggctatagattaaagagaaaaaaaaccaacatgcataatcagtattcaccggcctatgaagtttacagcaagtagcaagctaaaggctactggattgttcaatctaaaaataaaccaagagaataagttctcttacgaaagagggaaaataaagcgataaagtccaacatgcagaaacgaacacattcacaaaatgagcagcgaggatgtgagtgtgatgtgacgatccaccactcgattcgctaccaaggattgaaaacattggaaaaatcgagtgcgtgcgatgaattcaggcaacggcatatattccgaagcttagctatacatggccaactactcaagaatctcccttcagttgttgcaatcctgcagatacactaccgcctgtgacgttactgaattactgcaacctgttaatctgaagactctgaagtgctactatactataaatttgctgtctgaaattgttaatctgaagcaaagctggatgcgatgtctttctctgttccccagtatatatcaatacggagtactactactttgtgcgccgtcagagattgcaataagctgctttgtttggccgccaattatgcggccaaatgttccgatacgcgtgtgccacacaccctgcatgcgcgcgggatcttcgcattggcgcgccgaaaagcttcgtgattctctatctgattgtcaattagcgctacctgtcctaatctctttcgtgcctaatttcagcctgcactaacactgaaccagattgatttcttcaggccagatatgcatatggttctcttgttaacggctatttgcattagattgtctattctgatttttttcatgattagtaccatgctggtgtagtttttttgtcttcatcttcttatttaaattggtggttcttgtcttcttgatatgtgcgtctaaatgcgacatgaattctttacggagtatatactaagtatatatatgttacagcgactagtgtgctattttaattgtgaattgaatcggtcctatcctaatccttttttaatgcaatctgaacaagtctaagaggtcaattacctggaacatctgtctcgattttggaatttggattactgaacattgaaagaacaaaaaataataattctggagcaacgggtggatgcagctgtttatgctttaaaactgaaggatcatgcaagttcttttctactagatctaccacccaaccactctgctctcccgaactttcttccaacggcacggcagccagccaacgcaagcagcagtagtactgtatctgcttcttttgcacgaacaaatcaaatcagagagccacggaccagccgtttcagaaacttcggtgtcagaaacgcattgggtctgaatttcctgcgaaatttccgtgaagatttaataaccgttcgtcccaacagaaagggtttcaacggaaaattcgagtttttgacacgaaccctcacattgacgacacccacttctagctctcttgacagcgaaacaagcgaaatgaatgaacaagagatggattaattacttaccttgacgacctgaataaaaaaaagaagagcttgggcaatgggcatcgccatcgcatgaggcaaccagcagaggaaaaacgaatccgccgcgagtgcatgtgtggcgtccgctgctagtaccagtatacatctcagtgacaacgtaagccattgctgatttcgctagcagctgcatccgtcgtccatcgaacgcctggctaggccggcctgcaccagctttgcactaagggccctgttcaaatctccaacaaaaattgaataatcttttggatagaagtgacatgcttttcaaactgctaaacggtgtgtttcgtgcgaaaactttatatatgcaagttattctaaaagatcatattaatctattttttaagtttgtaataatcaaaactcaaataatcacatgttattaccatctcgttttacgtaaaatacttaatctttatctttatcttcaggagattcaaacaccatccaagcatcgtcactcctagtctactccgttccggctctgcactgttgttttcaatattttcatcggccaggcaggcaccagcgccattgcgccagccgtgcggcgcgc

SEQ ID NO: 45190 - DNA, 2900 bp, Oryza sativa
gcggatgtagcctgtattgtaggagtagtttacaacttttcgttgcttctttgcacctcgcaccctgatacaagcaacttcttttttttggacattttggttggtcacttttaaaatctgacaattaaggatttatcacgcgctatctataatatatggatcctcatgtgtatatgatagatgggtccagtaataaatcatttatcaccgtttataagagtggcaaataggtaattattcttttttttccatggccacaacaaaaagatgggtttgtccttgtactagtactaaactctcatgattaattctctattaatttgaggccaactgtactaacaagttatattatagaagtcttgccaacaaaaattcatatctcaactatttgatttattcattttgaagttctgataaattaagatgaatttttttaagggtcaccactcacgaggaggagaggttccccttctgaattatcgttagtaaatacttgaaacaatatgtataacagatgaaaccaaaccaaagaaaagaaattaaaactaagatcaaatcatagtgtaccacgccaatttttatgaagagtctgaccagtctaattttttttaaaaggggctgttcagattgtaatcaaaataaaccttaccaaattttagtaaatttgcaatattaccaaaattttaatatgatttcttatgtatttattaaagtttggcaataaactaaatgtaggcatttttttagcaactttacccaaaaaattgtatatttgaaaatggcatcaatctgaataggcacgaagagtctctaagaaagttttcgtgtgtgtatcattttctatttgagatagagcagcggctttctataataacaacaatttattaggccaaactaagggggtgttatcccaccctaaaatcttacaccccgtcacatcgaacgtttgaacacctgtatgaagtattaaatataggcggaaaaataactaattacgcagattgcaaccaatctgcaagacgaatcttttaagcctaattgcttcatgatttgacaatatggtgctatagtaaatatttgctaatgaaggattatttaggcttaataaatttatctgtgtgtccgtatatccgatgtgacacgcaaaaacttttcacccctaatctagacacaacctaaagcttcgaaaaatacgtgtaaattcccagaatgacgtaaccagatattactctaccatatcgactgcgtcatcgctgatccatagagaggaaaaaaaaacttgtgccatttgaggcgcaacttagcaagacgtcgtcttggttagttggttgccttggagacaaagcataaatgcataatcagtataggagcaaatcgttttaaaaaaaaactataggagcaaatcgcgattaaggaggtgtttagatggggctaaaactttttagcccatgtcacatcgaatgtttggacgctaatttggagtattaaacatagactagtaaaaaaactaattttataaatgagagctaatccgcgagacgaattttttaagcctaattaatccataattatcaaaagtttactgtagcatcacattgttaaaatcatggcgtaattagactcaaaagattcgtcttgcgaattagtccaaggttatggaatgagttttataattagtgtatgtttaatactctaaattagtgtctaaacatccgatgtgacagggacttaaaataagtccctgtaaaccaaacaggccctaaatagaatcttgggggtgcaaattggcaaccccacttcttcccggaggtgcatatatccgagacgctcagcttctcgaagcacacgtcgcgtcccaccacgtctctctctcctactgttttctcacccaaagatccgattttcaccaactaaacccgctccgatcaacggcgcagccaagccggcgcgcgttccaggcaatggccgtcgagacggacacggcgagggcggcggtgtcgtccgagacggcgccgatgtcgccgcaggccgaggcggcgccgcgcgccgccacggcgcgccgcgggaactggctgcggcgcctcataccgcgggactacctgtcgctcagccggcgctggaagctgggcggcggcgccttcgccgcgcccggcggcggcgcggcgtcgaggaggctggcgtcgctgtcgcggtcgctccggtggaagcggcggctcccggggttctccctgaccctgcggagcggctcggcgtcggcggtggtcgacgcggttgcgttccgcgtcatgtacgtcgtggaggccgtcgtgctcggcctcgcgctctcctgcttcttcctctgctgcggctgccacctctaacctctcctctcttcacaccacgccataatcgggcgtgcaacagctgcaaccatcttaattttccctgcttttttttttcttttttgttcttctcttgatgcttccgctgtaaatttctactacctacctttcggtgctaagattgaaatttgcaatctgcaaactgcaattcgtattttcttctctttggatgatgcaatgcaagagatggatggcgtgtggggacttctgatcggaaaacccaatgaaatgatttatttgtcgctgtctcgtgtaagagtagaaaatgcgacagctttgggtacacttggggaggtagaggagtagagagtggaggtggtcatggaggtggacgtggcggcgtttgggttccctgctccggtgaggccgggggcgacgcgggtggggtgggtgggcatcggcgtcatgggtggcgccatggccgcgcgcctcctcccccctgggttcgcggtgaccgcgtacgcgcggacgccggccaaggcggaggccctagtcgctgccggcgcgagcctcgcgggc

SEQ ID NO: 45191 - DNA, 9645 bp, Oryza sativa
cgaggcgctggcgttcgccaacgcggcggggctcgacgcgccgctgttcctcgacgcggtgtccaagggcgcggcgggttcgcgcgtcatggacatcttcggcgagcgcatgctgcgccgtgagttcgcgtccggtggctccgtgaagtacatcatcaaggaccttggcatggcgctggagaccgaggaggggccggagggggccaaggcgctgccaggggcggcgatgttccggcagatgttctccgcgatggcggcgaacggcgacggcgacctgagcctccagggattgatcaccgtagtcgaacgcctgaacggcattcgcaagtaaggaaggtgttcgtcagaatgccgcactgggaacgaaacgcttctgtatgttagacttaatcttgttgtttattgtgtgagttgtgattagtgcgtgcatgagttagcttgatcaagaaaatccatgatctgcatgtaagtgcttgcatgtaggaagttatatgtggatatcggctgggagtagtggccgagtcaagtagctggagtagtggcatggattgtggatcagttagctgtgttgcatgtgtgttagtgcatttgcatgcaaagagatatggccttcatgcatagagacgtgattagtggttaattagtggctaagtcatgtgagtggtggccggttagtgcggcaaaaacgtggctagtgtgctgctgcgcgtgtgtgctatttaagcatgtaatcagtgtgtgattaatgtgtggagaatagaaagtgaagtgtgtggtggttcactggtgtgcagtgacaagaaatttccttgcgtctctttgtttcattgcgtgctgttcatcttcttcctctgtcattgcctcctctgtatgtgtgtgtttcatcgagtgaaagagagagagagagagagagctgtgcgtgtgcaagtgagtgtttgggctaacactgtattcttatttcttaataaaacttgatgattgttctgtattcttatttctgaacaaaattcgatgcccatctctctgtaacagcatgaacttcaagggttcactcagctgattgaaagtgttattttactcatgcttgctgatgtaacctcagttatccgagctaagtgtgttataatctgatggattaacatatggagtacttggtcactaaccttatctcctgacagaaactctctgcacaaaaatatctccaagagaggtgcatactagagaagcaccttaactaagctcagaattgtgccaaactgccaatgctacactaatctgacagatgaggaccagtttgcaaaggctgagaactgagaggggctttgctgatgagctgctgctatagagaggatttttcaggtgtcagatatttgcacaggcgaagataacatatgtacggtcttttcttgtgtagtgcaatcttatctctttccctccaagaaacacttcagcagaggagcaacaatggcggcggcagggtcgctgggacttctccaggcgccatcgtccttcacggcggcagcggcgagccggccggcttctcggcgagcaccgcgagctctgttcgccgtgagagcctcggctgccgccgatgccaccaaggacgccgtcctcaaggccttccgagagaagagagctctcaaggtatcactcttatgaatcccagttcttgttgatgccttagctctgccaatgcaatgtttaactgcattaagttctgaatgctactccatgtctgaaggctgaagtgtagatgtagctgtctctggattttgaggcctaacagtataaaaataatgttgcttagattgctggaatctgatattcattgacatctttgcactgcagatcatttcagggcttcagaatttcgacaggagtagtgttgcctctgttgtctcggctgcagataaggtgtggatattgcatttatcttgcttatttttttggtttggttctttgcatgtggataaagtgtttgtaccaattacgttctaggagtagctttgcaggcttatctgaaaaactgaaatcatgtcaacgacaaaaacaatgtattgcgtggctatcatgaaatccatccctgaatatagtaatactagtattcatttttacccagtcaacacagtaatgttgagttgcctactgatgtgctccgtagctataaataatttgggcttatgtcactcctgattttctcgacaaagaagtctacaagcaaacggcactgcagtctagtgcagacgacctgttgtttagctgataattagagtcataattttagcgcacagcatttactatgatatatcaatgaaagttcgctgcatcacccaagtatgctctttgaagtcatacaacttccacaaaatcagtaagcagccattaatttttgaactaaggcaaccaatattgccatctcattctcttctccaacagtcaaaatattttctaaatatttgcagaaatctctgtatgaagtttgttaataagttaggtaactttcaactagaacagccaaattttggagggaattacacatttgtaatgctattcagctattttatgatttcagggaggtgccacccatgttgatatagcgtgtgaccaagacttagtaaagcttgctctggagcttacttcccttccggtgagcaaagcgttcatgtagctatcctacattatccaactgtggggttagctattctaaatgcattgtgggaattgcttgttgcagatttgtgtctcctccgtagatccttcagcattccgttctgcggtagaagctggagcaaagatggtcaggctctaagttttgataagaagtatatgaatccgaaagaactaatttccagtagttccttccgctcacaagcttttctccatgcagattgagattggaaactatgattctttttatgacacaggcatcgaattctcttctgagaaggtaaattcgttctctttgattatatgagtagtcagttatgataatgcatctgtttactgcagttatacacgatttgtttctgagaagaactgctcatcatttcagatcttaaagctgaccaaggagacaagggaaatgcttccagatataacactgtccgtaacagttccacatacactgagcctcctagatcaggtataccacttgtcatctcttcaacaatactctgaaatggtaaataaccaattgtttaatctggaaacgtttatgcataattacaggtaagacttgcagagctactcgaagaggaaggcgctgatatcatccaaactgaaggagggaagtgttctagtccaacaaagcctggagtgcttggattaattgaaaaggtatggcaaaaattacagaaaaagaaagacctcacaatcaaatttagtatacaatgtaaactcataaatactgtttaacaaattcaggcaacaccaactttggccgctgcatactccatctctcgggctgtcacaattccagtgatgtgtgcatctgggctaagctcagtgactgcaccaatggcagtaactgcaggagctgccggtgtggtatgtatccgtctctgaaactctgcagaatggttgagtaatcttcaggcatcacgaactttgtagcccaataatctatagcttactagttcatgtgttatttcatgtttcaaacatttgattatagttggcttttcttgtgattgcagggagttggttctgctgtcaacaaacttaacgacatcgtcgcaatggtcgctgaggtgaaaagtattgctgaagcattgggtttgccttcacggaacgtgtctagcaacttgagaacagttcaccattaggggctagttacctcctcttctagacaaactctagcgatcaataatattatcaaaagatgcagtagcttgacatttcacagtctactgcctttcgtaacatatatgcaaagcaatgcagaggtgccaattggcgttttcgacggttgtaatgtagctttggccagtggcgttgttgaactgagatcaagtttcagctgcaatcaattgtcagattgtcacatctttcccatgcaatttttttgcatcatgtccgtgtaaattgtcagatattccccttgcaatcttgtatatcaatgcctatgtaaatgcatgtggtgggtaaatccacattacttcacacgatatgcaacttaagcagaagctattttagaataagacatagaagagaaaatcaagatcgaaatacaacagggactccgtggcccaatggataaggagctggtctacggaaccagagattctgggttggatccccagcggagtcgaatcattccctgttttttactgcaactttccctgttttaactgttcatgtctatcaggtcaatttcttatctactttgatcctaaatttttttttgcccatgggttaggatcccagttggtgtaacattgcttatcagccgtcatcgcaggaaacaaccaaccatagcccagaggatatgggctacagtcaatagaactaaataccatgtccctggcgacatttggaacctatatactgctagtagctgacaatagcattcccatgaccaatttttcgaggtatagtttagacctctcactttgtcattcagaactagattatggactcgactgtcagctagacaagtctcggaggcttgtatgctagcatctttcagcaacaccgagccaccaaaagatgcagtttattcaggaaagcagaaatactggagtagtacatgattacacgcgcgagcgcaacaacatctcgtgcccaagaatcctgcaggctatcgacgcttgttgccggtggcgatctcccaagcttgcaggatgtggttcacaatttcctccacgccgactccatgtttcacctggaagcagtgtaaaataagcatgtgtaaatatggagctatgtcccttgcaattatcatcagcttctgttaattttcccccgctaaaaaaggaacaaatgtgtatggtttaatactgaacctgtgcaaagacaaaaggccctccttcccgcatgcgaagcgcatctcgttccattacagccaggtcagctccaactgctggtgcaaggtctgtcttgtttattatctgtgttcagaaagattgaaattgatcaaatggtaaatgcaaaagggtacaagcatatcagaaatatcaacgtctttgatacaggtatgcatcgtaacagaatggagaaagtaataacacaccaaaagatctgcttgggttatcccagggccaccttttcttggtattttgtccccaccagaaacatcgatgatgtagattatgtagtctgccagttccctgctgaagttggcagccaagttatctgcacaagtgtcagtatttcttttagcacttcattttggatttagcataacaatgccttccaaaataaacagataatacagttctgtctgtagcaggatgccaggatggtttgcaaaagcatacatgataaaaagaatagagaagtgcttccaatgttgggattcagagagttaaatacctcctccagattcacagaggagtaaatcagctttgcacaagtttgatagttcttccagaggacctagatttatgctgatgtcctcacgtattgcagcgtgagggcagcctccagtttcgactgcacggatgcgctcttcaggcagtgctccatgtttgatcaagaattctccatcctcttttgtgaatatatcatttgtaacctgcaagagcaaagagcaaagagacaaaagtccaagcatgagttcaagaaaacatggttgagactactaggttgatatgttaaaaaagaacagtatcacaagaatgatagatccttgtctttcgatatcagcccgctggaaagcgttgaatgataccaacaaacttttttgttgaattattggaagcgtgttgtacaagaatttactttacgaattaccatttacaaataagcaagaggcgaatcaagaaaagttccattcttgattgaatacaatcaaatgataagatggtgcttgcaaaagatctgaaacccaacaagcatgtagtgataaggaagagtaaaagaatcttgccacataccgctgcgagactatatttttcacgcagggacctgcaaagtgctagcatcagggcagttttcctgtacagcagaaaaaacatttttagggatcaaatatcacttatgctaatttcgcaagttacaacacacacacaagcaatgctttatggttgttatacttgttttatcaatagaagggaacatgcaaaattgcaaacgcttttgctccaaactaaccaggatcaactcacagaacaaatcctaggaagcttatgctaccgacttactgttctattatagatttgtagaaacacaattctgaaagcaagaatagaaaaactgattttgatgtacaagagaggtgcctttttagcaagaaaaggtatgatgtacaagaaggtgcctttttagcaagcaagtttacaagaataccgaaaactacaacccagattaccacaccaataatcactatttttcttctggcactgtggcacaacgattacattccgacattcgcaaacacattttgtcaaaagcaattgaagcaactaaatctgcgtgaagaagtaaacttatttatcgccaaagatatgcatacacctaaatctctccaaagtccaaactagatcaatcaagccctgtgcgctgaaattctcagtttctcaccaatcctacccatgggaaagatgcacaatttcagagaataatgcaaagcaggcgccttcctccacctaccatcacaactcacaaccatcaccaaacaggaaagccacgccactgtttgatgatagtacactacactacggggaaagcagagtcgacctgcaggaatgcaagcgaacggccgaacctacccagtgccgacggggccaccgatgccgacggtgaaggcgcgttccgcgaagcgccgcgagatgagcggcggcgcgcgcttggagaaagacgcccgggggagtaagatggggctcgtgggaaagcggcgcgagggccgccgtgcgagtgccacacgcgccccgttcttcccgacccacgagccgccgcccccgccatggctgccgtccctgcaagcgccgagtcaaacaggcagcagggagcgagatcatcagtacaaaccaccagccgaaaaggggggcagatgcccggctgcacgcactggtggtgggaatggtggtggtcgccgtcgtcgtgcctgtggtggtggtggtggtcgtggtcgtggtcgtgagacgccatggattccgaccttgaattgcggcggattcctccgggatgcgggaggttagggatgacgaagccgatagattctctcaacatgttgacctcggctcgttgacctggcccatatttggttgggccttaacgggctttccattttgtgaggcccaataacggaataaggatcacgtgcgggccaaattggttgggccttaacgggctttccattttgcgaggtccaataacggaattggacttacgtgcgggccatattggttgggccggaatgggatttcgatttcgtgcggcccaataacggggttgggcctcacctaggtgtttcttccccaactccggcccgcggaatcctctcctacattggcgccgccgagaattcttcgccgccgacgtgacgccatccgcgcgacggcagaagccacggcggtggttggccgcggcggcgcttttctcaaccgtgaaaagacgcatgtgatcgagcaaggcaaatgtatctgagagcttcttgtactgtacagatgtgagctcctcaacacaagctctctctctctctctctctcaaatcaaagcatttggcgcaaatccgccattgattctgtatcaatttctactgtaatttcactacggcaccacggcgacctccttgtgatcattggcagggtacacgtgctcctccgactgctcgtcgtcgtcgtcgtcgtcgtctccaagtgcggcggcttcttgctgctgctgctgccgcacgacgtggttccacctgtcctggaagaggtagacgaacgccatggccgacacctccacggtgaggagcaccgtccacggcctcacgctcctcccggtcctctcatggtaggtgtgcatgccgatgtagacgttggcgacgcccaccacgcagatcgcgatgccaagaagccagtgggtcaagtaccagatgctcctgaacctcacacctctgaagaaatgaacagcatgttcagacatcaagcttcagagatttagacaaatcaatccattgtataaatggatttcagagatgtgttcttctacctgtctggtctcaagaatccgatgagtggttgaagccaaatgaaaccatacagtgccaatcctattctctggtgtgtgttgttgaaggcgttctcgaagttgcttatcgacagcactgctccggcagttgcaagaatgacagcaacaatctgcaggcatgtgtccaacgcacagttaatttgcacctgatgcatttgtgagaaattaatcaagcaaacgaggatagcgagctaaggttacagacctgtgaagcaacatggcagtagaaaagaatcctgatgctcctggtgcttttcacattgcttgtgactctgattagcagtactcctattggcatcaagaaaccaaccgaagaccagagcaggaaggcatggagcttgagttgaagggagagtttgggtgtgagctgcaagaatagttgatgtgctgcagttagtgattcatcatctactaccagatattcagattgtagtgcagttaaatggaactagaaaattcctcaaaattacatgagaaggaacaattacctccaaaggctggacaatcttgtaactctgatttaaactatcagggctgcttgaagcacactgagttggagtgagaagcgaaagaatcgtacaacaacttcccaacacagcgagaagtctttttcttccaaacagtagcattgatgctagtcaatttagtctcctctcaacagaaaacaacgcaaaggaaagatcaagcagcagaggtgaacctcttcgacaggaaaagagccaactgaaacagcaaatgatggtcctaagctaccaaagacaggagaagaacagctaaaatttcttcatctctctcactatcatctcatgctggtatggaagtcatcccttccttcaaaggtctacctcaccttaaatactggcattacaagcgtattaaagaaatctatcttcactaaagaatgaacaaaaagaacaggaaaaaccaatgccttctaagttctaactctctgcacaatgtggatgtgttccaggataacttctaggcgaacgggaagaatctgccaagcaaattaaagaataagagttgtcatgggggaataacttgagaggggtgtcctatgaatgatttggatatgagcagctgctttctctgcttagcaataatatactatggtggacttttgtgctgttgggggatggaatggaatggaatgagatgggctcttttgatcacattcagcattgcttttacagctctatggtatgatggtataaaggaaggctttttgtggtggtgcagcaggaagca

SEQ ID NO: 45192 - DNA, 743 bp, Oryza sativa
acttccaggaaacagcgccacctccaagtgtgaacacatacccacttgtggcctttatctcatcagcatcagatatccagtttgaatcactatagccctccagcacttttgggtacccggcatagtgaattccatagctcattgtcccttttagatagcgcattactctttcaagagcatgccaatgatcatctcccggatttgaaacaaaccggctcaacttgctcacagcaaatgagatgtcaggcctcgttgcactagctaagtacatcaatgaaccaatgatctgggagtatctcaattgatcccttgctattcttcggtttttccttaatagcacactaggatcataaggagtaggagctgccttgcagtcactataaccaaagcgactcaagaccttgtccacatagtgagattgcacaagtgtaatccgaccctcatctcctctcagtagtttaatgttaagaataacatcagccactcccaaatccttcttttcaaagcttttggacagaaagtccttgacctcttcaatcacattgaggctggtcccaaagatcaatatgtcattgacatataaacacaagatcactccctctcccccaccattacgatagtacacacatttgtcagcttcgttcacaacaaagccagtagatgtaagtgtattgtcaaacttctcataccattgcttaggcgcttgttgagaccatacaaggacttcaacagctttgcatacc

SEQ ID NO: 45193 - DNA, 27771 bp, Oryza sativa
  unsure (1)..(27771): unsure at all n locations
tcatcatcatcatcatcatcttgcctctcctgtgcatgatgctgtctcggctgcagatgctagtacggcggccatgatccttccattcaccaccactgctgctgcgacgccgagcaacgtcgtcgctacaagctctgcactcgctgatcagttgcaaggtatgtttaattattagtactatgttcatgcatgcacggatgcccctgcaaaacaaagttcaattggaacaactagccatgcatagcacattcatggtcatgttgcaagtcgtactactactgctactgcttccccgtcccaagatataatcattttttattctgacacgatcttcgagatgctactttgaccaacaacatctatataaaagtaagatgttttaaataaaatgagttgcatattatgataaattatttaatgataaatttaataatatcaattttacgtggttgatatttctattattttgctattaattaatagtcaaaattaaaaatatttgacttgaaaatatgctaaaaatatttatattttggatggatggagtactatactctggccatagctagtacaacttgtctcttcccttttttgttggttatcatatgcatggattggatgctagctcagcagtttgcattgttcatgtttgtaagcatgtgcatagaagtgtctcctcacggggggtcaccaccaagctcagctcagctcagctcagcttggtgtagtgcatgaaacgttgtgcannnnnnnnnnnnnnnnnnnnnnnnnnnnnnnnnnnnnnattactgttgtgaaaaatgtaggccatcatgataaaaaaaaaacaagtataaacaaaagcttattacgtactgtggggccagcaagcaatgatgttccagagtctgctatagctgaacaaccgctagcacaaaatcctgatagcagcaaaggtgtaacgatgtgtaagattatttctcatttagacagatcggatatgaaaaacaagagtcagtacctgtggtctttcctccaatcaggacatcgcccatctcaaactgcacaaagtcaatgcaaacattacatcaaatgtcgaaaacactacagaacttagcagaaacaggaccaacctgccaatatcccttctgagagactggaacatatgtatggttgcccttgtagtggctaggatccattcctccaaacacaatttcaccaccttctccttcatcagaatgacggttgaaccagaaggagaaaacaggctcactgacaagaccttgctctaccatcttatacctgtgatttatacatatcattagggactatggatctgctatattatgtgcatgatacgtgaaaaatctaattatcatgacaaatgcgccaaaatatatataatgagaaaaataaaacagaaatatgcaagaaaacaaccagccaaatattttgagatacgtggttttaacagaatgaaggtagcctattgtgttaatcagcaggtcaatatctaggattcttcaccattataaatgtatcgtgcatagatgaactgtggttagagatagtggaagattcatacaaatataatcactatatgcaaaagagcaccttctcttctactgtgaaccacagtgagaaatcaaaaacttagatcacgtaagtcaggttgtcttaccacacaggtactgcatctccaacggatatttcctgaaatccaagcccaagaatgccatcaaattttgcaaccatgaaagtaagacctggctccttggtagcttcaatgaattcctaaagcggtgaagcaacaatgttaaaaatatttggggcaatatgatcagagataataatcagtaagttaaccgagatatatagtgcagacctgatctttcacaaccagatcacctactgtaacactatcctcgctgaaaaacccagcaattgaaccagtgccatactgaatggcagctggttttcctggagggatgaaacaacagaaaacaggactgtcaaacatacaattttccttaagctaccaaaagggtggttaaaatttagaaataaatgaaaagaaaatcaataaatttactgtaagaatatatgaatataccactttccaagaaataaaacatttatttcatatcacagcaaagtaagtggttatgttttaatgatatttcactaaaatttcaagtgctggaaataatgtaagaaacttccatgcatctttctagttagaagataggatggtacatctgaattattgtggtcaacacagacagcgatagtaaattgtcagcaatgttcctcaatcctgactgcatatcgttttaatgtcaagcgacaccatgtgggcactacatcaacatcatacccttttcaagtatgttaaggctacaccaatccacgtattttgttcaaacccatgcagaatatttttcccctttcatcataaatactttgtgatataaaatgattttccttttcatcataaatgattgaacaatttagagggactaaaagtataaccgccaagcgaagatgtaattttcaatgcatatatgcaaatctagtatctatctttttaggagaatttttttaaaacaaactttaacttgaataaaaccaacctcctaatttgatttgcaccaaaatccaaataacaccatctagtatccttttaactaaatccaattttgcttcttctaacaaggctattttttttcacaccaaaatccaaataactaccacgtaggattctttcaattacatccaattttggattaaaagggcaaatttcaacatgagatatgccaccagctatagagcaaatacgagtaatagcaaaaaaggatgttgtcaatgcatccaagtaaactgagagaggcagacagtcacaacataaactagcacggttggggaaagttttaaggcacggaccattcttctgataagtgctcgactgtccggacttgtagcgagagtggaagaagcacgcaatctgcatcaatcgccacaaggaaaaaaaaatccaccattagcacaggtcgcaatcgcaacaagactcttgggagaattccccttgaccagtgcatcgaacagggactcaccgagaagtagcacttggccgacggcacccagaggttggagctgccagtgtcgaagatgacggtgaatttctgcggcggagtgccgacgccaatctccccgaagtactgcgcgttcatgtagttcttcagcgccacgatgtcgccctcacccccgccgccgccaagggagttggcgccgcggaggcccagccggcgcgccccttcctcgccggagagtcgcgcggcgacgcggctgttctcgtcgatcgggcgcttcttcagcgcgatccgcaccaaaccctccgccgccgaagcggggaggagggcttggagcagcacggccgcgaggagcaccaaggccacgctgcgggttcccatggctgcgatctgcggcaaatcgcgagaaaaaccaaaccaaaccaaacagaaggcgatgagaaatttttcgtcaggagtgatgagatcgaaaaatccaaatggggaaaacactggaacacaacgactgttagatctcaactctctaactgacgatacgattaaaacacagtgaaattagtcgataatatcgaagattagtaactcacgaaataagaaaaaaaaacaaaatcaaatcgaaggttcagccatggaaccgaggctagaactgaaggggaaaacagaaaaaaaataaaactcaaaatcggagagcagcagttacagaaaacaccgatgcactaaccgaaaaatcaacaccaaaccacgaacagaaaaacaccgatcagttatccaacccagggtaaaatccgatcaaagctgccccaaaacaatccatccagacctaccacccatccgaccaaaaaactcctcaaaaaacaccaaaaacaacccgtaaaaataacccagattaccctcaaacacacaggaagtcaggaacaagcagatccacaccaaaactcacacgaacaccgcaaaatcccccccacctatcaaacagattcacccccacatcaagtcaagcggagtccacgagagctcaccggaaaacgggaggagcagcagcagcaacagcaacaaccgacgtgccgagcactacgggcggtggaggcgaccgcgcgtgcatataaagcgaggcgaggaggcgtgcgcgcgctgccaaccgtccgatcctcctggggctgcggctcagccgttggatcggggtgagtggggtgggaaactgctatatttacccggagaagtggcctgcgtgggggcaagaggagtacgtacctgactcagttaggacgtcgctttttcgcgatttactttaattgatttttgttcgtatttcttctgtacctgattaggaatccgatggtttctttgctttgaagtaacgaggtttcattaattttttgcaagtacattaaatacaaggaaattgtatatacggagtatttggcaagtatatcgagttggagccctggaggaaggattatagtattatccacttgttcataaagtttttgtttgcttcgtctcaattgtttatttgtcgagagtggacccattgcatggtggattgggatgttaatccacaaagttcatgagccttattaaactagtactcctatgaaaatttttttctttttttcagaatggttagttgcagtttttccacgtgctttgcgtttagagggtcggaatatctcattacatgatacattaactattaaaatggtcattcagagggtgtgttcaattcacgttaaaattgaaagtttggttgaaattggaacgatacaacggaaaagttaaaagtttatgtgtataggaaagttttgatgtgatgaaaaagttgaaagtttgaagaaaaagttagaaactaaacaagggctctgtcaaagaaaatgggtcattcagagcatgaggtttttgcttccttcaccgagatattccctgctcagattttcaccttcacagaaacaactagctacaaaaatatagcaatatttttttcataaacaacatgctgcattgatgattaagtcagtacatcctgttaagaaaatgcttaagatttaaatacaagccaataggccatttccaatatcaaatctgcatttaccagcagcagtagtactgtattgaaagcaggagtagcaatgatttgcaagtgaagcctttcctacgaattcagatgcgtaacacctccacgtagctagagtagatcgcttgcatggccacctcgtggaatctcctcacttgacacgtgtagctctcgacgcagtaggccccagtccaaagcactcactgtcaccacaggctgacatgtgggcccaaatcatatctgggcccggttttcagcggcagtgtacctcaccttctctgccgcttgcatccgccgacgaaaaggagtggtagggattgcgtgtgcgcgaagcgatgcgttgccgctcgccgcgggctaccgaagctagtaagctgggggatctcgctcgctccacgcaccccgtcgcgtgcacgccaaaaaacgcggggtcgtactcacgtgtatctggtgggccagccgtccgtcgcggtgtgaactcagcgagagagagcagattaagcgagagcatccatccactaattgatcgattaattattcgtctcagaaagaggaggagataagatgtacagatcatagcagtttcgctgtctctgaatattcttatatagctaactagaaaaagcctaggaggagaagtggtctcatggttttcttaattgtgcatcgcatgtcaccagctgaacaatgttacgagtaattacataatgaattatgaaaaagaaaggctcgtggaagtcaacttgtagctgctctgggcatctttcgtatgcatataaaaactatgaacaactgattatctcaattctcaaggactaacatcaagttagacatatcgaagttttgaagggctggatcagattcagtctctattgcacaatgtcaacttcacagtttgcttaaaggaaacgctctcttgcatgctgtttttcgctgtgttcgttggaatggtaatttttttctctcatgatgctgttgttattggcttattgcagacaagcagaggctacgaataatgtcaaactgtcaattgccaagcactcaacctaactagctgttccttagcccttgacttatctctctctttgtcgcccacaaacttatcatctttgagaaactcttcacacgccattgcagcttgcttccttttgttaagcggaatcctgggcgatgaaagtgactgcggactaattacttttagcaaaggtaagaggagctttctgatagtgctaaatgcttgggtttaacaagcatttcataaaaaaaaaaagatctttgttcacataactgacagcgaagttcctttgcactaataggttgtcaactatgctcggtctctccgtgcctgctggagcacgacgcatgtacagttaacgggctaggaataacacagcccatttagatatgggtcgtctagccatgtcgtgtttgggctgctatccgggccaacgtgccaacacgacaacgacaagcgcatgtaacgactagcgacgactcagcacgacatcgcctagaaaaggcacgacacgggcacgatagcgaccggcgattaccgaatagccgccggtcgagcaactgccaaccatggtgggcgcgacgttaggactgcgcagcagcgtggtggcggcggcgaccccattgacgagctattctgatttcctgtcgtgggctgtgtgcctgtgtcgactagcacggaccccaaagaggtggctcctgtcgctctcgccgccgtccgttagcgttagcccccgcgatgccgcccaattagcccccaagacggcgacgatgacctcgaacaacgccgccgccgtcggaatttcctcgagcgcgtccggcagcgtggcggaaggagtgcctgccgcccgccgcccgccgcggtggcgcccatgctcgtcgacgcggcggagcccgtcgaccccgtctcggtgcaggcggtggcggcgcacgtccctcccgccgctgtgtccgccttgcccatgggccagttccacgactagccgggctcaaacagaacatagcacggacgcagcatccgactacaagtcggaaaagacgcgagcctaagtcgaatcggaactgtaattactctttgattggccattattaaaaaaatagtttgggattagaggagattaaacccaagttaaattattagtagctcaacgctatgaagcgaaagagttcgatagtagcgcgtaaggacgcaaagaaggtgcagtcgtgggcgactgtcacgacgtcgctcgcgaggttcagggaagaggtggctcctggcttcttgtcgctctcgccgtcgtccgtcagccccggcgacgctgccgcccaattagccccccagacgacgacgataacgacctcgaacagcgccgccgccgttggaaattccacgagcgcatccggtaccacggcggaagtgtccgccgcgggggagcccatgctcatcgacgcggctgcaccgattgcagcggagcccatcgacgccgtcccgttgcaggcggtggcggcgcacgtccctcgcgccgccgtgccgcaaagagtagatgatgacgatgccgctcccccgccgccggcgtggatacgcggcgagctgctgccgctactaggcctacgcggcgacctgccgctgcacttcatctgcaggaagcgagtggaggcttccgacctgtcggcgcagcagagccgcttcctcatcccgcaagccgccgccagcctccgcctctgtccgctcctctcagcggcggagcgcgaggccgccaagctggtggaggagttcttgcacaagaaaaagaaatcgccagaaccaaagccgagggagaagggggagaagagccccgggctcgccgtgcgcgtggtcgtctaccgtgcatccccgctcgacgtgatggccatggagttgaccaggaggctctccaattgccacaccataatccggcaaaaagaaaccacaaggctcgtcgaccgcggcgtccaggtgaaggacgacgtcgccgtgtgggcgttccggccagaccccaacagtgctctgcacttcgtgatcgccaacaccgccgcccagcagcagcagccaccgccggcagcagcaccgaacgcgttgccgcaatagcaaaagccaaagcatcgacgcagctccagaagtgataatcagaaagtagcatcagcaaaggtcaagatgatagatactaatcttagaaatcagaacggtgacctgttaggtctcaagaagagttacaaggaagactgcacttgggcacatataataactcggctatcaaaacaaagcacaaatcattcttgtctgacgaacacacgcgaacatgttaaaaacactctcgaaactgttggttgaatggcgtggaccctccatcctcagcgctcgaggcacaggctcagctagtccgagctgcttaaaccctgcagctggtcaggatacacgcacgccatggtcggcaagcaacttaaccccaactataacaaagggtaaaggcctcagtagccggtgtgctgctgccacccctggtgagacggctgtgattgggcattctggaaaccgttcaggcctccctcggccgggttctggtggtgctcttggctttgagaatggtagaaagctggatacccatggccaccgaattgcgagtgctgctgcggttgctgcgcctgacgaaagccaccctgctgactctgtccctggaagccatagaagtgactcggtggaagcgccgacgttgctcttgaaccagcaccatgaagccacattgcagaattgtcaccctgaaaggaatacccaaagtaacttgtgactaatgtcccattcttttcagattatatagctactactttcattaaatccatcattgattgttttttaatagtatatgtgtaagaaatgtttctatattattctataaacttggtcaaacttgaaaaggtttgacgtagaacaaacccaaagtaacttgtaatatgaaatggagggagtatgatttttgaaaaagcatattctatacagaattttcttagaaaatacaaataaatccatttttcaaatttgtaataataaatggagtacttaattaattatatgataattaagtgttttttccggtaagccaagcactcatccaaaaccttcgaaccgagccgtgcctatcagaattattatatagcatataaattaccaaagaaacacaagggctgcttgcaattgttacctgctggagggccatatattggctgggatctttgtatggcgtgctcaatgcttcgtcaaacccaagatttgttgatgcagaggcagcattctgattaagagtgaaatttccaggaagattactagagcttccaaatcctccataaccagagatcactgaagaaggttgctgttgtaagcttgtagccgataggttgttcttgaattgcggcacattcatattgtacttcatagctcctggtacagcagcagcagcagactgatggaatggtccattactcgagtatgcttgctggaaggcagctgatggtaggtaagcagcagggtagttctgtgccaaatacggataaccaatcatattcgcaaaaggcgccagtggtacagtaggctgagagtaagggtggactaattgctgagggagaggaggccccgttgctatactagtacttggaagattttgggtagattgagcgttggagaaaactcctggcttcagagtctgaaacaaatatgtacatgtgtgtgaagaaaattagagaactagagattacttgttgctgaatgattaactgtatatgcacacaaaataaaaaattccaacaccatcacacccttgtaaattcatctttcaaataaagaaaggatgtggagcctttttcttcctaaagttatacttctatgaaatatgaatccagagaaaacaccatgagaaagtgaaccagcgtagttaaattacctcttgcatggagattgctggtccagtagtagttggtgcagctgagttatattttgtcattgattgtgctgctagcaaaggtgataaactgaagtccaagtcccgaagaggtgcaatgtttgaccccaataggctgttgtgtaatgaatttgcttgctggggaataaacgagttcaataagaattatgcaggagcacaattagctgacttgaataacatgcatatgcagaagacagaaaaactggtatccagaaagaccagctcccaatgttattctggacattccagaatgaagcaatgatttacatctgtggtcaatatcttgagacaagagttatgagcaaaagaatgggtctatatggcacctttttatttggctcttttccaatcaaggtaaaactagttatcttactgtatgtagcaagatcatagtttggctaaagctacttagtactgttagcaattcagcatgaatgatgaaaagtgaagattataggaaaaagaaaacaatttaccagtaagtttgaaagatgggaaagagtgtgcgcctggttgtttccttgtgaggactccattgacttggctgtgtagtgtttgcatatgcagcacttgaatcagatggtaggttatattgaagaccggaatgatcaagcacttcctgtctcaggacatcaggctgtgaaacagaaggtacatcaatgttctccatgttagttcctatgatagtatcaaggttctcatttcctgacgaattaactgcggcactatcataatagtcttgatctctgcaagattaaaaaaatggcattccagtcatgtcacaagcaatatgtggagtgaaataaagacggcaggaacaaacttaattaaccttgaatcaatttgatctagaggtacagattcctctataacaggcaactccacattgttatcatcagcgctccttgatggaacagggagaagcccagaaaatgctccagattcaaaactgccaaagctcaaagtgacacagtctgagccggtaacttgcaggtgatcaggaattataactgcagggttatcttcagctaattttgttggaactaactcttcattatgtaggcttagaccctggaagttttcagtggctaacgctacatcagaattggagccctcaactgcaagaatagtaaaaagaaatcagtattcacatgcaggtcatgcacagccaaagccagaatgcaacagcgtccaggaaaagaacaagcaaccagaaaggaacatatgctgtaaaacctattcacaataaactgcatgacctgttgttgccttacagaacttttaatactggataacacgacagtctaaagttcattattcatcaagaaagtaacagcatgacatcagaaatctgaagactggtattctactactaaaaagatgcaggaaccatcatatatcaattttgttcagtaaagttgattacttgccagttgcaacaactgcctccctaaaccctatcataacagagatgcattcaacatacccagattaacataggaattgataacgtcaattacagggtgtaagttgcatctcacacctacgcaagtatcaatggcattctggaaggaataccaaaagtatttactaataaattgtctgctgccttttccaatgctaacgaatgcaataagctcataacaccaaagatccaggttattccagcaggacagaatatggagatgctaaagttaagcaaattcataaactcatatctacactcaccttcatcttctgcatgagaattcttctgaggcagataggtactcgattcttgcaacagtccatcatcatattcagaatcgcctccatgatgttccaagtgtctctcggaagaaaatgcagctgatctgttctcatccaaatgagaattttcatgggggttaatcacaccagcaaccagtgtagatgactgtagcgatgactcatataatgattggtcaccggatgtctcaggcaaggctgattgatttcctggtggtggctcgtcctgtggaagccaatcattatcatatgcctgcttgttgacagctgctgagtggttgtgatccttgggatgaatagaatcttgagcagaatgtaacccctggtcaggatttgttggtgaaactgtgctagcagattgtttcaaattctggtttacagtactgggcaaagatgggtattgtccagtatatcctttgtctgcagtaaccgcaggcttgctagaggactgctttacctgaggcctgcccattttcacaatatcggccattgacaactgacctggtgtcccagaccaaccgtgctgaaacccagatgatgattgtgcaggtaccgacggtccatcagcaaccacacttttgtttaccaaggaactacagcagataaaaaagagcatgaattccccagagtgaaataagaaggcgttatgaaatcatcaacgcatcagataaaatttgtagtatgcattaactttcatgtgggatgcatcatccaagttcatccatattccatatggttcatttgaatctaacacaacattacaaacgatagtctcagataacaattatatgtaactatatgaactattgagtcatagtcatctaacaagagaattgtttgtaaaaaaacctatgctgtttgcatgaaattttacacataacagcagaattaacaataatgcaaaaggatcatatcaaatgcaaacagataaaggctccagagaaaagacaactagaaaaatggtatgccttctaaaaaggcagacctgctgtacaagcccttcttaaaatatatgcaacaaaagggaagctctcttaccttggaattgtttgcttctgagtggaattggttgatgtcataccaggccctgagattgaccttgaagccacattgtctgaatattgaaatgaacaaaaaaaaaatgtgaaaagaaattacaaccaatgataaccttgaagatactgatggtggtttttcctattaccaatggagctagagtaaaaagaactgtttcgcccgcctcgatctgcaccgcctcttacacctcgactggcagcattacttgccgctcgagatcttggctcaggaatctctttaacctatgaaagtgcccatgactataatggtaagttcatcaaggctagagaattttcaaaataaccaaaactccaaaagattagttccatatgcttaatttagacgcaggggaatcagacaaaaactaattgttacatgaataaaatgttttctttatgctattgatgatgaaaataaatatagggcaaccgaatcaaagctgagtgctggtcaaaaaataaggcgagcaatgcaagatgtggggcacacctcttttttcttatcgcgcttgctctttacctcttgaaaagtatctgaaaaaagcggtacataagatatcaattttaacataactgcaagagcaactgaaataaatataactgatttatcttggggtgcattgtcagatcacagtttaaactgactaaaaataactggatgatatgatcaacaaaggcatacaaaaaataatgttgaacaaaaataaaattggcatgacaatatgagaagaaatttagaaaaggttgacaaaacaacctaacacttgcctcctcgaacattcattaagtatgtgtgcagaaaataagatattcaatatgtggtaacagtacagcatataaactctgaacaagaaagtagtcataaaacccaaatgacacctctatgccatttcaggaagctgtattatgactttcacatgctacacagatgaggtatattaaggtggcaattcccactcctggctcatccatcatccctcataaacttagcagcaatagattaccaaggagtcaaggggagtaggagactaacaatgttcaggaaagttataacacaaatacacaatgcctcttgtaacatgttgtaaaagtcaaaccaagaaaaatgccatggaaaaatcatagatggaatagataggctaccaactatgtctgacagttaatctttcttcaacttcccagatcaaagaaaatgcatggagtttcaattaataaaaagcctccttgcaaagagaagagcccaagactaatgccacaaatcactgcaagctcagaaacttatcctacagaaataaagccacgagttcaaatggcacactacgatataaataagctaaaggtggacctgagtttcttgcttactaccactatatgaccaatgaaattcagtaaatatcatctaatagcccctttcatcatatacatatgatagttacacttccccccatgtccatatgttattattgtcaacacatcctaaaaactgatgatggaatgtttctatagaacaatcagagatgcacacattcttctttataaattatgaaaagatatgacacaggaaagagcgacaagagcaaaaacgaaggcactaaaacacctatcgaactgtccccgagaatgaacacaaaactcaaccaccaccctgcagaaacagcaagtcctaatttcacaagtattgtaatgcaaatagccattttggaagcaacagtaatgtgttcccacttttcaaacatagccaatatgagaagccagagggtccatctcctttcccaatctaaagattccactcttttcaagcctggtaactaaaattaccacaaccatctcttttccaatccaacaactaactttagcatggtgtatttacctagacaggtcagtaaattgatccaaacagcaaatctcaagtaatgaactcgttccactccttctatcctacataatcctaccaaagatatagctgtttctttcaaagttcagaaaaaagttcagtattcatctgtttgactttcctcccaaaaatctcaactccttcctacaaccgaaagacaagaaacaaaaggagatcgattcctataaataacaagcaggatcgacctaacccctgctccagaataggaaaacgctagccactgttaacatttagcaggaaccctaaacagaaaccctacaaatgtacaacggattcaacgaaccccaaagggccaaatctatcaaatgctacaatcataaacggataaatcatgacaaatcggcaggactctcatgaagaaaaaataataggcgcatccttcccactcatcccatccgtggtgcgcacgctcagagcgcggcaagtaacgaatagccccaatcggaaagaggggcacgcggttgtaagaatcttctagaaccctaacggcgacgagaactcgaggcgcgggcgcatcagggaagaatccgcgagggggcatcgaaacaagcgcgaaatcgcggggtgggagagggcgcgcgagaaagagagggggcggagaccttgggagaggaggcggctgaccgcctcgtcggggtccatgccgcaatcgcgcagcgccgcgtagatctccgcctccgggcggttcacgatctccttcaggctctgcaccagcttcctcgacgccgccgggacggggcccgccgccgcgccccccttccctcctcctcctcctccccccgcgccgccgccggtcatcctcgccgccggagagatcccccccgcctcctcctcctcctcctcctcctcctcctccccacactccgcgcgcgggaaacccctagggaccttgggggcgagtggtgcggcgcggcgcggcgaaggcgaaggcggcggcggcggctagtttcggtttcggctgcttccactttgctctcccacgcaacggcggcttctaattccaaaacccttcctcccctccctccgctgcgccgagctttatatagctggggttggatggatggatggatggattgtggaggaggaataaatagtgggggctttactttttccttccgtgtttagcagtaacttacacaaaaactgaaatttgccttgataaggtcacctccaaatctgcaaatttactcatggactctgtattaatatgtattttcggataacttctattttttgaattatatatttataaaaaaaatgtaaactataataacgtattaagaaataagcttgttgattttttatgggtataaatggtatctatgcccatcatattgtttgttatagaaaccaagtgtggtaaggaagtaggttgcggtcctgttcagacacctgggttacggctgcgttgtagcccgcagccacccagaatagtgccatgtgtacaagatagctagaggctgcaacagctgtagccgcatgaccgattgccggacagacccaacatttgtagcctcgtgaataaaaaaaactaaatcaagacaataagtgttaaaatctgaagagaaaaaaaaacttaatcagtgctacccctaaattgatcgagctatgcaagattctattttgatacgtcattcgtatttgagttggtttttaagttcgttcgcttttggaaatacatattcatatttgagtcgaattttaagtttgtttgcttctagaaataaaaaaaagtcgtataagaaatctctttaaaagaactcgcatgctaacttgagatgaaagtcgaactcctaattgcagctcatgattttctaaaaaaaaaaatccaagcgaattcctacagtgaattttatcctaactaaaccgtataacaataataagattttaaaaaaattagttgttgtaaaaattgaagatgttttcaccgatattttggtacgtcgtctgtacgtatttgagtcggtttctaagttcatccattttttgaaatacataaggagttgtataagaaatcatttaaaaaatactcgcatgctaactcgggatgagagacagactcctaattgctttataattcttgacagggcataagaaagcaagcatacagcatatggccatcatcttaataagagttccaaattagacataagtactatcaaaattaaaaaaaaacatatacttttactaatatcaaaatagtcttcatccgttgcaatgcacaagtgttttttcatagtttaactaaaaaaagcaaactataatgtattaagaaataaatttgttgattttcatgagtataaatggcatctatgtccaccatattgtttattatagaaaccaagtgcggtgagtaactaggtagcgtacctgttcaaacgcctgggttacggttacgttgtagcctgcagccacccagaatagtgccatgtgcacaagacagctagaggctgcaacagccgtagccacatgaccgattgccgaacataccaacatttgtagccttgtggataaaaaaactaaatcaaaccaggaagtattaaaatccggaaaaatattaatcagtgctacccctaaattgatcaggctatgcaagatcctatttctcgtatgattaaaaagaaatcctgcataacgatttatataaaatgatttgctagatctcaacttcatatcgaatatgatgttttaactttattacttgattttttttaattaaatgtgaggtgaaattttagttctttttcaaacctagagatgcattggctttataaaaaggaggagatataacatgagttcgcgaagacaatgaagtaaacttgttgttgagatacattagcaccgacttattgatgatactaaactggactgatgagatcgatgatatgtgttatccttatgtgcaaagaagcaacatcctcttgctgccgccaccaaggaggcatgttttctatatggtctttgactcattctgtggcttttagttctagcatatacgtgaacactgagatattattgatgtcactattcatgagaaagagaagaggacgtcgttttcatctccattattggtttatgagaaagaggcatcttgcgattatagtgtgtaagaggaatatatggtactatacttccatatcgtgcaatgagatagtagtgtttgtttcgaatgggcatatctagggctagctagtgttgcatcctatggttcatggatatggttcgactaaggccacccatgaaaaaaaaaccccttataatgcaatgattttagttgggcttgctaaaagctttcaaaattctccatgttgactacatgtctttaaaacttaaacaaggtgctactccatgatatcgtgttagcgagaaaatgttttctcatgtagtgtataatataccagtaacaagttaaagattgttgaatccttacatactccctcaattctataattgttgttgttttcgataactacaaggttttcaaaatatatatcaactatatattttattattaacatttaaaaagtaattattggattttattaacgtattttaaagtctaatatgtacatcattctgccggtgtttccaagacgactattttaaagtttatagtattcaaagtttaagtaaatttcataaaactacatatacttcaaccaaaaccacatgtattttttttataacttttggccttaaatatatatagttgtatgatatttttttatgggggtttttatgataaattgaccttaaatatgtagcttcgtgataatttagtgctaaatatgttgttctacgataggtttgtcaaaatatccatagtttggtgaaatttactcgtgaagtttgaattgtttgaccccaactttatacaaaacataaagaattaattgtatgtgcaatctcattaattactcgctgcaaaatttagagaaccctacaaattggcatgccgtttcaagaccgggaaaatccctgtctgtatattaatgagcagattacaatcatcaatcacgttgtaattaatgcgtgcataaaaaaaacacgggtacacgtgatgacccgtctcgatgatctacacgagccagcagtctctccctctcatctaggcccagccggaaaagacacgaatcgcacggcccttggtacggtttggattaagtctactttgcatccctcattcattatcttgatccaaccgtaaaatcggatataacacagttcccatctttgaaaaacgggtacaaattatcttcttggtggttttgaaagcagtttctgtagatggagcccacatattaacgaggtatgataaaaatgttagaaagtgatagacaaacaaacgataaaaaacaatagattaatcgtataagacactagatttaacgtgaaaaccctcccaaaacatgagagaaaaaaccacgggcgccagccagcaaaatatattcactatatcaagggtgaggttacaacgccgcacggcggcttacaagagatatatatatggtggaacactaaaagggatgacgatcggtacctccggcccaagcctaccggcgacaggcctccgccccacatctccctccctcttgcttcgaaggcagcagcggaggcccgcgcgccggatctcggcccagcgggaagcatacggtccggcccaatacaacccgttcgtggcaaccctattccagcccatcgcgcccaccgcatcatgggccgaatgcagcgtcgttgcgttacggttcagcccaaaaaccccgcagatttcttcgagaaaaagagggaaaatccgagagaaatcacgagaagttgccgctggcgctcgcctcgcctcctcctcctcctgctggcctgtccgccacgtcgccgtcgccgttacgcgatcatctcatctcgccgagtcatcagccgcgagaaaagcaagcccagatccaaaaacgagacccccaccaccctcgaacccggcgcgcacgcttgcccatccgcctcggcccccgcgacgggaaagtgaggcctctcgtgggccgtcgccgcccacccgcccggacacgtggacggtcacggtgggccgtgcccacggcttcaataacagcagcagctcacctcgccgtccagttcgtcactcacacgcggagacaaaaacaccttcacaattcgcgaaagctcagctgcttctgcttcttcttcttctttcggattcgagaagaggatgtccatctcgctgcgcctcgcggtcccgacggcggcgccgcccgtgctgccgccgctgcggcagtctgcggtgcgggcggcgggctcccccgccgccgccgctctgcggacgggcgcgctcaggtgaggcggctatctgtccgggttaatgcggtggatttgttcgtactgacggtgttgtggtgatggatgatgtgcaggggatgcgcctcgctgccgctgaagccgcagccgctgctgggggcgggacaggcggcgagcggtcgccggggtggcgccgccgtgtgccactcgtcggcgcacctgagcgcgcggacgatgcaatgggtctccgccggggccaccgcgtgagtgcctctgtttctcatactttcgtctaatggtagtggaatagtggataatgcgatgcgattcatccgctgtacagcatggcgattttggggtttggcatctgttcgatcttttgcccgtgagaactgtgaatgattgtgcaagtgttagttcatgtgcttctagctgtcactcgatagggacatgcgcaaacctatcttgattttgttgtctgaccgtgacgatgttgattgttgaaccttgaggaaggacagggcacaaacagagacataatcttgaaatggactatcaaattaacacgtataatctcccatgtaaaaaataagctaaaagaatatagcctcccaaattatgtatatatgtatgcaacttgaggattgataaccattttaaaatcaagttagcacaaatacaatctcattataattgtctactgtttaattttatcatttaatacttgggattgcgtgataactgcactgtaaattcccagtacgctctgattattatttgatcatttaccccctttttgtcttttccagagtgctattgcttgctaaaggcacagccatacacaaatctttccttgtgccactgtttgctctgctagcaccttgcagtgtaatctcatggatcaagtaaggcatcgctattccgtgcaaataattgtttaatacctattatgttccttcattaacaacatctagtaaatgcttgttcggtttaaaacaaggtactctcttgagtcctacttaattctttgatcaacaaatgtaggagtgactatggtcagtggactgcttttcttgctcttttggtgcgtttgttcttctccattccaggtagagtaacaataaaaagttcaatattgtaaggctattcatcattaacattttcctgctgaaaacaacttcagttgaagtgccctcattcagcctgaattcagatgtttatgctttgtcataggtgagctggagcttccattgtcaactatgctgctcgtgagtgttgctccttaccagttgatgaatctgaggtgtggaacactctccctgttctggaaataatatctgcagcctatacaaacaatttcaaaaggttcaaaatgacatttaacataagaaattttagtctttgcctgtagcgcggacaaaagtaataatttatagcaatcatattacagtatatgaatatcagtatgaacatatgtatcatttttatcactgttgacagggaactactccgtaagatcttacttttttcaaaagttcttgtgctcatgctccaattcccatttcctgtgcacaggggaactcaaggtggtgcagcactgtctttggcattggctgggtacctcgcttttcagcacttcaccagggttgggggtttagggaaagcatttgatcagggatcataattgcaaccttggccatcatctgcatcacagttatccccttgatgatgttgttctgagtcagattaagctggcaagccgttgttcattgtgggcattgcaggagctagtagggagtacagaaaaataatagctttgtaatgcaacaccctgtcagactttgtggccttgataaaagtaataatttatgagatggctacagaaatgtttactgatgctgatgtcttcagggatttgctcattttctcatttcttaatctctttcgcaatcttgcaaacaattgatgcttgtatggcctatatacaattatacaaacttataaaggcatgccgaaccttaaaaaagaaaagaaaatgggcatgccgatggccaatttctgcttctggatttatcatcccctgatgtagtggtgctgtctttttaagtctgtaattacataatcatgaatataacttgttcatagaatcctcttaatttttcagctgttttaacacaactaatcgacgatgatataggggcccggaggttaatcttccattaactaaactgcgacgattcttggtgcaatttcctcgtgctgactaacgtatcctctgaggcccattttaatttttagtagcataggaaatacgaagaatttgaattttacagaaaactttgaaacaaaggatcaggactatacgtacgaggaccctacgaaattcatatggaactagtaaggtgcccgtgcgttgcaacgggaaatgctatatatcaatttcaaattatattaagtgaaaatatattaaataattattgagtgaaaatttgttgaacactgaaaaaaatctggcaatccaaaaaaactacaaatcatgattcagtcgacgatgttttatcaactccatgttatgcttgatgtcttcagcgtctttttccccgtctcacgccagtacccaaagaacgaaagtctgaaccgatttcaggacacatccaatcaattcgttcgaatacataattcatggcttttcaacgttaattaaagcatcacattcatatatcagtacatgacatggcaaaccacaaagccaaggttgccataatctaagctacgatcaaattacagaaatctttgcatttgcgaataaatgcccaagagagaatagattaaatcgaatgcactatttcatacacgtttggtattcacttccaaatatgagagtatgcactaaaccttaggagatatatgattgcgtccatattctaatacagaagtatatgatacttgcttcagataaaatctgacaaggagaacaaaagttcaaactcgtcataaaaaaaatgtgtgcgtgttgagaagtaaaattataaaggtaccattttgccatcgttcggaaggagctgactctgttattgaatatctgatcctttttttcataaactcactaatacatatgagctagctttgattgatcatcatcagctagaagtgaaattgtaagtcaatagtgaagataaatgatggttttgagagagagagagagaggtggggtggggaagggggatgaactcaccaaaatatcccaactgcatacaaccatcaaggatcacgcattcatgtgtgatagagagctagctgaagggctggcacaggcaacagaatcaaggcagcaagtgccaaaataatgggacatgatcacattcaacgacaagaaatatatagtattttccaagaattgcccatcctctgctagaaaaattcccatgttgagctattttgatctgaatccaaagaaactattaatcaaaaatgaaggtgcagatttgcagttcactgggtacaaaagttagatgcacctctttaacatttagcagattgctctcagcatatgacaacagcttcccagtcaattgagctattgtcctttagaccctcaaacagctcctccttttgtgtatatatgccttcattatatatatatgtctgaaaaaaaccaaacaaaagggagaaatttatgaacatccctgctagttggttattttacaaggcattgaaaaaaataagaaaaaaatgatctactccatagtaatgacaccctgaaacaaaacagataaaaacaagaacaccaatagccgagcacatgggaaatcataataattaaattgacaacacaaaaaagaaactaccaagaccacaggcagcaagaatgacttggagtgaagaaagctgctaacaacatagggcaggctcccatctgccaccagccggctcagattgcaccagcagcaagcatgttggagtttgcagcaacaatcatgaagcaggataggcttagttggtgatcttggggttggtgtggttgttcatcttgagctgaacaatacaacataaaatgttagtcctactgctaggtatgaaaactcagctcaaatttttaagcaggtatcagatctatcacagctgagggttattaatagtagaaaatgtaagcagtgtcaactgtagagcagatttacaacatattaattcttgggctagctttaacatatgttatgcagatttacagagatgaagttcactaattaataacctgcaaatttttgtatttgtgcaatggccatctatgagaatttcaggatcgatatatcacgaacattgcttacataatcttcactgcatcattccattttttattttcatccactctgaaacaatcaagaaccagattagttttgagactgcgagatccaaattagtttgctccaacagatcaattgaatctttttgcttggtagcaacactctcaacttcccagcacttcatagcataaataacaacagagagaatcctgcaatcattagtataaataacaacataggggacatgacaatatgacattctcacttacagagaaatcaatttctggtaatacattggctaagcagcatttcgttgaacatcttatgggcaaaaaagagcattagtgatcctgcaatctgtaataaccctcggcactcacaatgatgattcttgataaatgaatggattgcaacgtaaagagaacgaaccaattatccacagggcgcgtagagtgctgaaggtcggcgcatgcgtcccttctccggcagaagctaaggagggatcgtgctccgatggtatccgggggcatggagcgctggaggcgggcacaggtgtcacctctcccatggagcgggcgaggcggctgggaagcagattggcgaacctcgcccttggcgccgacttgggcgaggggcgagtgagggatcggcggcggcattgatctgggcaaggacgaacaaccccgccgcacctcgcaccgcattctctccctcagtgcctggtagtgtcgccgcgcgcagccgtcgttggagtgaggtcttcaacatctcccctctgtcgactgttgtggcgtcgatgcagggtcagcgttcggtccccaatcggcggggtgtcgggcggcgatgagcgtgcgaccttgagaggcgaggcgtgcgatggcgatctgcggtggatggatggaggcgggggtgcggccggcagcgagacgcggcggatggatggaggcggtgctgacgggggaagtgttggggcgatggggcgggagggaccgggagagcaggcggcagaggaggaatggatcggtggtgcgactggcggcgagacgcggcggatggatggaggcggtgccggcgggggaggagcgcgataggaggagcggcgatgtcgatccgcgacggcggcggcgtggattcaggcgagcaggagtggcggttggcgaaggcgtggtgggggcgcggcgaaggatgaggggagcggcgtcgacggttggatagtgagcgcgatctggcctgtgggggagagaagtgattcacggaggggaggagcgcgtgcgatgggatcctcagcaccatccgatctgccaatcccacggttaataagtcgcgtgtttatcaggttggagtcatcttcaccactacagaattttaaagtaataagtagcctgagttttaatctcatgcaatcctttattcaagtatttatctcttctctaatccgtgtaattttccattttgtctatttaaataatcattattttttaattttcctacgtcctgttgtaattctttatttcatgtttccatttcaattaaaatcatataaactgtatatcttttcctaatcatgcatgttctcaattgattttcgaagaggttttgatagtataaaaaagagtaaattgtattgatggtacataaacttattaggtgggtgtaatttagtatatgaacttgcaaaatgcttgttttttacacgaacttatctaatccgtgcgaagtaggtccaaaatagcatggcaaggttaattttacctaactgatattgattaggatatggcgtacatacatatagttagtatacataaaacaagctatatttataattttgttctctagtttatcttgaatttcatatgtttctaaccctttataattgctcagttttttatatctttctctacaatcaccatgtctcattctatatttttattgaacaggtgtatgtctaagtagcaatcttctcatatatatatgtgtttacgtagtatcctaatcagcacctaaatcaacaaaattagtcatgtaatatccttttgaccttagctcgcacgcggaagacaagtttatgtaaaaaagagcattttacaagttcatacactagattgtacacacctgacaagttcatgttccgccgatgcaatttactctataaaaaaaagcacgtactcctgtattggcccttcaatttagggcccgtttagttccctaatttttttttccaaaaacatcacatcgaatatttagacacatgcatgaaacattaaatatagataaaaaaaactaatcgcacagttatggaggaaatcgcgagacgaatcttttaagcctaattagtccgtgattagccttaagtgctacagtaacccacatatgctaatgacggcttaattagtctcaaaagattcgtctcgcggtttccaggcgagttctgaaattagtttttttattcgtgtccgaaaacctcttccgacatccggtcaaacgttcgatgtgacaccaaaaatttccttttcctcaactaaacacacccttagggcacccttaatgattatctataggctctctacaagagatccatgtcagcatattttcttacttggaagagaagagcaaagctatctactaacctggagatagtctatagagaaaaataaggcaatggattagagagctatagatacccatatagacatactattaaggtggtttactattaatctagtttattgctgagatatacatattttatagagagtaccttactttaccattacgggtgctcttacggtagatgcacgccgttggctgaggtcagatgaacagaggccccacaggttccccaggtcctctccccctcctccacgtgacggtcgtcttctccacgtgacacatgcgccctgcgccctttgcggcgattggctccccatcattttgcctcttcgatccattccctctcctcctcctcccctccacctccacgcgctcctccccacctcgtctcgaacccaggtatcatccagaaatccccccttcctttgcttggattgttgtttcgagcgatttgttctgctctttgattttccgtgctcaatctgatccacatctcccccctcccccctcccccctccaatccaaccatttctccgcggactcatttgctgtatgtatggttgagtgcttgctaataggcagtttatttgtgaagaaatttggggattgagctgaatcagctgcatacagccatacagcaatcaacacagcagatggatttagaatcatgtatcagcatg

SEQ ID NO: 45194 - DNA, 1539 bp, Oryza sativa
gccttttctcttttccatgtaaacagacaatttaaaaaaatgaaagaaaagaagaaactaattcttcatggtgtaatgctttataaattgtgtcatctactcatgtgtggtaggtcaaaacatactaacattgagttataaccgattcagaatatgtttatgctccacttttgtttttccgagttagtatgatagatcatcgcacttttattattgttcaattcattgataactcatgtaatgtcttggaaaacttgtgtgcatctataccttatccaggttgatctactcttgtccagtcatttctgcagtttgcccccagtacctctttgaggaccaatattggtgcaaataacatgttgatagtgcaaacatattaatgataaattcaattttagaacatatgcaaacaactgttagaaagttatgtatgaccagcacatttggtttctacattatttgtccaaaaaggatgggtcaattgctgtacctaccctccattgataatgccaaaaatattgcatataagcattatagttattcttgatgcttagttactcaggcatgttcctcgtacttctacattattatttatttttttccatgattttatttcacatttcctcttccatcggtgtatgtcctagtttttatccaaatgattttggtagctttgggatatatcatgtcataaggatctgaattggtgcagcttgttgaaacatatacagtatgtcggggaagccatctgatgatacaacaggtcaagtgaggcccgaagtagatggttccgatgagaaagtagaaattgccaaccagaatgaaaaagaggtgatgccttcacctcaggaagaggtactgtgttttcttaacatttgtgattttagtccattagcaccttatttcatactatagtggttaactgggtatttgcaggaagcagcaataaagaaaaagtatggtggaatagttcccagaaagccagcgcttatagccaaggtaaccatcattgccttggaatctgattcaccctcttatacagataccattgtacaacatctataattctatatatgaaacagttagagaaattgatttaatattatctccatatccatgttatttacttatgctgaaaatgtaaaatgttttttcaggatcatgagcgagcttactttgattctgctgattgggctttggggaaggtattgtcatcttatttccaaagtgaaaactaactttcatgcgatgctctggacaagcaatgcggttctcaataaaatgtcattcacctgatctcggcttcctgcagcaaggaggacaccctcaaaaacctaaagggccgcttgaagcactccgaccaaaattgcaggtgctaaaactcgttgcctttttagaatgtacttacattgtaggattgatactttcttacgttggcgtgaagtcaaactggatgattaggatatctgggaaatctacctaatgtttatccatgctgttggttcttttcgcttagtaaccattgtacagcactgaatg

SEQ ID NO: 45195 - DNA, 20733 bp, Oryza sativa
tatatgctgaaagttaaagcttaaaatcgcttgcaaaagggaataggacacgtttgcatgcacggggtcagcacattcacgcatgtctttttgtcattcttcccataatttgcaagagttgggtctaagaagaggtttgatttatatgtggagggaggagcttttggttggatgaaataattccagctggaaaaaagtgtacaacatattagaagaaaaggatcggaaaaggacatgtggttgatgatatagccgtgctgtttttttcatttcaaaattttgtaagtcatctataaatattgctcattactcctctttcacaacgctccaatgaaggtcgatctgtgatctgaacgttttcttctagagtgctgtagctattttgtctaagaataggatccgaaaactgtagccatgatatagttcttgtttgtaccttggactagccattaaattttgtgtgtcactttttagtttatgttcacagcgatacatcatacatgcatgatagtatgcataaaaacgaattgatgacttcacttgcattttcagtgtgttttaatttttaaaacatgatgaaacagggcgccaaatgtcatgtgtacatattgtctttcttttttttgtactaacgaattggctgtctcgcaagaaatcctactcatgcaccacggcattccatctccaacttatcaacaaactcccttttcgcgtggataacatgagcccaattataaggatcaaaacttaatatttcttatgttttctaataagctcatcacacacattgaaaaatggtggagatgcaaggacaaaccacggactgcttgtgaactttctgaaacaggaattgcagagtgcaccacaaggcagtgtctagcacattttggcatcttgcagacgtgtagccgaatgcccgtcgcattcagggccactatagcaaagctcacttcctatttcgccgctacaaatctgaaacaggaggcgcatttgtcgtgctgcatcggtgactcgactcgcgcaagctagcgtagcggcgtcgtacatagtaacgtgggtcgctgtagctaagctgtagcttaagcttaactgggcgcacaatctcacatcatcgcgaagtcccatcacatcggcggtgtccctgtgtcgagcagagagacgagctaggaggaatcgtttactttgggcctgtttaagttggtggaatgaaaatttttaggtgtcatattgaacgttttaccggatgacggaaggggttttcagatacgaataaaaaaactaattccatacctcgcttgaaaatcacgagacgaatttttcgagcctaattaattcgtcattagtacatgtgggttactgtagcatttatggctaatcatgacctaattaggcttaaaagattcatctcgcgatttacatgtaaactgtgaaattaatttttttttatttatatttaatactctatatatgtatctaaacatttgatagatgtttttaggaaaatgtttttgggaactaaaaagatcagcttgctcaagtggtggatccctgcggccagtgacagtgaggtggtcagggtggccaagcaactcatgagcatgcagggtagcttagcttggtggtgtactggtgtgctcgtgcatgtgacccggctgtgtccggggctgagcgggcagtcaatcgggctacatgtgcccgaatttggtctgtctgaattcctgatctctcatcagattttgcgcctgcgtgatggaaaaaatccctgccggtcctgtacctgtcaaagatctccaccgcagatttcaggccatgcatgcctctcgcacctaacgagcttaattatttgcacacgcctccaccctttttgatactgcatttcattttggctaaaatgaggatgattcatcttggcttgtttaagttgggaaaaagaaaatttttagatgtcacatcggacatttgaccggatgtcggaaggggttttcggacacgaatgaaaaaactaatttcagaactcatcgggaaaccgtgagacgaatcttttgagcctaattaagccgtcattagcacatgtgggttactgtaccacttatggctaatcacggactaattagtctcaaaagattcgtctcgcgatttcccccctaactgtacaattagtttttatttttatctatatttaatactccatgcatatgtctaaagatttaatgtgatgtttttgggaaaaaaaatttgtgaactaaacgggcccttactaactggttgccatgctcttccttcttcaattaaaaagttcagtaagtttgcagtacgataaacaattgtttggcaatgccatccatagtgggtaggaagtgcattacgacattttaacgatccctaaccgccatgtgcactctactagtgtaactaattaagccttttgtcgagtaaggatttgttatactatatagggtgttccattcttactagctatagcgctggtacatcttctttgacaaaattaagcatcgatccgggcggttcagtcgtgcgtccgtccagaatctgatccctgtcaaaagccgtgataccggttaactgtcctgaagcatcgacatgcttcccaggtaagcaactagagactacacatgcatgcttccgttcccttttcctagctaagacctcggctaattaagttaacccaagtcgtctcgtcagtcgtcagtcactgatcgcagcatgcagcgtctactgttgcacgtgccacactgaaatcacgcagatgcgtgtacctgctctgcgtgcgtacatatggtccaaaagactagctaagctcgcccttgcatgcaaaaagaactccgataaaactggcgtcgtacacgctcccggctgggccgaccggccgccgcggactccacgattcgctaggtagataacgcgatacgaataccagcaagatgccccgcatgcatgctcgcccaggtgcagtggagagagtgtggccgcggcgcgctctccacgtgcatgccgccgcgcgcgcggcgacgagaggaggatttcgtgccggattgggccgcgccgcgtacgtcgtcgttcgttagcccgtcgccgttgcgcccgcgcgcgcgcgggcagttggaatatgctcgcgtcgcggctcgcggcacggcacggcacggcgcggcgcgccgcgccgcgcgtttgatttggccccgggtaaacgccgcgccgcgcaagtgatccccacacaccgcgcgcgcgaccaacacccatgtgccgtggctgttgccgcggcacgccgtagtaggcgcgcgaagtaaatgtgcaggcggcggggaggaggccgcgcgagccggcatgctacggcgtttgtggcagttttcgccggccggtttgggtgtggttggtcgcagggtacgagcgtacgtcggtcggtacgtacgttcgcccggtcatctattgcgcgatccagtagcatcgccctgccgtgcattacgtgcacctcgtggaatgtggcctgtcccctggttcgtgcgtgctggtcctgagcctgggcgcctaggtagtggtgtcgtacaggcaacgtcgctggagcagcgctagctgccaaccaatgcagtgcaaagtttaatactgcagtaattttgatgatcatatggggtcacattttgcgttggccatagtagttcacgagctagttgggctttgttttgttttggttgccaagtccacatctcgcactgccagttgccacgagagggcagaggttaccgattgactcaaccagcaactagcctacgaacataatactcgtcttcgtctagcacgttccactgacaacaaaagggagcatacgtgcaaattcacagcttaatgcacgtacgtatttgttgttatgcataaattagcaaaggagtaattaaactagcgcgacaagccaacggttcctttctcatcgtacacccgaatcgtacgcaccttcgatcgcatggacgtacaccaaaagagagcaaaaaactttcatcatggttgatgctcatgtcgaccaaccaaccagacgccccagaaaataccaagaataacaattcatagagatactgcatatgcgtcgatcaggacaacattctctgttcgaaccacgggcggcgcgtacgtgtgaagtgatacactcactcgtacgtgcacacacgcaccaaacggggttacatcgagacgggcatgtcactttgtcacgtactagtacgcgccaaataacggtgttccatacccccccaaaaagaaaggacaggaagtaccacgagacgtgtggtccgtaccgtgtcttttcccccacagattccgcgatagattaaacaaaaacgaaccgcaagttgtcacgcaggaatacgcatggatgatggaggatcggtggccaatgaacggagaggctcgcgtcgcgagttgcggcgcgcgcggcgcagccgggccgcgaatttcctttgcgcttcggtgcggcgggaggcagccgcgtgcttggccgctagctgggcagtgggcacgccgattgcgcgacgagcattggaaaaacggtggctcgcccatgcgccaccagttggtcttttcgtcgcaaactaaccgcctccatctcctcagagtttgagcgagatagctgctcgtccgtcttgtcagtcacatgcctgctacgtcaacacatagggggtgtgtaggtctaggggtaaagttttgacgtgtcacatcagttattatatagatgtcacgtagagtgttcggacaataataaaaaaaactaattataggatctatcagtaaaccgcgaaatgaatttattaagcctaattaacccatcattagcaaatgtttactctagcaccacgttgtcaaatcatgaagcaattaggcttaaaagattcgtctcgcaaattagtcgcaatctgtgcaactagttattttttagcctatatttaatatttcatgcaagtgttaaaacgttcgatgtgacaaggtgaaaatttttgaagagggatctaaatagggccttagtaaattttacgaaagtacaggtactttggtcaaatcatcataaaactatatatttaagttaatatataacagaactatagatttaacgataaatttatcataaaactataggtttaaggctaagcatcataaactacatgtttaataataaaattatcacaaaattatggggcttaaatctttagcactaatgttatgttggacttataattgttcatgttttgtgattaaattgtcaccaaaacttatagttttgtgataacaaaatttgttactaaatatgtagttttgtgatattttagttttatggtaaatttagtgtcaaatctatagttttataataatttgatcaaagtacttttagttttattaaattcactatttttttcgatcacaggactgcataagtacatgcaccaccttgtacacagcaccactgacacacctacgaatacatcaattaacacacgattatatcagtgctatttctttaatctcactaaatccaattaaaaacccatccgcatatgttcaagtttcctgcctacgtcatcacgttgactggctgcattggtgctctttcagccagttgagcctagaccctagaggaaagctgaggtgatgttccattccacaggtcacagagggcataagaatgtgaacgccaaacttggttagcgtctaatggtctgaagtcgtattgttttggcataaccaccggggcaagtggcaaccaagtgggtgtacttggaaggacatacagtgtactttggtccggtggttttgaggcttgcataattaatttggagttattacaaatttagtagcagtaaggataacttgctttaaagaataaatcctgatccattccggccggtgaaagtttaacaaaagaggtccaaaaaaagtactcacacctctgccttttcaggctggatctctagttttctaaagctataaaacaacaacaaaaggagaaatggtctgaagtctgaaccactaaagtaaggattctcttctactagtaatttgtttaggaatttcatacttggctgctgtctacaacggttgttgcagcccagaatgatgaggatgacggtttactttccatgccatcctctcttttgcatcctatgactaactatatgacacccttaacttccatttatttttaaaattcgtgttaactgttgtcaaccaagtgatgatcgccatagatgcacgggaaacgatcaaaggaccacgatgacgtgctacaaagtgtaccataaaaataagaactgctcaaagtatatgagcttaattagcatgcagagtggccgcaataagtaggatatatcgtttgctttcagtctgaaatgtcaagtgtcaacaccaaggaatgtaatgtattggtacatacttctaaattgctaaattaagattatctaaaaaaagattatgtaaggtttagaaaatcaactggtgaagtaagctagctactccctccgttccagaatatagcaatttttggttgaatggaatgcatcatagtgcctcctatctagatttataatactagaatatatcccatccaaacaaaagttgttatattttagtacggagggagtagttatttagctctagccggtaatcatgctgatgaaacaaactaaggctaaccactgtttttgtttttctctgttcatgactagtatgtttaattttcgcttattaacatggcacttatcgtaaacagccaaagcaaaacgaatcgaaatttgacgtatatgcaacgtagcagacaatacctgaccaaacaccggtgtactagtaacttgtcagttcgatttttttcatttctggcctgcaggatcattatctgctactgcattttgcttctctcgatcgagccagtgattcaggaagattgcgagcactaagtatcaaacaaaagaatatatatttgcaggcataaactatcatacattttttacgcactagtagtgcatcctccaacctttcctgataatattatcataggactgtctcgtcataaagcgccaaagaagaaagaatcagcagggcgtgcaaccaaaaaaaaaaaggagcagacatagccttttcatcttttgctatttgcgccagcgaagctgcgaaaaaagagagatagaacagaaacattgtatatgtttcacatcaatttaagtgcaacgtcgtacattgcgttatattgtactctaagggtgtgtttaaggagaaggggattgaggagattgagaagatacgtaaaacgaggtgagccattagctcatgattaattaagtattaactattttaaatttcaaaaatagattaatatgatttttaaagcaactttactatagaatttttttttataaaaaacacatcgtttagtagtttaaaaaacgtgcgcgtggaaaatgagacatatctcccctgtcactctgtaacgaacagagcctaagtagtgcccatgcattggaaagaacggttcaaatttctaactttagacagagtgtcatttgtctagatgcattcagcattctcgctgtaccgcataaaaggcttagcctccacaatatccaaacgatttgacgtgaactattacttttctgtgaacaaatttttaattttggtctactgtcgactgctggtgcgattacagtatcaccatattgtttctcgagaaatgtttttgcttgtgtgagttgggtgtgcgtggttataaacaacgatgtacacatgcatagcttctatgtaataacaaaaaatatatttttactgaaaaaaattattgcgtgcaaggatcgaatacaaatatttagagagtataaagaagcctgaatatttagcagagtataaactactgtaggatagttggttgcatgatcggttgacatgttttgcacttttagttaaaactacccagttctgactgaatcttattgtgtgtggagtagcatgattagctgcaggtacacatttgaaaatggtattagacgtctttaactatcaaccttgtttgacgataaatgattagccaaatgattaagcgtaccaaaatataatcatatttttcatccgttttcccctttctaaatcgcttcaccgaacagagattctcttttatgatctcgccaatagaaaagggtgtgaagggaacattgcgaggaggagatttatatgtaggcttataagccaaatgagtctattcgtccttttcctaattcgctaatcatatgtcaccaaatcaacctttgtcctgtgcttcacagatgctctacgtgtcaaccaccaacgctaagtacgcacttgacgtccttgcaatttgttaagtagcatactggatgccttgcaaatgatgattctccatgaccatggtgatacatgtggtggtgccatgtgtgtcatgggagcatgtggctgactctgcatagcaatttaactactagattcttgtgactcgtagctaatttcaaagtaatctatatatactacatatataaaacatgcctagaaaaaaactcatttctttttcagctcagctggatagcacatagacttccaatatgaaagaatcactagcgaacacgcagaaactcagggtctttcctaattaatctgaagaacaatactcaatgcaggaatgcactggtaattgttagtcacgattagtacaactaagcaccagaatgcccggttcatgcatctggtcattcatgtgtatgcatacatctatgagtgacgagttaatttattccggaacactctaaaaataagaaccttttttctctctcttgtctcagcctctcagcactcagctagctcctatctagctcatgcataatgcatttgcattttattagatgataatattgcgtgtagctagatgatgtgatctcgcaaccaaaaggacaaaaaccaatttcggttggaacagtcgctcaatccacgggggttcttcatcatttcacaaagattctgggggttgtgcatgttcaccgccttggcgagctgacacgtacacggccttcgtgatcgtgcgctgagccttaggcgtcgtgcacgagcgcagatgcttggcggcagcgaaggatataatcttcagagataacgaacctgaaagtgcagtgtaactggctgaaatccatcctggaattgccctggggtacacacgattcagctcgctacgtggctacgatacgatggtcaattagctaattattagttttatcttgaaacaaaaagatccatgtgctagtagtagtatatagacatggcaagtgcagaaatttatggtttataattttgttatgttgttctatttaggtgacacatgttagtatagtgatatccggtgcagggtgcagaggtcgcaaacatgcatgcagtgaagttttcagcattgtcaaatcttgtctggaacgagattttgtcccatgaatcctacagcattctgaatgatcagttggtccagagcccagacttcaaatcttgtctggaacgaggttttgtcctatgaatcctcagctgaaccagatctgccttaccctggatgatcagaccaagctttaatcagttaaatgtattgtactagaagtccctatcgacaggtgttagtaattaggagcataataagatgcatgtactcaactttgtgcagctgaaatgtgcaacgagggggcgtatgcgacactgttcccagagtactctgatcaatccagtgtggaattgacagtgacacggtggcaggatgcatgtcctagatgatggcattagcttgatttttgtttttattttccgctaggccagcgacgaaacgacggccaacttcattaagacaaagaagagtttgaatatagattacgtacaacaaacaaggttgtgagactacaggcctaagaactccaaaattacatcaaaccagttaaaccaactgttgaaattagctgattaatttcatgaggcagtagccctgctatttctcaggcgtgcagttcgtttgggagttggacagctgcagcacatccgcttatttgctgcggacgagcttgatatttgccgaaatggatgcctggatggagagaccattaatccgtatccggatcggaaagacaggaacctgccacgtccgaatccaagcgtatacgtggttcgaattgcatgctttaaagtttaatctggtccctacaaattgaattgtcataccaactctgctattatgtgactccagcgttatcaacctcagatcttatatacaagttggcaagagggtggaaacacactttgtggtggaccaacaaattgaaccctagtctcacatacgaagcaactcaaataaacggtatttcgtctcctccaagaccaacttactatcgatcgataatttcttaaatacttagtctcaaaataaaagaaatgatacatgtagatttatctcacaaatattatcataattcataaacttattagattttgtactatataactgatggacagaattttaaatttaatcaattttttataaatatttaatatttagaataggagggattacttatttactatgctagcttacacgtcttagggcatgctcaatgtatatgaactacattgctattatggtggatcacactaaaatatattatcatgtccacaatgtatatggaaagagtggatattaaggtggaccccacaaacccaagattagccattgagagagggagagagagtatcactattatgagagaggaaagaataatatattttttttactccttgtgggtggtctttatacatatggctagctcaaataaatgccacctataaagactactctcacaatatataaggttcactttagagtcttaaaacccacccttatgttcacattgtggctgcccttagacagcaatagtcaaaagatgagagcggagagactaagaatggagtgtaggtatgcatatgcacatatgtattttgcagtggcggatctagaaacttttgttagcctgggcaagccttattaacaacgccaacaaatatataacaaatctcatataactccatagactatgcaccatacaacaattttttttaccgtattctaatttagaggaaaacgatggttgtgtttttgcagactatgggacttagtaatttattatcttgaaaatgaaaaaaaatataatggacgctagaaaatttactttgctttcaggttgtagacatctaataacttgcactcaagtaataggtacaacgatctagtaaacattcatggtgcttcaggttactctagatgattgtgtgtctaacatctattaacagattattaaaacgtacttatactgctgcatgttgtggctaagcatgctctctaatacttatacaaattattaaagtgtcccaaccaagtagtgtgcttatactgctgtatgttgtggttaagcaccatgatttaagactactctaagagcaggtacaatagcagactataagccagctataaacacattttaagaagataaaagaggagagagaagaacaacgagctacagatttgtagccagctgcagcacggactccaacatatatgtgtgtatgacatgtgggactagatattaattgtgtaatatatatttataggtaactatcgtatgaactggctattaaattgactatagataatttgaagccaatagttggctatactattaaacttgctttaatgatgtgtgcggcggtggagcccgggcaattgcccatggttaccggcccctagctccgccgcttgtattttttacttcctcttttctaaactttaaatctgatcatatgttgttatattttggaatgaagatattttttttcctacatcgttacaacatactaactgcattattgattgttataaagcagctttcacatttttagccatcaaactatactaaccattttatcaaagtgtatgtaaaacatcaatcatcaaatcaattctcggtaaagaaaagaagttctaatggcctgttgcaacgcgtgagtatccactagcattgatattgaaccatatgtgtccatatgccttgactttgatctagctaaactatccgcattaactgttcatccgtcgtccatcgtgttcactgcagctcttgttttgctgttattttttcctgtattatcgactggtgccggacttccggctgctagaagctaggacaaaggcatgccactagtttaaaggctaatacatggcatatccaaagatccaaaccattttgggttgagacaagtttgccacatcaacatcacgagcacatgacaaacgacgacaaaacgcatacatgcactacacaataagccatatatcgattctttattaatttccgagtagaattacagggagaagaatacctaaaatcatcaccaccctctcaatcagattagtatatcttgtagtagctgtcagcccatggcagatagctatagcctacttgctatgctagctagcttagctagctacagtactgtgtgccggccgcctgccccagttgcgcgcgccgccattacgccgagcacgggagggcgccctttagacgtcgcatgcatgccccagcgcgcgttcttgcatgtgcccgcgtgcgtacgtgtcgtgcacggccttcttgtcccgcggtcgccacgcgcgcccgaacgaccagctgcaatgccgccgatcgacgacatggacgcgcgtgcacggtttgcagctgcttttgcttatcggtggcttaggtacgaggctttcggattggcgcggatcaccagacgaggctgtccatcccttgaagcagcggcgcccgcgacgacgacgacgaagacgactcggcgcggcgcttcgtgacgccgcaggtggcggcgggccggcagaaggccaggtcgtggcgctcgtcggaggacacgcggcggaggacgtcgcggaagtggtcctcgtcgcaggggagcgcgacggggccggaggcgccggacgggaagccgtactcctcctccgcctggcggagcagctcccggaacgccgggtggttcaagtgcgccacccgcaccacgaaccgcctcgcgtcctccccgccgcctcccacccgcacggccacgtgacccgccggaaccgcgtcgccgtcccgctccatcttgctgccggccgggcgcgccgcggcgcgggagcgccaccgccgcaccgtgcggcgcagccagacgagcgactggatcgtgatgaccttgcacatggttgacggcgagaatgaggctgatcgaacgatcgattgagcggcggccaatggcggaacgagcgagctgtgtttgttgctcggcggtggcttttcgatctctctttggctctttgcttggcgcgcgagctgttggttggaggagggcaagacggacttggaatatatagcagtttggttaggtgttggccactggagttgggcgaaaattgcaggaatggcatcgacatgtgtcaccttttgtttttctttcttttgtgtgtgtcagtgtgtgactgtgcgtgtatgtttcgcaggtgaggcgatactttggcatcggtaagcggtttgtgtcgtttctcgaagtctgggtgctgctgattgctgtgctaccaccgtacgagtactgctctagtcctgactgctgagtgtaaagtgaaaacacgagattgggaatgcttacaatcccatgtttcactttcacatgttacagggatgctaacctggtcattagcacacctgaaagtctgaaacaaaagcaaaagatattgtttgtctcagttcctggagcataatcaacgtatcgagttagaacatggctaataatatagccagtaaatagttgtttactgtatactagtagatctttacagtttacctcttaaccaactcacatagtgattagctcttaactattaatatatgtccacctatctctctcacaaatttttgagccagtttggtttggtgccctaccaaaatcttggtagtaccaaagtttaggcaacttttggcactaccaaatttgggtggacagattttgtactacctaataaatggtgttggtaaaatttggcaccaatccaaacatatagaagcactattcaaaattaccaatgaattggtagggcataatttggcaccaaaccaaacaagccctttatttttatgtatctaagccggctgtaagcttattacccgtttctcctctctttcctctcctctctcatccatatcagcatttagccttcttacagtcttctcttactagtctggatcttttactatagatcatttttgttccagtattctcagttctggaggttggaatcaaacgtaaaaatagcttacccctggttcaatgggcaggtacatgcggagagttcccaaactgatcaacaatctttccccgaaactggacgcagctattcagctaggagtacatagctatacaggtatagcaccgactgcctgttcaccgttaaatccggctcaaccgctcaaacgcgcacgttcaccacgcaggacggcaggaggactctgccgaaccttcgcgaagctggcgtgcatatcagctcgtgcgccgaactcagaattaagacacagtcatcatcggtgtgctagattccaggactgacaaatagatcctgccattatcattagcatcgatcccctttacatcgatgacataagtattttaagaaaatgagggtattaacattagtgttgttggtaccaagacgttgaacatgaaggtcactaatgctgagaaaaagaaccattttaaaataagtttttttttatatatttacaaagtttttaaaaatgattaaaatgtaaaatattcacaccggcgtgccctgcaaaatcttcctcgctaccagcgagatgacgactacatcgagatgtacttgatagtgcagtgataagtaatatttagtttcaatactatcttaacactctcgtaatttagggatatatctcctttcaaatcttgttttctttttcttttttataaagaaggcggctgcgacgtagtcctcccgttggcttcgattccccaccagctgcacggctgcagcctgcaccacgcatacatggatgcgttcgcgtgagacctgcagtgttgaaacatgcgtttcttatgtcgtcgggcgaggggtacaccacatttattttgctttcctcgcagctcgtacgtgctgccggcggcgtgtctgcccggtggatgtgcaccctgatctgtcatgcagagcatgcacccttgcgaggtgatctactgatctcaactgggcacgtacgtggccccagaacaggctggtgtatggattattcaggataagcctttgatggtgaggtcgcccacttgtgaacgggttctaaatccagagtacgccgtaactcggtttaggctgtgtttagatggtggaaaagttagaagttagaaaaaagttgatagtttagaggaaaaagttagtaatttatgtgggtagaaaagtttttaatgtaatgtgatgtgatgaaaagttggtaatttgggtaactaaacatcggccttatttgcatcgtgtcgagtttaacaggtcattgagttctcaccacaggtaatctgtcaccatgcacgatgatttgacactagaaagtggagtagtactatgttgattcttttccgataaagagaggcttcttttttttttcggcgtagctggctagctgcatgtgacgatacgatacgaggattcaccatctcataccgttgggccctcgccatcaccggcacacatgagcacttcagcagtgaaactgaaacctgtacgtccataatctctactgggccggaataattctggcttctccgtgatgacaagcgcgacaatactgttcagccaacagattgcaaaataccgggcgtctgctgctatgctatgctcacggttttgcaggtgtggcagtacgatcacccattaatttggagcctccaaactgaaatcgatgacatattctacaggaaccacgttacagcatatcagctgccgaattatttcgtcacgccttgcaacttgccgcctgcacatccatgcgtgcatgcaaaaccacaatatttaaattaagatcaacggagttcatcgacgacggatacacacgacatacacacacacacacacatagcacaccgtataaaatgtataattaagggatattggaaagttttgcccggtttcggctcgcgcacacagagtcgggacgggcgcggggcgcctttgcctttttgctgcgggcgcgcggatggaacagcgctgcggcatgggagcgtactactcctgctcgatcttgtcacgggctcgcgcgcgtgagcgggcgcggggcggccgcctttccggaggagatcgacgcgcgccgtgcatggcgagcaagcgaccgcgacgtacgggtgcgagattgcgggcgttgcgcgcgtacgctgccctgtgcgatgcgatggtttgcctgcgcgggagggcactgcacaagcgcaacggggacggcgcccaccgcgcgtacgtgtgatcgatcgatcgcgtcgtcgtcgcgtgcctcacctgagccgccccacatttccggggatcctggctggctcgtgcacctcgaaaccgggggctcgtctgccggtttttgatttattactgctggctggtgcacggtggggtgacagactgatagaggcttcagtaatcagcttggttttttatctcttcttttgtcgtgtgtacttaaactgcaaagcatgggaggatgaagtgatttgagttgtcgcaatgatcgcgtcctcaagaacgggacagtgtaatttttattttgtggcccctgacaagctgacatggggttggttcatgacagccgtccgatagtgctcaggtcacccagatcgaaaagatcacggaatatggggttgggttcgtgagcggcgaacgaacggatcgggcgttgggatggacggcccaggttggatctctaccaatggcagcgatctatgcttgtgctcgtgggccaacttgttccacttgcatgcaccaagtgattgggccgcatgatgaggaccatttagcctgcatttcttgccgagtggtaggcaattggccagttaattatcacgtctgcatatgtttgccctgttccttatcaaaatttaaaggtcatgagcgtgagatatttttcagttcataagtgaatttggtcatgtttcatataaagttctcccccttttgctctctttgacaaagggaggcgggaggtctgtccctagctattacttagccgatatagagaaaagacaactctgaaaatgtaaagaaggtctcatgtaaagagtccttacttcgtttactactatattagtagtattacgactgcttcgattttcgacggaagatacacattatttcagtcttcaagcattcgtgctgcaaatgcatagacagcatagttatacttatatctagtccacagtactccacacatcgatcgcgctgcgtccatggcgatctaggcaagaatctcgtcgagagacttgggcttctgtgctgccaactccgcggcgacctgcgtcggcggcggcggcggcagcgccgcctgctgcagctgccgctgctccttggccttcttcttgagcttggcgagctcgaggtcgcgtgccatcttgcgccggtacatctccgcgaacgtgatcggctcctccagtatgggctcctccccgtcgcgcaccgccagcgggtacaccatcgcgtccggcgccgggttctggaacgtcgcgatcgacagccggcagcagtcggagttcaccaccgcctggtgatccgcgttcttgaacctcccattgctcagatactgcaagttcacattgcctaagagatgcatgatctaaaacaaaatcaccaaggatacagtgtggccgtagtactcacgtgagcatggtcaccgaggttgacgacgaaggagccggggatgggctggacggtgatccacgtcttgccggcgtcgcgggtggcctggaggccgccgacgaggtcctggaggaggagcgtgatggtaccggggtcggtgtggcgcttgaggccaagggtgaggtcgggctgggggcacttggggtagaagttgacgacaaccttctggtccatgtcgacgcaggcatcggccagcgcgttggtgtcgaggcccatggcctcggagagcacgcccagcagcttgcaggcgaggcccatgagccgctcgctgtactgctccaccactgcgcgccaccccgccggcttgtcgggccaccgcgagtagtcgcgggacttcaccgggtacgagaagtaggtcacgatctcccgccagtctttcaccgcttcaccctgcacgttacagtaaactctaaacgtgtaaaactgtaaattgaaactgacaaatatattggacgtgactacacagagactgtacactgtattgttttaatgagagacctttacgtctatacctaacaatgtatgcctttttttattcttataaaattttctcttaaattacttatccgatctataatccgattaaactattgtattcgttgcaattaaatatttacaacaaaaccttacataattatattttttttattaaaaaatatctatgaattacttttattaatatgtaagttacttttatcatatataaaaaaatacttttgtgagttgtttgttttattaccatttttaatcaattccataatgtatgctaattacatttaatttttagatagactcatgtttttaccccccacaacggatttacttctaatgtcgtgacaagttactttcgttttgttttaagttactttatatatatatattacttttaggctttattgaatttacttttatatgtctaaaaggtaatttaataaaatctaaaagtaatttagatatattataaaagtaatttgtatttttttatcaaaaatataatcatgtgagatattgttataaagatttaattgttatgaacacaacagtgtaatcggatcgtaaattcgatgagtaatctaagagaaaattttatttgaaacataggtgatagaaatatatttctctacttacttgttggactagtattactatagttaagtaaattcttccggtcaatgtcgtgtcgctggttaggactaaatcgagatgctcttgagttagatttaccgaaatatatttaattgtttcaacgaagatgatagctacagaaacgttggtgcacaaagaataggaagttatgcagctatagaaacggtggtaaacaattggaagtttgaaaggttaaggttcttggcctctcattggtcgtacgggtctgtccattcacaaagactgtacagaaacagtataaatgagattaatttgaagtttagagtgcaacatgggatctgtcaatttgtttgttgaattgaagacagtaatctactcctattttctaaaaaaaaaaatactcctgttgtcttcgtccttcatgactagttcgtctctccaaactgttcgtcggctaatgaagggaaatataacacaagaatattttaccagatccttttggagaattcaggattgtgtaaggattccattcgttttcttttcttttgaaaatatagcagccgaggccaatacgacaaaccattggaattgcaacctagtcaacattggcataggaatatcttcggtgatcactgctctgacgaagcaacagagcagacatggtgatcgacatgtcgccgttcccgcgcgtgcgtcgacttcgagtgctctaggaacgtaacgacgtgaagtgacgtgacgtgacgtacctggaggtggctggagacgatgaatccgcccttcttgccgccggacatgtcgaaccggagcttgtcctccggcggcagcgcgaagaagtcgcgggcgaggcgcgccatgtcggcgacgagccccgcgtccacgccgtggtccaccacctggaagatgccccactcctcgcacgcgccggccacgcgggcacggatctccgcccgcgccgcttcgtcgatcccctggagcgagatcaccgggaccgcgtcgctgaactggttgtacgccaccctggggcgctcgtcctcgtcgcgcacgaacgacgccgcagcgtcgcctcgttcgacgccgtcgggaggaacgtcgtggccaccggcgccatctcgatcgatcgacccgatgcacgcgcgcgcgataggcgtggatggatcgacccttgcgtttcggttgtggttttcgcgggttttacgatagggagagcgtgtactgcgtgatcatccgtatatagggaggggcgtactgtacgggtggagcacgctacatagagaggctgggttcgctactactcacacagggtcgaagaactaaagtcgtgcagtgggcagtggcacgttccaactactactcatcgatgcgtttgtgttctctagctagctgcaggcctttagcataactgatcacccgatcgataagcttaggtagttccgatttgacggtgaagggtaggtgctatctaacattccgtgctctccactgctccagcaaacatttttggttgtgtgcacgtacgcttcaatgggactatgggagctaaactagccctacaatacctacaaatatcctagagatgagcgtaggaaatatct

SEQ ID NO: 45196 - DNA, 3685 bp, Oryza sativa
caaatgttccagttaactaacaagtgaaacatcaagttatatatggtgaaacaaaaatatcagcaactgaaacatttaaaaagtttatgaaacatgatgaagatacacgttgaaacatatcactatcacatataaaacaaccaatgttaatggatcgaaacatatgtttttctttcatcaaaatataatcatgcgatatcttgttttaaagatttaattacaaagaatacaacggtgtgatcagatcgtaggttgaataattagtttaagagaaaaatcgttttgaaactagttaaaatgcatgcatgcatgcatgaggtggagagagagaggagagagtagtaacagttagttttgtgagtgaattttgtgaaacacgctgaagacacatattgaaacatgtccctatcacgtaagaaaaaaaatgttaatggattaaaacatatgattattttgtatcggaatataatcaagcgatatcttgttgtaaagatttaattataacgaatataacggtgtgatcgaattgtagatcagctaagtaatttaagaaaaaaattcgttttaaatatcgttaaaagtgtatgttatatggttggagatagagatatagtcttgaataggtgtacgtgtgtcagaggctgcctgtccgacttttctccttacttcagacgttcgaggagaagcattatccgcaactacgcgaggaaaaacacactcttctgggatgatcacatcatgctaccatgaactaacaactgttcgactgggatcggttaggaatgaggtagtatagtaccacgtctcgtttgtctgcatggcacgcgatgagtgaacagtgatgtaagatccggtcccgctgcttagttcgcgcggccgctttgaacgattggtggtgagcgggcgggtagccgtggcgcgcgttctcccggcggggagggagacgtcgcgtgctccaccaacctgtcgcaacagcccgtcaaaataccagtaaatcgctagccccgcgtatctgcaatctacaagcaccaaaagggcaaaatgccagttggtgcaaaccccacgagccaaaaatatgcatatgatgccctcaggaaaaaaagagagaagaagacagcgagtgcattggcgggtcaacactcaagagaacaatcacattcatttcacaggagctggagccattgatctcatcaaaatttgctacagtgaaaaatgatgtgacaaacattgcttctgtgtatatatctttctcggcacatctgcaattagtgcagtatagatttcaagtgccgtgcaaatgaaaaatggtacaacacagagaaaaccaaacccttttggtgcttccagtgacagcttcaatataatcttccatgtgacgaaaattttccctcaccaagcaaatggacattttccttccagagagacgtggcaccagccccggtctcgaaccaatgggcaatgtttgccggtaacacaccgaactgggtaccaactttcaaccatattaaagtggctgcggtacttctctgaatcatgtattcttagctgatattctagtttgtatgatctaagtgattcatactgccaaaccagttgtatctactacgttctgcagaaagcgtgccttggcagaagggtccgtcaaaaactgacccagaactgcaatcgttgcagtgctactcctgattttctctattccccttgatatcatgcaaatgtggttagcttctacaacaactatggccccacaatgcgaaacagaataaactgcttcagctatctgccttgtcattctctcttgaacctgaagcttgcatccataaaaatgaaccaaggcctgaaaatgagatcgatcaatcacttcaccatctccgccgtcaaggtagccaatatgcactactccatagaacggcagaagatggtgctcgcactgcgcacaaaatggcaaatgcagctcagaatggattgctcgatggtcagcagcatctccagctggactctggtatacactcaaattattgagtgtaaagccattcagcttcacatctaggttacatgctctgaacttcatcagccattgcacgtaacgctgaggagtacctacaagttctttcctgaagggatcctctccaagggataagagcattgagctaacagcagaaaccatattagagggagctggtactgatttgggtgaaattgcaccgttggttgtagccttcttgcagtgcccattgcagactgggacatcatgagaccttaaagggcaccaagctatggaggcagaatggctgtccctctccatgtctatgcccctaagcttaagaagggctgagaagtcattccaaaaagagctgctctcaccctcaaaaactccagagcgagatgaatgtgaagtgctaatccaaccttgcaaagtcttgcatttcaagttttctggcaaaggtatgtgccaacattgcagagcaacagccacaccagcaggttgtatgctagcatgcaatgcaccacaaacttcactagccagtctttgaggattctgcaacctcttggcgaagacatcagctactctcgaaagcttgcttaacccaacaacccttccaccagagggcacatagccaacatggaattgtatgctgaatggaagtaagcatgactcacagtatgagaaaagatcaatatcacgaacaacaacttgccctccagttcctccagcagaaccagtcctcttgtcaacaccaacctcaggaaagagagccccctgcacaatgtcctttactttttgcttgtaacctgtaatattagttttaactatatgtcaaataaagctcataaagcaactgcattacagttttttttttacaaacaaataattgttagcagcccaaacattgtaacaacaaagaagagacgctgatacaacaaagtaaatatattggcaccactgcctgctgatggggctgaaaggattctttgccttgcataagaataacatgaccacatattgtgcacatgaacgcatgtgctgactatccatgacttcacacaaacctttcaagattagacccagcatgatgtagcttggattgggatgctgcaagttgcacacatcaagctcaaaactgtcctgttcaggtaaactagcagtctagtgtaaaatggtcctatagatgatacggaaaaatattatatttattcgactccaaagcaatggtaagagttagcaaatgttcgctgattggctatactgtataactccagcacttgattaagttctacaagaccattatcagctgcaacaaagtagccaaaaaagttgacttgttattttgtcatctatgcatgcacaacttgggagaagacaagaaccacaagctccctagccctaccagtttgagtattcaaagttgctattaccatgctactgttgtaagggttctgttcttgtgagttaagccactaaaataaatataaaataacagttttctttcaaaagagattataagagaaacagcatactcaaacaacgctccaacgctgacaatggtccagtaatccagtaataccacagaacatcagcagtcctctttaccatcacaggtaaaaatggcattgtgttctaaagtaatacgagtatggaataaatgtacaagaacaggcttttcatggtataatttatgctgta

SEQ ID NO: 45197 - DNA, 13255 bp, Oryza sativa
caaataaaatttggtggttagttctcacttctcagttgcccctaagctttatgtagactacggtctctcattgacagcagtaatttatcaaacaagcaatgatgaaaaaacagtcattttttgtggctagtttccagagtacaaccatttgataaaacaaatataagaacaatgtaatcaattccaatgccccccaaatcccatgaattggtactcaaactaaatgagaagcactgttttatggacaagtagacacaattaaattaaaaaatggttgcgtaagacagattgatacagaaagctctccaagaatatggtaactgccagctggtcacaaaaaaggatactaatgcttggcaagttggcatggcatcagctatgaaataattaaagtaacttttatttccaaattttctctttgaaatcgtagtagtaatgtatcaaaagtcaaaacagcggaacagtacataactacgatccaacgttacatttcataatgaaacaaagaacatatttctaatttaatcaaggagcaggcgagtttgtgtaaaaagtgtggctaggatgagaactaaaagaaaatagattacattttaagtactaagtagaagagctgccggttgaagttgcaattagtctgtacggagcaggaactttggaaggtaataatagattaacataatttaaataatccaaaaagacaaacccaagcacatggcacagcattatcctgctgctgcagcccataaggcaaaagtagactaataaataaaggacagccattgtgattactacaggaattcccagtattgcagactgaaataaacaattttcataaccataagaaactgtggaatggcttattgcaagtatgcaatccaatcataagactcctagtaactacatacaacggatcctcgttgtaaccatccgaatccaacttctctttgcacaatcctgctgcatactttggtcattcatgcttgcatcaaagtctgtttggtggccagttgctaaatttttaaagagaggggagttaattgctgaaactacaagcataatagcgctgtaatagcctaacaccaccataacagcaatgattatgaccgatgggcaaaaccatttacatcaagttatcacttctatgatgggctaccgagatagaattcaatcattcaggaataattcccagacaacccgacccatcgtcctgagatccaaacaacaccacacgagttcaaatgccccacggctttgttctgcttcaccaggttcggtgctagacaagcaagagagacagctgcggcccgcagctcgcaaatcacggatcaaaaaattatgccatggactccacaaacagcacacacacacacacaaaaacggatccacgaactccggaggccggaggagggagtctgggccgtacctcgggtgccgtcgcggaaggccttggcgacgcgcttgggcgtcctccgcagcccctcccggcgcgcgtcctcgccgagccccagcagcagcgcgcgcaccgccggctccatggcgtcggcggccgccgcctcgccgtccccctcgacgaggtcatcctcctcctcctcctcgtagcactcgcactcgcacgcggagatggcggcggcgaggtgggcctcctcgagcgctcccatggcggtggtggtgcctggtcactcgagctattattaggcggcggcgagagatagcacaaggtgcgcgagcttgcggccgcgcaaaaatagataaataataaaaaaacgcggtggagtggaggagaattgatgcccaccgcgcgcctcgagatgtgtcatgtgtggatctcgctggcgccgccgcctcgcctccactcctctcctttcctttcctttcctttcacaggcctcagcgcgtcccggaatttttggaccgggccgaattccaaaaggcttatataaagtggggcggtgggccccgctctccagtggcacgcgttacgatgggggtttgaggatttgtggggcccacaagccggaaagaaaaaaagtgcggctccagtctcacgactcgcggtgaggcgggggtggtcgaccggtcgccgtctcgtgcaccggatgcggtgtttggtgaggtggggggcggttgctttacgagcggtaggtgggtggtgctggtaagccacgaccacgaaggtgtgggtggccaggtcggctgcagggagctgcgcgtcacggtgaccgttggatcgagaacctacggatcggatcaacctatgggagagtcatcacgaaccaagaaaattggggcgtgtgtttcgttgcggtcgggttactcaaacgtgcggtaacagggtcagtgggagggtcgggctttcgttgaaatttgacattttttgtggttgcccgtggctgcaagctatatccatccccgcatttcaacgagagaataaaaatgattctcctagtagaaaagataataaaaatgataggtgggtatattcttccgtttatctctgcttttataccggataatttttttggaattgaatctctttaagagatacttcctccgtccttaaaaaaagataaaccctgagtttccgtgtccaacgtttgaccgtccgtcttatttaaaaaaaattattaaaaaattaaaaagacaagtcacgcataaagtattaatcatgttttatcatctaacaacaatgaaaatactaattataaaaaaaatttatataagacggacaatcgaacgctggacacgaaaacctagggtttgtctttttttttggacggatggagtacgtataaatgcggattctaacaacatgagctcacctctataaatacatacacacactcgatcctcatgtgtatctaaaaaaattggaccggtgtatcataaaattaatgaagtcaccacaacgttccgttattgacatatatatcgcctaccactgaaataacatcatatgggagcatccatgttaggttaaactcgagtgaacatattccaccacaaggaacctattagcacatatttatgcttccttgtcacacttgtttcctaaagcaatatatggccaaatttactttgaaaacgctatcactagaaacatttagagaaaattccctgtgtacccctgaaagttcatccaatcctttttatatccctgagatttgcgcattcacttccatacccctaaatttcaatttggatctcttatataccccttttgtcagttgaccgttaaattcatatcataaagtccattttaccctttggtatcaagaaaatataaatttatgaagtatattgatggagtgtataaatttattgtgtgtgactgtcatatttatgagtttattttgtgagatatttttaacaaaagtaatattttacgccttgcgaagggaaaacaaaataatttttatctatggcaaaatttattttagataaaacaaaacgtagtttttttttaccattaaaaactgcatattttgttatagttgtacggaaatttttataagataaatcttgctatgcgagataaaaattatttttgttaaataatatctcacaaaataaactcataaatatgatagtcgtatacaataaatttatacactccatcaatatacttcataaatttatatttttattgataccaaagggttgtcatagataaaaattatttttgttttcccttcgcgaggcgaaactaaaatattacttttgttaaataatatctcacaaaataaactcatacatataatagtcacatacaataaatttatacgcttcataaatttacaatgcaggcgttctcgtggtgcggttttaagagagatggtatttcatatagccccagatgtcatcctatctccaatctcttctccgccttttttatcatcttgacgtcgaagcctccaaatccctcactctagttactaccattcatctgctgttcagttgtccttgccccctctcctctccagtcatcatcattcctcgcacccctctagctgacagcgctagtttttgttatccacccaatgagtcgattgttaggttgttcgtaaagtatatgacacgaccgaccgacgagggcagatgatgtgcagcccgtgtctactgacctttgattccttcatgagccactgcgatatagctatactcatttggtctccttattgctagagttgtcaaggccatcatcatgtggctagctttcttcttcgcacacatggctcgtcgtggtgctcagctcaatatttgttcttcaaatgacatcctctttatcactttcctcctataatttcatatcccgctccacatccaccttccctttccatactcctatatcctccgctagacatctatgctcaatgaagccactctcttagctaaggttgaggcttagcaaggtgaaggcccgaaaccactcgccatattacttcatgacctagcctcacaaggaaatctatcctcttagagcagctccagtgtgtggagaaatcgaatcgtgagccaaaagtatcgaacacatcacgctgagagagtcgatcgttgtgtgagatagcagaatcgacctccaaacttgagtcgatgttagacaattaaagtattaggccgtgtttagatccaagggtgtatagttttgacgtgtcccatcagatatacggacacacgtttaaagtatttaacgtagtctaataacaaaacaaattacagaatccgcttttgtaaatcgcgagacgaatttattaagcctaattaatccatcactagcaaatgtttaccgtagcaccacattattaaatcatagcgctattaggtttaaaagactcgtctcgtaatttacacacaatctgtgtaattagttattttttcatatatatttaatattctatgcatatgtcaaaacattcgatgtgatagggtgtataattttactaggggatctaaatagggccttaattgttgctgacggggttgaacacatccaagccaaatcaaataatttacaatttctctcaacttttcttattgtaaacgggtcacataaatagatgtgcacactgcagccaccaaaccaaagttgcattcgccattcacgaactaacacatatagtaatcgaacatacactggagttgccctcaatccatgacttctgacatccttgccctcgcctggccagccagcaaaaattagttatgaccacaacatttgctcgtacttacagttttattactccatgctcaaatctaccgacaagtggaccctacgatgacgatggaccacaagtcagtaactcatcacctcgcaaagtacgacccatcgacgtcgtcttgggcctcttggcctgtccataggaacgaagcccgggaaaaggctgaagttaaaaccacggccttaactaaacccagtgccacttggaccacgaactgatcatcactgacaaatgggccccacttttcccggtcccactggtcagtgccacatttgacgtgataggaaatatctcctggtccgctttgattagtcgacccactagccgaacccactgcgtactatgaatccgcactggctcataaataactaacccgcacataaaaagagtttctatctgcaatctctaatttcaaatctcccccattcgttgcttctcctctccgctacccccgaacaaatctagggtttcggatcggaatcctccaccgccgccggcgttactaccggcgataatgtcggccagcggcgagcccgagaaggtccccgccgccgccgagggagaggagaaggcggacggcgcgaaggatgccgcgggctccgggggagagctgctgtactgcggcgcgaccaacttcgagaccatggggcggaaggtggtgggcggggcgcagggtaacctagtgtcgccgacgcggatgcggtcgctcatgggcgtcgacatacgattcgttgcctccgggtgcagtgagtcccctcgtccttctgtcagtttcagatggtctcctagagtcaagtcacggagggatgagaactgccgctggtttagtttatatttattcgttggatgcgtgaaaccaggtcaggtggaattggtcaggtttaaagttcgcgggctcttccagtggctggatgagctaatgccgaaacggcgccactctgtttagtactatcaagttaatgctggaaaatgttttcctgacctattaaattgaccgtattgcgacagataacacatatggaaaattctaacgcgaaggcgctggttgattggattttagcgatttagacacgtgtgcttactgcttaatgttgcaaaatgctgtcatgacctattagattgatagcatcgagacagatagtacatatggaaagttctaacgcgggggtgctggttgattggattttagcgattcagacacgtgtgagaaacatacaatgcagtggacttaatggtctagatagactgctgatgcaaccatccagcgagtatgtgtgcttttaagacggacttaatacgaggttgtcgttttcctaattttggttttgggtgatcggacggagtttaactctaggagtggtaagagttcaactttagggcattctgtcataagcatttaggcttggttgattaagtttcctaatttatttcctgtaatccacaagcaaattcgatcttctggtgatcctcagtactcctgtaataactctataacatcatttatccagcggcttgccattgtgttgccttggatgctgaaggacgttgctatacatggggtcgaaatgaggtacgaaatttacttgacgccacctttcttcactatattttttaacactgttactttctagcagaaggggcagttggggcatggggatactcttcagcgtaacctgccgactgttgtttctgaactatcaaagtaggaactaactatttgtttgtacttcaattgttaacaatagctcttggtatgctaaattcatgaattgaccaggtgcactggttgagatgaattatttatgggtgctaaatgttttcaggtacaaagtcattaaagcaagtgttggaagaaatcacacagtggttgtaaccgatgacgggaagtcattctcatttggtcacaataaacacggacagttgggtacaggctccctaaggaatggtatgtacctttggttcatttttaactcactgacatcagtagtacaccaaatacatgtcctgcagacaaatcattctgtctttggaaaagtctggatatatctgcttcgcggatggttgattcttttttggtaatgcttccatgtgtgatctgtctgtttagacattgatgctgcaatgcagtgtttcacggggagtttttcatattcttataatatatgctaacaaatgttggacatttcgtaaattcttcctagctctgcgacacaatgtgtgataactgataaacttattttacttgttttgggcagcttatttcccctttatttattacattatttgattcttgttcctttggttcaaaaattgctgcagaaattgagacatcaccaatgccctgtcttgttactgaagcaactaatgctgtttgtggtgctgattttactgtctggctgtcatcagtggagggctctactatactgtatgtcttgcttataatacgacactaatatattttcaacccttttaattatatctgcttgtgctcttgttagtgagtgttgttcgtgaacttttttgaggcagtattttattcttctgtgctattcagtacagcaggtcttccccagtacggtcagcttggtcatggaaccgacaatgaggttgtttgctactctattaacacagataacctgttcatttatttcatatcaatgcactgataattgatttgtgctgttgcagtacaatattaaagactcatctgtaaagctggcatatgatccccagccccgtcccagggcaatagcttcattatctgggaaaactatcgtcaaagctgcatgtggaacaaatcatacaggtttctgttatatttacagatatatattttggttattctaacctttcaggattaacaccaatctcacactgttcatttacttgtgtgctgcagttgcagttgattcaagtggctatgtttacacgtatgttatttattcatcaattttttatgcaattaccaactttaaattattttgacttgctagtatgatagtatccatctgtcctgtatcagctatcaagccgtttcctatctgcaatatctaataatacatgttttcttcagttccctgtttatggtttctaatatcgtttctcttttcttttggccctggcagatggggctttggtggatatggaaggtgagacactgatgtcatataacccaatatcccactataatcaggatagcatcgttggtctgatccccatccacttgttatttgcataggttgggccatagagaacaaaaggatgagtggcagcctcgccttgttgaagtcttccagaagcataatgttctgccacccaatgctattatatcagctggtgcggcaagttctgcatgcactgccggtatgtttccttttctgatatttggacatcgatagagtagttctgttattatttggctcaatcataaagaaatacttaataaaaaccactttgggcctgtaaattaggcaattagctgagtatcatacatggaaaataagctatttgtgatgtaagtttatattttgttttgtttgtaattataatattatagagcattttggttgtatttctgaaattcgatgattgtactgttattcatgtattcagttaaatggcatggactaataaatgagacatgaaattcagcatgtcgcatgctaactttttcaaaatcgggaagacattattttattgtcttatggaattcctgtgcattatctctgccaacaaatctgtcaagttattatcaacttattgccgttttattgatcctcccatgtgttattatgtgaacaattgtcatcagggttttgtgtctgctgaaatgttgatactattggctttgctctaatttgctgttacaacctctttgctttgatgattgagtagcgaggtgctataggcaaaggggatcctatgtagtcgaggagccagttgagtgtttttaaatgctttagcatgtacactaagcatcttatagcgtaagcctgctcatttttttctggccttctgataggccgatatgagcatgcatcaggtttatttttttcccactctatgtgtttcctgctagttagatggagattcatgttgtgtagtattatttatgtcctgttaagaatatcatacttgaaccttggagacttggattctgctaaccaaaatgatgttgatagtgttgcataaaaagataagaatgaacaccacattattattaatttttgggtatttgctttgtttattaggtggaggacagttgtacatgtggggaaagttaaagaatacaggcgacgactggatgtatccaaagccattattggatttaaggttacttgcggacaaacttaactgtagataccatatagtgatgaatagttccgtccttggctattctttctgttgataaatcgtgattagctgcctgttcaaatgatgttatccaaagttatctgtttaactggtgattttattgttcagtggttggaacattcgttgcatggcttctggtaacatgcaccacgttgttggtgcagatgattcttgcataagctggggaacagcccaaaatggagagcttggctatggccctaatgggcaaaagtacgcctattgaatactgttaatatcattttaatactaggctagcaattgttaaaaccatagaattcctcttacagtcattgaacttgtaatgcaggtcatctgctaatcctaaaaaggttgacatccttgaaggaatgcatgttataaggtaactacactaaatcaaaatgtttatatagttgcagctcctgtataatcaactaaattgctgacacattctgcagtgttggttgtggatatgggttgtctgcgattgttgtagacagatcaattgctagtgaccggcttaatcaggtaactgaatgtgctccaattcacaggccatctgcttgatgctaccaagagattacaatatgttgcaacatttacttgagatgttcaacaaagaaaatgagttgctcgagttagcagctatgttaggtgttatgcggtatcatagtctctatctcgaataaggcacattagatttaccaacggatgttatgctataacttttaggtttaaagacttgcattaggctatctacccttgaaatggagctacactaatgttaaaaatggctacatttgtccttacagtcttttaaaagcacagctttgatcaagatagtttatctgttaccaaggtgttctttaatgagctaccttattcacttatcttatttcgtctcttatattgcttagactaataattttgttttatcatctagcatctcttttagtagtcgcagtacaaactgtacagatgtatgctaatttcttgcattctctcgttaccctaggtttttggattattattggttatcttataataaatgtttttttttctcagctggatatttatgacggtgatacctccactgaaggtttgtattttgcatgtcctctttattttgttttacaatcacattgttaaattatgtatgcaagcttcaagaaatttaacgttgtatgaatatcatccttagtttggtttgatatgtgcagaataaattattgtctccaattgtatataattggatagtcccctaccaccatggttccttttgtttacagtcaatagtttttatgtgcttagttctatgagctaatgtggttatgcccttgtgcggggaggctgctccgcttgtggagggaaaatcgcttaatagtgccagtgtgattgttggtgtaactcaagtagtcaagtatgtgagcaacttttggctttacatgccatttctatatcctgctgttactttacattttgctgtgagcgtattgtctgaaatttgaatggactggtattgtaatcatgcaggctgctgaaatgcttctcatatcatttaccattttattattttgcatcgactcatgcatgattggaactcttcactgcagtagaagacagagtggaggtccaggttgccaagaaggcatctgctagcaccaatgcacgatctaacaagcgcaagaaaaccaaggatgtttccgaatcagaagaggatgatgatgaggaagatgatagcgacgacgatgaaaatggtgaaataaaaggtggtaagggtagacgtggccgcaaaccttcaaacagagggagaggcaggggagctaaaaaggcaactcctgagccaaagccatctgcaaggggcagaggccgcccgaagaaaaccgagtctcctgctcagaaaactgggagcttggggcgaggcgggaagagggggaagcgaggaagagctcggaagtgagtttaaaccaagtagggcattgttgaactcagatcgtgtgattgtctaactcctgatgcgatccaacccagccattcaagggcatttgttttcttagcaatggtttcttactcttgcccgccttacattgttgagcctgttttttgagtggaattacctctggtattgaagacttgtctgatttgaacctgaaaagctctgtttagttagcctccaagagcatgagataagttagctctcgtagagcccagggctcaaaagattttatccacaccgcagcttctatagccattagaagcttttgcttaggaagttgtgtaaattcttgtctgacaagcttaggaagttgggggcgtggagctcggccgtaaaattcccttgtgaactcgatgaaaattattgctggttgccgttggcatcaattttgtgcatgcgtgtaatgagcttacagaatcgtcgcaaacagagtgcggcgaaccttgatagccaacggcagacaaattctccatatcaaactcgcgtaatgcttaactcattcaggagtcggcactgcctcgttcaaacaacagcatagcaaatttgcaaatcaagttacaagcataacataacattgttaaatatacattattcaactgcatagaacgagaatttcgatctcaacaaacactagcttaggtcaccaagtaaaatgccaattcaagtctcaggctagaaacgcagaatttcctgctgtcaaatcataatattatgcaggcctcggtacaggtgaagtctgctaagaaaattctggttgtagttcctactggcaactgccaaactgccatacatgatatatactggtactacacaactggatgccacactggttggtcattttcctgccagaaaggtgtcaattatatgtccatgtctatcagtgcatcttcctcttcaccatcggatggtgcactggtaaggaagtcatctcctgatattttgctgtaatataacagaaacttgtgagtgattcaaaacatcgcgcatcgtgtttcctgcaaaagaatgcagaactgcatagcaagtgtctaccttatacaactgcaacgaaagctcacaactcgctttagcttccgattgtagaagaaaaagttgatcgaccatctaaaagaaaacagtataccatattcatgtaacattcatttgattgctaagttaaaagcatggttatcacagcttaacttacatgacccccttttcaagaaatggatctccatcttggtctggattatagctgtagatgtcagactctccgattttgataacctacaaagtaatgtttgacagtataaaatatatgaatatccaagttctctgaattaagcatcatgtaagtgcaaacctcatcaatgacattagtcatactgtctagaagagaagtgccctcatttgttgctgcccattgctgaaagatagtccaattttaggttaagcaaatcacaccagtgaaaatgaaaataaataagtaggacaatcatgatggaaaaaattagctatgtgttaatatatacatttttgcttttgcagtcataccgtacctatttctaaattctgatagcatgcatgtttacaaacacacctatctttggattaagagtagatgcataaaaaagagagttcaagttgttacctttgaagcctcagataagtaggtgtctgtcatctc

SEQ ID NO: 45198 - DNA, 3649 bp, Oryza sativa
gacagtataaaatatatgaatatccaagttctctgaattaagcatcatgtaagtgcaaacctcatcaatgacattagtcatactgtctagaagagaagtgccctcatttgttgctgcccattgctgaaagatagtccaattttaggttaagcaaatcacaccagtgaaaatgaaaataaataagtaggacaatcatgatggaaaaaattagctatgtgttaatatatacatttttgcttttgcagtcataccgtacctatttctaaattctgatagcatgcatgtttacaaacacacctatctttggattaagagtagatgcataaaaaagagagttcaagttgttacctttgaagcctcagataagtaggtgtctgtcatctccttaaagctttcccactcctcttctttgaagaacaggtgtgcccgaacagcactggtaagtgaaaaaatgttgacaaaaggatgttatctaaaggtcatcctgtcatgcatgtgtcacataacagcaagaagacctttaagaaagttacagctcagtcaaatacacaaagggcaagggtaatggagagaattgaactctcagctcaaagagcaacggatatcaatccgtctgtcataccatttgacaacacccccttaggctggcaggaaggacaaaagcgggttgccaaatcgccaaaataggctgactatgacattacccaatatccttcctcccagatggttttagaacacactagttaagaagacaaaaactaccttcctgtaaaatgaaagaaatttacctgaaatcataatctggatacatgtggctaagggtgagaactagatagatcaatgttttccgactggaatgagcagcaaacacaaaaggcagttagtattgtataatagaaattccgcaacataagtaatctaaacgtgattaccttgaccgacatgacaaatgctccactggtgatgaatgatcactatcagaagacttactgaggcaatcaagaatctgaggacacgacaatcttttttaagaaatcggtataatcacaaacatatttgatagtattcactttgcttcggttttcatatgatttgcatgaacagacatacaattttctaaataagacatggtaatttatcctaaagcggtctcaatggtgataatgcatggagggaaaaatgttaaatatttacctcatgttctagacttattgaaagtcgacggtcattaccagtgtgcttgcctacaaatcaatattagaaggttggtcttcattgtcattaaagtcatatactcaataagagacttggcagggaatattcctacatgagaaggcttcaaggtttcctcttatcgtacaatcaccaaggtcaagattatcaaggaacagatttatactgaaacaaaacgaatcaaacagtagagttaataagtttgtgtaaaatttgcatgctaccaagagtacatcaataagaagaaacaaaggatagaactattacctgtcgaagggggtgtattctaaaaacttcatgttgagtgtcttgtgaactcataaaaagaacagcgatatcagatgtgtctcgagaaggcgagatcaaaagctcagctgcatagaatgccaaagattagacattaatacatagaaactcaacatggcaagaaataaaggaaaaactaactataacaaaaaattatacccaacactagctgtccttagagaaactatgaacaacacttcaacgtattttctgttaaattactggcattatcaggttggtcatggaggctcaggaaacaaacttggttgcatcagtagtagttagttgggggctaaggggccaagaggccaagatcagcaagagtgtataaacacaagaattttagacttcagcaagcgggtggacaaggtggcatcaggaactaacaggtggcatcaatgttatcagcgaacaatggcagatgccatataaagtcacttcttcattcctttctcctagaatcctatcccactaaaactcgcacataaaaaacccgatcaacacacactacgctctcaaaatgtgcagaccaatttcaccgtgtttgcacattacacgcgagcgcgcggttccatctccactagcatcgtactcgtaccagcatcgaattaaacaaacatggacaggatgacccaccgaacaatcaccaggcagataacgaaaaggaacagaaggcatcatgcaatgggaggggacccgatgcggaccagaagatcaccccgtaggtttctccccggactccctcaaattcgaggagctcgtctctggatgagatgggtggtgggggatattgccctcggagtcggacccgtgtctagtctagtttaagcgataatatggctaccaagccacaggatgaggatgaggatttttttccttttttttttcggaatattcctaccagatgctgtaccatcacgccccgcacgggatcgctccgctccctcacgcgggcctcacgtgacccagaggcgccgcgcatggtcaccggcgacgacgacggggcgtgcggtggccggagaggggcgggaccggtcggaacacggggtcggtagagggggtttggaggaggattagccgacgaggaagtggactcaccgacgtcggcgacgtgcagatcggagcgcggcagccgttcgccggagttgacggagaagacggcgtccccggcagcgaatcggccgccggagcgcagggtcaacgagtgcctcggatctccccggcgcgcctcgtctcctccgccaccgcctcgtggtcgcaggtgtgaactgtgaagggggagaggagagagcagggtggttggagaaggggaagcagaatggcagaagcgagctcgcggctccggattcgattttgtccggagctggagtacgtggcaggcagccagccagggggagcggctcctgctctggagctagagcggcggcgaggagagggagccggagcccatggaccgtgatggtcccagcaggagtaatatgggcctaaatgggcctatggacgtggaacgtcgccaactttattgtctataatcaggctacaaatacaggccctaatttaaactccctgtacagtacagtactctctgatgtcattcatttcgtatttattatactccctcacttccaatgtagtacttgtcaacattaactaaaataatatagcaaataactaaaaactatattatattttagtgaacgaaaattgtatggttctgtttaacatgcaacgattacatgtcgtattcttaaacattttgaaattctttgctaagataatgtttgtcagagtttgcatatagatgctgtatgttgacaggtgagtatttttttgcactcatgtgttttattgattcaggacaaaacacatgagttgtgtaccagggaggcaaagctgagagaacagcttgttttacataaaagcaatggttgggcaaattacacttcgagcatagcatatgcgaagaaagacataaaaagatatagaaaaagcaatcaagtcctttcaacttacaactgaagggtttgaaggtgaacccaccatccaaaggacagaaaggagacatcaagaagaacgccgacgagacagccatgtttgtcatgctaaaaca

SEQ ID NO: 45199 - DNA, 14827 bp, Oryza sativa
  unsure (1)..(14827): unsure at all n locations
nnnnnnnnnnnnnnnnnnnnnnnnnnnnnnnnnnnnnnnnnnnnnnnnnnnnnntgggataagatgtgcttgctgctttcttgctttagtttctcacatctttgtgttaagttcaacaagtggggaggaaataagagagcaatgacctttcgttctttcttagtttaatcctcacattagctgatcccatatcacaatttcagaaactatcacagctctagacatttggtctctatgatcacagtcactggaactgtatttttcacctctacttactcctaccaaattattctgctacatatagttcatggcacatatcaaattcagcattaattcttcctcaatgctattggcattatgctagaatatagtactatctagctaggtggtgactctaccactgatcatcaactcatggtcagaacaaatgttggcctgctaagaacctaagatcaaggtagtaggaaggaaacaacaattgatattaagaatgaaaacaaaaggtagcaccaccactacatgaagaatcatggctgcttttggatcctggtccatccctccatatatgctcatgctctgccctaatctaatccacactaccggtcgttcttttcgcgtaggatgcctttagtgtaagcatcattgcacgctgccaaaaagcaccttgttgtttggatatagtagtatctcttattatggttttatgcatctgacgcttgcttaggccgttaattactgtgccacgacaccgttgttaactaggtgattagatgatgcttcctttgaattctttctgcctgtttctttctggtcctgagagagagagagagggggagagagtagaacaaaggcaggagctgtaggagataacgtttacggtggcatcgcacgtggctgtaacgtggcgagcagcgcgctacgtgtccatgtgcgaaaggctggcacgtgcccggtggtctcggggtggccccactcgcagctgctcgtagtggctcggacacccctcgttgcgcacgtggccccactttgttttcacatgcactcactcaccaccgttaataaacactcgtaacgagcttaattgccacaccgttgttgcgtgcaaaaccgctcgcgtggtgaccacttaaccaccataaattactaaccccatttgacggtctagctgtcgagcgcttgaccgcgtgtggaccgaaacgaccgtgccagaaactcagtagtgtcagtgactggtctggccggtgcagctcgtgagagttaacacagtgaaaaaggccgtggaggcgatgaattctccgctccgctctcccgtttttctcgaacgcgatcactgtgtctcacgtgaaacgccaaccaaccaaccgaaccacgggccccatcccgcgcttgggcggcgcgcggccagcgagcaaagctcgcgcgatcaccgcgccaccaccgccacaccgccaccaccaacaacccaacgccgcccaatgcaagcagcaaccgcggccgcatgcggccacgcactttctcgtgctcgcccccgccccgcgcggccgcgcgcgcgcgagcattccgccgggccgtcacgtcgacgcccgtaccgttttttgccgcgatttagtgccggtaccgtgtcatctcgatcgtttgttggttacgaaggtcgctgtacttaccagccgcttaattgcaggggtatcgccttcgccgcatgcatgcagctggctggcctctcgctctttaccaacagtgacagggtcaggatcggctttacaattaattaatagtagcatcagtactgagaatttaggagtaaaaacgactatgggaagaacaagtgctgacctgtgtactgtacttggtaacaataggctggccgcggccggagaaacggaagccccaccaaagtacgctcttgccatggctaggctcgtcggagttagattgttgcttgcattaatggccttgttattgcgaacttaaaggcgccgtggacttgcaatcacaactgaccggatcgtggccggacgggacggtaccagcgccatgaagaagaacaacatttgtttgcacccctaggcctaggcttgttaatggtcggtccaaggacggtacgagtgatgtggtacaagacaacgatcgaatgagagatgctaactccccacatatattgcggtatattccaatagatcgagctatgcagcgacgagacactgtcccacggaattagagggactaattttgtcacaattaaattagattgtcatgtggtgtgtcacacgtgctagcgttatttttaagaaacaagtcgaatttatctcgctatcttttaaatctatgaattaccttctcaccgattcccttctcctctcttgccaaccctcaaatcaaggtgcagatcaattagagcaaggctaataatatagccgaattgttgcatataaggttctttacagccttctcttagtctacacatacaatagttagctatttataattaatatatatggcccacttgcctctctcacaaaattttttggttcttgtgtccaagccagatgtaagtttacagcctgcttctcatatctctcctccacttgagcatttagccgacttagaacctcccattatacttgcccttagggaggaaatgatcccaacccccatacacatccttctcgatgggaaaaaaagaaaatgtaaaacctgagtggcctatttagtacgagtacttttcttcccaacttatcttctttattttccacgcgcacgctttacaaactattaaacggtacgcgttttataaaaaaaattctataggaaagttacttaaaaaaatcatattaatctatttttaagtttttttatagctaatacttatttaatcatgagttaatatatcactccgttttatgtgcacggggaagatgtttctgaccccttcgaaagctagaacacggccttaaagatccaatatggttgggctatagaacatctaagcactcatatgataacccatttactgacttaatatactagaggcttataaatcctatacccacgtatatcatgtgtctagtactcttgcgtatgtacaatcacgaaaactatgtgtctcgccgtcttgcgcgtataccgtcttccgtgtgtatcttctcccggatgaaatgcaaaggtaaaagaaacaaatataaaatcactcgcaaaacttttttaaaacctcaattacgtattaattaattaaccttaattaataaaaggaaaagaaataaacaaagcatataaagctgcattggagaaggggaaaaaaaaagggaggagaaaggaacagcggcaaggtagagatagcggagggcccgaatcctccggaatataaaaactgcaagcaaacaagcagagccgcagctaaacgcaaagcaaaaccaacgcaaagccagagaagaaacaagtcagaggaacgcagctccctatcctgttccgctccagacgcacgcacgcacgcgctgcactgactgaggccgacgcggcggcggcggcggcagcggcggcggcgaaagcgaccccgatgacgaagcccaagaacggctgcctcaagatcctcgcctgcgccggcggcggatccgacccgtccgccggctccgacggcgacgcggatgaccacgtcgacgaggtactcgcgcgccgcacctccgcttgaatgcgccgccgcgccggccttgctcgccgaagccgtttttttttgttcttttgggggggttctctcgagctggtgcgtttgttttcagcagatctcagtgggatgcgtggggtcgaggtgcgggcgcgtgttgttttagttagatctggggttgattcgtggcggcgagcaagacgcagccagcaaaatgagagcttttttttttttttggctggtgatcccgtgctgttcccgcacgtcctatgagttcattcaaaggctcaattttgatttcaatttccttccttttttttaccccttctcttctgttgctgcatggctctagctgcagcagctggaatattatggctgctactcttgccgccctgagtccatgcaagatgtcaggaagggatctggtgtttatctgctgctcaaagtgctactcactgtgtatggtgtctctcgtcttgttgcatgattggcatctgtcattctcttcctcggagctgagtgttgctagccttgtcccccatgatttgacactttggttgtaatgttgcgctgttgattactgtttttccctaccaagaatctcagtgtggggaggagttcactggactctggagcagctcatttttcactaattggctggacgctcatcgtataaaatctctatgttgaatcgagaaaaatcctctaatcgtaggagacagccgcaccatagtgttggtgaaatgggatctggaattttcacgggacagcctagaggatctgtaccaactatagtgagtgactgagagtagttagctctttttgatgttcagggaaaagagagagtagttagctctctttcattgatataattgcaaaaggacaaattttttcttgctggatcagtggtgatagctgacagcaaaccaaatgtatttttgctaggattctatgcctccacctgcaattattagaagttggcaaattaaaaatactcctgattaagtagtgcataatttcaccaaggtattacctgaatcatgttagcttacctccttttatagtttatttactgaactggtatttttggaaataaattgattattgatggatatatcacgccagtaaggcattaacaaactttgggtctttttttgcgaggaaaactttggggagatttattaggaactggtacattaatttcaaaactaatagagtttatctgccacttcctttctttttgtgttgtttcccttcctggtcaacgacattttgcttcattaaatgagaagtatgttggttgcctacatttcagatacacgaaactagccctcattacctgcattttgcttgtaacatctcttctagttcgtctcgggtgaaaaagctaccacagaatatctgtcttctcttccttatatcaagtagatgaatcatgctaatggctgttaaatgttggcttttacagaacaaggccatatcagataaaagtaggtggagctttcgtaggaggtctacaaggcatcgtgttttgaagaattctgatatatctgaacctgaaactcttagttcgagcaaagcaaaagctgaaattgctccaagcaacatctattcttcaacttactcctatgcctcagaaaaacctctacagcaagagaaaccagatgagaaaattctgcagcaagagaaatcagatgagaaaattctgcagcaagacgaaccagctgagaaaattctgcagcaagagaaaccggacgagaaaattttgcagcaagataaaccagatgaggggcctttgaatgaagagatgcctgatgaaaaactgatagagaagccaattgatcagccaggtgatgaatcaattgaaaagccagctgatgaaccaattgaaaagtcagctgaccagataactgaaaggtcaattgagcagccagctgaaagagtaactgaagtgccaatccaagaaccaactgaaagggtaactgaaactccaatagtaaagccaaatgataatgatgttgaggaacacactgataagacggatgaaagtatttttgtttcatcaactgaggtgaagcaggaggaaaccgtctctctctttgatggaagcagtgaagaccatcaggaagattgtgcggagactgctgctgctgtcattcagtctggcatcagagtgcacactgtatgttgcagtatttcccactatttatatttattaattatttttctgttagtgttattacattattgtcatttacatgactataggaagagcaagaactaccaaatgataaggaccttgtgaaactgcaagctgtgatacgtgggcatcttgttaggaggcaggctgcagaatcattacaatgcttgcttgctattgttaaaatgcaaggacttgtccgggttcatcaagcacagcaatatggaggaaagtttcaggtattcaaggcactctcatttagacacgtatggtatcattgtatctagacagtataaactcttttgctgccagtcagttaagcttggtttaatattattcaatataagtttaatatgctatgtgaagtctatgatcttcttatccttccttcgccaagttccttcttctagtaacctgaaagctgtcaacctcttgttggcaattgatcttaaggtttagtatgtgcggaggcaatccactttagttgctacattgattggatatctcgcatctcgatgttgaattccatgcacgcacaatcattaattttggatcaaaaccttatctgctgcacttaacacgtatataattcttgtttctgtgtgacaatactgaatagtagccttgcttgaacattttgcttgtttgttcatgattttacatttctttttgcaggactctttgatctgttcttcaagtgagaaattactcaataatggatttgctctgaaggttagatgaaagaacccttattaactaagattatcatacgttagttcttggttggattttctcatgtttgttaccttctgtcagctcatggacagcatgtcgacttcaaaatccattcacataaaatgtgatccttctgaacctgatgttgcatggaaatggatggagagatggacatccatgattccaccaaacactgggggacacttgctagaggatagagagaataacgagtcggtggatgagaaaataaaaggagatgctcaacatgaggaaaatacccttcctttggattctgacatctctttcctgaagttggtgcctgatgatgcggaagagacactaaggccatctgattctcatcccctggaggtttctgcatgcattccagatagaacttctggaatggaaattgaagatgttcctgaaccagatttgattgaaaagttcaaggaagatgttgaaaaattgactgaaccggagactgagaatgttgcggaacaacctttggaggtctcagttgaacaatctactcaaactgatacatcaagggaacccattcctcttcctgaaaaacctgaatcttcctttgatgatactatggatgcatataaaactgagcagacttcggagatggaaggtaaaaagtttatggctagaaagtcatgcaatcctgcatttgctgctgcacagttaaaatttgaagagttgacttccaatttgacggtcagtaggtccaacagtctggatggggcaaacaaaccaaaggtacatactcctcgttcacaagacaatgtctcacccaagcaaagtaatgacacaagcataccagagagctcagtggggcatgatcctaaaatcgtagttgctgcttcagaatgtggaactgagatatcaatctcctctacacttgactcaccggatagatcagaagctgatggtggcgagattgtactggagattggatccctggaagataggaaccatgttggtgataatgctgaaaaggataacagtgttttgcattctgaagtgaacacttctggaggagctatcgagccagaaaaggaagtacaaactgatgacactgctatcgctgccaatgcaattgatcctgtgcctgttgaacaaccacatctgggacaggaaaagcctgatttacatgatgaactggaaaaatctgtaggatcttatgtgaagacacctgaaggtactcccttgagccgaactacctttgctgaatctcatgggacaccatcaagtgaggtctctgttaacaccaaaaaaagcaagagcaaaaggcccaagtctcatgtaagcaagagatcactaactagtccaagcagcgattctgtgggacggagcagcatggataatctgtcaaaggattacagacttgggaggcgagagagctcaggcaaggttaaatctgatcatgttgatcaagaacctcgcataagcaacagcactccattgccaagttatatgcagtttacagaatctgcaagggcaaaggcatctgctagtgtatcaccaaagttaagcccggatgtgcaagacaacaatccaaggaaaaggcactctttgcccatgactaacggtaagcaagattcatctcctcgcatgcaacgatcatcatcccaagctcagcagaatgtgaaaagcaatggtgctgttcctgttcctcccaattcatctgataagtgactaagtgcgcacaagtctattcctttgctagttgctactatcatcctatgatcttagtatgatcagtttgcacttgaaagcttagtttacgaagatgatttgtaatgattacctgtttttctctggatcactgtagcaacaaatatcttgtagcctcgatatgcagtttaggtcattaaactctactctaatttgtgaggtccacttttgtgaagcacccacttgcatacacaagctatttcagggaactgcataacattaaaattaagatgaacatagaaatgtagtgtttgggcattaccggtaatccgccttccctgaacattcccagcgacctgtgatctcttcagtggtgcttttagtgtcgcctcagaacattttcgtcctttatatgtaatgttcattgttttcagtttattactggctatattactgataaatggtaatgcactaatccctgaatattatcatgtacttatatttttactctcttcagtgtggttttgtgcttgctcagtatgatcatctaccagtgctgttgctatgtttgtgttaccatctattgaacagtatagaataatacgatagactgtatttccatccatgatgcacatatatctaaacaagaacttctggtttgcagataggagatggcatatatgatgagtgcgcctagcaagagtttttagcgaggtgccatagaagcatttgatgagatgactcagatttgtgcttgttttcccaccgcacaccaccatctaattcgtcagtttttttattctttgttggaatactcggtatggttggaacttgggagaagaacagcaacagctttcctataatgtacatttgttggttcttggtttgttgttatttgactggtaatgaatgaatgaatgatttgtgtgtgtaatatatcttgacttgtaatgcaacagcggtctgttatatttgccaatattgatgttcatgttggtgtggagtgagaaatgcctgaccgctgtatgaggttctgtcgacaagaaattgacttgctctatcttttgtcttctactcccgtgtgtcagtgcgcagggaaagaaaaaaaaacaaaccaatgaacccgctaggcccagtccaaagagacgcacaatcatgtctggccaacaaaatcaaatggagttacgaactgaagcattttttgcgaggaaagtccatttaaatttctgacatcaacgatccaaatgtggcccacaaagttatacagacagtcccaattcctaatgcacgaaatgccaacaccaccacacggtgctcggcatgcaaacgcgggttcaaatccattcctccccatgcgaaacaatgtgacggattagcgcataattaattaaatattcttagcttaaaaattaaaaattaatataattttttaaaaacttttctataaatatttttttaaattctttttaaaaattacaccgttgagaagttgggaaagatttatagatcatagccttaggtcaggtggttgcgcaacttgcgctcatttccttccttagcgtgtggttttagttcattcctatttcctttctcgggttgatccataaatacatgtataaagcttctataccaaatattcttttatgtacaaagtttttgcatctaagttctatgtataaaatttctataccgaagtttctacacataaagtttttatatatataatttctatactaaaagtttatattttaaaataaaattcaaccaagtcgaatgctcgtgtggttgtaggctgaatgcacatgggctttcgaacttggattgggccacgacatgttcacgggcctaatgtgcatggacacatgcgtattagcccctctctccaaagccgtgttatcctccattgactatccaaaattcttgtcctctacgatgctagagtctttatgtttcgatggagtcggagctgttgcattgaattnnnnnnnnnnnnnnnnnnnnnataacattcaacactccagctctgattttctagaggctctacaccttttgaggaagtcttagacgaaagcctagtctggtctcctaagatcggcgacatcgacacctgcgggcgccgttttctccttggaggtgttgccttgtggactctctctccttttgggtgaaaacccagctcagttgggtgggtgtcgacagcggattctgtcgttgtttacctccttggaggcttcgtcttgaaggtcctgctcttccctcggtgtgtactgtggtttgtagttttgtcacaggtttttcatgttttcaatgtaaggttttgtcggtttccctttagcaaactgtacagttgtatggtttttgggactagttttccttataaatagggtcaattctcttctaaattatccggtagaactcctaccgtctactgtttcaaaaaaaaaaaaactatccaaaattcttgagtttttagtatgctcaacatgttaagagttggtggaaagattggtcatgaaagtttcaatttttctcatcatcctttatttggtagtagagatgagaatcacggaaagttcgagtgagaattaaattttatgatgatgtccggctcagatttatctttaacgtacttacgacgaaattccctcatagttatatgtcctacctaggtattgaaaaagtgagagtttactcttaaacttcgccatccaaacaacgtaattaagaacccctaccctcgaattaacaattccctccaacgaaaacacgttcttattaaaggaggaggatccaatgaaaaattaagaagacaacgatgagagagctcaaacgattgactaggtggcgcgccaatggtggtcgatcaggcaatgttgtgtcatactctatccgtcccaaaatataactaagtatcggataagacatttcataatagtatgaatctacagtatgtcaagattcgtataactaggaaatatctcctctcctccagtccaagtttcttatgttttgggacggaatgagtatatgatttatcctacgtcaaatctctctaattttagctaaatttatagaaaaacctatgaacacctataacgacaactaaaatacattatcaacacacattttatatagatgttgatatagttttatcataaatttactacaagttagcgaaatatggaaaaagagtatgtatctatactatctataaaattataacccactaagtctaaaactcaacatgtaaccatgctacatcatcacccactaacaataattacatatttaacctcatgcaagcatacaacatcatctacaatttatttaattcaacaaattaacatacaaacatatccaatcatcacccgtcacatcatttgcataatattttaacaaatctatctatcatttttataatgtttaacatatatttatcaatatgtttcatattaggttatcatttgtttgtttcatgataagtactgatacaccttatattttattattttttcttttttacttctatcttggttgtaaaaaaatatattaaaaattacttagtaattcatgcagcaatacacgaaaaatcaccgaatcacctaagaatagactggcacaatgaatgcgaagaagactacgcttcatccgtgcactagtatttgcagagtgcgacgtttcactgacaaaccgactgtcacaactagagacagaattagtgaattcagaacaagatatcgagctcgaacttgattcagtaaaaatttgagcaccaatcaatcatgaaatattttgctttctttcagaacatctcctctcctcgacgaacataaaaaaggaggctaatggaagagctaacggagtaatatttactgatccatgatagatgaaccaaagaacagtcaaaaattaaatggcggcttcagctcaatttcgaccgcccattgtgttgtctaattttatcctttttgatcccttttgcttctgatgatcttttcttgttggggctgacgcatcatgtaggaatgtgcaactagcaccatttcgacaacccttcgggctgttaaagtatgcacacggtttcatcggcctcaccttgccatctctgctcaccatagcagcagcaccgttcatggcatcaataccgccattttgtggaggaccaggttggcggtacataccaaactgcattccatgctgctcaaatggttgttccagtctctcccctccatgctgatggatgagggttttataatagccgacacccctccctggaacacttccaaagttcactgatgggcttgaacttggcagggcacttccaaagttcattgctgggcttgaacttggtggatgattcatagcaactgaaggaatggttgaaggtggccgattcatcattggtggtggaggcggcagggtaggattcatgccatgaaaggttccgacatgatcagagaagggggcaggagagcttgcagttatttggggtggtgggattgataccaatggggcaacaacagaactactagctgattgttcatgtctgactgggccacattctttcattaacctctgaagctgtgaaggatcacttagtattttgaagagtagttcctggtcaatcgtgctcccgttttggtcagccatgctcccattttgattactctgtatggtttgcataattgcagtgactgttgctgagactgcagcctgaggctcaatggtgaatccagaacttatagcaccaccacatggtggttgttgctcagcggaaacaggagtatttgaaactcctgttatgttgtaatggcttggtagatcaagggttggtccttccaattgatcagatgcatcatcatcttcaagagggatcaaaggaaccaacagggttttggaatcgtcataatgggcatctttcacatcaagagaaagaaatgggctggattggcacacaaaaaaatcattataaaaaatggtatgtgacatctgaagaacttgtaatgaaaaaaaaggagcttgcttactttggcggaatgttcgatggacgtgggtaaattgcctcaagcgctccatttattctctcattttgaatttcaatctccctactttcttctccagcaacaatatgccaatcctgctccaatactatctgcaatcaagagagtgttgggaatttcagtaatctttgaacttgtcttgctattgtccaacacaacagtaactgtgagccttacatgtggggggcatttccacctaattagggggatttgagacatgtcaattttgaggtcattgcttggcggcaatgactcaaagcctggaggcaaggaatcatctgagcttgggccagctgcatgcagtaaccatgagccttttgcttggagattatcctgcggtcttaatccagcttgagagggggaatcctctgacaggaaaagccttacctgacacaaacacatgatacaaggttgttcagtatttataatttattacaatgctttagtgacacaagaaacattaaacgagacaatcaagtccgaagaacatgggcaataagatgattcactatcatgaagcattctgtgagccaaataacaaatttgaagaacttggtcatcgtatcatcaaaagggctataatgctgggtgataaaaacttcagctcagattaaatttaatcttctgctgactaccaaaatgtatagttcaatgaagtctcaaaaaagaataatttttttaggagggttcacaatgttaaggcatgataacagtttgtgacagacattaacctcaaacaaagcaaggagctagtttctatccaatgttcttttttcttttttgaaagaactccatccaatgttcaatcacttgcttagcacctacctgcctccaggatagttaaaaccattctttattatccagtaaaataaaaggattgtttaataccttcatgccacttttatatatcttatatgcctatccaagacaagatgaaaagaaacaagaactaaacccttcctcttcaatgccatttcagggctacttcagcagttcaactatttattcttttaattttcctaacatacattctaacagccggcagattgcagcttgtatgaatccacaaaacacaattgctgactagttttaagatgtttcttaacagaagactatgaccatccttcaaaattctagaacaccaataaaaatctcttacaattaataccatcttactattgatcatttattcaaagtactactaaaccatcagccaaattttattcccgcaatctgtacaatttaaacactcaaggccaatgtgaagtgctaaaatcaactttcagataatatatacatgatttgacacgttgtatatgcaaatccatattaacttcttagatttcacagtccataacatatcagctaccaggcaccagcaatcaagattcgaggaaagtacttcattcagtcctatgtaaatctgcaactaacatgtcatctcacaaacaggatacttaagatatgaataccaatttagctgttcattag

SEQ ID NO: 45200 - DNA, 1182 bp, Oryza sativa
gcggtttatcttttaaaaaaaaacttctccggatcttctaggcaccgctttgcgtgtttaccatgttacccttgtccgtgacgagggcaggtcatgtgcctgacggtttcgttcttgaactcaatcatggactctggtgaccgtctcgtcgtgttgttttaaaatggattagatcagtgtttcaggagacgtttcagataagaactctgtcatccatccaacgaggataatgactgaaggatatattttgagttaggttggtattcctagcaacctgtatcctgacttcaacaacatttatcctgacttcaacaacctgtatcctaacctcagctgcatctcagctcctagataagtatcattgcttcccagttgataaccatatcaggtcgttcgaacagctaaagcattcacttattccctacaatcagtggcttacataattataagacttaaaagtatctcggttcacatctcatgtcaacaatcatggtcattaacatcaggtacgtactgcacatgcagccttaagaatctagaccatattccatagaatacaaagatgtccgccttaagtccttaacaaccatatcagtgcgactgaaaacacagcgaggaaatggaccagacaaatccaacttcctgatcatctcttcttaaaaccatacttctttcgttcatagaagagatcggtcttggcgcttccaagattgacaatcttgggacatccatctcggtccttttcctgctgagtgcactccttgcagtagtaggcatctgagatgccgacccccccacagatgacacacctcccctggaaggaaccatagttgcactcatcacagactcggacaagcgtacatgggcgcacatacgagtcacagatgacacacttgccatcacatttctcgcacaaacgaccaatagcaatgccaggctgcttcctgcacatgatgagatcaggatgatgctttgccatggctgtcgaatgctaacctgtggaaccatagcagaatgcaaatatatatcagaaacaagcaatgctggtccatcactaacagaaaaaacaagcagaaaaaaaaatccatttgtatactattcagctgttggtcgaacaactctatgatctttgggcatagtatgtgtaagagaagcaatgctgattacagactttccagtgaa

SEQ ID NO: 45201 - DNA, 765 bp, Oryza sativa
  unsure (1)..(765): unsure at all n locations
gggaggggggagtaactattgtgtgattagatactagtaattctcatattcaccttccaatgttttctttctcctctccgacttctctgtccctggatgacgtgacatgagtttgttgagcaatgaaaaattaaggagatagattacctgtccatattactacgatatgtcacattcagtactagattgattctttatgagacggaagaagtagacagcagcctggcagtgacatgtatgaataagttggacccgtgtaaaagaagcacgaatctcaacccacatcacagnnnnnnnnnnnnnnnnnnnnnncgggaaaaatatgttgacacaatgattgcgaatcctttttttttctagctctataaattggtctctccaaataactccaacacgtcactgtcttttataatctctcacatacaacttatttggtagagaacactctccatgaagtttattttctcttctaacctccacctctatctagttttcaataatttctcgttgtactgatcaacttctcacagcatgtggggctccggcgtggtgagcaaagttgcccctatgtcttttcttattaggcttgagattttatacaccacttctatagtagcatgtgtttgccgccatggttttaccaccgtacccctatggaattaaagagtacaaaagcataaggtgaaaggagaccgaaatacacacaccttttgtggcaagggataacttcaatcaccaaatggaggcctatggagcgcaagaagt

SEQ ID NO: 45202 - DNA, 781 bp, Oryza sativa
  unsure (1)..(781): unsure at all n locations
nnnnnnnnnnnnnnnnnnnnnnnnnnnnnnnnnnnnnnnccatctttaccaaagaagtgcatgatagatgtctctaacagtttgcatccttctttcatcacatcgcgctaatcttctttaagcagcaaggaccattgtcgagcccaatacgtccccctgaaaataacctgcaagtaagagttaaaattggagccattgaagaccacatcatttctacaaatccacattacccacaacaacgccgcaatccctataaaaatttggtgctttagcctagattgcaaaccctttagccaaatcccaaacatattagcaacattgttaggcggatttatcccaaatgttataaaaagggtactccaaacaaatctagcaacatgacaatcaaagaagagatgttgtatcgtttcattgtggttacaaaaacaacacttagtgttgcccttccaatttctttttgctagattgtccttagtgagaatcactctcttctttaaagtgggggacctncacctnccccactttcacccggcctgcaccaccattcctctccgagctagcagctccccccttcttctcttcctttcttcccatatcatccattttcctatcaaaagctggacgttgtgacctgaaatctcttgctgaccctctccctggtctttctgcaaaactgctgcgccttgggccaaaaacacgagcccctctcaggcggtaaccatgcctctaccacctntgaccgaagctaccctgctgcccaaaacatagcccggatcaaacc

SEQ ID NO: 45203 - DNA, 725 bp, Oryza sativa
cgagagcgaattaaggatcagattttatgagcacgatcgatcacgattgagcaggtagctcgatctgctacataacgtactcagaaattaattaatttatatttttaagaaacacggtataaacacaaacgttctcgcgtgtgacactcacctatatgagcatttttagaagactgggcatattgacgtttcgttgtcgacgggtacgtcgtccactactgaacgaataattaaccgtaaatgtgaacacccatatcaaatttaagatttgaacctaaacctgctccgctcatttcgtgaaattaattaatttcgttaagaaggaaaaaaaggaaaaaggaagaagaaaagtacatacttgatgcgtacgtagctgcgtagtacgcttggatggatcggtgcaatatatgcaatgcaatcgagcggctttgtagtttctctctctagctagctaatatagcagctagtctctctctaccgaatccatcgtccgtccatccgtcggaggaggtaggtgggccagggcagccatgtgcgctcatgtggtggtttgcaacgcttggccccaccaccactttctctctctctctctctagactttctctctctttctcctcctctccaacccaccactcactaacctgtagtacccccaacaatgcgtacacggccgtcaccctcttcctcatttctcttttataatctctacaactttaaaaacatag

SEQ ID NO: 45204 - DNA, 1396 bp, Oryza sativa
tctaccgaatccatcgtccgtccatccgtcggaggaggtaggtgggccagggcagccatgtgcgctcatgtggtggtttgcaacgcttggccccaccaccactttctctctctctctctctagactttctctctctttctcctcctctccaacccaccactcactaacctgtagtacccccaacaatgcgtacacggccgtcaccctcttcctcatttctcttttataatctctacaactttaaaaacatagtgtcctcggttcgttcttctcatatatgcataaccatagtatgatccagtaatttacctaggtcaaacctgttacaaagcagagggcatattatactatataagaaatttcacgatctttattatttaattataacttattataaactgtaattgtattggcgcccttgtgactcgaactaccccatgaaggagggagaagctgtaacacttgcgttcgcgaaaaacaactgtgtaacacttcaaaaatagtttataaataaaacttatatatatttgttgttagtaatttaaaacttaatgttgagaaataaactaaaaaaaacatcaaaaaaaatctaaaattaagatttaaaatttaaatttcagttacgactaacaaagctaaaaagcaaatgatgtagcttagctagggtttaaagtttatccataaattgatctctcctacaatttcttcgatctatccaacaccgctatatttattactcactgtggtaatattatatgctcctagaggcattggaatattttttttttctttttacctcaattttaaagcttgccaattaacctaaaatctcttaaaatttgaacggatcaggtagctacagaattagccactgccttgtttatctctctaggggattagctagctaggggcctgtactgtatctatctcaaaacgccctaacgggaacggaacgaatcggcatggaggcgcatgttacctttctgcaaagcgtgtggcatgtgttgcccaagattacgatcaattggtcgatatttgatcgagatcaagttgttgcctggctccagcaacatctttataatctctctgctggattaattattttaatttttctccagctgtgcaatatacacacacatttgcgcgtaatatgtgcttttgcacgccgattaggcgattgctactatagaaacttaattaacattgcatggcgatggtttgacgaacgtgtcaaaccccaaatcccaggccggtttactcgttttacgttgcttccacgcagacgaacaatttaacaacaaatcgagttaatgtttcagacgcggacggcaacgtgatgctgatgctgatttgcatgaaaaaaaaaagcattgccttaatttttcctctttttttt

SEQ ID NO: 45205 - DNA, 2206 bp, Oryza sativa
  unsure (1)..(2206): unsure at all n locations
gggattagctagctagggggcctgtattgtatctatctcaaaacgccctaacgggaacggaacgaatcggcatggaaggcgcatgttacctttctgcaaaagcgtgtggcatgtgttgcccaagattacgatcaattggtcgatatttgatcgagatcaagttgttgcctggctccagcaacatctttataatctctctgctggattaattattttaatttttctccagctgtgcaatatacacacacatttgcgcgtaatatgtgcttttgcacgccgattaggcgattgctactatagaaacttaattaacattgcatggcgatggtttgacgaacgtgtcaaaccccaaatcccaggccggtttactcgttttacgttgcttccacgcagacgaacaatttaacaacaaatcgagttaatgtttcagacgcggacggcaacgtgatgctgatgctgatttgcatgaaaaaaaaaagcattgccttaatttttcctcttttttttcatccaattgtaactaccactaccaccgtactcatatatctatccagcacatgcatggatatgcatggttaatagtagtttagcatgtgttgtttcctcatgttcgtcaatgcaatcaggttaattaaccaaatcagcagattgcgtaggagtagatgtatgtgaccgatcgagtaactgaatcaatatatcgatccgaccaaagtccgaccagattgcttttatatccattagcccacatgcaagcaagagctaaccaaagatgagtctcatgttcatcttggccaacaatttcttactttctttctctacagtactagcagactaatttttttaataaaaaagaataatttggattgtttttgtctctcgttgtcaactaggtattataagacaccggatcttgctcaggacatttgtgtcagagccgtgttcctcgctctcttccctttcctttttttctctctctaaaatcgcaacccacaaatccttctgatccgtttgtgtcagagccaaatcttcttcttcttctccatctctctcctctcctcttctcttctctccgtggaaggtgaggaggtgaggtgaggttgggggcgccgtttgatggacgcgaagaggacgccgncgncgncgacgccgncgaaccctaaccctagcgtaattggcagcggcgccgccgcggacggcggcggatttgggaggggggaagcggcggcggcgaccaagcacatgctggccttccacttcctgcgcgcgctgtcgcggatccaccgggcgacacccgtgacgcggcgcacgcggaccatccgccgggccggcctactcctccattggaccggcggcaaagcccgcgccgcgcgtgaaccggggccttgctcggccaggtccgcgcgcggaggtccagnacgctaataaggccgncccccgtgctggtcggaggcgcgttgtagccgctcntgcgctttctcccgcctccgcaagaggcgtcaggattattgctgccggagagacgtcgncggcggctcgggctgttccgccgcctccgcggcagcagggcgagccgccgagggccgaagcgctccggcgcctggtccccggcggcgccggcatggagtactccagcctcctggaggagaccgccgactacctccgctcgcttcgcgcgcaggtgcagctgatgcaaggcctcgtcgacctcttctcctaccaatgatccatccatcgagtaattaacatatgcatcatatggttaattatttattcgttcgtcttgcacgcatcacatgctgctgttgctgcttctgttctacttctctacctacatcatatcgatctatctcttgttcatgtggatcgatcgatcgatgcatatgatggttggttaagataggggattattattggggtaattaaggggaggatctaggagattgggtggagtgttagtatacatgttttttgtttttgttggtaattaagattattggtaggtgatgaaaagattgttggatacatacatccatgtatagaagtataggccgaccggctgggagcacaatgaattgaatcatatataccaagaagaaggcttttatagagagagagagagagaggggtaattaattgtaacatataaagagaaggatgaagttacatatactatatgatagtgaattagtgcagtgttaattgctgt

SEQ ID NO: 45206 - DNA, 7533 bp, Oryza sativa
caattgtcagtaaatcgatctatatatctgcgtatatgtgtgtttgtgaattgtgaaaaattcatgcatcctactaacctacctttgtagctgtatctgcgatgttggtatatatatattttttcatcttctgtaggtacgtcttctatctgattggggaagaaacaggtaattacttaatcaaagaacttaacaatgaggtcatagatgaatggatgttgcatatatatcatgcatgataatctgcatgtgtgcagattcgttttgttctagtagaattaagtattaattggttgctagctagctgcacatgcatgatgcatatgtgtgtactacctctatatcatcgttcccatgcatccgctactcgtattagctagggattgacagctagatgatgctccattagctagttgttgcctagcttgtctaattagactattagagtactgctagcttgctaactaggagggtggttatgttgaattggttgtttggtagagtgttttttcttttctcctctctcaaatttgggaaagtgggagccacaatctatgagggatagggttgctaatctttgagcttgatgagaagacacacataacttgtggccaaaggaaccaaacaaaagacattctctccatgggcggttagcatcttttgattaaagggccttgtgtttttccctttggaaataagcatatatgtatttgtgtttttgctattatttttcttctctcttcttgttgcccttccatcatctctctctaccaacttatccctgttcctttttaggtgccaccggttctctattgagtattctttgtgtacttgatgctgctggcaagtttttctgcttggctcttttgtcgtgtttttttttctctcagttggctagctttgacacatgcgtttgttgcttcctttatggggtaagaatccgaaagggttgaagctagcctcttctgcttgtaagcttcctattaagtgttatgttacatcgggatcatatatatatgtacaacacaaacagtagttaatcaactggacgtagaaaaagactagctggtaccatgcaagtttgacatgcatggttgaaaccacattctttacttttacttaactgatataataatatagttaagtcttttgcatgtccctgaaaaaaaaaggtaaaaagatacagacgaagcagatgcaaagaatcttagtagaactatatgtatttacatatgtgtgttttcacactagctagctaacagattatgtcttgtgcaccgtggtatattgagagaagaagagcctgctgcctgctgcatccataaaataccctaaatttctgcttttgcttttttaatttttttatttgtacttgcatatattgtttttagttgtgatcacagagctagatataatttccacttaagacgatattgtagtgtgtggttttaatctgttttctatttggatattcgataggggggcgtttttggttcagatatcgaatttgctcattggccatagctagctgtcatatatgacaaaattagtacacctattgacaggacaaagctagctacatgcatgtgtgcattttgcttggaatcatgtaagatcaccatccaattcgcaattgggccacaaaatagctatattagggagccatttcacatcactaaaaacatttttggtacttgaatcaacagctaatcataattggcccactgattagctgtactcatttgatcagctggctataatcatctccttcaacagacatgcatgtatatatgctatatagtactataccttggaatgtacatattgaaataaaataaacatggatcggtgtgtagcgtatcatatatgcatcgagacacatatttgtgacagtacatcggaattttctaacatcatgcatgtttaattactgcatatatgactttctgtcacttctatttttcagaatactatctttgatcatctgctggttagccttgccattagttcatatatagacttatatataattttgttttcaatgttaatgcactaaaaattgtgctccattcgaacaaaatgcagagaaattaaaagatgattcagattggtccaaaatacatatatatagttagcatggtcaagtaatttaatgagtttgccgatttgatatatcagttttttatttcgtcaaatacacgatgatatatataggtgcatgaaataattctcagtattgctaattgatcgttatttcagcaggatgtgaaattagttaataattgccgctatatatacctgtcatatcttcgtattaggacttatccacatggacacatccattttatgtcactgaaagctcactatacttcttaatttttaatatgcttgcttataatttatctattagcgggagaagcatcaatgatatacgatggaataataaattaatgcatgatattttatccatcatgattaaaatacagtgcgatagcgcccatgaatattacgatacacgagtatatatgcttttaataagattttagtgaagctagtgagttacaatcgctactatagcttcatctctttgagcatatgttagggaacatatttagagatgagtaagtgtggtgtgccgcacgcgtaagagtactttgtgaaatcggaaaaattaatctttattaacagaccgtgcgtgggacatattttaggccgtgtgagtattgtggtaatcgaaaaaaatattgttaataaaccatgtgcacgagatagatggatgtactagttaatgggggtactagttattttaacaagtagtgctgttgcatatcaaatatgcacatttaatttctctcttatatatacagcatatatatgtatccgggataaatatgccgtgcaaattaaattgatttttgtgccatcagctatatattcttatgcacggaatgcagatatatagaaaattcagtacatggctttctttataccgtggctaacgtacgtatacgcatccatatgcatggatccgtatatatgcctccagggacttttgtatgtgtatcgcctcgtactctctgttgtttgaatgtttttgtagatctagcgatcaatgtgtttaattaattaaccgaacgctaccaacagtactacaccacttatacagcacctgctgactttaatttaaagtatatatactttttgagatttaaccaagttatagttgatgaatgttacgtgctacacagcgcttgtgctttaattagatcgaccaaacctagctggctagctagcgtattactctaattaatatactcgatcggtatatatataagagcttagcatgcgtggaacagtacggtacaaattaattttgtgtcattttgactcattgtgtgtgtgtaagtctgtatagaattgttcattgtgtataattaagcttgtatacaattaattaattgtgcaattatatatattgtgtgtaagattataacatgggaaagctgttcgtgtatgcaccatgtatgcgtgtaagctaacgaggatatattgcggccgatggatacatggcacctatccctaaaattcatttttttaattagtcccttttactgtcctttcctgctgcttaattgagcccatatatattaatctactctggcatcaatatagaagaaacgagaagaagtctaaggcccattccattatttgtactgagagctgcagaatttgtaagaactttggtatacgaaatattcccactaatttgaatgttggttttcctacaaaattctcgatacactagagtgaagtgctcaagacaacaaacatgaattggagtgcgtgtagtggttagctagctaattataattaatctttgattaatgatatagatatagtaaagggaaacatatatcctatgcacacaaactttccgtgcataccaactaataaatatcatgaaaaattatagaaaaaattggatatttattcataatagtcgagatgatgcagtacatatatatcctatctgtttctaattaacattaacacgagatttatggcgaggggcagcagaaaattactcagaattaaataacaaccttttctgtcttagcaagtagtagcaacgtcagactgacgtcgttgcataaatatatgtacagttgtctccaactacaaggacgtacagactgacgctacggagatatgtcgaatacgtcataagttaggaccatgtccaaagcatgcatgacattgttgttgttttcctgaaatatttggaaattatatattcagaagacttagctatatatatacacgcatatatataataattaattaaatagctactagctagtaggtgcgagtaccacgcgcgtacgtacgtacacctctctagctagctgtattcctgtacgtatttagtgtatggtacagggacatgatcagtacagattatatattattcatggtaacgtgtaaccttgtatgccatatggacgtattatgcatataatgtgactgattcaattggtgcaaatgcatggctactaagcaagcttcccctgctctagaattattgattagttaacaaattttgtcggttcaattccaacctggtcatatcataagtacaggttctgttagttcttcccttgcatcttgacgaacactctcaatttaatttcttgaatcttgacgagtagtccgtcaaaatcttaaatcatagctatagagactaccgtcctggtaagaattcattaattacatcgatgaatgtctggcagtacttaatttaccagaaaactggtgaattaatcagccatcgatgatcgttgcctgttgccacaatctgttgattgattttttttcccctacttccatcgtcaaaacgatcaattattagtcttgcgcaacaccaagttgaactccgtacatcatcagacgatgctatgttgtttaatttgcatatcgtcggagctctgaactcatgaacttaagtacgtggatacactatcatcattctacctacaccgccttctgtagaaaattatacgggagtttttctaatttatatggaatttaactgtttaccgcagctgtaaattaaattcctaattcctgtacaacagtacaagaagactgatcatatatccaatatccatgattttttagtagatatagtcggtccttccatagttatgtggtttaatttgtttactatgatctaactagtttagatatcctcaagttgttttccactttatccacactttcaatcaaaaccatgcgcgcttaatgcctttataaacattataaacacggcgagaagagattgaaatgtcctgacgtcgcatagatcgaaagctagttaattaattaagctaattaattagacgtccagctgaaagcctgaaagctaaagctcgaaatcatacacgaaaaaaagaaaagaaaaggcaaaaaaaaaagttattacacatgatgagatgaggacgcggcggcgctagctcgcgttaggagatcggaccggagtcaggcgacggcggccgggagcgcgagcgtgccgacgaagggaaagctgagctgcggcagcgcgaccagctgccgccgccccgccgccgccgccatctccatcagcgccttcctgatcggccgcagcagctccgccaccagccgccaccgcaccagccgcgacacggccagcctgcaccggcccgccggcctgcgccgccgccccagccacaccgtcccgccgcagtactgccgccgccgcagcctctgccgcgccctccgctccctccacccgccgccgccgttccaccccaccaacgacgccaacctcgccatgcttaacactgtgcacacacgcactgatgtggtgatctgactctcccggctgagctgagcagtgtttggctttcgcagctgtatcactcactgatgacttagtgaggaagcttaatttatagtacgagaaagagcaacgcgattagctagctaagtaggtgaggtgttaatggtaattagctagttaactatagatagcctgcagctgcatgcgctcactctgatgatggtgatgatgatggcgtgatgataacattctatcaaagcttcatttttttaacgtgtaaaagaattacacgttaatatactagaaaaaggaaagttcaattatgcatcgcaaccagtcagaggacaattgtcggggggcaaggagaaaagaaaactgaaaaaaagagagaaaaaaatggagctaaaactggacactactcctatacgagagagggggagccggagccctactatacactcccaatatatccccaaaagacgcgacgccagtaaatgaccatgggaaaccttcatgtagaatggacttcagaaccaccgaaaccgacgagagagagtaatcgaacactctggagttccgctcctttcatagctgcgaggagaggaggactaaagagtcgaagcacttatgacaatgcttaggcaggcaggccctagaagtaggccactagacctgaagagaggagccacggagcagagtgaggtcagaccagtcaggtagagacagaatccggtgtcagacttggcgagcgaactcacagttgaggaggatgtgattcgccgttttgagttattggacgcaaaatggataggccgagtggctgtcaataccacgcttttaaatgctcttaatgtagttgtatcaccttaatttaactccttttgtcttaaaaaatcaaagctatcttaggtaagaagcgctaagctcactacacttaggaattgagaaggccgtcgccctctacatgcataatactaatcatttgcacggcagcttattaattaagtgtacatgtcccacaagaaaaggatatgatctgtgatcatactatcataagctagctacacataaagattaaatgtatatgtattttactaaataaagtgtaccatgtacaatactacaaaatggccaagagggtggctagctaaagcatgcgagaaattaattaaagttaatctatcagcttgatctctagctacctaatgatatcttaaacttgcttgtgctctcgaaaagcaaaatggatatataagagcgtgaaggccagctgatcttggcgagatgagaactgatgagaaaaagctttaattggcgattttattaattaagcaagtctgggcctgaagcagaatggatttttctcttttttactgcctagttggtcctttcaggtacgtacgattaacgatacaactgatttgttaactaaatcaatcaattaagatgttggtggtgcaatggattggatggcctagcaagtgtcaagttggataaattacagttgatgtgatgattggagccattgatgtatagctagctgctagcctttgctcatcagctgcttaattgttagctagctgcaacctgatgtgtcaggaaagcaaagcctaaattgcttttgatttgcttgtattaaattaaggaggaagctaggagggcaatttggacgt

SEQ ID NO: 45207 - DNA, 2890 bp, Oryza sativa
  unsure (1)..(2890): unsure at all n locations
acagtctggtgttagtccactcgtaggtggcctgtggcatcgccgccccaatttggtctgcttaaaataacccaagataacaatatcatcttgggttacttcagctatagtgtgctctgctttgctttacccaggtagctaatgctttctgattagctagatttgactctagcagccggcaattcgttccatttctaaagcctaggtagcattttgatttaaatatttcaaaatcaaagaattgccacacaagtttctcttgcatgctttgtcacttcatagagcatgacgaagaaaagaaagtaacggcagaatattgttggactccttaccaatttggatcagctttaggctctgtttttttctagatggaatattgtttgaaaccggcaaagttgtaatgagaggactcagcagctaactaattgacacgtcaacagtaacaagcctatcgtatccataatctagtcaaaaaaattgtcatttctccaggacaagttgaacatgaggccaacgagatagctccagataggaatcagaaatggcaccaacgcaactcgtggtcgatcaatcctcctaaactatgatcaaaagaaatgataggtcgtgatcagtatcctctttttcatgtcatgagaagcacattggtgacataggataatctatagttctaccacgcacatttttgtagtattaccgatgcaaacggtactggactacaggttcaattttaatttaacctggaattcagcttttgctgccgtccattgaaggaaaaaaaagtaactatcttgtatccactgtaatctggaaataatcgagaggaaaaaaatcaaatagataacatccaggatgctatgcgtgcatgacgacgggaaaaaaaaaagaaacaagaatcaagcaataccagaaagcgcatcaaaggcataatgcatgacagaatagtcacaggttggctaggactaggagtattcgattccaggagagctccagcatagcacggttgcataaaggcgattcaatggtggtgtttgcatcctatgaagataaaaattaagtgtttcacgtaaaacgagatagtaatagcatgtgattaattgagttttagttattacaaacttgaaaaatagattaatatgatattttagaacaactttcatatagaaaattttctcacgaaacgcatcgtttaacatcgtttaacagtttgaaaagcatgccatgagtatccaaaatttaatccactccttacataagaaaggaacaggaccattaatgttaactcataaaatggagtcctattgaaaaaaaaagagagagaggaggcattcgcaatcacatatttatcctgttgagaacacccccacagaattagttgaaatcatatccagtttaaagcctcaaaggatttgattagcatttgccaacatcctggtaagtcagtttcaggctttcagccatggctaatccggctacttggcctaaagcatgcattgcactgttaatactacctacatccctcgatgtttgaaagttcgttagtgaaaaaataaagaatggcgggagtagcactttgttaagtaaaaaaacaatcaacaaatatggcatgcaaaccatttacagctaggatatactgtggttcagatttcttaagagttacctatatcaaatcaactgaataggattacacatgaattacaagttagcatattgccaattctgaacggtggaattatcacatctcaatgtcctctaaatctggcaagggaaatcgaagtatagctgcgattcctgtcaactgcgccaactctgctcaaatgaaaaaaaaaaatccaccttaaacacagagaacacaatgcagcaaactaatgcaaattacaaattaataaattccttgttcaaaaaggttaatatgaaaatgtgacaattatttatgaactggtctattgcattttgatgagcagttatagtgaagtacaaatggatacgaatacttacgttcaccagagacatgcattgaagaaaagatgtgcactgtgccaccgaatttttttaccgattcaaccaagcgcacataattttgcctcgttgcaatgtcagagttcctgcaggtagaaatagaagaatcaatgttatttctcaccactaaaattttatgaacataccaacagttttgatatgagatgttagtttactgtgagtgttacaaaactagaaattcaagaactcagcagaaaaaaggaaacaaagcagtaggaaaataacaagactatagaggtaaattagctgactcgtaaacttctctttaattaacacaacttaccgaaacaaattatctgttattaaaagagtttggatagcaagacgttcatttgcaatctcaacatgcttaggtccataacaagctcgagctgaatcctgcaattatcaaaaaaaaaaaaaacagagcgacaggggtttaattatattcttcaactaagcagaatcagtagctctaaccacaaatattataaaaacaatatttccttccaaaatgaaatacaaataatgtatatgcatattaaaagggtctaagcagtaacacataagtacttcatccgtttcacaatgcaaaactttctagcattgcccacattcatatagatgttaacgaatctaggcatacatatgtgtctagatttattaacatctatatgaatatgggcaatactagaaagtcttacaatatgaaacggatggagtaggatatttcaatccaactgttagaaggtagtttttcttcaagnnnnnnnnnnnnnnnnnnnnnnnnnnnnnnnnnnnnnnnnnnnnnnnnnnnnnnnnnnnnnnnnnnnnnnnnnnnnnnnnnngggtaccgagctcgaattcgccc

SEQ ID NO: 45208 - DNA, 815 bp, Oryza sativa
  unsure (1)..(815): unsure at all n locations
nnnnnnnnnnnnnnnnnnnnnnnnnnnnnnnnnnnnnnnnnnnnnnnnnnnnnnnaaatataagcacaaacccataatgcatcagcaaattaattaatatcaggtattataacaattcaatttaatgtagtggcgcaatttgtcaacaagagagtaaagagaacacctaagatttaagagtaaatttcataaaatcccacataatattgtccaagttgcacaaaaccacagtgattttggcacgtggcatgtaaccccaggtattatggtcctaaagtttcacaaaaccacacttgatggggttatacaatcacatctcaaatttatgagttttttaatccatcgtataactgttatatccggtttttaaaattttgatataggagtatgccaaaatggttaacggtgtggttttgtgaaactttagtacctacacgaggttatgtgccacttgtcaaaagcactatagttntctgcatcttggaccatatagatggggttttatgaaatttactcaaaatttaaacatcccaggtgctttccagcaaggtacagtgcccaaatacatcttgccatcaattcatatcttaaagatgcatatcccacctatatagcagcaatataattatcttgactaaaggggtgcaccgaggacctcaacaaggaaaagcagaggtgttactgccaagaaacagaccagtgacaagaaataataattacctcaatgaaggcttttggatttgggcagtttgcttgttttgataacctcagtgtacgttctgcagctgtacgaccatctgggcgtgcaacagcct

SEQ ID NO: 45209 - DNA, 957 bp, Oryza sativa
agcttgctagtataacagaaggaactgttttatatataacctagattcaattgctgtttgacttcctactgttaacatgagagcaagtcgaatgttgtctgtgcataaaactgtggccctactgcactggactgtaagctcctcagaagtgcatagctagtcccgcatcatagataacaccttttatctttcccccctttttttctttcttgctggaaccttatctgctaccctggccgatggaaatttcctgatcagttttggttacgaacataatgaactgatatgaacagcttggtgctaactaaagcatcatcctaactaaaagcagttttgtagttaatttgttccctcaaattaatttatgtgtttggaaagtcattcgcacatattggtggcatgggagtttaataggtgatgttagtatacctgaaacattaccttctgtatctttttattaagtgtgcttgtaatttttgttaatgaaagtggaagtagtttccccccttcaaagtattttttttcctttttgtttttgtccctggatgcttgtgccatatttattttggtgcttacccttcatagtagctaacttagttcttgtgcttctcaattgtagctatgttcctaaccctgtcctggtgattattgatgttcaacccaaggagttaggaatacccaccaaagcatactatgctgtggaggaggttaaagaggttagcatgtgatctaagaagctggaggtttattgtgcttgtccattgtcttgttctgtttcattaatgtacatgttgtcttttacagaatgctactcaaaaaagtcaaaaggtgtttgttcatgttccttcagaaatagctgcccacgaggttgaggaaatcggtatgtctgtctcatctgtttttactaggaaaaagggatgctttatgtattttgcaagttacagataatagttagct

SEQ ID NO: 45210 - DNA, 11722 bp, Oryza sativa
caattgtagctatgttcctaaccctgtcctggtgattattgatgttcaacccaaggagttaggaatacccaccaaagcatactatgctgtggaggaggttaaagaggttagcatgtgatctaagaagctggaggtttattgtgcttgtccattgtcttgttctgtttcattaatgtacatgttgtcttttacagaatgctactcaaaaaagtcaaaaggtgtttgttcatgttccttcagaaatagctgcccacgaggttgaggaaatcggtatgtctgtctcatctgtttttactaggaaaaagggatgctttatgtattttgcaagttacagataatagttagcttgtttgagcggtaaatatattaagttgttgatgctagtgaggtttcttcaccaagaggaaagaatatttttgtggtgaagtctttttccttcagaaaggattgttgactgatgtatgttcatcctacttataggagttgagcatcttctgagggatgtcaaggacacaacaataagcacgcttgcgacagaggtaatatttcacaagaatatgcattttcagcctacaagttgctttattatgccctaatatatcctttatcattgttgtcattaaaggtaaccagcaagcttgcagccttgaaaggactggacgcaaggctcagggagatccgtgggtacttagatcttgtaattgaagggaagctcccactgaatcatgagattttgtaccacttgcaggttcgccttctactcattgctttctgtatggtattcttaggagttacatatacctccaattctcttgcatttgctatattattgaggtcagcacttgaaagctatctcatgctaccgccgtttggttttatggaatatttgtgcctttgagatatacacctccattattgtggttgttcggaattcagtatcactaaatatcactcccaaatcaaataaaaaaagtgcttaaaagttgcttacaaagtggaatatgctgccactggtaattccctgtgatgctactggtagttttcacaatacattggacgcgagatataagggatcttttggatggccaaatttgttttatgtatgttttttatgatttgttggttttttgtctaatatttttactcagcttgtcactaccttaataagaaaactgtgacacaacatgtctaaaaaaactaatgaaggtcatgacagtttactacatgtaacttgccaaacaaaatttaaatataattcaaagttctgttgctgaaacaattttactgatgcagttaataacctgtttattttttaaaaaaatcacaggatgtgtttaatctgctccccaatctcaatgtaaacgagcttattaaagcctttgcaggtaataacacatgttctcaccaatttactataattgagctgaacctgtcgtctgggtttcttatcttaaaatggttcgatgctaatgttctttcctgcagttaaaacaaacgatatgatgttggtcatatacttgtcttctcttatccggagtgtcatcgcactccataacttgatcaataacaaggtaaattgtttctgtcttatctattgaatatagaagatgcgggagttaggagatacttgtcatttattgtaagacttccttttatttgattccagatgctaaacaaggagcatgagaaagccgaggattcgaagccaaccgccatacctagtgctgctgggagctgaatgtgctttatttgccttagattttggacccagtggaagccaaaagaattgtgacatgttagcatgatggcgtttgaaccaattgtctttgaccttggttttacactttcgatgtttatttcatgtacgataaggtcaacggcaaactttacattctgtgagcttaggtcatactacctcttgagctttcatcttgatcttatatacaatgtttcatggggtgcatcatgttttgtgatgcggattgtcgtacgattaacttctagtaaatgtttacttgacgcaaaaccattagtttgttcggcttgtggcaacattgtaattgatacctaacaagttgctaggacaggttttcttggcgaggcttatcgtatgtgttctctagttggcggctgtcaatggagcgctgatgggtgcacacaggtggttttcgcttcggctcgagttcaaaaactaccctggtgaactaattcaattcatgacgtcaaactaaactgccctggattatctttcatctatttttgcaattttcaaatcgttttcataaaaatggacaaccgttgagtacttgatcagcgaacggttttggaaccttgatgtagcggctgaattggagttgcaggtttttcctaattcctactttgaaacttactgaacctcgttgtaaatctacctcgaaatgaattgcagtcgaacgtttttcccaattcctactttgaaactgttactgttctctgaaaaataaaagcacacggccaaattcgtaaaataaataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataataaacccgttccaaactccatcggcacaaggcacaagacaaaattcgtcgaaatcatcctccagattccagaacggtttgcgtggtgtgtgcgtctgctgattacgactcggcgaattcgtaagccgtagcgaatcgaatcgtcgcggtcgcggccatcctctccaacccatcgccgaattcaccatcgcgaggcgcaaacgcagctcgtcccccctatggccttctcctctttctcgtggccgttccgccgccgaggcggcggaggcggaggcggcccgagcaaaccctccgcgtcctccgccgccgccgccgccgccgccgcggccgggaacgaggaggaggagctgggcgtgacgccgcagctgctcgacttcctccggacgctctccccggactccttcaagtcctccgcgctccagctccaaggcaacagccacacactcgccatctccatctcgatttcatccttcccactccgatccgggctcgatcgtgatgtccgtgcgtgcttctcgcaggggtggaagctggcgacctcaccggctggcaggagcggcacgccgtgctcgtgctctccaaagccaaggtacgcttcccggcggatctcggttctgtatcgctcgcttctctctgtctgtgatgaggatgttgtggaagtttgagcaaacgcatgcgtgcttgatgcgcaggaattggccaagatccggtacgatctgtgcccgcgccacatgaaggataagcagttctggaggatatactttctgctcgctaagagttacacttctccgtaagcttccattctgaaattatttcgattatcgtcatgtaaatttagtttctgagtattgatatgcaacacaagctaacatcagagtagcatctcactttttccttcataattcaatgagttatgcattaccttctaatccaatttaatacagtacataattataaactatggacattacattaccttgcacttaacattacgcacaaccaatttatatctcatcagataagttacatcaaatgtgagcccttgtacatatttaagaagttgggtttgctgtacctgatgaagtgatgagtatgcaaaaacatgagattgcccattaattgctatcttcttggtgaagtagtgcttctgccagatataattgccgtttacatcctgtgattttgttaattatcatggaatgttggaaggttattgttctccattgtacctcactaacttaagttacctaaatgacctatcctgaaaaaaaggaattattcatccttgtttggtctgaattatatgtcctaagatttagaggtattgtaggcatatacttcaaataggtgaaattataggtaaaatgaattattcatccttgcgagtgctgaagttacaggatccaggctaaaattatagacaggcatgtaaacactagaccaaatatacagttaactcctctgtagcctcgtgagactttgcaatcagctttgctcattatctgcttccacctatgcaatcgagataggctgatatttgatgtgcaaagacctcatagatttaggctgctatttcaaatgttatccgcagaagtctatgaatttcatatttacatgttctcctagtccctattaccatagacaatttaacagcatcaacatttgaaacatatgttctgtttttttttttatttgtaggtatgagctacgagccatacaaaaggagaaggtaagaaggatggagacagaaaatgggaaggcaaaagatgtgactactgttgaggtcgagatgcaagaatcaaaatgcagtagggattctcaaacgttaccaggtgatgaagaatctcaagattcatagttagtgttgtgaactgaaatttaggacatgatggtagtataaaatccattttgtgtgtgaggagctatctattctttctttgggtctcatgcttccagttgaatgtcggcttgaaaactgtattagaagtaacacctatgcatggcctgaatgtgcatgcagcttcttgctgaatggcataacgtgcaccattgtaaatttatagtgcctgaatgtgcagtaaacaaatactgaagattggaatcaagtacggttctttttttgcagtatgcgccatctgctactggttcatatagcgtataatactcagtctccacatacttttttaagataatgaaagcttttttgaactcagcgaaaaaattgtgcacacaactatagtgcacataggcaacacatcccaacgaacacaactaagagaacatcaaagagtaagcaagggccatctatccgtaatccgtagcctagattggccacgcactgacatgaaagtcgatgaatctgaccatgagaattatcctgcataatcaggttgtaatgtgacaggaaaatacactcaagaacataagcaaagcgctactgtaatagagaaacggctacaaaattgtattagtaagtgaatgaactgtcataggcgttgagctgcattacacaacattgacaacaacaatgcacatgcaagtagctctgcagcaaatcacgacctcaccttaaaaagttccaaaaaaaaaatcatacacgagtagctacaccgatggacccagaaattctgctcaacgatattctcaagccatagcatcaaaatcgtccaattcaccattatactcctggacctttctcttgatctttgaggagtcaacccaggtgatgaaatcctccatgttcctggttacaagaaaggctggatcggtgactgtctctgggcctacacgcacatgaccctgctgtatgtatgtcacggcctctttaaggtgctccgcgaacttgagcttcaccatgactgttgcaagcctccgcctgcaataatttgccaatacacgcaataagtgatgtacgatatgtctgatctcctacaactttagtcttgtgtgctaatcgaggttatagtgtttgttaagtggttagccatggtaagtctcatttatgttgaagcagtggtacaacaacactttaacatacagctgaccaatgaaacgtgcaatttaacaattgttgaactgagatgagtaaacatttgccactaaatggtaaaagatggctacacagcacatatacatggagagagagagagagagagagaaaggacctgcaaaaggagctcactgaaagtttttcacatgttaacaggctcttttttgttggaattacacccatgttgtacctgaaatttcatgaacttcatcaaactacacatgagtagtacaaaatctggaaatggctagacaactggaaacaagaaaagcatacaaaattaagagtgcacagttctatatgaagtacccaagcataggcaatccattgcagaaagtaacattagattataagttctgcttagcacaagtctatcaatcttttagtccagtccaagctcaaaatgttgggagtaaaaaagaagaggactaccgaggttcgtatccaaacataagagcgagaattattcgaaaaatctttggcaggattatcgaaacaattatgtccctggacaagaagcagatgaactactgagaaactagtcatgtgtatatactttatagcctcgattgcaaatccaatcaatttggtaattcaaaaatagacacaggcacacagcccctcctcaaacacacgaattagttgacatgctataaaattctctgaaacattatatacaggaactgaatttccctgagcaatctcgattctgactctatgacaattcagcaaacagcaaatttgtgtgcctaacgtgtttgatgggtcatgtggaattgtagatcgtaactgtccagctctaaatttgtatgcagaccacgcaacaggctacttacagcttatcgagcaacatgtctgtcatctccgctctgtaagggtctctcgggtccatttgctttataatgttgacgagcttttgcaccatcaggcatatgccattgtacctgccaccacccaaaaacaaaatcacaaatttgcagcaaatccatgtccatggacaggatgaacagtaaaacgcgaaagaacacacagataatcctttaaccaaccgataaggtacgagttgatactctggagagagagatgagttagtacttcttgtagtcgtctctctcgacgaggaggtagcgctgcgtgacgatggcgtcgcggtggcctttctccctcttgaagtcgaggaagttggtcttcttgagtagcttctgctcgtggaacctgagcttcctcatccttcacgctgcaaggcagggccggcgattcagcaagaaccgacggagacgaagattacagggtgcgggcgggaagcagcaggtggacttacctgagcggagaaaccgcaccggcgagctttcgcacgctccagacggtgacggtggccggcgcggcgagcacgcggaagtcggggagaagcaagccggcgcggctctagggttggttgggacttgtgggagcttgtgtgtgttgtggcgtgggctgagtgggccttgtggcccgtgacgttgcgtgccttgtgggccccgtgtgtgagcctgaattttttttttcagttctgttttgctagatttctgtttcttttcctacgtcggtctttttagtggaatcctatgccggttttaatgtgggattagctatacaactttccacagtttttttcaaaccttttaaatataactatatcatacttatttgctttcaatcaaaagcaggatgaaaagtttttttcttaaaatattagcataattatctatattttcaaattttttttgaaattttcttttttttcccaaaaatttcaaaccgtacattatgcaattcgcaacctgtgatcaccccaactatatcatattgcttgtgacaggttagaagctcatggatcaagggtgttttttgtattttaaaaatctctctccaattggataaaaatagtaaagagtgaagtgcacggacggttcttaaaattatgcgggtatgtcatttagattcctaatctatcaaaaaaaatgtcatttagaaaccgctatggcatgtcacgttagtacatagagtgggttggaacccgtttagaattatatgacacccaaaacaagttcggtaccaaaaatacgttttgaaagttgagggatctacataatacatccgtacaagtttagatatcgttcatgtgctttactcaataatagaataatgattatgatattctccatcaaattactagtttttaattttatatggtgtcctctaaccgtgtcaggtttttagatgtccacggataaattatataaattttgagtacattttgataaaatttgccataacaaatacttcatccgtcccgaaatataagggattttacatccacctaaaatcccttatactccctccgttttaaaatgtttgacaccgttgactttttagcacatgtttgaccgttagtcttattctaaaaaaattgtgaaatatgtaaaactatatgtgcatatgaaagtatatttaacaatgaatcaaatgatatgaaaagaataaataattatttaaattttttgaataaaacgaatggtcaaacacgtattaaaaactcaacggtatcaaacattttgaaaggagggagtatttcggacggagggagtaaataaataaatttgacgtcatacaggatttcaccgcccgtaaatccgtatttacccggagaggaacgtcgccgcctgtatgtcctacccccacgtgtccagagccgcacgtgtagcgccgcaggcgtaccggctgccgccccgactcttgcagttttgcatttttgcttcgcgagaacggaacggaacggatcgggcaacggagaagaagaagggaggacgggagaaaggacggggcacaaaaaggcggaggagaaaggactaaaccgcaaaaaagaaaaggccgcaaaggactacggactcggaggcaagcagaagcaggtgatgatggggcaacggcgtgcggctgctggtccacaccgcgccgtcccgggccggggtatcatcacacatgcagcggggcccacggcccacatgcgcgcccctccctccctctcaacctcccctcccccaccaccgaatcgcacccatccatttcagcggcagcggcagcacagtaaaaaataggagtactactggagtacgtagaccaagtgggatgcagatcctctccactccggatccacacatcagtgtttttactaccgtattaacagtactgaagtgaccctctccttctggtctcgttattagtttattgtcaattacaaccaaaatttcaattttaaaatttaactataaagttagtttgaaagttgtcttacaataatctaattttgacattacttttggatcgcacaaatataaattgtatttcatatattatttatattaccatgtttatttttctgtggcttatagctcgaacaatcggagcctacacagtagaatactgaatacacacacactctctctctctctctctccatccccacatacaggagtagctcataactttacgatattttttttcgtccacgtaataattggactggattagccgggggccagtactggataaaacggtttcctccctgattgccgaatttttgcaggctaacctgctgaaaatctagtaatcttaaggagagacggacaaaaataatcatccagagagaggaggaagaacattcgaaaggggaatctttgagaggtgtttgcatactaccactgcataattaacctgatcttctctaggagcaatagtgcaatatacaaagtcgtttactgactaccactaaatgataagctgctctcttcaggttcagtgtttcgcctgttcggtgcaaagtggacggccataccgttatgtgttgagattcgactagaaagtagtagatcaaaatgttttttttttctaaaaaaacagcttttctgaactatggctgttgctaagagcttgacgatatcttcaggcttcagggataatttaagtcgcttaattttcagtcccagagaaaagaacagaaaatagttgactaccgcacacaacattgatagcagtagctaggaatacttaagttgcagtatcaattatcagcccataattccgatcggtagctggtcgatgcatccatgataatgcatacctaaaccattgcaaacagcctagcgacagcttgaacatatattctactccagtactaagcttgcactactcctgctccattcttaattttcccacaaaaggagaagataccgtgtcaaatccttttctaattaagctacctttaattaagccccctaataatccgtacggtccaaatagtaagaagcttcagctcacacagaaatgtagtagtagtagcagcaagtacatacaggaccgtacagtagaaagaaaattaagagacagtgaggctttgtaaagaaagaatgtttcaattcacttgaaatggtggcagaataatcgcagtagtacagttatttacactggcgaattattaagtgaaaataagaagaagaagaagaaagaataaaaatctccggtgctaaataattttcccggatttgacaagggaatggatgactagacttggccgtctcaaaatcctaagactttctcagccatctcacttcaccgccaccgccggccggtcgccgatttctctctctttctcttgctccggcgagtctcagctcctctcaaatggccatggagggagaggggaaaaaagaggacaagaagagaagagaaaaaaaaaatggtggcaagaacggtcgcgcgcatgcacgcacgcgcaatggcgagcggagcggctagctaggggtgggatcacacatcgcattcaccacacggccttgtcggtggcaatgccgcggaggagcgggagggcgtcgccggcggcggcgcagcagcaggagagggcgccgctctggatgtcctcgagggtgacgaaccgcgcggcggaggacggcgaggagaggtgccggaggacgtgctcgaagaggccctcgtcgcaggggagcgcgatggggccacagtaggcgcccgacgggaagccgtactcctcctccgcctgccggagcagctccctgaacaccgggtggttcaggtgcgccgcccgcaccacgaaccgccgcgacgccccgcccacgcacaccgccacgtgccccgccggcaccgcctccgccgccgcgcgcgccgcggcccgggaccgccaccgccgcagcgtctgccggagccagacgatgtagcggatcttgctgcatttggccatcggcgacgacgacgacgacgacgcggtgggggagagagccagagaggtgttcgtccgttggttggctcggctcggctagctgctgttgggtgagttaatggcgtgtgtgggggtgtgagttggtgaaatggaggagctggcttttcgagtgggcggggcgggacgttttataggacgggacagacgaactgggaaaatgtttttgggtcgtccagttggctcgcaaagttttttaatactacggcgagatgtgactttattctcctattttatactcctttcgtccctaaaataaattaatttaatagtgatgtaacacatgatatattactataaagtgaaaactgtatttaatctttttttatcttgggatttttgaatcatcgtttggtatgtataggaaacaaacattggaaaattcatttggattagtagtttgcccatgcatgcatatgttgtctatctatggtagggaagcccatttgtaaggaaaataatttcaattgagttctacggtatgctccattcctccataggtgaaaaaaatgtaagctttcttgttcatttttatcatttccttttttt

SEQ ID NO: 45211 - DNA, 6561 bp, Oryza sativa
ataaatataaacatacctctgtttcgtattcgttgtattataaagtgttatgtttcgttttagatttattttttttttggacggagggattacatactgacgatctggagatagtaccggccagaacgcaaacgcacacgtacgtacgcatcgatcgaccgatcaattcgatcacctcatcatgcatgcatgtcgatcaacatgccaagttagcgatcgagagctagccataatgataagcactgttgaccaaatgagaggacccggccggcagcaacccttgattctgtgcatcagcatagagctctagtggatgaaacagttgcactactgcacagcagcaacatgcagaagacatcaaaattcttaaacctccaagacaagagccggccggccggccgggtcgccttgttggctacagctccacgatgaccatgacactctcccctgcaaatgttgcagcaaattaagatctcggctcgacgacacaaacacgaaacgattgcatatatacatgtattggtccccctctgattagctagcaactaatggacgtctaaccatgccaattaatgggaaattaaggtgcagcattatgtaattaaaacagtacctgtgctgattgattcttagctggcttgggtaataagacgaaccaaatttaaggggaaattaacagatactcctcctagctgtgatatactcatagtggtgtccggccgtttgtatatacggatattagacatagcgcgcgcggcatgcatgcagaggcttgttcctttcatgaaaaagaggtggagtgtcttgtaaggcatgctacatggaagcatcacgatttaaatacatttggcaaagttcttgcatagatcatcaggtctaacctcccaaattgagcatgcccggccggccctgcaggctgcagattgcttaaactgcttggcttagcttgtagcctgcatatatattatctggaactacatgagtactactattcgattagcgtagctggcataacatcttaattaattagagtagtagaaatgtctgaaaaatgcaagcttgtttgcagtcagaattatattttttttcttgcattcggctatgtaacttaatcccttctattaatataacgctaaccaatctgtttggccgttaaaaaaaataacatcttaattgatggactcgaaaaattaatagtactgtaaaaatctagcatgaacaatctatataatataatataatgctgctgccacccccgttgctcagcatgacttttgcatgtttggcgccgatatggatgaatcgtcttgtttactacttgttgcatgcatgtgggctaaggcctctttaggggaccaaatcaataagatgtatacaaagtggccctattgtaatctccgaaagtaagtgggatcccccatctcctagtcctacttcttggaaccttctttaattataatctgctgctagcggatcataaaacaacggaatctatccatcatgtcctgcatagataagggaacatgcacgcatattatcacattcgtcaaagcactctatcatatcatatacacttgtaacttgttgcttcctcattggctatctctagagccatttaattatttatttatatgtgattaatctctcgtttttttaactagttgtgagtctcaaacatgtactgacatcgattaattacagaggtagtacagactctactttagttggagacatgggtgtgtggttttggaaggatgtgtcgtagtagcgttagttgaatgcagttggatgagctagctttactcttcggcttggcaaccgctacctttcgtaccatagtgcacgagctcaacatgaacaatgccattaaaagagcggcggctacttcaaaagatgaaagtgaaagcattatattgttaattaattaggtcatctgattttgagaaatgttaaattcttaatttctccaggatttcctatacttctcatcaagcgtccggcgatgtatactatcttaaactacatatcatactcatatagtttattctgcacttaagatcagaatgcatgatcaatctgcgatttgaaaatatttttcagcagctatatatacatagcatatataggtcatgcgatcctatagcttttttttttttgcggggctatagcttaattagttaggaccactgttgatgtagggaaaaaaagcatgcatgtatgcactggcagattctttcattcacacgtacatatctataaagttttattgcaactcaattgttaaagtgcatactgtattaattctcacgtatgaatttaatgtacagttatatataattcagtaatttgtttaggagctaggagaattaatattctgactgaacttgcatgtatgcagacaaactatacacattcacttcaattaattggactgtgatatttttggtgcatacgttttttatatacagtaattgtttaaatctgtatttatgctcttcggccacatatgacgaactggacatttaaacatgataatgacattagaaggtagggggtatgtttctgacaggaactttaattatgtatcttaacacgtatattttggacattctgagacgtttgtggagataaccaaacttggttttaatgatattttagaagtacttattgtaaacggtgaaatttagaaattttcgttagttaagatcgggtcaaagaaggaattcacgctgtgagtatagaagattcagttaggcaagctgatccagatttggtattaaccttctgcaataggaaatgtgtatcttagtttttttatatatataaatagagtcctgaatcgatgagttgtgttgggatcagacttagggtgtgtttagttcacgctaaaattggaagtttggttgaaattggaacgatgtaacggaaaagttgaaagtttatgtgtgtagaaaagttttgatgtgatgaaaaagttggaaattcgaagaaaaagtttggaactaaactcggccttaggtgagttttctcttttgatcagccgatcaaaagttgtgtcagagtcaaagttgtaatgataatttttttttagagatagagtcctatatcaatccgattgtagtagaatcggacttaaggcatgttcagattgtagctaaaataaaccttaccaagttttggcaatgccaaaattttggcaggatggtaatattgcaaaaattttggcaggatttcttatgtattgaccaaatttggcaataaactaaacgtagacatatttttggtaactttgtcaaaaaaaaatggtatggttgaaaatggcatcaaagtgaacaggcccttagtatagcctatgggcataaatatgtgcacccagggcctttgtaaacaccaacagttcaataatcactttttcgacgcatcgccaccctagtttagcttcaactggttcttgttcgagtttgtgctgcatcgatttcgatctccagcaagaaagtaagccccgtcaacttcacttgtattggttgggctgtactttctcaattaagtctgatatattaatttgatctttgcatgcgttgcctatctaatgtatcagatctatctttgattgttttgctctcatagttagggtattatatcaaatcactttgaattttaccaatcggctagtttaaatctatcaaacttaccattaatcttgaattatcttggttatgtccaatctactaaaattataatttgctagataaatttattcaagtcaataggtttaaacaattgtttcattggagtcttaaccgatgagttatgtgtttattataaattaatttgctacatcgtttgagttacaagatttagcataatcggttaactgctatttttgttatcttcaatcttatactgacggagcgtggggctcctcaccgggagaccgcgcaggcccccctttgccagttcagccgggggcgctaagtgaggttcttcgccctcgatctgaggaacgtcagcgagagaggaaatgcacaagacacgggcgatgtagacaggtccgggccgctgagaagcgtaacaccctactcctgtgttctggtggatctatgcgtgaaggaatacagagagccggagagcgagagagagttcaggctctagaacccattccccagagtcccagtccccttctcccctctcctcccttttttctcctaggcctgggcctcctttttatctggtcaggggtcaccacatgggcctctagctgcctaagaagggaaacatgctttttacaatgagggctagtctacagccggaagtgacctctgacaagcagagcacacgtctcctgccccgctcgcctgctttcccggtggacgcccatttcaaccttcatttaatggccagcgacttccttaccatacttgcgctgaagcctggaatggatttgaccgggactgacataccaactccaggagttagcacgccggctccggctagggacgagagctaggaagctctcatcattccgacgggacggggcgaggcgtgtgacaggccgcctattgccacctaaccagcgatctgaccggtctgtgaccggtcacacaccgcgaccggtcacggaccggataagcgtgcgctgcgccgcattaaatgcggcgtggtgcactcgtccaacctgctataaatgcggttaggtgagccccgctgtgctcacctaacccacacacgtggcgccaaaaccacagggggtcggggcgccccagccctcggggccgaaacgggagcggcccgacccctcggggagacagagggaggggtggccacgtcaccttcgggcccgacccccccgagggggtcaggccacgtgggtgaccgcggctacccaagcctctagtcacgatacccccggccccatgtcaccgacatatactgtctcgatttgatccgatctatcaagattgtggttaataatcataggttgttaatgattatactttaacttgttatagctgatgttgtttttttctttactttgcgaatgatgataagcttcaattaatattttagtgcattggcctacatctaggaatatatataattgttaagttgatatctttactactttcaatcttatattgtctcagtttgatttgatctatcaagattggttataataaagttagaagattttgcaaatatatattatgtagattttggtcgatgtcactttgatcctaaatatttatatccatcggttacagccaatcgatccaaaatttcatcggcatcggatgggcacacgatacaatatcggccctatgaccaattgactccacaatctaatcttttcgttgtctatcttgttaattctaagatcaaactaactggcatgccctgaacccgattgataggacttgcactagatctaaacaaatctcttatgcctttgtgtatgtgacgaattttacatcaacacttatcaattcaacttcctaatgaaatttaaaattttgacaattagtccaattttatgaattatataggagtatttaaatttgccatctactccctccgtcccaaaatgtaaacatttttagaatagtgtcaagtcaaactttttaaattttgactattaatagcgataaattaagaaatattaatcatgtaaacttgatgttactatatttatcattaaacgaactatcataatatgcaactctttttatttaaaatattttacttttgtagatattgtcttggagaccgtgtcgagatccaaaaatacttacattttgggacggagggagtactatataatactctctaaaggtttcttggatgtttatgctcgatttgtaagctagaacccatgccaccacctatatatatattcatgtcaatgtatagctagcctatttgaaaattaatgaaatgcataaagtccaaagaaataaaatctattagtgttactttgtaaggcaagaattttacaggatttcacataattaaatcggttcaattcctgcaaaacttctcaaagaaaatcatccattccaaacacatgggaatatgagaaaaaatgccacacctttttgaacggagttctctttatttaattaatttacaattaatggaatgtctttaatttctccaactaattagtagtatataaaaaaaaatgacacacgagttacctgtatgtggtcgatttgtcaattcgttataattaaaaacaattgctacatataaacccgacagctctaagaacatgatccatgcattggtggcccatggttaggaaatgccggagatcaggcgcagcatggatatatcattagaggttgggcagagtatttatctcgttgtttaagcatcattattgggctcgaaccaatctgatgaaaatttggtagctttctagtgacagcattatgagcataaccactacaaaattaattaagaacgccaaggacatgtacttataaaatttttacattagctgcaggcactaacaatattaataagccaacaattgatgattggtgtgaatatgctcatatg

SEQ ID NO: 45212 - DNA, 1471 bp, Oryza sativa
  unsure (1)..(1471): unsure at all n locations
nnnnnnnnnnnnnnnnnnnnnnnnnnnnnnnnnnnnnnnnnnnnnnnnnnnnnnnnnnnnnnnnnnnnnnnaagcggctgcttaatgttgagcaactgaacaagcaaggcgatttcctcgcaatccgttgccagaaacaacttcaggactttttctgtcagcttaccggcagctatagttctctgccaacaaagatgccttcagagattaacaaaatataatagcaaaactattactttcagtttgatctatcataataataaaaaaaaaagtgactcaggatccccaactacgagtctaaaccccagctcatggccaaatgttcataaacccccatccatcctctcagcaaaattgacaggttcaacgtagcatcatcagaccacttggtaatcaaacatgggccgcattgggcacctcgtgtgatatgatctaaatctaaacacaaaacaggtggtgcaaatcacctcttcccatttcccaatccgataagttccactaattgcgcgcacgatgtaccacatatataacctagtctcattaatctcatcaatctaagcagccaattgccacagatcagccaaaccaaccaacataaacaataataggaaataccacaacacaacactgcatccgagcatcgggacgagaggggcaaaggggggatcaatcgagcgagcgatggtgtgggggtacctacacggaagaggtcgatgaggaggtggtcggggaggcgggagaggtcgtggaggtgggcgatgcggaggagcgcggagtcgagggtgagggagagcagggagggggggcgcatcggcgccagatctggatctcgcgccccctcttttataatccccacgcttccgttgcaagcaaagcgcgcgccacgttgcgcccgctgcctcgatcctcctcctcctcgcttccgctctccctcttccgcttgccggcaatcgaggaggaaacggatcggcgactttttttttttccttcccttgtcctttttggcccccccaactcttgtggaatttttccaccgtcctccacttcctgtaaccgtacgagcgctgggtcgcgggctgcgtgggcgtggtcaccgacagacagcccacagacggcccagcgtgatggattgatggatggggcctaggatgatctcaccaggccgtcccgcgtcgatgggtccgtgtcatgtctgcattcttcgcctactatagaaaatgggaatactataatactaaaaaaatctagataaaagttatagtattagtatgtgctatattataatttatttattttaggactagttataataactattttttcgttcaaaaataaataaacttatgataagaatatagatatataactattcagcattttattttatgtttgtttgttttagaacggaagaaatgttaccttgacagttgctattcggattggtcatttgaattacccattatctgctggg

SEQ ID NO: 45213 - DNA, 10072 bp, Oryza sativa
  unsure (1)..(10072): unsure at all n locations
nnnnnnnnnnnnnnnnnnnnnnnnnnnnnnnnnnnnnnnnnnnnnnnnnnnnnnnnnnnnntcactttgaaacatcagactcttttctcaggtatatgaacaatcttgattatgttggctcttatttatcaatgaactttcacacatgtatacgtaagactatttctttggtttataataagttgaatgtagatgaataaaaaagttaaatatggtctagagtacttaaaaaaaataaaaaaatctgattcaaagtactattaagaaaagatggtttaaagcgaaataacctaaagtaaaatttacttaaaagtattggtaaacccagaaaagtttggaaagacggcgcagcgcaagcaggcccgcgtgcgtgcccaagagtacaggcccggtccacggaggccggaacagaaggaaagcncancngtngtnttntngcnncnncngnnngntcccccccccccccccccccctccttccagccaggctgccgcccgtccgtccgcccccgcgcaccacgcggcgtctcgtcctcctctcatcggaccaccaaatttgcagctcgcctccacctccacctccacctccacctcctccgcctccgcctccgcctccaaaccctagcgcctcgccgcccaccgacccccgcgcttctcctccatccatgcgcccccgtctcgtcgccgccgccgccgccgccgatcatggctgcctctagggtttcccgggcccagccatggtgatctcatccccgccaacgaaccactcttctgcatcggtaagtccccgttggccccccacccccgcccacctctcgctcgcttctatgacctcgaggggattcgatctcctcgcccctcgctcgcggatgcgcggagcccaatcgcgttgctaaatccgaacctctaatgtgagtgtctctccagctttgtacgattcgcccgagcctggatcccgccttcattgacgcgcccgctgtccgggaacaccatgatgtcgaggtcagctccgcagctcaaaatctactgagcttattggtgcttaatttggtgcaatgtagaagtgtaaatggttttcctgttgcttccaggtttatgcaaatagggaagagcagaaaactagttcatgatgtattggttaactcgaaacccaatagtttcactgcacataacattggatccaactttgcgttcggtttggcacatacaggcagggcctgtttgcacgggaaggttccgcatggaccgggcacgtcatccatgcttggaagagcaaaggagagtttataccggaatccagctgcaagaaacttttcagttctctcaacatgtagccagaatgcatttcatggtcaacttgcttggaagcaactcatgacaatcggttctcatgtaccaaaggcatctccgattttaagtagggttgcttgtgccattagcttggctgccactagatctaatttagttccttacctctttgctttcgttgctggggagataatgctagctcagaagaccagtgcagacggagagtacttaccaattcgtgatagtctttacacgcgtgctcaagatggtcgtatctatgtcacctccttgatattttcagcagtagagctggtcatcataatcttcagatcaatatatttggcattgttgttcactccaagtatactcatggccccatttgcagatactcttggcagtaagtacaggaaaacatggctccgtcttgtgcatcgtaccctggagaaagcaggtcctgcatttattaaatggggccaatgggctgctactcgccctgatttatttgaaagtgacctctgtgctgaattgtcaaaactacacacaaaagcacctgctcacagctttgcttataccaagaagactgttgagaaagcttttggtcgaaagctatctgatctttttgagaattttgaagaagagcctgttgcttctggaagtgttgctcaagtgcaccgagctggtttgagattccggtatcctggccagcatataaagcgtgtaacagttgctgtaaaagtaagacatcctggcgtaggagaatcaatacggagggatttcactatcattaatgcagtagctaaaatttctagatatattcctacattgaattggttgcggctggatgagagtgtgcaacagtttgctgtctttatgatgtctcaagttgaccttgcaagggaagctgctcatttgagccggtttatctacaacttccgaaggtggaaggatgtgtcttttccaaaacctctttacccacttgttcatcctgctgtattggttgaaacttatgagcaaggtgagagtgttgcacactatgtcgatgacctcgatggacatgatcgaattaaaagcgcccttgcacatattggcactcatgctctcctgaaaatgcttctggtaatgctttcagccatctcttagaattgtcattattgttttgcgtttggagatgagagcatgtatttcatttgagtgaaacaatgaaatgttatagcatacccttttgatgaatgatgactcttgtgtcttatggtctatttctgggttactgtttatgctgtgagcccgtgagttcaattgagcattgttgcatttaacctctaaattgaactgcctgtttataaaagttcagtgcttgtttagaaacatctctggttcatattgatataggttagcaaagacattcagcacaactgtcacttcacttctctagacaaaactaatccaaatatatctttacacaagtttgaaaccaaggatttgaaaatatgcaaaatgtgacatattttggaaagataaagggtttcaatattttgttttatgcatataatatcactttagctccttcgttcttagtttcttacagaactattgtgtatgcaattcaacacaatattaaaagatcattatttttattattattttggtccaaattgatgaacctcactggaccttgaccatctctctttagtacattctatttgctagttacacataggcacttaacattttagggcttttaattatggttagttttcaccacgttgcagcattgttaacatccaccttttgcaggttgataactttgttcatgcggatatgcaccctggaaatattttggtccgtgttatacaaccaaggaattcaaataacacccttttgaagtctaggccacatgtagtattccttgatgtaggaatgactgctgaactttcaagtaatgatcgtgtgaatttactggaatttttcaaggctgttgcacgccgagatggtcgtacagctgcagaacgtacactgaggttatcaaaacagcaaaactgcccaaatccaaaagccttcattgaggtaattattatttcttgtcactggtctgtttcttggcagtaacacctctgcttttccttgttgaggtcctcggtgcaccctttagtcaagataattatattgctgctataataggtggtatatgcatctttaagatatgaattgatggcaagatgtatttgggcactgtaccttgctggaaagcacctgggatgtttaaattttgagtaaatttcataaaaccccatctatatggtccaagatgcagaaaactatagtgcttttgacaagtggcacataacctcgtgtaggtactaaagtttcacaaaaccacaccgttaaccattttggcatactcctatatcaaaattttaaaaaccggatataacagttatacgatggattaaaaaactcataaatttgagatgtgattgtataaccccatcaagtgtggttttgtgaaactttaggaccataatacctggggttacatgccacgtgccaaaatcactgtggttttgtgcaacttggacaatattatgtgggattttatgaaatttactcttaaatcttaggtgttctctttactctcttgttgacaaattgcgccactacattaaattgaattgttataatacctgatattaattaatttgctgatgcattatgggtttgtgcttatatttaatgtgagtcctgtgagtttttggtcaactatttggtggtttgatactaacatgaaatatagttaccttatatttggtgttagtaaagtatacattttagatgcatgcatttctaggtccaaactttcggtgcacttgaatatttgcctcaactcatcaacatgaactaatctatcacaagttcacaatgtcacattttatgtaaatgcatttagctacaaattaattaaaacaatgttgtgttggtacaatgcctttttatatatttgatagttacaaattacgacaagtcctacatgtcttgtttttgtcaacaggaagttgaacggtcgttttccttttggggaacctctgaaggtgatgctgtccacccagctgagtgtatgcaccagttgcttgagcaagtacggcgccataaagtaaacattgatgggaacgtttgtactgttatggtcactacattagttcttgaggtatgcttcaactgcttgtctcatgctccagtcagtcacttattatggtgtaacttaggccctgtttgtttcaacttaagattattgtaatctagattattgaaccagattactataagctggattataataagccggcatagaataagctgttagctgtttgtttctctggattattagttgttagccgcccaataatctaaaaaagcacctttagagtggattaccagattatagtaatctggtttatagattgtaatacagtattatctatcataataagttatatgtttgtttcagcttactcctaataatccagattataataatcctaagctgaatcaaacagggccttagatgtctctgtcatatgtccaatagatcacgatgagctgtttctcaagattatagtatgtgctgtattgccaacgagaaaggtatatggagatgtatttaggacctaggagttaggagaactcgacccctagaattcagtcacaacgttttctaatggcatagtcagatgactgaacatgcactccctagatgtcacaatatgacaaaagacttcaggggtattaggtttatgcatatttgtaccctgaccttagaccttgatggaaatgcatgaatatgagaattttcatcttcattgaatggtctcaagagcttcggattcgttgataatgcctactagttgcctaaggataaaagtgtcttgacatagtaggtcacagttaaagtgattctttgttggttgcagaattgttttcaaaaaaagtagtgggaaaaggtgctttatagcagaacatctttagcaacatatttaaaactggagaaatggtgtaaataaccaaactaccatagcggaacctcatgaaatatcatatatatgactcttatagcttacttttagtcagtgttctggaaatctggctctgtaattcaaagtacatgtgcctctgtactgctttgtgttcctacctatttctgcttctgcgttagtttccttttgttaaaagggaaataattgtcatgaacttttgtttctttctcattctctcatactatctatagcctattgcttattgctccattacagatccttgagtttgttttttattttacagggctggcagcgcaagttggatccagattacaatgttatgaaaacattacaaactttactttttaaggaagactgggccaagtctcttcagtacacaatcgaagggcttatggcaccttagggatgcattggaatccactaaaaaattttgaccccttttttgcgcagttgatgagatattggaggatgctccttcgcaccagtacatctagtttctttttcctgtttacttttaaattccacagttttgtacccatcttggccagtgctgcttaaacggccatgtctaattaataattgcagcattttttcaagctaccagagaagtgtgctctggacccacaataccctgggattatctgcttatgcactctgcaggccaaaggatgcgttctcctccatgaaatttctgttaatagctcttagaagatgtagcaaaaggccttcgctgatgatctttttgtaactcgagaggtgtcagtgaacaagaggttttttattgtatacacagatacagctaactgttccaaaaaaaacctacgtcatgcctgacaaaattcatggattgcccatataactgagtgctttcgcatttgtttggaatgcagaagacttaactgtacaaatgtttgctggtaagcaggcatagagtttatttccaggttgcttctgcgtttcaaattcctgtcttatgttgatacaaaatactagccaaattcctccttttatacgtccgcggcaatttacaagttgaatacttgaatgcaatgcccattcttgttcttttttctttgctggtcctttgcaggtatagtgattagtgaacctggagttctatttctttctctttttttttgaaaaaaggttttctgttgggacttctcttgtagtaaaaaaaaaaaactgtgccatatatggaattcagggtctacctttctgttgggtgctctgatcctggtaacttagcggtagctcggttttcatgaaaaccaacaatttttaaacatttcttttaaaaaacataaatttgaatccaaattctcaggttcagttgatcacatgacaaaaactggtcggtttcactgaaatgttgattgggaataacaaaatttcgctacacgaactagaatcaaatcgatctatgtccaagaaaaacacccggttttgttgaaaagctgaagattactgcagaattaattttgttttatgaaaatgggggaatagggaaaattaaggaaatgtgtaggaaatgagagaacttatataaaaatgctgacatgagctttcctacattgtagttctctccattgagaaacacacgattgcaatacactctcatgaaaacaattttaaagcacaggcaattgataattcaatatgcatcaccaaacataggccaaatccggctgtggtcgctcggtttctgtgtggtcccggatggaaatcgacacccggcgagcagcaaactaccgcagtggtagggaacgatcactgtatccggcggaggaacgtcgttgccgcccgaatcctttcatctttttcctaaaatgggctggttgaccctatttgtcattgccttttggcccatgaaggtcattttccttttaatatatactacttttctattattgtgtgccgttaaaagaacacacgaaaattcatatttttttaaagcatgccattaatgagttatatgaatatcatagtacttttaggaattttaaaatcgctttcatttttcttcagatcaaatttgaattggaccgaaatgcatcgaattttccaatggaatattcttccgagctaggttcaggatgtctggttttcgtgaaaaccaaccgaattttatctaaaaggtaaaccatgatggaattttcttatcttcgagacatctgttggtaacctactcttagttggtgctttctgccatattactgcagatgacgaaaagtagtggccatatacttcggacatgttaacaaaagagtttttttttttttgtctcttgaaaccgaaggcagacttgctggtattatattaagtaggaaaaggccctgtttagtttcaaagtttttttttctaaacctccaacttttcatcacatcaaacatttcatacacacacaacttttctatcacatcgtaccaatttcaaacaaagtttcaaacttcagtgtgaactaaacacaaccaaagagtatatttatatatttttcccaactgtgaaaagaagaaaggaagaaaaataacaaagatacattcatatcttcacagaggtacgagatagggactaaggcaacattcaacgaaagagttttcattttttacctacaaggtgactaggtgagacttgactctttttgagtcttgagacgactggttgaagaacatcactattttttttcaagatacgaacagggtactgagtttctgataaaacctgacctgtgtggctgtggccggagtagctgtctacccgtgcacattaacaccgatggcacaagccgagcgcgggagcaggggcgatcacccatcgatccttaaccacgatgtgcccctctcatccgttgaccaattctgcgtcacaagcaggatggccaaggatcatgtcaaaccctatcccgaatcattgcgcccaacccaaaggatcgagcagagaattaagcggcgcgcaaatgtgtgatcccggcgagtttgatcggttgaacatgcgagaagttccgggttgctttccccgtttctgtcgtatcaaatcggagaacttttcggaccagctagcttgaccaggtacgtacgcatacccgatcaatgcccgtatctgtatgtattccagacgagcacacacaggaaacggaagaatacggtgtcttaattgctgtgctgtctgacgtatacggcggcagggtaggcgtagtactagtagtaggacctggagcttgaaggagggtcaaagaggaggacaaaatcggagacatggattgggcccgtgtattgtatatagggcccggttagtttccaaatttttttcccaaaaacatcacatcgaatctttaggtacatgcataaagcattaaatatagataaaaagaaaaactaattgtacagttatggggaaaatcgcgagacgaatcttctaagcctaattagtccgtgattagccataagtgctaccgtacccacatgtgctaatgacggcttaattagtctcaaaagattcgtcacgcggtttccagacgagttttgaaattagtttttttattcgtgtccgaaaactccttctaacatctgttcaaacgttcgatgtgacatccaaaaattttctttttcccaactaaacacacccatggcccgttggtggcgggtcgcggtaggaggcaacaaggcagcaaacgcacgcacacgcacgcacgcacgatcgcacgagcagctgctgcggctagcgatcgatcggtcatccatccatccatcggtcgctcttcggcccacgcccccttgcctctcgttatcccgcgcacgcgtacgtacgtccatcggtaggcgcggccggccgcgcgcgcgaggcccccacccatgtgcagatgcgcgtctccagctcggccgccgccacgtccgtccgcgccgcgcgaatcgcccgcccctttttttcccctgttccccagcagaaacgcccgcgcgcgcggcaagcaatcatcacgagttggggtttactcccgtggaacgatcgatcgacgacgcatcatcgatcatacgtacgtcgtcccgatcgaccttgtactagttaaaaagcctcgcctcgcggctcaaaaggaggatcgatttggttattatcattagctaacttgtacgatagacgacgtcaccagatctgctgggaaagctagcattagcccccgttccaatcgcgcctcgaccggtacgtacagtgcaaccaccgtacgtgaggtcgatcgcctgcagggcgtacgcacgatggtgcgtccgtttgattagagcatgatatttgattagcaccgaataaaaagaacaagaaatctgattagcagcagctcgatcggcttcatgaattgagtaccggccccggtcatgcgtatctccctgcacgtacgcgtggctccaccaccgtattgattaatctctgcacatacggaattattattgtgccacatatggcggccgcccggccggttttgcatgcacgcactgccgtggcccgtgtgcacgatatatccattcgtgagggggccggataatggaacagtagcacagtacgctagtagtactcgagtagtagtcggctagcgtgcggttgggcgaggagagtgagcgcagtaatgatgggcgggcgggcgggcgaggcaggcggcagtgcggccccgcatgcacgccgggattgtgctcgggcggggttggggttgggggtgttgtatggatggat

SEQ ID NO: 45214 - DNA, 1184 bp, Oryza sativa
  unsure (1)..(1184): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaattaaaccacaactatagctacatacataatcaaatcatcgttacactactagcgtagaacgtctcgccgattatagagccactcatgcacgacagtatacccgcgtgccgtgctgtgtacgcgcgatccccgcggtgagtcgtgattgatataggcatatcgtggcgccatacgggccgtagcccgtaggcgaaccaccgccccgcacggctcacctgctcacctggtttgtcatatgagcccatgaccaataatttcaccgcacgcacgcccgccccgcgcgtccgaggagaaaacggtggcggtcacgctggattgaaggtttttccttctagttttaaaccttttcttttctgctgcaacatcatatcaacggagcggcctctattccgcattactcttctactgttagcggcagttgaacaaattaaagaaccaatcatgaacgattgcacgagcgggtaatcttgatccactcgtcagatgtcgtactttcgtgctaactggttcctgctccagccagcagcaagcgactactcactccgtctcatgaaaaaccaacctataactaaatgtgacacatcctattttataaatataaacatacctctgtttcgtattcgttgtattataaagtgttatgtttcgttttagatttattttttttttggacggagggattacatactgacgatctggagatagtaccggccagaacgcaaacgcacacgtacgtacgcatcgatcgaccgatcaattcgatcacctcatcatgcatgcatgtcgatcaacatgccaagttagcgatcgagagctagccataatgataagcactgttgaccaaatgagaggacccggccggcagcaacccttgattctgtgcatcagcatagagctctagtggggg

SEQ ID NO: 45215 - DNA, 704 bp, Oryza sativa
acatggttcttgtgggaataactatttctgtgaaattaaaccattcaaaacaggccttcaagttatatgtcataaagtacacaaaaaaacaagctaatataatcagtttagttcagttactaaatgctagcaagccagtaggagaatatatgtatcacgaactggagatttaattttaaaactagcacgagtatgaaaacttacgctccgtgcttccaaacaagtaaactgttttcccataaagctcccctccttcttctagtgctttctgctcaccaacaggaaaccttatgtcatgctgaaagcaagtgtgataataaaaaaagagtagtattggaatactatctgcccatcgtacctccaaattttcaaagttccagttgaactcctttatcttatcaatgttttcccactgcagatgagaggcccggatatggataatagttagcggagcaaatatccatagtacacagttgaaagtatgtcaaaacatgcatcactaattgactcagccataaataaaaaagaaagaaatagataggcccatagaaagtaacaaacctcggtcccaaccggaaatgctgatagccaaagatcctcctgaacacagtaacacaatattagccataaaactataagtaatcattttgcctgtttgcaaagacaaactgattatgctcaaacgttccttttatatccatcaa

SEQ ID NO: 45216 - DNA, 1066 bp, Oryza sativa
gcatttggagttggtaatgtgacagaagcattccctgtggatgcaaacactccttttaatgtcacagaaagatcaaagaaagtaagttttgttcttctcttccttttttcttccacccttatttttgagattcctgcgtgtgtctgctcatgtgcctaagtactttgactgattcccgcgctctattatggccagcctccagtgcctaactggcttcgcgaagaacttttgaagaagaaatctacatcagtgagtgcttcggtgcaacactcaacagagttccactccaagggatctgaagatgctgaaaaaacacttaaaagttctgatcaggctgacagcagaagcgtagattcagctaaatctactgatgatgatgaagaagatgaggtgcagtttgctattctattactaaaaactacttatatgacttcattttggtcacaagataattcactaatttgttaaaaaaaaaagattcatggccttttggagcatatagaaatgttggggccatatgctagctactgagaagctatttgcacttacagcaactccattttaaaggaaagctacctttagttcttttttaggtggataattagacaacgtatttgaacaatgtgctggttttatccccttctattttcttttatctattttatagtctagtatagccgcctttatttgtaataattttactggactaaaattatttgcaggacgaaattgaagcagcccggatggcagcaatgaaccaggaaattaagcgtgtattaactgaagttctcttaaaggtcttgtttttaacatggaactggaagttactttgctaggtctgacaaggtcctgtcatttctttagtttttgatcctcttgtcactttccaggttactgatgatctttttgatgagatcgcgacaaaagtattgaatgaagatgatccatcagctgaacgtgagtgatgtgctaaattgtaaatttaaatagacattctgcatttctgataatttcttctacattgtagcaaatgagcccactagagtttctagtgtgaaggggcctg

SEQ ID NO: 45217 - DNA, 757 bp, Oryza sativa
  unsure (1)..(757): unsure at all n locations
actgctttgtgttcctacctatttctgcttctgcgttagtttccttttgttaaaagggaaataattgtcatgaacttttgtttctttctcattctctcatactatctatagcctattgcttattgctccattacagatccttgagtttgttttttattttacagggctggcagcgcaagttggatccagattacaatgttatgaaaacattacaaactttactttttaaggaagactgggccaagtctcttcagtacacaatcgaagggcttatggcaccttagggatgcattggaatccactaaaaaattttgaccccttttttgcgcagttgatgagatattggaggatgctccttcgcaccagtacatctagtttctttttcctgtttacttttaaattccacagttttgtacccatcttggccagtgctgcttaaacggccatgtctaattaataattgcagcattttttcaagctaccagagaagtgtgctctggacccacaataccctgggattatctgcttatgcactctgcaggccaaaggatgcgttctcctccatgaaatttctgttaatagctcttagaagatgtagcaaaaggccttcgctgatgatctttttgtaactcgagaggtgtcagtgaacaagaggttttttattgtatacacagatacagctaactgttccaaaaaaaacctacgtnnnnnnnnnnnnnnnnnnnnnnnnnnnnnnnnnnnnnnnnnnnnnnnnnnn

SEQ ID NO: 45218 - DNA, 1140 bp, Oryza sativa
  unsure (1)..(1140): unsure at all n locations
nnnnnnnnnnnnnnnnnnnnnnnnnnnnnnnnnnnnnnnnnnnnnnnnnnnnnnncaacaaaataatgcgttttattttaaaggaagcaacgaaataacatgttgtgttgaaattgtagccatagaactagtttgagattctgtctccctgatgctaacacagccttagccagaaacttagcttcaggtttgagccacagcccacagaatagctgatataagagttatacgttatcctgaataggctgactctttgtttgcttcaggtttgagccacagcccacagaatacgttatatgtgagctagatgttcatcgatctctttgtttcataattcatctgaatccgttccgcaaactccatgtttccatctgttccctacacatagtaactgaaatgcacggacatgttgtttgtcgatatctcccaccgttaaggatattgtgaacatctgaaatctgatttatgcatttttattgttatgtatgccctctgtaatattagttctctttgttccaggaagcatatttgggataactactgtctgacacatcaaaatgagaagttgatagatgacaattccgtgctttcgtctaatggcatttgtaataactccaaggtagttcttttattgaagaataccagagtatatccgctttaattaaccataatgttcgtcaattttctgttaaatgtttttaatcacatatgcttgttgggagttatatcctttattttctgtttctcttttctttttgcattctagtacaaaatttgagcgcctgtcttatttgatgatatgacacagtttaacctacatggcacacatctgtttgaggatattacttactagtaatacttattatattacttacaaagtgtgcacagttgaggatactgcacacatctgtttgacttcatctctatgttctgtcaatctaggtttatttctcgccgcacgttatgtccagggtatatcgaaagcactcaagaagaagaaaacaccgctttttccatggtcttcataggaaaatgtgatcccatcttgtttatttgagctggtgttggggagcagcatggtcacatcacagacaaagaggtggccaaccttcagttctattgacatgagggaagcatgta

SEQ ID NO: 45219 - DNA, 974 bp, Oryza sativa
  unsure (1)..(974): unsure at all n locations
acaccacccctccccgccacctcctctcctccccctccacccacctgctgccgctgctgctgctgcatgtgatccatggaaacggatgccaagtgaaaccaagaagaagaagtagaagatcaagaagaggatcaagatcaagatgaagaggaagaaagggcttgtggccttggactgggtggaggagggacatgagggtttataaggaggagagaaggatggagtgaaggtagctagggaaggggagctatggaaggtagggggggtgatataggttggggcgctctgagggagaatcatggatatcttttggagatggacaagtgaagttgacacacgaggtaggagaaggaagagaggcatgtggggactacgcaagggggcgtactaccatgcaggcgcctccttatggcaatcgcttcttcctcctctcctctcctctccgatccttagctaagctgcaagccttctctctcatcatacacagagagagagagagagagagcatgcatgttgatgctttcattgagctgtatttggaggcaaccatggtggtggcatggtttgtggttgtgatgtgagagttggtaccatgttgcttcttcaaacttgcctgtgttttcagttctctgtgaataatgttacgttatgagaggtgtgtgtcgatcagattgacagggaaaataatccagttcgtccggtgctttatagctgtgtttagatccaagggtaaaatttgttaccgtgtcacatcgaaaatcggatatacgaatacacatttaaagtattaaacatagtctaataacaaaaaaaattacggaatccatcagtaaccgtagatgaacgattaagcctaattaatccgtcattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45220 - DNA, 875 bp, Oryza sativa
gggttatgttaattgctgctgctattcagcacaagtgcaaggtagttgacttgggtattgcaaaagatactgaggaaagtcttaaggagcatatggatgcagctctaagttctgatgctgatatcattcttacttctggtggtgtttccatgggcgatagggatcttgtcaaaccttgtttggcaagcatggggaaaattcactttgaaaaggtatcttggaaattcctccaaaattaggcgtgcaccatgcagttgtatggaagtacaaaccaggagttatgatatgcttttcttgtttccagctggataaccaattaaaacagttattgatggaaaattcttttagtctttggcactaatatatttgtacaattccagtaattctaacagtttgctgtgtttgcatgtacagattcggatgaaaccagggaaaccattaacatttgctgagatcgtaacagaagattcatcaaaaccatctaaaaaggttcttgcatttgggttgcctggaaacccagtgagttgtgttgtttgcttcaatctctttgttgttcctgcaatacgttcactctctggctggtcaaatcctcatctaccaaggtagttattgtcatgcataagtggttagcattgttattaagttctttattcccattatatatcattgagcatattgtcttcactgacatgactttctacagagtgcacgcacgtctactgcatcctttaagaggagacccacatcgtcaagagttccatcgtgcagtgatcagatgggtgcctgatgatggatctggtagacctgggtaagagctatattttaatatgatgccttatatttggcaatactgtaggtgataccggctgatgaaa

SEQ ID NO: 45221 - DNA, 836 bp, Oryza sativa
tggctcacgcttctcgcaactctagagagcagttgagggctcatggaggattggatgtgtacttgaacttattggaggatgatgcatgggcgtgtactgcgttagattcaattgctgtttgcttgtcccatgacaatgatcacagaaaagtggaacaagccttgttgaagaaagatgccattcagaaattagtgaagttttttcaagactgccctgaacaatattttgttcatatattggatgcttttttgaagataatcacgtaagaccaaagagttaccttcctttttgatgacattatataatatgaacatgacaggatacagaatattgagacatgcaattgcattgacttgactacaggaaatcttctcggataaatacagcaatggctaccaatggtttactgacactgcttattgcaaggcttgaccaccgagaagctattgcccgtttgacactgctaaaattaataaaggtttgcattcctcgctttaaatttctggttacatggttttaatatatcaaccttctactagcagtgatcaaataagtctagaatttcattttactcaatatcaacgatatgtttaatgtacctttgtaaagtttgaactccatgatttaacgttcgattgtttggaattgctttcaggttgtctatgagcatcatcctcgaccaaagcagctcatagttgagaatgatcttcctcaaaagctacaaaacctgatcgaagaacgaagggatgggcaacgtggcggtcaacaggtattggtgaaacaaatggccacctcgttgttgaaagcactgcacatcaatacagtactgtgatttg

SEQ ID NO: 45222 - DNA, 1337 bp, Oryza sativa
  unsure (1)..(1337): unsure at all n locations
nnnnnnnnnnnnnnnnnnnnnnnnnnnnnnnnnnnnnnnnnnnnnnnnnnnnnnnnnnnnnnnnnnncgaggtcggcgcagccggcggcggctgccccggagatgacgccatggacgagcggcgcggcgagcatcgaggagagcaggcggatggagttctcgaggcggcaagcctcgtccccaccgcaatcgccgccgctcacgaccaccgccccgtcgctccccaccgccgtcgtcccgaccgctccccgtcgccaccaccaccggctccgccgccgccgctccccaccacctcgtcccgaccaccgccgctgccacttcgtgccacccccgccgccgcgctagccagtcgtcggcgactccgacccccccaccggggcggctcccctctcgtacccctccctccctcccgacggccgcgggctatagccgtcacctccaccgtgcgttccccaccgtcactgccgccaccgccgccgctcctgaagtgagagagataagggagggagagagagggaggatgacatgtgggtcccacatgaatagtgggtcccacttttttttaatgacatatgggtcctacatattttttatttttgtttttattctaatgccacgtaagcgccacgtaggacaaaaactcggtcaagactgccacgtgggcgccacgtcagccaaaaccactgagggacattgtttgcaccgtttttgatagttggaggagtcgatatacccggttttatggtttgaggttatgaatcatactcggacgatagttgagggagtcaaagtatactttttcctatctaaaaatgttgagtaagacttcgggcctattcagattgatggcattttcaaccataccattatttagtaaaattgataattatgtggctatgtttagtttgttaccaaatattggtaatgcatatagaattttggcaacattattaagccaatcctacaaaaaatttggcaatgttgccaattcgccaaaatttggtaaggttcattttagcatcaatccgaatagccacttcatatctacaccattagcagtttaaaagccaatagccaatgctaaaagtgcactatgataaaaagaaccaaaatcaaatcaaaaattaacttttgaaatctaaattttgctaatgagacatggaagcaccaatagatattgaaagaaaaactattgatcggtattattgctgtagttatttgttcctttcgtcgatgaaagtacaaccacccattttccacactttttcatattgacttaagtcaccgaattactcgcggcgnnnnnnnnnnnnnnnnnnnnnnnnnnnnnnnnnnnn

SEQ ID NO: 45223 - DNA, 3089 bp, Oryza sativa
  unsure (1)..(3089): unsure at all n locations
nnnnnnnnnnnnnnnnnnnnnnnnnnnnnnnnnnnnnnnnnnnnnnnnnnnnnnnnnnnnnnnnnatgggcgcacatacgagtcacagatgacacacttgccatcacatttctcgcacaaacgaccaatagcaatgccaggctgcttcctgcacatgatgagatcaggatgatgctttgccatggctgtcgaatgctaacctgtggaaccatagcagaatgcaaatatatatcagaaacaagcaatgctggtccatcactaacagaaaaaacaagcagaaaaaaaaatccatttgtatactattcagctgttggtcgaacaactctatgatctttgggcatagtatgtgtaagagaagcaatgctgattacagactttccagtgaagaacttaacaggcacatcaacagaacaatttctaaaacaataaatactcatggttgaacaaatgggttactaactgaaagaaactgctagatataggaccactccgttttgttagaccttaaaatatagttaaccatactgtcaccaggtcattccatcgactctagtgctgcaatatgcaaccaccaagtttggcatgcgaatttactgataagctgcaccaaagccaaagacagaaatgtacatgcagccaatgatctcaaaagagtgtcatggcaatgcaaggaggaagggggtggtcaggactcgggatcagagacaggtggaggtagcagcaaggaaggcctaaggtcacctagggaacacaatgcagtgaggaggaagaggtggctgcggactgggagcaacctggacatgaggaggggatgacttaaacaacggggtagcagctaaaggtggcctgaacatgagttggtttgaatcaacagtacactgcccagtagcaaaagaaaaccaccttgcaatcacactaacaagagtatacagagcaaaacagagatgcatgctacaggatcactagtagttcatcatcaaattaacaagctaaccaaggagcagtgctggccccctgatctcaaaccttcagcttagcaaattctaatccccaccttaattctattgtgcatcagtaagcaggattcttaacccaagctctctaaaaccctgcctaatccaacatccatccgaattcgcccaaagtacaacacaaacctccatgtgaaggaatagcaacagaatctcatggatcaaagatcacggatagccagagattggcagcccaaccagcaagcaagaacgctctgctcggtgtccctccccgcaaggccgcaaccacttcgcaagctgctctactcggcgcgtccctccccggggatggcaacggggctggatcagccccgtagccgacaaccgacagaaaatccaccatcgaagcccagcattattcactaattcagcaatccaagcagcagattgagattagggaacccaaaaaaagaggcgttgagagcttgcttgctataccgaagagtatgagacgcggcggcgatctgcgcgaaggaaccgacgacgaggtggcggcgttctggtcgcggatccgacgaggacgaggcggcgtggtcgaagccggcggtcggtggccttcaactcctcgccgccactccgatggcgaggcccgattccggcggcggcggagacgaagggtttgggggatttggagcggaagagagacagatcaaacgagaggatctccgtccagattgctcaagaatccaatccaacggctggaacgcgcagccgcaggaataacgctacggcccaattaattacaatgggccacacgctcgtggcccaactagcactggccggcgagagttcgtcctccacggcggcggcggcggcggcggaaacgcaatggaccccgggaaatcgttctctgcggcggaggaggaggcgacggattcggtctctacgaagccggaggaggttgcggcttaccagagcagcgaggccaagcaggcgaagctacagtccatgctcgccgccctcctcgacgaccccatactcgccgacgtgcccaggaagccctccctcgccgacgtcgacacgctgatcaacctcgagctcggcagcgccatgcggctaaccgtcgtcaagctggatggcacctccttcggtactggtcccttcgaatgccacatttcactgcctgtttggttaatttgcatctactagtagattgcataaatcgtatgacgttttaatgtcttctttgtgtgtgtgaaagatgttgcaatgttgaacacagccactgtcaaggatttgaagatggctatcaggaagaagacggatgagattgaacaggaaaagatgggccatcgtcatatctcatggtaaagcccacatctctttaaacaatgtgatgattgcaaattgtttctcctttctacggtggatgatatcctgcgatgaataccatttactttcactcatggtaaccttatttgtcctgatcactaaatgatctttgaaacatttgcaatgtaatttcgctgtctagcatctcctacaagggagactagagcaacgtattgatcaatccagaggtattgtgcataaggatgtcatggggtatatatgctgaaagagtgagagtcacaggatatatgagattgatttgagttgcagccttgtagggttgcagcttagctcaaaccccatatgaacccaagctgaaatttgttttgattttgagttgatcttacagcaaattggtgagctcaacttttgtaggcctgaatctgtatgcataatgagtgaagcccatttagttgaggttatagacaggtcctccatatcttattacttgtcagttgaaactaagtaaattataatcatgatcgtgctgatccttctaggtttctatttttctttatggctttttttcaagaactatcagatcccttcacaggtataatcatatttccttaattttaggaagcttcagtcctgttgtcctaccctgtcaaggatcacacttctctgctgattatgcttgtgcatttcttttacctagcaagtagtgatcactggaaannnnnnnnnnnnnnnnnnnnnnnnnnnnnnnnnnnnnnnnnnnnnnnn

SEQ ID NO: 45224 - DNA, 1515 bp, Oryza sativa
agtacaaaatttgagcgcctgtcttatttgatgatatgacacagtttaacctacatggcacacatctgtttgaggatattacttactagtaatacttattatattacttacaaagtgtgcacagttgaggatactgcacacatctgtttgacttcatctctatgttctgtcaatctaggtttatttctcgccgcacgttatgtccagggtatatcgaaagcactcaagaagaagaaaacaccgctttttccatggtcttcataggaaaatgtgatcccatcttgtttatttgagctggtgttggggagcagcatggtcacatcagagacaaagaggtggccaaccttcagttctattgacatgagggaagcatgtagcatgaaaccattgttctgaaattcttcgataatctcagctggaaaagagctgtaatatcttttttttttagaaccaagagcagatcgtgcaagcgtttcatatgttcttatattgtagctactttcagtcatgtaagttttcagtagttaggacttaggcgtggtaatacatctttcacttgtactatcttttgagggggtaatattatggaaccaattcctcagctatgtttgatcttaaaaatgatgctctcagttcaagtaattaggttgtgaatgcttcttaggctttgtaagtaattaatctatgagtgaactcctactatactttttgtttgtttgtttcagaaagctctgaaatgttcaggatcattttcattttttataatcgcagctcatagggtcatagtatatagtacaatatctctatcgaacaaaaaatatatatataagttttctcttaatatctctatcgaagaaaaacttgcatttcttcactgtgctaacagctattgcgacgatatgctttgtctgatcatcagatatgaaaaaggcataaagcgagaatgtgtgtacgtgagcaggcgagagcatttccaacactgcagaagtaaatgtgatgatcacactggaaaggctgaccatttcttaacactagccaacaattcaagttcaaccaaagtggtcccaggcttgctactatacatggaattctgaaacaagaaactggcagtacaaaagcgaaaattatactcttgctgaaaaaaggaatgagaaaaatctcaacaggtgatgagcatgagcaaccaggcagtagtaaacagcagacagacagagagatatagataacttttttccttcagctggaagccatcaaagggagagacaagtttgacacaactgtgcccaaacacatcacaaccagccagccactagtgtagttagtagtagcaacttagcatgcagtgcactaccagttgaggaccactgcattctacaggcagcatgcatgttataatgctgcatactccctagctatataaatatagtatctttcagacatgcttctatatatgcttccttctagctaagctctctagtagctaggacatggacaccattgctctctcaatcagaa

SEQ ID NO: 45225 - DNA, 752 bp, Oryza sativa
  unsure (1)..(752): unsure at all n locations
tttcgaataattctcgctcttatgtttggatacgaacctcggtagtcctcttcttttttactcccaacattttgagcttggactggactaaaagattgatagacttgtgctaagcagaacttataatctaatgttactttctgcaatggattgcctatgcttgggtacttcatatagaactgtgcactcttaattttgtatgcttttcttgtttccagttgtctagccatttccagattttgtactactcatgtgtagtttgatgaagttcatgaaatttcaggtacaacatgggtgtaattccaacaaaaaagagcctgttaacatgtgaaaaactttcagtgagctccttttgcaggtcctttctctctctctctctctctctccatgtatatgtgctgtgtagccatcttttaccatttagtggcaaatgtttactcatctcagttcaacaattgttaaattgcacgtttcattggtcagctgtatgttaaagtgttgttgtaccactgcttcaacataaatgagacttaccatggctaaccacttaacaaacactataacctcgattagcacacaagactaaagttgtaggagatcagacatatcgtacatcacttattgcgtgtattggcaaattattgcaggcggaggcttgcaacagtcatggtgaagctcaagttcgcggagcaccttaaagaggccgtgacatannnnnnnnnnnnnnnnnnnnnnnnnnnnnnnnnnnnnnn

SEQ ID NO: 45226 - DNA, 818 bp, Oryza sativa
  unsure (1)..(818): unsure at all n locations
nnnnnnnnnnnnnnnnnnnnnnnnnnnnnnnnnnnnnnnnnntttgcccctctcgtccggatgctcggatgcagtgttgtgttgtggtatttcctattattgtttatgttggttggtttggctgatctgtggcaattggctgcttagattgatgagattaatgagactaggttatatatgtggtacatcgtgcgcgcaattagtggaacttatcggattgggaaatgggaagaggtgatttgcaccacctgttttgtgtttagatttagatcatatcacacgaggtgcccaatgcggcccatgtttgattaccaagtggtctgatgatgctacgttgaacctgtcaattttgctgagaggatggatgggggtttatgaacatttggccatgagctggggtttagactcgtagttgtgatcctactcacttttttttttattattatgatagatcaaactgaaagtaatagttttgctattatattttgttaatctctgaaggcatctttgttggcagagaactatagctgccggtaagctgacagaaaaagtcctgaagttgtttctggcaacggattgcgaggaaatcgccttgcttgttcagttgctcaacattaagcagccgcttgtaccggtccttcccacgagtatgttattcatcagcttatctctgtctatttgattgtcatgtgatttatgtcaaaagatcttggtttttgacacgctatcctcttggctgtagggtgctctgagaagttctagaagtgacactgattaggtcagtcttggttacctgagaaaagatgtctttggaaatt

SEQ ID NO: 45227 - DNA, 1330 bp, Oryza sativa
  unsure (1)..(1330): unsure at all n locations
nnnnnnnnnnnnnnnnnnnnnnnnnnnnnnnnnnnnnnnnnnnnnnnnnnnnnnnnnnnnacagcggaggcgaaaagacgacggctgtgctttccttttgttccggcctccgtggaccgggcctgtactcttgggcacgcacgcgggcctgcttgcgctgcgccgtctttccaaacttttctgggtttaccaatacttttaagtaaattttactttaggttatttcgctttaaaccatcttttcttaatagtactttgaatcagatttttttattttttttaagtactctagaccatatttaacttttttattcatctacattcaacttattataaaccaaagaaatagtcttacgtatacatgtgtgaaagttcattgataaataagagccaacataatcaagattgttcatatacctgagaaaagagtctgatgtttcaaagtgaaacatagataagtctactccgtctaattaaaataatattagttaaaggacgatctaaaataaaatattgataataaaaggtggctcctttctttttggcaaaaattgaatccatttccagcaatccctgctgttttagaaaagctgtccatgcttaactcgttcgttaatagctttgttaatctactccaccggttcgacagaaatgtcggtagatggtatgaatgctcgaggaaattcagcgtccttttgtcgataagtcacgatcatcaactgagagcattcacacgtgtatattcgtgtactagtaggctctgcatcagcttcgattatttgtgcttaaaaggaaaatatctacgaagttctaccgtaacgtggcacccagcagataatgggtaattcaaatgaccaatccgaatagcaactgtcaaggtaacatttcttccgttctaaaacaaacaaacataaaataaaatgctgaatagttatatatctatattcttatcataagtttatttatttttgaacgaaaaaatagttattataactagtcctaaaataaataaattataatatagcacatactaatactataacttttatctagatttttttagtattatagtattcccattttctatagtaggcgaagaatgcagacatgacacggacccatcgacgcgggacggcctggtgagatcatcctaggccccatccatcaatccatcacgctgggccgtctgtgggctgtctgtcggtgaccacgcccacgcagcccgcgacccagcgctcgtacggttacaggaagtggaggacggtggaaaaattccacaagagttgggggggccaaaaaggacaagggaaggaaaaaaaaaaagtcgccg

SEQ ID NO: 45228 - DNA, 12272 bp, Oryza sativa
  unsure (1)..(12272): unsure at all n locations
tcctactcacttttttttttattattatgatagatcaaactgaaagtaatagttttgctattatattttgttaatctctgaaggcatctttgttggcagagaactatagctgccggtaagctgacagaaaaagtcctgaagttgtttctggcaacggattgcgaggaaatcgccttgcttgttcagttgctcaacattaagcagccgcttgtaccggtccttcccacgagtatgttattcatcagcttatctctgtctatttgattgtcatgtgatttatgtcaaaagatcttggtttttgacacgctatcctcttggctgtagggtgctctgagaagttctagaagtgacactgattaggtcagtcttggttacctgagaaaagatgtctttggaaattcaggacagtgaggtcgacattgtgattgcagcactccagcccaacctgactactttctttgaggcatggaggccatttttctctcggttccacatcattgttgtcaaagatccagatatggctgaggagcttcaaatccctacaggttttgatctcaaggtttatacgaagtcagatatgggagtgcttggagccacatccatcgacttctctggtcactcatgccgttactttgggtaccttgtctcacgcaagaagtatgtcatctcaattgatgacaattgcctcccagcgaaggacaatggtgggttgactgttgatgcagttgcacagcatatgtccaatctgaagacacctgctacacctttctttttcaacacattgtatgatccattccgcaaaggggctgactttgtccgtggatacccatttagtctgcgcgagggggttgagtgcatgctctcttgtgggctgtggcttcacaatgcagactatgacccaatgactcatgttgtgaagagaaatcaacgcaacacaacgtatgtggatgctgtgatgacagttccacttggtgcgatgatgcctgtgagcgggataaatgttgcattcaaccgtgaggtgctgggacctgtaatgttccctgctctgcggctgcgcaaggaaggaaagcacagatgggatacacttgaagacgtttggaatggcttgtgtgctaaagtggtgtgtgatcgcttacggtatggcgtgaagacaggtcttccttatgtgatgagaagtgatgcagaagcaggtaaggctctcgagagcttgaaagaatgggaaggggtgaaagtcatggacgtcgttcttcccttcttcgaatctctgaagctatcgagtacttcagttactgttgaagactgtgttaaggaactaaccagcattgtcaaggagaaactgggaccgcagaatgcaatcttcgctaaagctgctgatgcaatggaggaatggaccaaactctggaaatctcacggagctcaaagcgcttaggctgaaatttggttatctgttatgagcatatctgatttcgatacccactgttatgaaactgaataaaccgcattcctgtatgctgggaattttctcgttagtgtacgctccaatactcgtgccgttttcaaagacaagcagtgatatgcaaagcaatgctgtgtatcttgtgtgttacatcaggagttttttttaatggtgatttcgttcatagttttcagacatctgtttccgtcacacgttcgtgggaatgacttttttcatatgaaatgcgcccatggctgcgcctgaaataattttacttgtcccgtttgggatgaatgaattcttttcctgttcgttgttcagtaattcacacagagtcataaacataccggtggaaacatgctcacaaagaaagaaacatcatgaagtcaggctaaggataagaatagccagcacacctagagcaaaattttactaacatcagatgcaagaaagtctacatgagttctaaaaaggaaactggggaaaactaatttacaccaattatcactaatagtacactaaatataaacgaccaagaagggctctaggaacccattttgtatctagcacccgaacgttgaacctttctcccgataaaagagggatcaggcgtgcaacagactggctctcacgccagggaaaccacaggtacaaaagaggcagcgaaagaagaaacaaaacttttcctccggggcgaacatatacaacttgagaggaaaaatacacaatggccgagagacaaatcacagtactgtattgatgtgcagtgctttcaacaacgaggtggccatttgtttcaccaatacctgttgaccgccacgttgcccatcccttcgttcttcgatcaggttttgtagcttttgaggaagatcattctcaactatgagctgctttggtcgaggatgatgctcatagacaacctgaaagcaattccaaacaatcgaacgttaaatcatggagttcaaactttacaaaggtacattaaacatatcgttgatattgagtaaaatgaaattctagacttatttgatcactgctagtagaaggttgatatattaaaaccatgtaaccagaaatttaaagcgaggaatgcaaacctttattaattttagcagtgtcaaacgggcaatagcttctcggtggtcaagcctttntggnnngttcgntttaaaccaattggtagccattgctgtatttatccgagaagatttcctgtagtcaagtcaatgcaattgcatgtctcaatattctgtatcctgtcatgttcatattatataatgtcatcaaaaaggaaggtaactctttggtcttacgtgattatcttcaaaaaagcatccaatatatgaacaaaatattgttcagggcagtcttgaaaaaacttcactaatttctgaatggcatctttcttcaacaaggcttgttccacttttctgtgatcattgtcatgggacaagcaaacagcaattgaatctaacgcagtacacgcccatgcatcatcctccaataagttcaagtacacatccaatcctccatgagccctcaactgctctctagagttgcgagaagcgtgagccatatcacacagcagaggtaaagcatattgcctgagaggtgagtctgacatgacaaaattcattaagtgagggatgatcccattttcagctgcttgttcctgtcttcttttattgatcttgcaaagattgaacagagcattgaggacctaaaacagcaaaaaattgcatagagttataatgtgctgagaaatcgtgcagacctatttcaaattctgaatagccaactgtcttgacatttgtccctaacacaaagtttgcgaattccagaaaaagtgcagttgcacaagccattgtaattttgcgatgtcaccattcgtttttctactcctacgatcccaatgtaagttgtttgagccttctcaactctttcctacacataagctgttttagaacttctatgcaatttttcatctgttcttacatgtttgtcattgttaaataaatgctactacccgttttacaaacaaatgattcatcttttccaatgtataaatgaagggcatcaaagtcattttgagttcttttcttaattcttgtgcagaagtctaaaatcactgacatttggaatcagagggagtaccatatttactttataatatcatggttttgtctatttgattccagtacactgtacctaatgaataatgatatggttgaataaaatgcaagcataagttcactagtttgctcatctagactctgtttgtctgccagagataacataaactcttctttaaaaagcaacagaaattttactattcaaaagagggagaaaaccaggataaaaaacatttttttttaaaaaaaagaaaacgagtaagcatctaaaaattcatccaaagcaacaggatataatcacatgtgcagccaactccgtatgtttaaagcacatagcataagaaaagcctttaaaaagaaactacccacctcactatgtatttgataaactagagggccatcatgaagttcaagaatcggtatcagatgcttgattgcatctgtgcgctggagtgtctcgagacaattaggatcacccgacaaatgattaatgcacctaagaatctgcagaaaaggaaagatggttcaagaacagaaacagaaacacaaacaaatcagtcacaaagtagcaacactaagtcactaaaatgcttgaagttttaccttaagaagaataggcggttctatcttgttaaacatctggaaaagccgtgcaagaaggctttggctagacatgagagattttacgacagtgtctgcttgtgcaaactccaaaagaagatcagcaactttctcaaggtactcacgtgccacgtcagcactcatagataccatctgagctaataggccagatgatgttgtacttcccggtcttgcatttaacacccctgatccagataacacaccagatgctgtctgtgatgcagctccagatgttgatgctccctcattagaagttgttggacctgatgatggtgcatatttcatgcttggaaccctatttgaagtttttatgttggaatcaaggttaccattttctcttccctgtctagagacctctgcatgaaatagaaagaacaataagtgcataaagaaaggttgttccctcgtacctaaccacctcgcactaactacacacagtattctatagtcctaaatactgctatacgaattctacaaacagagtttagaacagtcaaaacaaaaactgtgtatattgggttcataaaaggcagatgaataaatagcccacatgacccaagacatggtaatcataactgctgagtgatgaagagagaggaattaagcataccagcaaattctgccattaacaagtcaagttcgccgttagttttcctctctgttgaagcatgcagtaatggcaaaatactttcatgcctttctagaccagataagtggcgaacataatcaagttgtccagatacatgccgagagggtggttctttctccaacaggctcagtaggggacgaatttgatcattttgaccactactatgcccatttgatactagctctatatgctttggtgatctatctgttgatgtccttcctgcagaaacactaagccgttgtggcctaatgggatcattatcatttctctccatgtgaccagcagccgccatatcggtgaatctaggcgatgctgaaggatccattatgatatgatgcctatctgcatctgcttgtaaagattgcagtgaaccagatgaatggtgatgatccagcctcgttttggaaatttctagcattggcggatctaattgaccagaccttcgcctgggggtggagccattctgtgttactgaagcaccagacccggagatggaagcaaaccttgttgcttcattcaagctatgaagagtattgaccagcctaagaagtatcccgttttttgccgctatgcgacagaagtcatttcttggagtcgaatgctggagtttgaagacctgccatatgccatcgattgcaagatgaaccatttccctgctaatttaaaatatatggaatacactaattagatataatcattaaattacaccacaaaattccaaagggagtgttaagagaagagtggactcacctgtattttgcataatcaggctccagaaaactcaccaatacagggatcccttggcatgcaatgaacatttgcaatgtcaaggtgctgaggatgcaaatttgaaaattagcccacaacgtttaattccttttatttgtatctaaatatagttagacactaacaattaagtcaaagaacaaacctggcttgacaaagctgctgaaggaacctagatgcttgcacccgaacttcctttgcacgatctggcacggcaaaattcataaccaccggaatctgcaaataaattttaaacagcacatatcaattccacgtcaacagaatttataagtcgtaaatagttatctgaataaatggtcttacaaggccaacaaggcaagcattttctaggaaggtcgtattatcttttactatttggttgatgagttgcagaacagaagtaataatctgcagggaaaacaatcaacttttcagcgtgaagatccagtaaaaaggttctctcaaacaaaagttaaacttcatacacggtttttgggaagttcaagaagctccatcagcggaaggaaaccattttgtgacacataaatctgtttttgctcaggccgttgattgaagattgacacaagcttttggcaagctgataatatcacgtcctcactttccccaggtttcagctgtgctactattttgctgtattccacagactacaaaaaaaaaaacagacaaggaaaaatacttcatgatcaagacatgataactataaatgtatcaaaacctaagcagcaaatattactgcaatttcaaacatacacaataattatgattgttttggggaaggaaaatacaaaaaacctttccatacattttaggcacagaaaacctgctttcaaaaaagatgaataaagtgttaactagcacaatctatcctcctacgtagacagtttgccagcagatgcagttggattctaaaacttctgcagtactctggatgcttctgctggaccttggtgctagcatgcacatgaaatgacacctaatgcaatatttgaatacatgagaaggcaaatgagtgctgccaaagtccatggcaaatgtcacttcttggttgcgtagctggacacttgatccatatataagacaaatacatactcaaacttaaaaagaaaaggttaagcaagagcattgctacattatgataaaggtacacatcagtcacagaaacatcagagctttagggcatcgcatacctgcaaaggaaaaagactctctccaggaatagtctcatcaaatgcctgaaatcatcagagttgtgtcacttattttatattctcaaaggtacaggcaaaataaaatacatagtactataactatattagtgaaagcaataccgttccatcaatatcttcttccctcaaacgcatgacatattcaagaagttttccaccattcatgtgctcagtatcattttccttctgcttctgagccatcctagtcttgagttccttcgcgagatcattttgtgcaccattgtattgaagctcttcaccagtagtggatgttgaagcttcagccccatgatctcctcgcttcttaggtgggaataaatcatcaaaggaggcatctccaggtgtgtcactgaatctacttagctcgttagccatctcaactgaagttttagcttcctgtcaagacatgaaacattcaacggcaattaattagctaaaaacagctacaaatgagaatatgcagaggtcacagatatgctcaaggctttgacagtgaagcctttgggggggaaaggcgataactgacaagctgcagatcaaaaatatgatctatcatacattggataaaaaatgttctcatagaaacattgcgccactctagtcatgcatgtcttaatactccctctgtttcacaatgtaagtcattctagcatttcccacattcacagtgatgttaatgaatctagatatacatttcccacattcacagtgatgttaatgaatctagatagaacatcactgtgaatgtgggaaatgctagaatgacttacattgtgaaacagagaagtataaaatattcaatgtgctgcatttagaaatgttaaaatgtacatctttgaccccccccccaaaaaaaaaaaacttatgtgcaaggtcaaaatgatgtgcataaaattatcaccttttggaagttgatattttgtcctccagcctggaagctgaaagcatcaccatcctcaagacttgaaccatctttactttcatcttctacatatttaccatcactctttcttgattcttggccgctgctagttaacttgtttggtggaccatcttgtgatacctcatgagttagtttaccatttaaatcagttgcgcctagtgaagattccaatgatagcttctcatggaaaactaatgtaggatctttattaagaaccacgttatctttcataagttccacatcattcgaactactactcccagtagtttttaacattccatcatgaaactcatcaggtatatcttgcctggcagattcagaaaccaaatcttttcttccatcctcctaaagcaatgttaataaaaaagttcacattatgatagcgtaataatcttgtgagtccacaattttggactaatttcaaaatatgagtagaatatggcatgccaagaaccctgaaaggcatatatacctgttcaaggccagaagcagtaggtgtttgtgtatctcgtggtgggccagaaaatccagagtgattgtcaccacttgatccttcatcgtcctcatcaatatccctgacagtactaacaaaccaggaacttagcaatggcttatcaaggtcactttcgaaagacggttcaaaataattttggtgccagctatttgagagatcaattttgctgagattttaaactatgattttgttgggcaattactatgcagttgtaattcctggtagactacaatacaaggctatgcaaaatccatgtgaacaaccaacaaccaaaatcagcaacagaccgagatatgccgcctatgtcaaataaaataacactacttaaaaagttaaaagatgcaagtggcaaaatgctacttagctaaccacaaaatttaaacaggcacataaagaaaaaaatgggattatacgtatatgtactatgtaaaagcagagagagtaaaactataagaaattccagtggcaaacctccagaaggaacatctctcacaggaagttgcatctataactaacttaaacccactagtactgcaattaacccctggacatgtgtagttgtgtacacatcctacttgctaaacgaataactctagcaatgcttgaataaaattgaccagtacaggtttaatatgcagaatatacaaccattattatagacttatagtgatcaggtgactgaaaaatgacaagctatggagctatatttttctgttttccgtcctgtttgtatctttatggctattattgttggtttatcatttacaatgaatagcaattgaaaagaaggaggcagtaaatgtgagctaccttggtgattgaacaggttgtcgaagagatggcaaagctcgccttgagttttgcaaccatgggtgcatcaataatgtctttgcatcaggtctttgtattgaatcctacaggtgcttcttgaagtcagaacagcaaacaatttgataaaataatcattaaattctcaaagatatagccagaaacgacacagaaccttttgaaaacattgtcgaagaaaatcagtaatctcaggagataagccttctggtattggtggatgcacatcctattgtccatagataaaaactttctatgtaatcatagtctcatgtgtgaatggatattgtgacttttgaaaatgtaggggaagtaaacagctgcaagtaatcaacctgaacaatgcgaaacagcgcaggcatgggctgaaggtcataatatggtggggcacaggtgagtagctcaataacagtacaaccaacactccagatatctgatgcagcacaaacacctgacatttcgatgacctaatgcacaatataaataatgaacaaatacattagcatctcgcaagaaaaagtatgtttcagaatcacaagatgcaaataattttggttgataacgcttggtgtaatgctggcatggaaaatagcaataagttctatcctgttggcagtagtaattagcttttatgttgatagtactagtagaattaggagttaaacctaatcgattgattcattgaaacagcataagtgaagataattagcaaacctcaggggccatccagtatggagttccaaccactgaatgtgtgttgatatcagcttcagttaatttagtagcaactccaaaatcagcaagtttgacaaggccctaaacaagagattgtacattaatgagaacatgtagacaaatttggtacataactgcctatgaggtattcattccagcagttctctgtttccataatttctgctagattgctatatatgtgaatgagctcatctcagtgtaccctttcctaactcctgcatagtatttaatttgtgttctcatgttaacagaagtgcatgaagacgacagcttacaaggatgttattcaaaacatttttccaaaatttgtatacttaagatattccctttgcaattatctcaagtcatcacaaaaggggtaaatatggatgtgatgcagcaataaacctctttggtagtcaatatatttgcgcccttgatatctctatgtatgacaccttgctcgtgaagataaacaagtccttccagcacctggttcgatatgtaaaaaaattaataccggacatagcaaaaacaggaaagttgcaggtaatcatcatattcacctgagcaatgtagacggccaccaatgattcagggaatggcccaaatttgtttggcttgataatattggcaagtgatccattctccacatacctgcaatcatcccatgaggattaaaacttccaagctaaaaaaaaaaaaaaactaatagcctaataggtataatcatatcaagaaactgtcatgaggattgtgaactgcttactctagaatgatatggaggtgactccttgtcttcaatgatccaagatacttcacaatatttttgtgattcagattctgcgtaaagtggcagaacttagaattcgcagcaatacaattttcttgcgaacgtatatacatttcagatatcaagaaccatttaatttcaagtacaatagattatagacatgaccactaaccacagaagaaggaacggtatcatttttcattaaattttgggcatcagggcatccataggaacatgtagctaaacatttaaatagaagcttgttgggtgtataaaaataagtatacattgatggaactccaaaattttcttcataaatttgttcatgtaaggctatagctatagaagcataatgataacagcaacacttacatccaaagataaaggggaacagatgcaacaaaaacaaggataggcggggataagagattatttaaccagtaagatgtgttatttagttttttgtcaagtacaaatatgataagtaaataatgtgaaagaaaatgaagacttactttcaagagatcaatttcttgctgaatcagccacagcagcataccatgaacggaaaagtcacaataaaaaacaatttattagaacagcagactacagcaatacaatagaaattataaaatggtgatattcaaataaaatcttgacaatgaaagcactgaataagatagcacaatatggtggtaggataaaaaaagtataggatttatcaggttgtgctaaatgtcaactccaagcactaaaccatgcatgcaccaaatgacaaaaataaacaatagctcgtgcaattagttcactttagcaaaaagtaacaccaacagattaaacttctaaaattttttggtttggactcctttatgaacctcaacaccaacagctcctttgtaaattttagcttagcacatgttggcacaaataaacattaatcatgtagatttttcactgactttttcaagtttctttcctaagtcaaatagtgtttcaatattttcaccaaaatgtgtatctgtagttgaacctaccgtggccagattttggttcatggttcaagttgacaattcgatgattcacatttagggttccagcagagtgaataccactctagctaagaaatcagaaatggggtccgtgaacccaacatcgacacccaactctagtacaaaatgttgtataaaaaggtcaagctgtattacagctttccgtgggttaatgataaaaaggagaaaagggaaatgaatagttattgcctcctacccttcaaacccaaggcagtcatctccctctgtccttacctgcccactgaaaattcttctctctgtccaccacatgaaggtagactgataaacaagagaagtcacaaaaaaaaactgaagtagacattggtgagtgtagcaatggcgatggcttcagcaagcagcaagccagctgcgacaatgtgtgcgggaataaaaaattaaaaaggaacaagggtgacaacttcactgggcagcaaaatggatgagtgacagcagtggtca

SEQ ID NO: 45229 - DNA, 3710 bp, Oryza sativa
atcgatatagcaaacaacaagcagtatttccccaatttccagacgcacttatccctgttgaggtcgctgctgcccgtttatcaactcccgacagccacatttcacgtaatcgcatacatcatcttttttcctttggcacacgttatgcatcataagaaaggcccaaaaagaaaacctcaccatgatgatgttgagatcctcctgcgggatgttctccaacgatacttgcttgatggccacgaagtctccattttccaggtcaagccccttgtacactcgcccatatgctcccttccctatttcatctccgagcatctgcaccggcccccacacccccccccccccccaccatgcacacagtcagtgagcgaaaccaaacccaaaattaacaccaccagaacacgaattccacccggatccgaggcggtaggctccggaacactcacatatttgttgtcgagcgtcttgttcttgtggaactgcgcattgtgctgccgcgacgccatctcgccccgccccccacacacacccaccccgagatcgggccccggacgccgccgtccgcggcgggggcgggcggatcgggggtcactggcggcacgggaacggctccggcgagcccgccgcgagggccatttaggttttagggtttgggtgggaagggaattggaggtcgaggcggaagcaggaggaagaagaagaagacggaggcgatggaagagagagagaaggggaggagagatggggggcttttccgtaattattttgttttcggggggcgtgggaatctaacggaatgagagggcggcttttatactcgggggtgtacttttgaagtgggcggaagccaacgaggatattgagagataagcggaggaaaccactgtcaattagctgtcctcaactagcatccgcgattttgtagcacatcatccggggccccctcgatttttctttccaaaggaaaaaatagaccatttttgtccgctgcttgcgtcatttcttccatggctttcttttccggtcattctctagtggcgtgtaaggagatttttatatttatttggttctactaggctggtttctgtcgtcggcgttgcaacagtgtccttgtgcacaagaacaaccttaaggaccacaaagactatagaataattattaaaataatagataatgattaatatatatatatggtcgactgataaaaagatggtgagtagttgtgtactatatagaatcattgttaataaagcattattagataagtagctggtaactctctttatttgttttccgcatcctagctcattctctccatatctaagcttccaacaataaaatgatgttggttgctttcacaatcatctctgcctcgaaattcaaaataaatggcatttttattaattatgtgactcaataaagaaaatttacatgtctatagtttggaagaaatcaactaaaaattaacggagtgttcaacttccatgataacctataggcaacaatatatatttatcatcacaccaaatcaccaatgtaacaataatggcagcatagagcttaagaaataatctggacgattttacaattggatgatgttggtaggaaatgaaggcagggaggggaagcaccaatgatacagcgatagagacacggcgcactcatgggtatgctttcgattggattttagtaagattatagagttgccgctaatttcgtctttttgataggattttagcaagatcatagttcagttgttgatctttgtctctttaagcgtattttggaagatttcttgcgggtacatgtgagcagttaatatgtgagcttctaataactataatttatcctagaatagattatcatcagattataagaaactatagttgtataattcataagctaggtttaatcataagctctatttagcagcttctctagactctcataaactgacgaccaaacaacatattcgcttgtgtagcaaaacctttcactcagcaagcagcttcttctctttttctcagcaacgcggtggaacacccatcatggcactgccgactacgtgtcggcgcgcgccaacagctaccataccataccatcacagcacgctaattgtacgatagaagtaaccctaatcatggatacgaatatacgacgcagtcaggtcagttggttgccacccacaatgtggctgccacttgaacatgttattcttgtccttgtgagtgaacttgaacattttatagagaattggctatttttcttcaatattgatggcaatgcagtttgcaacttaaagacatgcacaaagattcaagaacatacgtacactgacaagaaacattcaagaaagtacttttgctctctagagctggaagcagaaatttatcttgggtaaactttggaagtttgaatggacaaggtcattgatccgattattgtgtatataatataattgcatacactaatcacagtgggcatcctctagtgtctagaggaagtgttccaaaatctcacaacaattctttatttcagtcgtgccaaaatgaatagaaatcctcaactaaatagtgatacagcatgagcagacttcaaattgtaacacagctcactcgccgcttaggatagggttgatcagtggcttcagctgcgcaagatagacgattgcccacctgcagataagcattaacaaattactaccagaaaaattggcatccggattgtcacacccagtatggagcttatcaagcaaaagagggaagatcaatgatggaaccatcatgtaagcaaggcggcaatacaacgacaatcagatatcaaatcttaaaaaagaagccataagaaatatgagtgacattactccttcaataaactatccaggatatctggctctcatggacccacaaccaaagaataaacagacttatattgagcacatgcaggttacaagaaccaatggagtgaaactataagtcagaatcagattgagtttcagcgtacaactaataccacctgttctactttaacaagagttaatcatcagttcatattgctcctagaaatttagaccttgcaagattacctactagtcaataaaataatgtcaccattgtgcgattcaaagtagactacatgtagaccataagatgccaagttttgctggtagtgtgcttttcatgtttgccagcaatacttttgggtttcaattaatcaatcagcctactgttaaaatcatattttctgagcaatccagtttggatagacaaaccagaaagtgtaagtgaacaaatggatcagaacttacatcatccaacagcaaaccgttgctgtaataaccaaggtcaaatggaatctgcacaaattaaacataagttaatttaataggttagcaaaataaccacatgcatgtagacaaagctcaacagctaactgccatatttcaaacatcccagtattttctcaagacaaggtaatgataagaagacggtagtaatatgatagaaacacagccacacaatttagatagagtcaccatgctttgagaagaatattaataaaagaaagtgtgtgatacagtaccaataatggatatgaacgatgacgatattcgtcacatgaacatagtaggctagagatacaaatactcttagtcacgatcaaataattaagaacacaggctagagatacaaatactcttagtcacgata

SEQ ID NO: 45230 - DNA, 2230 bp, Oryza sativa
ttttgaagaaaaatctaattggcatattattagagtaattgaaccactcgaattagctctgaaaagccaaacctggttacagcctaccaatttcatcttaagagaggaacatagggtaaagattgaacaaatttgggggttttcgcacgaagtcacttcttttactgaacatgggctaagatcagccgctacccccatcgatccaaccgtttcaaccgttatccgatcgaaaagacgacgcaatctcaacgagaaatctaccaatagaggaaatccttagccctacacaatacgcccaaatctagatcaaaaccaccatccggcgggtcaaatccgcccgaatcgcgcccgccccgatccgaaagctccaggcggcatacaggcgatcccaatcacaccacaccagatcagcagctatctgaagagaatcagcgggggggaagagcgtacaggttggtcgacggcccgcggttgcagcagagcagcgagaagagggaggcgacgaagccggcgaggaggaagatgagcgtggtcacccagaaccccatggccggcggaaagctctccgatcctctcccttcccttccctctcgatctctttcttccctcgggatcgctcgctgggtctcgtcgtctcggggcggaggtggggtggggagagacggagcgaagaggaacaggggtcagacgtgtagtcggtttaggggtagagaagacgacacgatgaattgggcccgggctccttatctgggccttggcctgttaataagtttgggcccacaaaactgtaaagaacaagtgggcccatgtgatggggtgcgcaccggtgttgtacggaataagtttagtttaggtctctcatgttgagatcgagtagctctgcttcgctccgggcgccgacttgccgatgaaggacgatgaaaaggaggtgcctttggctttggacatcaccatgcgtccatgcccgtcgagaagaagttggtcgtgatcgctccggccgccaccattccggctgtgagcgagaagaaaatggctgctgtggacaccgacatgccgagcagagtggctcctcaagccaccgacacacaagccgtggctcctccggctgccgccatggacaagcagaaagttgctcatttggatgtcattacgccaaagatgatcacttaggacaacgccatgtgaacaagcacatttgggggagtcaggataagctagatttaggttaacgagggtttattgtgtacaatagttagctattttggctgtgtttagttcgtgtgctaaattttttttaaatatacggacatacatttaaagtattaaacgtagactaataacaaaacaaattacagattccacctataaactgcgagataaatctattaagcctaattatttcatcattattaaatgtttactgtagcaccacattgttaaatcatgacgtaattaggctcaaaagatttgtcttgcaatttacatgcaaactgtgcaattggatttttttcgtccacatttaatgctccatgcatatgtctaaatatttgatgtgacgaaaaagttgaaagtttgaagaaaaaaagtttaaatctaaacacggcctacatcatctacccacagatttaaatgcttttttttatcttcttcttctaattttctgcctctttcttcatgtccactcgttttcataagaaagcaactagtctgacctcacgtggaccccacaatcatgttgacgaggctgcgttcgagcgcaggagaaagagagaaagatagttttgttttccacacgcacgctttccgaactactaaacggtgtgttttttgtaaaaaatttctataaaaaagttgctttaaaaaatcatattaatccatttttaaagtttaaaataattaatacttaattaatcatgtactaatagctcacctcattttacgcatcttctcagtctcctcaatcccgtccttctcgaacactcaattaatcatgtgctgcctcttacgcctgggagggagtgtgtcgtcgactatttagccacctgctccctccctctctccactcattttcctgccacctcactacttttgccactataggcacactacggtcggctaaactttcttactacgtattatacttgctctcatacagcggcgtggtgatttgctgcccatctacacgaaatttctttttcagccgcacccgatccgtgtcggagtcgatgcg

SEQ ID NO: 45231 - DNA, 10214 bp, Oryza sativa
  unsure (1)..(10214): unsure at all n locations
tcttgacagtcatctccctctctctgggcatcttgtgtgcgctcctcagtttcctctggccaagcatatcagtggatcaccggaccttgggattgttgttctcggtcattttcctgatcgaagccgtggttccagcttgggatcattacagaaaatttggatggtctgtctgcgtctcccagatcgagaagcccttaccaaccgaagacgatgcaggcggcggcggcagcgccggattctgatcgtgatcgtgcggaggtcatcgcaaagtatatggcgttcgaggattccgtcgtcttcgtaggcaccacgctctcccaggggatcgtgtgtgcgctcctcagcatcctctcgcccggcgtatcatgggagtacagggccttcggtgtgcagctttcggggattttcttggtaggcgccgcgtttggaatttgggagcatcacaagaaattcggatggtctgttccacgggtcgaggagcctaaccaacaagaagtgaccggtgatgaattatgctgatgaagtattctctcggtgtggggttgaattgttgctcatttttggcatcaaattcactactccatttgtttcatattatataaaataataataatatttttaaaccaagacaaatatattcaactacagatttaatgaagctaattggatattgtaaataatacaatatttgtctacaaacttaatcgaacttgaaatagtttaatttcaaaaaaaatcaaaaagatttataatctgaaagggagtaccaaatacgagaaagtgcatcagttcgtgcgtgtgtgcatgcacaccaattttgtaaaagaccggttgtgatcacggttgcgaccatagctattctgtttggtgtagcttcatattttaaatccacagttgatttgaaatttatgtgttaaattatagtgttttaaaattttatatttcatcatgaaaataagatgattcatttaaatgatattaatgaaattaaacatccagatttataggtttgtggagctagaacattcaactccacaaaatctcatagaggtaattacaattgatcgacctgtactaccatctagaaaccagaatctgattttttccgttaagttagatcattctttctccttattaccatccagtcgcggtggctctgcgcacggactacactggacttcctgcttcgatcgggcgacacgcaagaaaaaacgccgatctctgcatgcgcttgctgttcctaaacgtttttgcgcgatggatgacttcgtgacatgctaagacgactaagcattgacgttaattcgttgcgctgttctaatatacacgttttccttgatgatctcagttgaatattattctgaccgttaagcataagatcgagcttaatttgttacgtacgtcaaagaaagataagaactttggggttaatttggtctttcaaaaacacttttgaaacccttaagatatcaagcagttatatatatatatatatatatatatatatatatatatatatatactttctctatctcaaaataactcaaattatgatatgacgtgagttgttttattggtagaatccctatgttgttaaaaatgatgacaatatgaattaatatataatatatcacttcacctctacaagttgtatatacggtttgtgttaatttgttatgtttgttataatttatagaagttgaatttgagcctacatatttgtaaagtgatatattatatattaatcatcttgtaaaatatttttaatatttttttataatcctttaattaacatagaataatcaaataaacatttactcgattgattataacagtttccccattagggaggcaaagaggcggcgaagaagggggtctgtgtgtaggcggcgagctgcaggttagagccgaagaggagaagaaggaggttcggaagggagggatggcaaggaggaaagatgattacaatgggtgcagcaacaaagattgggggcaaagaggtagcttcagggaggaggaggaggaaggttttggaacaggctttcagggaagtcgcatggggtttgatccgggctatggttttgggcagcagggtagcttcggtcagaggtggtagaggcatggttaccgcctgagaggggctcgtggttttggcccaaggcgcagcagttttgcaggaagaccagggagagggtcagcaagaggattcaggtcacaacgtccagcttttgataggaaaatggatgatatgggaagaaagggagaggagaaggggggagctgctagctcggagaggaatggtggtgcaggccgggtgaaagtgggggaggtggaggtcccccactttaaagaagagagtgattctcactaaggacaatctagcaaaaagaaattggaagggcaacactaagtgttgtttttgtaaccacaatgaaacgatacaacatctcttctttgattgtcatgttgctagatttgtttggagtaccctttttataacatttgggataaatccgcctaacaatgttgctaatatgtttgggatttggctaaagggtttgcaatctaggctaaagcaccaaatttttatagggattgcggcgttgttgtgggtaatgtggatttgtagaaatgatgtggtcttcaatggctccaattttaactcttacttgcaggttattttcagggggacgtattgggctcgacaatggtccttgctgcttaaagaagattagcgcgatgtgatgaaagaaggatgcaaactgttagagacatctatcatgcacttctttggtaaagatggatggaacatgagaaagcggttaaaggagtaatgtggtcgttagtttgtttggaaggtcttttcactttgaaaggcgttggaagtctttgtgctcttttagttttatgtaaggtgcttgagcctttgtgatccttttgtttgtgaacatgtgtgtatgaactgagcttgtttggtcagattttctgtggctgtatacacccccgttggtgtagaagccgggttttataaattcccattatctaaaaaaaattagcgaccccagcggattcgggcaagcgctagtagatcaagcctctagtctaagggtgcatttctcgttttttattttcagtttttctttttgttttttcctggtttttccccttatttctttcgatttttaacatatacatatatataaattttgtattcatgcgtatacaaagtttgtatacatacgaataaaaaaattgtatacgtggtgtttttttcttggttttcggttttttaaatatgtatgtatttatatatataaactttgtatacgtgtatacaacaaactttatatacacgtggtgttttttttttgttttcggttttttaaatatgcatactttacatacgtaccacctattactactaggactgcctactacctctactactacttttatactactagtagtagtactactacaactatactgttactagtagtaatactacactgttgtacataaaatttaatttatgtacatgtatgtaaaatttgtgtaaaatagggtagtagtactactagtaattatagtagtagtaggtggtactagtactgtactataggaggagaccgcgggggcggctgggcgcgcccattagcagtggctgcgcggctctctgcactcactgttcttcctgcagtcctgcttcgggggatcactgatttcacatgacatggttcacatcttcttcttattttttgaaacttaagcaattttattaaataaagacagataaggaggatatggttcacatctcacattaacaaaatgcgccgcttgctgtcacattccagtagttcccaggaccaagcagcttttcggctttcgctagatgatgatcgtgaattcgtgactcctgaacgcgcggccggcgaaaccgtcgtgcgcaaggcgtgtttcttcggagttcggatcacacgttcacacgcgaagaagagagaagacaaaagcattgacgtttgttgctccgttcacagatacgtcttccctgatgtatcatcccatttgaatatagaccggctcgttagggacgtgatatttgggggtttaaaattgatcccgctggactttacagtgcatacgcactcacaagtcacaagtacgtttatacatatccattccgaacacgttccagaagacgaatggtaatatgggattcgtgttaataattaccaagactcgttctatgtatctgagtgaacgtacgttagttcctcgaaggagatggggctgcttctagttcctatacttaattacatgacatgtcctaacagaattcttcaggttgaaggctaacttaaaccttcatattatactgctaacagccttcttccgggaaaaaaggtacacatccacatgccgcaaaaggaaagatagtttattcagctgttttccgatcaataaaaggaaaaaaaaatcattcatgcacaactgcatgcaacagtaccaaccaagtgaaatttgacgacatttgactctttcacaaagtcacccggctcatttttctgtcaacgaaacagaggattacacgagacagtgccgatctagcccaggagaaacaagggaaaaccacacctgattactttttctcgcggctcgcgggtacaaatctgggatcagcgcccgctgtatctgtccatctctcaattcaaatcacccacgtcaacagaagtaatcagccacattggcaactggaaatgtgtgagggcggaagggcagcagcatccatggctcgcacggcgagcgcgtcccggcgacagccggagacgaccagcctcgccgtggatgaggccggaggcagggcgtcgcggaggccgagaggatggaaagccgtcgggttcatgatcggtctctctctccttcctgtctgctcatgaattcgtactccctccatctcgaaaaaacccacctagtattgaacgagatattttctattgcaataaatctgaatataaaaaatgtttcattcaatactaaattgtttttttacagaggtagtactacagttcatgataagttcaaaatttgagccactgttttgttttttaaaaaagcaagaacaatttaagagtgctgctttgtgagctaatgaccaaatgctttttggtgtgcgtggaagcagggctctacctggcaatcgccatggcgttgaacgcgttcgcccagcccgtcaccaactacctcatcaaacgttacaacatgaagccgaatgccgcaacaaacgtggccaacgtcttcagtggcacctacagcttctcgccggtggtcggagccttcgtcgccgatgcgttctgcggcaggttctggaccctcttgttcggagccgtcgccgcctttgttgtaagtgatcagcattgcatccatgacccatcagaaaactatttaaaaattctcgaaagatatatcttgttatttatacatgtcattcaaataattatgattttttaaataaacaagataaatttatttagaaacatataaaatttaatttaatttaaatataagatgcaatgaatataggttaatttgtcataatcaattttattgatttttttaaaaatattttcataactattcggataatatgcgaataattaacgagggaatgttctggagagtttggagtcccctctcatcatccatctctcgcttatcaggttaagagacgaaattaatggctgcttatccgtgatctcctctcgcccatgcaggcaatggtggtcatcacgctatcggcgacgatccgtcagctcaagccaccgtcgtgcagcgacgtggcacggcaagccggcacgtgcgcggggccgtcgggcctccaccgcgccgtgctctacatcggcatggcgctgctcgtcgtggccacgggcggcgcgaacccgaccagcctgccgttcggcgcggaccagttcgaccacgacgacgcgagcagcggcagcagcagcaacgaagccgacgagcgacgacggcgcgccgaggagcccgcggggctcaagcgcttctacaactggtactacgtggtcaccatgatggcctcgttcatggcgctcaccttcatcgcgtacatccaggacaaggtgagctggggcctcggcttcggcatccccacggcgctcgtggccgccaccttcgccgtgttcctcgccggcacgccgctgtacgtccgcgtgccggccgagggcagcatcttctcgagcgtcgcgcgggtggtcgtcgcgtcgtgccggaagcggaggctcacgctgcctcacccgcgcgacgcgcggcagcaggaggccgttctgtacaatcctcccgtcgtcgtcgcagctggaacgggaaccagccgcgtcttcaagctcccactcacgttgcagctgagctttctgaacaaggcggccattgtaaccgccgacgccgacgagatacggccggacggatctccggcgaggccgtggagcctgtgcagcgtgcagcaggtggaggaggtgaagtgcctcgtcaagatcgtccccgtgtggatctccggcgtgatgtggttcatctcggtggcggagctgaccaactacacgttcctgcaggccctgaccatggacctccacatgggcaggagcttcaccatcccgcccgtgtcgatcgccgccatattcaacctcgccatcgtgctcttcgtgccggtctacgatctgctcgtcgcccgcgcagcgcagcgcgtcaccggggtggagggcggcatcacggtgctgcagaggcagggcgtcggcgtggcgatcagcggcctggcgctcgtggtcgcggccgtcgtcgagcgcaggcgccgggcctccgccttggacaacggcgggacgtcgccgatgtcggtgttcgtgctcgcgccgcagctcgccgtgatgggcgtctcggcggcgttcaacatgatcgggcagatggagttctacaacacggagttcccggaccagatgcgcacgctcgccaacgcggcgttctactgcgcgcagggggcgagcagctacctggccacggcggttgtgaacgtcgtgaacgcgaggacgaggcggcgcggcggcgggcagggctgggtcgccgaggacatcaacgccgggaagctggaccacttctactacgccatggccgtgttcgcggcgatcaacttcgtctacttcctcgtctgctcctacttctaccgctacaagggcgagccagaggtggcggccgaggactcgccaccggccactccagaggccgtcctcctgaagcactagccagtagctagcaagattggttacggtagatcactctatgatcaattaattcgatttattattggtgtgattaataataaagttgccactactggacgcatcgcgtttacggcccatataaaaaaaagcccatacaacctgtcacgtgcctgacatggctacccagtagtcccagtacccacaaatggaccgcttatatgagccgcaaaggccgtgatcgaacggctatcagatgccttgtatgatgatactatgatctgatgagtacttcgtagtctgctgtacgatggaggcatggagctgaaggggatcgacttcctgtgttcgatctgggacgcataagcttgatcgaaccgtagccatatatcccaagagggttcggagatttactctccgaatcctcaaaccagcaataatatcgtgactgaccgagccggaggctgtggccctgaataattttccgtttatctgggccgcaaatggcatgatccaacggctgtcagatgtcccaaggagggtcggagtttgaaacgatgaccccaaggacaccatctgaaaaacgacagatgcaaggacttcactggtgagtaatgaggatgcatgcgagatttacttcacatcataaatggcatgcatgatctgaatatctctgatgataagatgatgatcgagtacgggtcagctcgttggatggcggatggcctcgccggcgccgaccacgaagggacatcgtggacgtgcacgatggccgccggcggcatctcttgctgctccgccggcgtggacggcgccgacgccgattggttgcagtctgcagtcgtccgcgtccgcggtgattaagtttagtaatgaagatgctcttgcaagatcgatcagaatgatgagagctggccgcatcccggccgtccatgctgaggtacggtgcacccaacggcgtctgggtcgatgtcaccggctccattcgtctccagcgccggcctgtcagagtgagatgccagctgcaggaggccgtccgtcctcctgaagcactatctagcaagatggcttcatgctcttgaatcttgatcatgatataattaattaatttctaaatttccagtagatgtgatcgacataagaagctatcactaatgaggatacacacgagatcgatctagttacatgatgaaacgatgagtatatagttatttagttagttacatgatggagcaagctggagggggatcctgctggtggtagactacgctctggtcgtactcgtaggatggccacgccggagccgaccacgtcgaggcggggatgtagtggacgtacacggtggccggcggctcaggcgccctcttctccgcggccgccgtgtacaccttctcctcggccgccggcgcctgcttcttgatctgctgctgctccgtcgacgggttggacgacgacgacgacgacgacgccggcggcggcccgatggtcacgacttccgcgcgcttcccggccttcctcgtccgctcgatcacgtccaccgggtccgcgctgccggtcaccgtcatcgttcccttctccgagtcgatatcgatcttgtcaacacctgatcaacatggacacatgtcacactatgcttcacattctttttgcactttgtaatttagaatcaacagttcatttgcttgtttcttcgatctgttaatgcttcatattagtatatttgtttaaaaatatatatatgatatcgttgacttatcacataatatttgactactcgtcatatttaaagaataatataaatacaattagatataagttaaaattatagtattttctttgatgataaaaaagtaccttggaggccggagacggtttgcaggatcttgcgcttgcatttgtcgcaggaggtgtccaccctgagcaccgtcttcttcgacatggacggactggtgcgagagagctcagctctcccctagctgctacgtatccgtgtagagcgaattcgagctcgacccagagccgtgcatgccggtgtagcgggtgctctgctgccgcggtccttgatcgagctaactaactacagcctacaaatatcttgcttggcttttatactgctgcctttcagcctttcaggtggcagtgaatggtagctcaactcctcgagtagaagtatctccttgatgcgtctcttcattggctagctctaccaatttgtcatcaacaactctctagctcgctactctacatttctagaacacggttcacatttttcacgctactctacatttatagaacacggttcacatttttcacttggtgtctggtgatgccaagcaggtgtcccgtgtccttcagtatagtcatatatggacatttcttcaagattaacggctggttggtagtaggcaagtaggcaacgaaccttaactgcaattcctaactgttcgtacttgtaggttagtgttgcgctcgcaatacgcagccacgtctcctctgtggatgttggtggttagaacaactttaacctatccatgactccatgggctatacctatacataattaacagcctttagcattctagagcctagatattgcatatatagacaagcaatatcagaagaataagaaacactttctgcattcggatgacctcattttagacatttagcgcaacaaaatcacaatacgcctacactgaaaatactccggaaaagaaagtacagaaacgactaacttgccaggccgcactaggatgtcagaactcagatcacagattcacagcaagctgagtatacgggaatttatcatagatttccaaggtaaacgtggatgcctcagtatacagtttattaactcttcttaatgtttgtctactgaaaattnnnnnnnnnnnnnnnnnnnnnnnnnnnnnnnnnnnnnnnnnnnnnnnnnnnnnnnnn

SEQ ID NO: 45232 - DNA, 4452 bp, Oryza sativa
  unsure (1)..(4452): unsure at all n locations
gacctcattttagacatttagcgcaacaaaatcacaatacgcctacactgaaaatactccggaaaagaaagtacagaaacgactaacttgccaggccgcactaggatgtcagaactcagatcacagattcacagcaagctgagtatacgggaatttatcatagatttccaaggtaaacgtggatgcctcagtatacagtttattaactcttcttaatgtttgtctactgaaaattcggcctactgctgaggcaaaccacacggtatacaggatgtactacaacaactaccactctcttacacgttttccctagaagggaggagaacctgcacattggacatgcacacttgtagaaacacaacaatcaccaagatacaacagacacttgtcctatgccctttatatttcaaggtcgtcaatgttggagctgaacctttggagctgaacctttgtgtcacctagggccacatccctttggaggatcacgtggatctcccccaacttctccatttctagtgtagaaattgactatcttttgatccaatttaaagtaatgtaccatcttatccaagggtttcacatccagatcaataaaatatgcctgcaacaacaaatgtgcaaatcaatgggttggtgggaaagaaacattaataaaaagagtttttagaaagaaaaaaacaattgttccacaaggaactagatgacttatcgaacttctcaaacaagaaacatatcacatcaataccttgtaatcatagctttggttcactgaatcaagaaatacagaatcgtactcagaatctgttgttccactctgtcttggtcgaaagctgatcattaggctacaatcttttgcagtagcagagataagaaagtccctgacaatcttctcactcttgtccaatggaagagaatgcaaggtggagtacttgcgcagaagttctgtatcagttatacttttgcataccaaacaaggctgagaaatgatgttatagtacagatgaatcgccccttcgatgtcatgatcatccagtttttgagtggctaaaagtttacccaacactccagacttaaagattgcctctgacaggagctcaataaagtcagatagttgtaagccagtaaccttgctcagatcttcaagacatttctctgtttcattaggatgaacactatctgcgccacctcccatgccaccaaaaactaaagaaccatccacaaaaattctaaagttgttctgaggagttgaaaaaaatgacttgatagccatatgtattctttcttttgatccagaaaataaatctaggggatcgtattcacttgtcttcgatatctgaaatgtgtttaaaaatatgtttagaaccaagctgatttgaaaagcaaaagggatgatatagcattgcaacttccaagagtgacagaatgaatatgaagcatctattaatatctgtttcagctagaagagtagtttgttgtctttcagtgagcaaaagagtagtgtgctattatatatttagtactcaaaattatggctgcggtgaaatcaaaatctggtacccaaaaccaacatacctctcccagatgaaattttaggtgctgatgcatcttataccgtgttacttgtttcttgatagaattctccttcgatatgtattcagatgacggaagaaatccacattttgcctggaaggcaaagcatgttaaaagaaatgtgtacaaaagatgaacagtgaagaaataaataaagctcaaaatgtacctttatctccactgctatgcaactgcttcctctaggattacctgaggtttagaaaaattaccaaaaacaaacatagtgttaaaaaacaaaatctagcagcgagttacgaataataatttagcaatggcgcaatgtaaaaaactaccgaatcatctttaatcattcaaactaatcaattttggaccaactaccaattttaggacggaaacaagctcttgcggatggaacagatcagagttaagctagaaattcgaaaaaacaagcaggttctttcattctttccatgtttcagaataatggagaatcttgagaaatataaattgtatgaatccttccaaacatatcccaagtttcacaagtgtcatggagaaagttgggcttaccaatcttgatcctatctatttggttgtagactagaaaaccataaattacaaacttgccactcttaacaaacaaataaggttaaagcatgtgatgcaaatagaaataataaactgagtaacagtgttgctgcaaatgttatatcataaagagttaatagatcaccagacctaactgatatttgctctttcttagtacaaacaagagtcacattatactcaaaagggaaagagatgaagcgttcaaataacattgaaacgccaagactttaccggaaaataatgtgtggtcagaaattagaagagcagaatcagctccagcatcaattgcactagcattcactctccatgcaggacggttgtcaagcacattctttccagcaagctcgaaaaagttcttagacacacgtacacggacctgaacatgaaaaagagaccacgtttattcattttagtcaagtggatccaattatctaatcaaggatgtattttcaaataacccgaattttccattaattatagagcaaaagaattttaaattggaaaacgttggttgatttatttctaataaatatcaccgtaacaacattaaataattggatttaaaacataccccgccatcaacatgattggcacccaaatgttggctcataacaattgtagcataggcttgtggcaagcaatcatttttaacagattccaacaatcctgggatcttgccccacagatgttcctcatgacttgagaagactatacagtttggtgccggttgtcccttgtcttttagaatctttttgactcgcagaaccttgccaagctgttcaagaaaacatcatcaaaacatttttcctgtaaacatatcatacgagggaaacataatactttggtcacaaactaaaaattttagtcaaccaagtcaagataagattattttctctttttcctctcttcttttaaaaaacagaagaaccttgctctccctctttccattacaggaaacaacaatgttgtagcaatacagcaaaaggaattgaacaaaaaaacaaaactagaccgggcaggcagatcacacaactaagatggcgccgccaccaccccttctttttgtgtgatcacacaactaagattattttcttttgaattatataatattaaagtgaaactatttgactacatgaaagctgtatgggattttctaatttacatatacaaacatttgccatttcaagagtgcagctctggccataggacatgcatccctgggcgttgcatcaaagttggtaaaacatctttttggggggaaatcaggcattcattaaaccggctttgtgaggaaagccaaacaaacagagtcttataggaaaataaaaacagctagctaaactaggacagaaacgactagacaccaactgctgggtcctagctagatcaagcacaaggctacatctccagatcacctcataaaacaccatccaaaacatctcatgaaaagagcttgaactactgtcgcctcccagacacccaaacattcatagctataatcatcagaacatcaaaagtaaaacatccttcttgaagcacatgcatcaaattcgccgatttacgggagactataggtcagtaaccaataatgacacaagcagaacctattcgatgcataccatagaaggtgacgagccagtgtagctgaggattagattcgctgcaccttctcctttgtaaacccaatctttggcatccccctcatgcagaaccacctccatccccacacagaatctgcaggcttccaagtatgagttcaaggtctattattcaaaataagtaaggaggaatagtaggcgaaaaacgaagtaggaggaacagaaaattgctgcttaacgccgagtaacacagcaaactcgagtccaagtgcaggtgcattcatttactcatctaccaaagagaagatcaagcgagaaagaagcaacacttggttcctggtcggtgcggcattccgtcgagcagatagcgagctttagttgcttaccagataacaacagctgctgcggccgtggggatcccctgcagccctgctccggcgatcgccgcagcagcagggcgggcgggatgatgcagcgcgctccaagcctccagctgccaatttcctcctcgtcctcgaggaggaggaagaggaagtggaagtggagccgacgatgaggaaagcggcagattcccctcccctgcaaggaaggattagcaaggggcaggaggagacgtnnnnnnnnnnnnnnnnnnnnnnnnnnnnnnnnnnnnnnnnnnnnnnnnnnnnnnnnn

SEQ ID NO: 45233 - DNA, 7806 bp, Oryza sativa
gacgctcagcctcgccgccggccgcccatcccggccaggccaggcccttccgcgccgacgagtcaagaggaagatttggggatttgggggagagagtaacggtggtggtggtgatggtatcggccgaatgttgatgggcctgtagcttgctaacttgggtttcaccggcccattcggctcaaccctggcaaattctaagtttctacttggatgagaaagctttatctctctgataataatcataatcataaaatcatgcgatttcaacgccaaaccaacatcgaacgaaaaaaacgccggaacctacactgccgagtcagattcaacattttacgtggactaattgatccccttacataggaatatttgaaaagacactcgaatgtaacatttcaaaagaacaatgcaaacattatctgaaaaaaaaaagaacaatgaagttagacgaggggaggcgaggtcgaagctgaggaagatcggtgctcgacaggccacggatactacaaacagcaatatagcatgtcaagcaagaccagttaagacaaaatcaaggggtttgcacccaagcaaccttcacaggacggtgaaaggaatcagcatttttcctaaaccaattgttttgctcttacaagatgtacggcctgatggttacataatctattcccagaatgttacacgacgcacaacaaaaaagaatgccgaaggaagcgatactctaaggaatggcaggatctgacgaaaactgcagtacagagttaaggtgcaacaagttttcaccccgggtctataagagacccaatttgaagatgtcgccaggaatctctcccacggctttcaaaatttcggtgtcagctctccaagttggatagctcatttcaagataggatgcaattacatcagatgatgtgcatgcctgtaatatctattgatgtactttgcctgcaatacagtagatacaggagttaaagccaagacaactatatgcataatcaactgttccaagatacacctgagctgcaatgtcacatacctttacgttgcttacatcaggggtgtctggagtttttacaggataaaatttgtaaaatttgatattttcaaatgcctctttgaccttagggtccatatcatcaatagctttctttcttgcttccttagcctgcataagatttggagaaacagttagtacttgaatgcattaaagtatctggtgaaggcaattaacatttcgtttgactatgacctgttttagctctcttttcctttctctaaccctctcctttatgaattcctgttaaaagaaatgtgtcagcagttaggaaggagtactcagtgaggtaattattatagactgactattcttctgacagcttaagcaaaaaattaagatgcaccttaaatttttctttctcatcctctggtagcacctcatctttaactttctcatcagcaaagtcctgcattgcaacagaatgactcaatgcaggtgcctttcataggaagcatcaagcaaaacaaccaaattagtacaaacctcgtaatcatccatctcccagtcgaagtcacatactatctgcaataagcagtacaatgtgaatacaaaataatttgatgactgctacgttatcaacattggaggcatctaggtgaacataagcaatacaagtaaatctaataaatatcaacattggaggcatctacgtgaacataataacttcagtgtttatatcagctaagaaccaagtgactcaggctacattatcgcttcagaacaatgaaatgtttgtatcaatagcaggaaataaacactgcaactaagcttccatccagtgactcaatagtgatcctgtttggttcgaggaatgaaatgggtttgtccatcacctcattcctcaaaagcaaatgctaagctattggatgaggaatggagccattcctcagattttgtgggatgatcctatgatggatcgtcctgtccaagatggttttcatgtggtgattcctcaaaccaaagcaacttgtaagtgaccagcctgaaagatcaagactgacatgattgcacaactgcctaccggtcaaacttgagtgtaggtggcatgaaaacaccacatgtacacctatgcaattatgctgacagactaagcaatgccataacgccagcccagcaagcagcaattattcgatttagagggaaacaatcagtacgtctatgcaacagcaattaagagggaatttataagcatgtggcagcagttaggaaataatcatcctggagcagcaatcgtagaggaaaacaatcagcacacagaagcaattaaagatgaaaatagtccgcatgcagaggcaactagaagcacacataaataaaccaaaataggaaatattttttcagattaatgaagcataaagaagtacacatctcctgactcaacagacacaagacaccaaacttcagaagcatccaactgaaaatagtgagggtgacaacaatacaacattgcaggagtgctagtgcgagaaatgacagcagcaaaagtcacgatttcatagaagtaggcaaggggaaccagcagcatgtgggttggttttgacctcacaagctaaggcaaatgaagcaccacagacaaaagaacacaaattcataactggcaatcatgacatggatgcaagcagcctagagatgcatacaaataagagaagatcaattcttagctgcaggaaacagtgaaacacgataaattttatcttctcacataggccaggtgcccaggttaacaatgcagtttatagcagtggagaagatacagctgcatctgggctcttccctaaaatgactagctgacttaatgaatcccaaatataggcctaattaagatcacaatccaagaaatttattttagttttgcccattacacataatattttaggtttgcactaataagatacctccataaaataaactaatagcttatgttgaggaaaatttattaggcaatactggaataacaaaaaacactaagagaagattaccgggggttctaggggatatatgatgttgacaactgtatcatcttcgtcttcgggagggttcagtggcatataatctgcaacaacattaaacgagattcatttgcagactacatcactctcagccattttcataaaacactctgcatcatataagtgtaacaatgtaaataaaatgatctgatcaaccagttgagcatgattgttgaccttgcgccatgctcacacactttataacaagacttacacagtgtgcctatgtttgtgccacaattgctaacattaaaggaacaaacaacactgaaaactggctcactacagacaatgttacatagctggaaagaagtgccttcctaagttaacacaggatatgtaaatggcatcaaattattatattaaaattaagtactaaccatccaacgcaggcaaataagccagctaaaaagcttatcaaagtcaaaaggcatggcagcaatagcatgtaaatatatctagcgttcacccattccaatgaaattaacaaattgtcatacagaaacagaatggaaatgaattaaagaatgactagtaaaaagcttcttatcccatggcatactgacattgcaaccatttaactaagacatcatcgatgtcttgcaggatattttgcaattggactggaccaagccaaggaaccacactcaagttaacaggcactcaaagaatcctatgaaaacagatatttgtacacacaaaacaggccaacagaaataatcccaagtcagcttacatggcatgcagtagtcaaacaatttgactctctcagttttgaggtgcctcagcgcagacctgcaaaacatacaaatgaggatactctagaattagtcagaaaaaaatctagggaaagatgttaacagtgaatttatgttgcatgcttctggatgataacgttccaacaaacaaacaaaaataaaatagaaccagaaatgccataaagcattaatcgcgagtaaggagggaaaaagcatgaattactaacctccgctgggtgcagccaagagtaaatatttttgttttcaaactgtcaatcctactaagcctgtagaccaacaaaaaagaatgagtaaaacacaaagctgcatatgatgattggtaaaaacagaagccattaatgagggagcaaggtaaggatacaggttctcaaaagaaatggtaagaaatattgttcagaattaatagtatgggagtaccgatcctccagcggaacataaggcacccaggccatcttcatggccttcattggcactatctcttcattttccctttggacagaatttatgccaattttgtctgagggaggaaaagggcagtcaacctgcagcacagaaaaggtagcaagtgctaaatgagattcaacatgaggcaagtaaatagtaaaatcagtaatatataaacaagtcaactgccaatgacgttgtaaccataaagtatccaaacaatgttttccaaattgcactgtatactcaattttaaagaggttagggttaaagagcaaacaaacaaattccagagtaaaatagtgtgataaaaaaaaaagggggcattgggtaggccattactgcagtgttctaggctatgctgtgctgccctgcccagccctgcggcacagcgtatttggctgctgcaggaagcagccgcttactgctggcaggctgcagcacctgtagctgctggctggctagctgcagctagctcttccaaacagcgccaaggaaattagtcccattggcttttatgaaactaaggtgactatgtttgtactggcatctttcaaaaatgacagaggtaggaagtacaaacatagtcaccttagtaaaatcaacttgttagcgatggtgcataaacgggataagatgttgagttggcataagcatgagataaatgttcagatttaagagtattgctaaagtggactgtttcctcatgcaaatttccatatcaagagaatggaagcgaacttacagcaacaactataggaataagcactatctttgattcaccattaacctccaatagttgagctgcatgtcagcaaaaacaatttaatcagataaactgtatcgatgattattaaacaatctggcacatcccaagaacaaatgaaaatatcagagacaagaaaacatttttccacgacaacacccaacatatctaaagtgcacatggtaaaacaaataaatgctgataccaatcaacttaggaaaggcagtagcaactcgaacattgacatggaaaaacagcataagaaataaatagaagtatggtcctaaaggggacaatttcattgttggaaatgtccagagaatctttcagtaatgacaaaaacatgcaagtgtatatctacaacaatgtgcatctaagttcagagaaatatataattttctcagggtgctactgcagtcataattagtgaatttcaggggaacaaacaaactgatagatttgatatttaggcctgtcaggaacgtcaaaaaagaaaaataacatggttcttgtgggaataactatttctgtgaaattaaaccattcaaaacaggccttcaagttatatgtcataaagtacacaaaaaaacaagctaatataatcagtttagttcagttactaaatgctagcaagccagtaggagaatatatgtatcacgaactggagatttaattttaaaactagcacgagtatgaaaacttacgctccgtgcttccaaacaagtaaactgttttcccataaagctcccctccttcttctagtgctttctgctcaccaacaggaaaccttatgtcatgctgaaagcaagtgtgataataaaaaaagagtagtattggaatactatctgcccatcgtacctccaaattttcaaagttccagttgaactcctttatcttatcaatgttttcccactgcagatgagaggcccggatatggataatagttagcggagcaaatatccatagtacacagttgaaagtatgtcaaaacatgcatcactaattgactcagccataaataaaaaagaaagaaatagataggcccatagaaagtaacaaacctcggtcccaaccggaaatgctgatagccaaagatcctcctgaacacagtaacacaatattagccataaaactataagtaatcattttgcctgtttgcaaagacaaactgattatgctcaaacgttccttttatatccatcaaacacatttccaaacaattaattgccctagaactgcttaaataaacccatgtgagttttcattgttccaataatagctcaaacttcacgataacaaattcaagtaatcgtttcatatagcaaagcacttcacaataaaaaaactattcctaacactgacttagaagaacataaactgtacaattcagtcccacgcagatgtggctcaaactctacaacataacattcaacacaaaaactattcctaatgaaatggggagcccctatagtccagccaaatccagtcacatattaaccattcgtatttcaacatcaaccaccattaccatcatttggactaatccgaccactacgaatctcgccgcagaagcagcaaccaaatacaccacgcggtccacaacgccaaaacgaatccagaccaatcaaaccccccaacctaatcggggcataacgaagcgaagcgaagcacgcatccgagacaggtaatcggggaagcctcctcctcaccagattccgcttctcggggaagtactccgtctccggcttgggcttgggtgacgccttggcacgcttcccccgcccccgcgcggccggcttcttcgcctctgcagcctccggcttgctggagtcctcctccgccaccgccgccgccgccgccgcacgcttcctgcctctcggacgcgccatcttctccctctctctcgattgctagggctagggtttcagcagccgtttcgattggggatcagtatttatgcgttcgaggggtgggggtgtgtgcgatttgggggaatcggcgcgtgaaatcgacgcgatccaaatttgaagcggggttggagaaggggactgcgtggggtgggggcgggggaggaggaaaatggtgggcggcgcgggccgcgtgcgtggctgtcttgagggcttcgaggaccgtccgatccgttttggaagatggttctgagccgtcggatttcagggtaggtgtgatggtccagagagggcgagatggtcgacgaccagtgtgggccccgtggggaagtggaaagcaaaacaaaattgctagtgccatgacatgtgggaccaccaggctcgttcaaaacgtggatgcctccatgggccgtgttgggctgtcgggcctctgcatgaactactgcacattatattatgagagtacctatacatctttcgaaagatttttataatcgtatcacacagatttttaatctttgtattaaaatccgatagatataataaaaagaaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcaaatgagatatagcaaaatcgttatattattacttttgggcttacagtaatacagtactaactactagtagcagtt

SEQ ID NO: 45234 - DNA, 1657 bp, Oryza sativa
  unsure (1)..(1657): unsure at all n locations
nnnnnnnnnnnnnnnnnnnnnnnnnnnnnnnnnnnnnnnccccgtggggaagtggaaagcaaaacaaaattgctagtgccatgacatgtgggaccaccaggctcgttcaaaacgtggatgcctccatgggccgtgttgggctgtcgggcctctgcatgaactactgcacattatattatgagagtacctatacatctttcgaaagatttttataatcgtatcacacagatttttaatctttgtattaaaatccgatagatataataaaaagaaaaaagcaattaagaaacaccataatgaacattaaattaccatatcctcaagaaaaagaccaaatcaaatacaaaatttaaaatttacatgtgaagattcaaaaattacagtgtaacttacaaaagttacagtgtaagtttcataaattacactgtaacttacaagaaaatacactgtaaatttgagtgagaaaatcgagtgagagataagaaaaaatctttcaaatgagatatagcaaaatcgttatattattacttttgggcttacagtaatacagtactaactactagtagcagtttatatctaaaaggaaaaagtacactttgactccctcaactatcgcctgagtatcattcataacctccaaccacaaaaccgggaatatcgaatcctccaactatcgaaaccggtgcaaacaatgtccctcggtggttttagaggtggttttgtctgacgtgacgcccacgtggcagtcttgaccgattctttgtcctatgtggcgcttacgtggcattagaataaaaacaaaataaaaaaaatatgtgggacccatatatcattcacacaaaaaaaaagtgttgtgggaccactaacatgtgggacccacatgtcatcctccctctccttcctttcttcctctcccctctctctcccttatttctctctcctctcggcctttctcttggccggagcggcggcatggacggcgatggggagcggcagcggcggcggtgggaacggcggcggcggcggtcggaatacgcccagaacctgttccccatgagtccacgacggtagaccacgcatatgcatcgctgggctatataaaggaccttagctagctcaccaactcgaacctggtgttagctttggttagttcgtttcgttcgtgtaggaggagagaatatcttcaagggcttctcgtctcgtctcgtgaaatcctcatggaggtacagtgcagccccatgtttctcttccccatctccatgctggctctccccgccggagcgctcgtcggcgtccccggtgccacgttcgtcgccatggtggcgccgggcggtggtgcttgtgcgatgacgacgaccgcgaggcgcatggtgctggccgcggcgcccagcgtcgcgctgcaccagggcggtggtggggggccggccggcgcatgccttcgccgcggcatcgtctgcttcaaggcgggcgacactccgtcatctggagacgacgaggctaagttatatatccaatccaccggccaccgcgctctttgtctttttcttttgcgcgatcaatgtcatcgacgatgtgtggggtgtgcgttcttggattgttcggcgcctagccaagaatttttctgccttggcgagggcgaaggtggacggctcggggc

SEQ ID NO: 45235 - DNA, 1364 bp, Oryza sativa
  unsure (1)..(1364): unsure at all n locations
nnnnnnnnnnnnnnnnnnnnnnnnnnnnnnnnnnnnnnnnnnnnnnnnnnnnnnnnnnnnnaattttggcaacattattaagccaatcctacaaaaaatttggcaatgttgccaattcgccaaaatttggtaaggttcattttagcatcaatccgaatagccacttcatatctacaccattagcagtttaaaagccaatagccaatgctaaaagtgcactatgataaaaagaaccaaaatcaaatcaaaaattaacttttgaaatctaaattttggctaatgagacatggaagcaccaatagatattgaaagaaaaactattgatcggtattattgctgtagttatttgttcctttcgtcgatgaaagtacaaccacccattttccacactttttcatattgacttaagtcagcgaattactcgcggcgaggaggagtttagctttgagagttggaaaggaaatagggcggtgggtaaggcctatttcaaaattttattggtgggtggtactatatgtgtgactgaggtccatcaaaactgtaggtgcattcgtctaaagggtagacccttgaattcactttgcctgctttcggcaattgcattcaactttacctgtctgtggggctttgactatggtgactcctcctttgactctaacatccgctgggtactttactttactttgcaggggaagatcatatagatatcaactcatcgacgaagtcctaggggctccctggccggggaggtaaaggggattgctatcatacatgataagctaaaatcgattatgttttgcttatcatatgatatgatatgagaggctaatattgattatgttttgctaagcatgtctaaagttagagttgttgttgtaatgtacatgcatctggtcatttttatttgatgcaactaaacttaactactcaactcttttgacgtaaggtaaagaataccaggaggaagtatttttgaaacactatctttcaaagcacaatgttgttgcccctcccttggaacattttgaatttaaagatgtgtgcaagctgaaaactaggtggataggaaaatgatattatcacaacaaatcaaaataattgcctgggtaggttagtcacctgaataacttgaagggtgtcaacgtttagctacacattgtccatgttgttctacgggtaccaattggttagtaaaaaaaactttaaataaatgactctaagatgaataaataaataacgtgaacttgcaaccaattatcaaaagtgggagttgggctagtaatcaatactttcactacacgtactttttacaagcatnnnnnnnnnnnnnnnnnnnnnnnnnnnnnnnnnnnnnnnnnnnnnnn

SEQ ID NO: 45236 - DNA, 4393 bp, Oryza sativa
gtcactctatctcgatactattagaagacctcacttttttgggaggaagggtggttggtggaggaccggcgatgagtggcggtgctttgcccatagagtcgagggatggaagcaagggcaacacgagcaagagatctagaaggaggcaggaaacaacaacggatctagtagtggcaaccatcatatacaaggaaggagagcaagacaagctctaggcggcgggttcgggacaaggaagggaatagctagggtttggaagggaagtgattatatatgagttatatgcggcacaagatccattagagccttatttggtgggcctcaatcccagcccattcacaccgcggactaaaaattttagcatccaagtagcccaaatgagatatcataatatttattttgtaaagctagcatttaaaagatgggtacacaagcccgattaaaaaaattagtctactataatgttggggaattggaaggttcaataagaaaaagaaaacttaaacaaagaatactctattggaaggatcaacatccaaataaaatgaaatgaatcattgagtttgcttgaagtgcttctaagagaaaacatggatattagtcgccatataaaggtgtactgtgatccttcacaaacacataactattacaagaaaagccccattggcctctgccttatcatagttggtctaggtcagggtcaatccttgcgcacatgactttcccaacaaagctagaacattgacaaccaatcatcaatttttttactcactaacatgtaaaaatagaatataacacattgataatgttgctaaaagcaatcaacaattaagtatgaggatacatgttaatccacataatctcaaccttagatggaagagcaagagaagaagatagaggaacggggaggggtgtgtggggaaggaggtacttcatctatcgtcgggtggtagcaaaaaaaaagtgagaccctacatcccactttgttgacatgccaatggcaacctacgaggattgttggatccatgctactgccaatgttgaaatatcacaaaactatggtggtttcgggaaagttggactataaaaaatcctatacatagctaatttaataacgtgttattgcactcgatatcttcgactaatttgctatacatatgacgtggatattttttgatctgactaccggtgctactagtattgctctaaacccgcttcacgcagcctttgaattaaaagagtgtacagaacttgggttatgccaataacatgtttttttaacacgcaggagatctgcgtatcattccactaagacatagaagaaaatgtatatggtgttagagaaagactcgacactcgcccactaaggatacaacagaacaccacacaaccaatggaaaaaaaataaactattgcattagcagcacagtcatagtaaagataccacggagcctagcagctcttactagacaccgaagagcgtcctcgttagcgatggtggctcaatgtacattggccaagcatgaggtacgtcgataacatattttaaaactactgtaataagtattggactctatgttatatgaacatggttaatgatggaaaaatttcctatactatttttactagtaatatgcccgtgctaaatgctacggtgcaattcgatttgtctttaataattgttaaaatttcatgttagcggaaatttttttgtatgatatgtgcatttgaactttaattcaattcatgtcgtacattaaatatatttatttaacgtaaaatataataatatgatactgcatgggcacaataaatctttacaagaattaagtatatataatcacttcagtatatagtacgctattatgttaaaaaagtgagttatttcattatttgttgcgggaacaaaataaagcattatttgcgatctggaggaggtgcaggagagaggctgcagtggttggcgatttgacggaggggaaaggaaaccgatcggtgaccgcgtgtgcgattatttgtgatccctaatacattgcaggggaaatctgttctgtgctgcctactcaaaggcagaattttctaagccaatctcattgtcatccaaagtactactgccaatgaactgacaaaagaattgacaaaagaattgatgaaccaaagcagtgacatacttctagacaaacaacttgggcaaactgagagagctcccatggttatagcatatggaaactgatcctacaataaagaaaataatttacactataatataagaaaccaacttttctgctacttgaagtttagaaactgaacttgaggtgatgtgtttagaaactgaacttgaaaccacggttcttgtttgatccacctgaacatctcacggttatccataagtacaaggcaaatatgagtagatggctaattcgctatggagcaaaataatactggaagactggaggttaccttctgttgtttgtatgtaatgaaatatgtgacacagaagacctcaagaaaagtttctatgtacggataagggctatggcttataaacatgttcatgttttttttccggtttgtaaattggtattctaacctggaccaggaacctaccatgagttttaatattaacataattgttttgcattggaataatgaatgttatgcaaacattatgcagtctcctgaaatgaatcatccgataataccaaagtaaatgaagcagcaccgcatttatagagaaaaaaaatgttttccctaagtagtcctacacttccagttgtaagaaggattcaaacttcagaaaaatcacccttccatttgtattcatgctttaaaattgtaaaattttatcttatattcttttctttttaccaatgctttcatacacttcggggatagacggcggagatgagacgaacatgggtagatgcatggcaacctacggagtggcggcagttagggttgggagatgccgccgtgatgtggtggtggcggtgcgtgtggcagcgccggttggtagtggccacggaggagatcggcgtggtgtcactggtgttgtcctcgatggtcggtggcggcacggagatgtcgagggtaggcttcagcggcgccggtgtggtcccccgaggtggatgttgccggatgttgtatcaataatccctaatcctatagggcaaaataagaaaatcaggaggaagattacggtggtgcaatgtttcatgaagcttattgcactttgcttaaaaatgaaccatcttggtacagaattagtcaaaagctaactgaagtcataagttcactttgaccaaatctgtcaagaatccagaaacagttggattgtcctaacatatgcatggagatggtgatttcattaatcaaggaatgaatctctactatactgataattgatatagatggtgcatcatcttaaatattctgtcactgccagtgaaaatcgaattttaaggtttgatttctgaaatgtgtaaaatcttaaataaccagatactatatattgttctttggagatgtttagacatgtgcagacagttatgcgttgttcatagacatggatactttagttatcattatctaaaaacatgaattctttagataccaaagcgatgctttcggtttttttcttttgattgattctggattatattaagaaccgtatgatcaaatcagcggcgactgatggggagagaggaaatatatataatactgcattgtggattaaaaaaaaggggaggaaggatgattactgtaccttaatttcggcgaatcagatcgaggatgtggtgacactgttctgaaagcagagatcggtggttgcacggagacggtcgacgagccggagattgggggcggcacggaggagaccggcgaggcggagttcctggtggagatcgggggcggtgcggaggagaccggcgagaagggcgatgaatggcggagtggcgagtggaggagacaactggcggggtgggagggcgggtacggtgtgcggcgcgcgacggcggagtgggcgatgcggtctggacggcgggtgggggcgcgagcgccgggagatgacgggggcggcgacgtgcataggcgcgatgggcgagagaactggcggaggagatggatttcgcgatcagaaggaaagtgcgactatttccgaggcgcaggggtgtgggaaggcggatgctattctagacgtcagatctcttagggataatctgaaccgttaagtgataaataaaagaataagtgaaagtatttcttgaactataccctaataacttactaatagcacaatctcacaatgattccttttaaaaaaatgcgataagaaaaggacacccctccgcacctcgtcgttctccatccccaaccccgagtgcagacgaaa

SEQ ID NO: 45237 - DNA, 1780 bp, Oryza sativa
aacaaaaaggaaatcagcctgaacgccggcggcgctcccgccgcgctcgagctctgctcctccgatggtgaccagatggagcgagaagggccccggcctcaagatcctgtggatctggaccctgggaaccgctggaagtaagcaatcccgccatattcctcaactctcgtctctccaatcgcacatagtaccacagactgcactctgatctgatgaattttcgtccgcagttatgattaccaatgtcgtccggacgcgcgtcaatgatatgcagaagatcctccaggaggaagacgaagcagcagcagccgccgcccccatggcctccggcgagcgtgtcctgaaagacgatgagtagaacaggtatttttctcccccattggtcgattgaactgtgttgtgtatcattcctgcaccgttaagttcagtattcaagaatcatgttataggatttgcttttctcgtgcggtgattgtgaagctcaactgtgaatctgggttcattcggctcctaattcgcagctgaaaccgaaaaaatactgacataattgattttaagaagttttgcttatgctaatacgggaagagttctgtcaggtcagagctccgattctggacaattacataaaccctgattcctatatggtaaaataatggcattcattttggtaggcactatctagttctgtttcagcagtatactgctataaagtctaaacagaatgaggcattatccagttttgtttcagctgttgtactggactactggtaaaactgcaatgtggaccgatgaaatttctacatatttctctccctctatggctgaatcttcattgacttttttgtgaaacaccaccattggtcacatattatggcttgtcgttgggaattaccaggggcgtagccagctaggtggcaccgtggtccacggaccacctaaaaaattaaaattatagtatatgtgctagttaatataataaaaattgtatagtggaccacccttttaattgacatattatatatagatggaccacttttactttaaatcctagctacgccactgggaattacaccagggcaatctatctccagagcatttatccatgctgctccatttcattaggctgtataaatggcctttcaaagtgcactctggaatcacctcaaacatgaagagcccttttttctactcttgaagcctgagcaccaatttaacgaggatattttttctgctgcggacaactgttgatagtagatagggagtggggtttaattggatggttgtaagcatgggcgtgcctccaaaatcatggctaaattatcttacatcaccatgtaaatttaagaaaaaaaataaacaactcactagttaagcactattttagccctactcttcaataatttctagctccgccactagttgtaagtaatacctttttttgttaagattgcgtgaagagtagcatgtgaaattgtgaatgggcaaacattttgagagctttcagagtgtttatgtttatgctgtctggtccactgatcctcttcgttttattctttatctactcccacgtagacatgtagttcatccaactcccatcccctgcccaccaggtgctaactcgattggtgcattttcaagttattagttatacaacatgtaactggtaagtctgctacatatagtgtaggtaattctggcaacaatcactttgttgttgcaaaacaatgtacactacctgctttaacatgacagttatcagagtgttttactttgaaactgc

SEQ ID NO: 45238 - DNA, 4703 bp, Oryza sativa
  unsure (1)..(4703): unsure at all n locations
acagccgcagatgtcataggcccatcttttcgatttttttttgtttgggtctgtgtgtgtataactttgattcatacagccaaaaagtgttacttgctgtaagttgtagcttgcatcagcttaggtttgagctgtgtaaggcaaatatattttacctttatgataagtatgttgtcaggtgtaccttttgtctagtgtcactttggccagataagacttaaaagagattttggggcttcaaaacttggggttgatctagtggaattattttatcttttaaatctttttaatttttaattttaaaataaatcctttcaaaaattatttccagaatctgaaccttttagccaaaccagccgcctggcgtggcagttatttggccacgccggtctagctaggcaacgttatttggttacactggctgcaggtggtgtgtcagtgatgtttttctacaccaagcgtgctggcgtgaccaaaagatttagattctggaaataagttttgaaagggttcatttttaaaattaaaaagttcaaaaaataaaattaagaaattgatctagtgttagtttctggatggaatagtatattagtatgggcagtaaatttttgtgcatcttcagcagcttaactgaaactctttttttttctcttcttattttgcagaacgtctctacttatcaaaattccctgaaccccgctgttgtgccaagctgagttaggtattgtttatctggttcgtcttagtggattttactggtaaaacagctacttgcttgagcggaagtatggaattacttgattcaaaatactgggtcgtctaccatctcatttagaactttttagatcttcatacagtgaattttctgttggctagaaagaaggtgatcgaacatcttcaggcatagctataactgagaatcctgagggtgcagcaatgagaacatgcagtgttcctcaaacatccagctggtaaaataacctactgctgcttctgtgtcgattactccctccgtcccataaaaaatcaacctcgtaccggatgtgacacatcctaggactacgaatctggacatatctctatccagattcattatactagaatatgtcacatccggtactagatttgttttttttgggacggagggagtacttctttgcaatatcctaggagtggtacccctccgttcaaaaaaaaaaagacaaaccttgggttttcgtgtccaacggttgactgtctgtcttatatgaattttttttataactaatatttttattgttgttagatgataaaacatgattaatactttatgcgtgacttgtctttttaatttttttaatattttttttcaaataagatgtatggtcaaacgttgtatacggaaactcgggatttgtcttttttttttttttgggacggagggagtaactggcaagtataggcggcaatggcagctatatgacatatcgacaggtcgagcattcagacactcctaggaacacgatgaaatgagaaatactacagtactagttttgaagagaatttgggagaggctatcgcgttgcaagaagggcatgcgtgtcctgtgattgccgtgtacatgaactagtagcttcgaagccttcgatcagcatcttttcctagctcgctcgttcgcgctggcagcgtgccgctgcagcattgcctcttggctctttgagcggtcgaagcgatgggcatgcgggatgtaggatgggccgcttcgtggttctgacagggacgcgcaacggcgggcaaatccggcgtgcgaatggcagggatacgcgcggaccgacgttcgccacctttacccgcgaccaaacgttagttcaagcctttttttttcctctcgatttcaaaaggccagttcatttttctaagggaaattttaaaaaccaccccataaatcacttgaaatttggtattatacctcataggtcattttgttgtaaatactaatcccctatttaattttactgcaaaacccatcccagccaagacgtcgttttacggaatcaacatgtttcataaattatgagctattgatgtggtctttaccaaaattaagtatttctagagtatagtctggacacctttttttttttggaaaaatccacggatagaaatggtcgtactgagtttcgctatatccgtaaaaaagagttcaacacaaacactagtttagcatatggtagctctacatcaatgataacagactgatttcgttaagcatgtgtatactgagcttttttacaataaactagttaggagatgatcatttgcaacaaagtaacttttcggttaggttttacagtttttctaaatgaaacgtgatttggactttcgacttattttgattgcggcaccaccatccaccgaaaagcatccgtcgcacgacttgtggcaggctgccatttaaataggattcgattcgcaactcgtgaagttgagtaatactccctccttccctaaatgattgacgccgttgacttttttaaatatgtttgaccgttcgtcttattcaaaaacttttgtaaaatgtgtaaaactatatgtatacataaaagtatatttaacaataaatcaaatgagaggaaaagaattaacaattatttaaattttttaaataagacgaacgatcaaatatttttaaaaaagtcaacgacgtcaaacattttgggatggaggtagtacttaatatgtcacataaaaaacgagtataggataggaggtgacacactagtactacggttttttttatgggacggagtcaggaggaatatatcgagtgctacggtacaggagcatacttccatgctcccaaacgtatcctgtgcgttgggttttaaatcaagggctcaaagtgagtaggtagtcgatactctctcgtcaatggagatgggcagcctcagccgccggacgccgccgcccgagataaaccgaccaaaataggagtagaagaagaacagcaaaaaaggaaaaaaaatgttgcaggtggaggaggcgctggcggccgtgctgtccgcggcggcggcgagcgcggcggcgcgcgccgccgaggccgtgccgctgcacgacgcgctcgggctcgtcctcgcggaggacgtccgcgcgcccgaccccctccctcccttccgcgcctccatcaaggtcaacaccttcctccccctctcttctgctccccctccttgccgccgcgcctgagggtgcttgggttgaaaccctctgcaggatgggtacgccgtcgtggcctccgacgggcccggggagtacccggtgattacggagtcgagggccggcgacgacgccctcggcgtggtcgtcacccccggcacggtggcgtatgtcacgaccggaggtgaggtggctcgctctgttccttccgatgatgcggcggtgatcggttactgaccgtggtttctcgggcagggccgattccggatggtgctgacgccgtcgtgcaagtggaggacacggagcagctcgccggcgcgccggatgggtcgaagagggttaggatattggtgcggccaactcaggggcaggatatacgcaatgtggtattgctaataggtttcgttgctttgcttaatgcttatccttacttgctttattccctcctacttgcgtttgtgcgacgatttgattgaaacaaaaaagctactatccatgctctgctcttctgctatgtcaattgcatcttaattcagtttaaattgttgatgtatttgagtggatttacttgtttatgtccttcagtggaagcaacattcttgtttgttattattgcgctattagctgtgtactgtagttctcaattactatgtacttctatagttcatgcagagcatttggtacagtattacttcatctggtaactgatgagttagttatttgaataaataatccatagggatgtgacatacaaaaggattcggtagtgctgaagtctagtgagcacataggtcctgcagaaattgggttacttgcaaccgtgggagtgactactgtcaaggtgaataagtctttcagttaccctgtcactgagtgcagaagagaatctcgcacaactgatcattttgagtatgaatctgcaggtatatcgtcgaccaaccattgctgtattttctacaggggatgaattagtggagccagccacagcatctctcagtcgtggtcaggttattcccactatttcacaatgtttgcatccctcacctttatctgcatttcatattcaccgaaatgtgtacttgctttgcagattcgtgattccaaccgggctatgttaattgctgctgctattcagcacaagtgcaaggtagttgacttgggtattgcaaaagacactgaggaaagtcttaaggagcatatggatgcagctctaagttctgatgctgatatcattcttacttctggtggtgtttccatgggcgatagggatcttgtcaaaccttgtttggcaagcatggggaaaattcactttgaaaaggtatcttggaaattcctccaaaattaggcgtgcaccatgcagttgtatggaagtacaaaccaggagttatgatatgcttttcttgtttccagctggataaccaattaaaacagttattgatggaaaattcttttagtnnnnnnnnnnnnnnnnnnnnnnnnnnnnnnnnnnnnnnnnnnnnnnnnnnnnnnnn

SEQ ID NO: 45239 - DNA, 5757 bp, Oryza sativa
cccacatcgtcaagagttccatcgtgcagtgatcagatgggtgcctgatgatggatctggtagacctgggtaagagctatattttaatatgatgccttatatttggcaatactgtaggtgataccggctgatgaaattggtcttggcagatatgttgctgaaagcacgggccaacaagctagtagccgcctcctaagtatgaaatctgcgaatgctttactggaagtaccattagtggggcagatgttggaggctggaacatctatgcaagctatacttatttctgatatgaccagttcaccttttgacaagctacccactgcttcaaatccgttgccatctcatttatttccttctgcaaaaagtgtttccacagatttgtctcaggttccagcctcacagaatactgaagttaaagtagcaattctgacagtgagcgacactgtttcattgggtgcaggccctgacaggaggtatttcattaagcgcctttttcctcgtgattgttgctgaaaagctgctgtacttttgcttgtgattgggttccagattgaatcagaaaagataatgaaccaatataaagtcttaccttttgaagtgcacgcatcctgatacacctctttgtgttgagttgcaaaggggtcacaccatgatgcaaaactaaagagtcgaattactgttttttcttcacataagatggtgatgcatctcagtaagggctccacatttcacaaggctgttattttttccatcggaacagtggatcaaccaaaagctttaattccttatgctgtcagcttagcatttttataaaacacatgtgactactttttcatgaatacttaaatcactgttgtttcttctctgtaatacaatatcatctgtagtgggccaagggcaatatctgtagtgaattcttcatcagagaaattgggtggagcgactgttgttgctactgctgttgttccagacgatgtggaaaaaatcaagaacattttggtgaagtggagtgacattgatcgtgtcagcctcatcttgacactaggtgaaaatgttttcattctttaagttagcaaattgcacaatccttatttttacagtgagatgagcatcaacttactttttataatggatatgcaggtggtactggtttcacacctagagatgtcacaccagaggcaacaaaatctgtcatagagaaagaagcacctggcctcacatatgtcatgcttcaggaaagtttgaaggtgatgactgacatttttctatatccccttgttctttggtttaacatggaaatccattatcatcaactttttctagagataagagataacaactaaccatgcatatgacactagggctaaactttagtggcatttcatttcaatagattttagtaccctaactttcctttaatctgagctattgaacttatctgtggtacaggtgacaccattcgcaatgctatctagagccactgcggggatcagaggatcaacacttgtacacaccatagctcaaacttggcaatttctcacctcactctgaaacgttcacatgtttatcaaacctgttgatatatcttttcagatcatcaacatgcccgggaacccgaacgccgttgcggagtgcatggaggcgcttcttccagcactgaaacacgccctgaagcagataaagggtgataagagggagaagcacccgcgccatgtccctcacgctgaagctgcgcctgtggaccagtgggatcggagtttccgagccgcgtcgtccggcaggggatgctcgtgcgagccatgatcggggccgatgagaatttggtcctcgcgggctatcggcgttcacttcgtcagcttgtcagttccttcgttagcccagccgcgttcagctcggagctaagcagtgacgattttggttctgctcactgttttgttttcacttcacccgaaccttacgaacaccagtgtgacaaataaagtggttacagtatatttgatcttgtaacttcggcccgtttagttaccaaaaactttttgcaaaagcattacattgaatttttgaacacaagcattaaatatagataaaaagaaaaattaattgcagataaaaagaaaaattaattgcacagttagcatataaatcgcgagacgaatcttttgagtctaattagtccatgactagctataagtgctatagtaacccaaatgtgttaatgatagcttaattaggcttaaaagattcgtctcgcggtttcaaggtgagttatgaaattagttttttcattcgtgtctgaaaacctttacgatatcaggtcaaacgtccgatataacatattttcatttcaccaactaaacaggcccttcaaacttttgtatacacggcacctgattttacagcgtcatagggtgggttctattgtggcgagttacttaaatttttttagtacagttcagctgcctaccacgctcgaatcataatgaagaacaacaatggagtagcggtaagcaagatggataggcgagccaaatagaataatacgaacaatctgcgtttcaagaaaaaaacataacagtaatcttcaaaactacaaaaataatcgcaagccagtacacacctactgggcgttggcgttgccaattttccacaatcaagatggaatacatgaaatcgaaaggtggtacatgtcatatttgcgtgggtcgctaggcctacaaaataattaagtacattgctctctgctaggctgctagcacagaagatttaatatcctctgtatgggcaaacctccagcttatctacactggtgatccgcgggcatcttgctaccgtgggaatgcgttgttcaatgaatcagtagaagatgcagcgatatgccacacatcgcctcacaaggatgtcgaggcatcttgaaatcaaaagtatcttctatcttcttttgactggagttctggatctggaacgcttcttcctgaaatgattagacacagatttaaagacaccaccaatataacacaaagtaacacagttactacacaagtggcatagggcagacagggttccagatttataggagttcacgcatttgcttcagtgtctaggattggaggcaggccagcatatcagctctgtcccaataaaacctgaattggtggcctctctgttttcagtggttttttaacattagtaatattactagggttgtttgctttggacgaatggatgctgaattgggcatctgccgatcctaactgcgaactttgatgtctagtttggtttgactttgggcaatgtagtgggttgatacaccaatatttttatcactcaaagcacaagcgtagtacaaaataaagtgacagttgttccaccaaaatcatcgaatgatccatgaagaaccaacctgtcctattcctaaaaccaagcagcccataagtgttatgcatgacaaatatattctagttctaggaaaaattttgtaccaagggtcttcaatttctcaagctgagatggaagtccatgcaataacaacttatgtaaatttgaatttaaaacacaaaggtttcatgtaaacccagaacacattttttaatcgggtacatgttcttaagacacctaaaggttgacttctattttctcaaactcgttaatatatttttctgcatctaatcaaattcctataatcagctacagtaagatcgaccatattactgaagctgagaactcctgaaaaattcatgtggaaataccacctggagtaacataatgataaaggaagaactgattaatctcttacctttccgcagatgaataaggcgaatgcctgcggtgagaatgcttgctatgtggagaccgcgaaactcgtctagagatgaaacataactaaatgggtaagtgaaaggataagagatatatgaacctgatgtttcttcactcagaagatacctgcacactcatatcaaattcacaaggcatagaataaaagcattcctatacaagacttaccatagcagatatgcgaaagcagtgtccttgaggcactgcctcaaagaacatgaatccagacagatagtacaaaatagttcaaccaatacatcccctcccccccaccccaacacacacacaaaaacaaaaatctcttatcctcgcatggggagaaaggatggaaatcatagaaaaaccatggcatgactagccgtattcatgatttaaaaaacatcaaatgctaagcaatttgtggcttccagataaccagaacagagtaagtatgtcagccacattattgatgccaaacataaaaacaacttttaggattaactaatgatgccagccataaaacaataccatctacaaacatgttgaagctaactgctaattcgcacatttttaacagcattaatctacattataaatatgctgtaaacatatagttacctgttcctagattttgggggtgagggggacatgctgcttttacatgaatgaagttttctgtaacagaaaaaaaaagtaatggacaaattaccacgcagggataacaattaatacaatacacattatgagaatttaagaatggcatatacctccttttcgaattatcagaaggctcatcacttgagacactctctcgatgtgaagaactctccttcttggtccgacttctcgcacttggtgatcttgaccttctactgctatgactacttgagccctttgtagtttgcctcgacctatcctccttttcatgtttccctttctctcttctatctgcagaatccctgcttttctctcttacgtccttttgataatcttttctctctccttttgcatcatcctgcttagagtttcctctggaacggggttcccttgtatcagctccatgtctcacactcctgtcagatcctttttcctccttgaagctaccctttttatcaatatttccatacatgctagatttatcatcatcattatatcttttggaagaagattcggattcttttcttcgaacagcctttggctcctttacaaaatcttcctcattgctgctcttccctaaatgcccttgactgctctccatattgctaaaattttcaacattattgcctgaaggtggaacttttccattttgggaatatccatgtgccttctcatccagggtaggagccacatccttcggctgacttgatattttggcatctgaaggaaattccctactatgtgtgtcatgaacacgtagctcttgtttaagttctgcacttgagttcctatgagacatttcatcattaaatttacgatcttcgcctaatgaagcattttggaccacagaatttctttcattatgatttccatgctgttcaccatcagtggctttttcacctattgattatttactcgagttaatatatttaaatggacaagtaatgctctgcaggtatttattttaagaacttaccttctcctggacgagctgcgccagctttagtttcagacgataagtttgaaactggaaccttatcctcattatcaccctcatcgtcctcatcatctgaatcataactagcaaggccaagaagagcgcctttaggggaacttaacccagtaccatcagaatgatcagctgagctaacattagttggcttagcagggacaacaactttagctgagacctttggttttgattctcccagacaggccccttcacactagaaactctagtgggctcatttgctacaatgtagaagaaattatcagaaatgcagaatg

SEQ ID NO: 45240 - DNA, 9942 bp, Oryza sativa
  unsure (1)..(9942): unsure at all n locations
nnnnnnnnnnnnnnnnnnnnnnnnnnnnnnnnnnnnnnnnnnnnnnnnnnnnntttttttaacaaattagtgaattatcttgtgaccattttgaagtcatataagtagtttttagtaatagaatagcaaactgcacctcatcttcttcatcatcatcagtagatttagctgaatctacgcttctgctgtcagcctgatcagaacttttaagtgttttttcagcatcttcagatcccttggagtggaactctgttgagtgttgcaccgaagcactcactgatgtagatttcttcttcaaaagttcttcgcgaagccagttaggcactggaggctggccataatagagcgcgggaatcagtcaaagtacttaggcacatgagcagacacacgcaggaatctcaaaaataagggtggaagaaaaaaggaagagaagaacaaaacttactttctttgatctttctgtgacattaaaaggagtgtttgcatccacagggaatgcttctgtcacattaccaactccaaatgctgcaggtggaatatagcttgaaccagaaactgctccaaagagtggtgcagcatgaactgaagggtccatctgtaaggtaaaagttaattatcatatctatggtgcagaggaatcatatggagtaataaaataatagaattgaacctgtgctgcttgtggtggtactgaagcttgaggaaaaagtactgtagtagatggaatccatgattgcgctggtgctgaatgtgcatcatgatcagatgctgctattggagctgctggaatattagaattgaaatttgctgttctgtgcactgccatatcaggagctttcctactattaaattctaaaggttgatcactgggatcaactgcaatcttggaagactgcccatcatgcccaaaatgaggttgttccagtgagggagcaatatgcatactggaaggcgcttgtggaaatccgtcttgcattgctgaggcagttggaggtagctgagtctgcgagcttggatattgaatcatagcattcccaacacctgttattacattgcatagtcagcattaagcctggataaaaaatgcaggttaccccatccaaacactgagttatatacattgagcacagccagccagtaattagcttttctaaaatgtgatttccatctaatttccaggactggcagcaagagaaatgaagattttcagtgcttcaaagtaaaaagggctcaaccaaacattcaattacattcatgatatatcagaggtaattattgaatccatgataaaatggcatagtcactgagaaagtgattctgagtagatatctgcgtattcctccttttgaaggtggtgaaacccaccaagcaatcgcctcaaatataggaagagtggagcatacacaaacaataacgctagctcaaatgtttttagaaggtaacgtgtgtcatatgctcttttttcttaaataaatagctctgtagacttgcaagtctttccatatttgaatctgaaggtattaccaggagggaccagccttaatatgattcaggctacacagtaagttatattgccaagcaagcatacctggagtagaaggataattataagatacctcctgctcataggcggatggaaatgaaccaaagttctttgctggtggcgccaatggacctccatctgcaatattatcttcagctccactctggaactgacatatccatatataacatatattgagcaatagtaataagatatggtacctggcagatagtttgtttccctgtgctgtcctgtcatttgaaatggcaactggtcattacttgactgagggattggcgggcgtaaaggttctgcgggcagaccagctggttgctgatactgatcctggtaaccgtaattatgaacttctggcctatttgcggatatggcatgctgttgaatatgatggttttctgtaacagatttagcagcagcccatgccttcgcctttgtagcccaatcttcctcatttccatgcccttccagatggggagaaaaaacaaattgaaaaggtcaatcctgaaccatcatcagtaactacattcttactgtaagggatttgtctgctccaagaaagcttagtactatcttattatcaattagtaccatcttattatcaaacatatgtaagaattcttttgaagcacagaccataaatacatctaataagcctatgcatttggtgaatcagaaaaggaattatttataagcaaaagttcagaaaaaagggataatgggaaacatgtgcatcatacacgctagttctcatgtaaatttactaatacatactgggaatgggcagaaaatagctccagatggcatagtggatacttgtttgatcaccgctagcgatgagccgatgactactttagtaaaaacttaaaggcaacttacactccccaaaattcttgaaacgcatgtacattcaataaacatttgtccctatgcatagtgttatgagcttaaacattgaaagatgcatgctgcatcataatgatcaaccagtgctgtgcatcagtaacaacacaagtttcattaacatccggttgtcaagcatactggaccaataaaattagatccaaatgaacataaagcttagatctaatgacaaacctgcgtatccatgactttgagcccacgaatgattggcccagccctaggaaataagcaatgtcaactaacaaaacattatttgaattcaacaaaagaacagataagaaaacagggtcatgggaaacattatgtcatttagattggatgttgaagccaactgaatgtaacctcaccaagagcacctaaccaaagctcatgaaggagtggcatcatatctaaagggaaccaaattgttccaaggcactaaggatttgccacaaagaatatgtaccaaaatgaagtaaagaaaatacaacaagtgcaggaggtttattgaatgcattctaaaagatgatttagaccttcaccctagatgatctatccatatgaaagtctccattgtgaataagtgagaactgtacaaggacaacactattcacacaatcatccctcagtgactcatcagaccagtttcacacagtcacaaaaccaccctagagttatagtcacctcaccctaatcaaacaccgtatcacacccttcccagaaaccctacagccaacagcgatcctgaactacaaaccctaacagaaaatttactatagtctccaacggcgactccaaaacgaaacaggatagcccccgacatacctggccggaggcggcggcgggtagctgggcggcggtggctgggcagcggcgtggtgaggaggccagggattccccgccgcaggaggcggcggctgcatcggcatcggagggagggagggatggtacccatacggcggcggatgctgcggcagcggcggcggagggtggggtggtccccactggtggtgctggggagggaaagggtggttggcgtggggagggtacggcggtggggactgcccggggtaccagtgcgggctcgcgtgggagggaggtggaggctgcggctgcngcggcggcggcggcggggggggcgtcccggagacggcgaancggcggtggtgggggtaggcgtccatggatgcggatggacgggaggggaggcggaggagagtcaagagagacacggacacgcgcagcggagctcggcgaggggctttaacccggctcggtttggtcggccttctgtctgagctctgggctcccgtgtctatgggccgcctgcacgtccacgttatcatgttatggacccagtttcacacggaaggcccaagccagaacacataaagtaacttatcttcttgggagtagcaatatttatgacatcatatttttcactagaaaatagtcaaaatattttcactccataattgcattcatgtacattgtaattaccctgtatttatcttgtaacttttatatagctacagtgtaactacaatatataactacaacgtaactataatgtactccctcagtcccataaaaaacgaatcaggaccggatgtgacatattctagtacgataaacctgaacatatgtatgtctagattcgtagtactaggatgtgtcacattcggtcctaggttggttttttgggatggggggagtaactattgtgtgattaaatacttttttaaggacacagggggggaggggggagtaactattgtgtgattagatactagtaattctcatattcaccttccaatgttttctttctcctctccgacttctctgtccctggatgacgtgacatgagtttgttgagcaatgaaaaattaaggagatagattacctgtccatattactacgatatgtcacattcagtactagattgattctttatgagacggaagaagtagacagcagcctggcagtgacatgtatgaataagttggacccgtgtaaaagaagcacgaatctcaacccacatcacagaataaaaaatggttgtttttgacgggaaaaatatgttgacacaatgattgcgaatcctttttttttctagctctataaattggtctctccaaataactccaacacgtcactgtcttttataatctctcacatacaacttaatttggtagagaacactctccatgaagtttattttctcttctaacctccacctctatctagttttcaataatttctcgttgtactgatcaacttctcacagcatgtggggctccggcgtggtgagcaaagttgcccctatgtcttttcttattaggcttgagattttatacaccacttctatagtagcatgtgtttgccgccatggttttaccaccgtaccactatggaattaaagagtacaaaagcataaggtgaaaggagaccgaaatacacacaccttttgtggcaagggataacttcaatcaccaaatggaggcctatggagcgcaagaagttgctgaaagctaatagaggtgggaagttggaagaaactaataaacttgtaaggagtgttctctatcaattaagttgtaggtgggagattggaaagatcagttacttataggggtgtatttggggtgaatagctaattaagcccctcaagtttcaccgaaggctcaatttggtcattcacgtttcattttgttcatatagctcatctaaatatttgttttggcttgacatcatccttgggcccacttaatatgccatatggctatttttaagtcaatatttctattagaaaatgtcccttttgcccttaatttatatacaactatatactagaagggagaaaccaagatgaataaacaacattgcagatatacttcccattatttcaacatgtgcacataaaacataagcaattactatcgtatacacttgctagtacttaatttattttcgttttacataatttactatatattatcaataaaaaaatcaagcatacaatttttctcttatatatgtgaatgatgggggtataagtgtcatttatcaagagagttgttggttcgaggatatttgaactaaaatgaaaacttgaaggactaatatggatagatgaaatatcaaggactaaactgagccttagatgaaacttggaggaccactttggctattcacccatgtatttggatttcccccactaaaaaaaaatcttccagtcttctactagtagagtagataaaaaataataatggaactgtcaagcaattaaacagaactataggttctaaacatcatgaaactgtatgcattacaggagaacattgaagcttttctaccgtcaagtccaggataggttcaatgtttaaagtttcacaaatcacaacacacaaacaggcaataaataaggagtttgcacaaaagccagaagtatctcccacggtcacactactcactagactatttctacaggtgaactgccaagtgcactctctagctagccaacttggcacgttaggaagcagggaagcagatacatcacatgtcttcacattgcaggcaaactcggctggtttccatctaagattagcagtgattccccaagtagcttttgtgcctcctctctcctcctgcgaaacaatagcaagaaaggtataaatctcaggaaagtgattcacgtgctttgtgccaatagggatccaaatcagtgatacataggatgaaaactggagtggttttcaatgaggaatgtaagttgcacaattcgcaaataatataagggttggaggtcaaaattgatctgagcctaaaagtcggcatttgttctaaaacagcatgcatgatcattgaagttcaacagccattcttagttagcagccctattcaaggtttcaagctaaagatacttactgctttatatcttcaattgcttgtttccgacgctgaatttggttctcaagcatgtgaatcagagtggctctggcctacaaagtattttgaaaagggaaatcattttggcgaatatagagacaatcattcatactgtgggataaaaactgagtctcttacttggtgaggtcgtaaggaattaagaaggtggtgcaagttcttgaaaatgagtgaaatatcctctaccctacgagcatactgtgatggtctttccactaaaatatctgctagctccaaaatatggagctgaagctctctgttcagggtccttagctcctttttgaaatctgcagataatcagttattcaaaaagccagctcgttaaatcaaagaatacaaaagttgtttagtgctgaaagtaacaacacaaaccatttgttcagtatggccagaagtgtaggaagcttaccatagaagcccgaataattttaacaagtcacaatgtaactattgaactaaatatgcagtcaggagttgcacataccgatatctgggctcttcggataaagctgacgaacaccttgatcctctaagcttgggagcaccacatctgtctagagagcatataggcaaaggcatagtcagtttaacacatgtaacaacataatataaagaagagtacaataagcaacatactgtgtaggtagcaccgaagagttgatatggtccatcaactggcggtggaggttcaggtgcagatgaaggatccttttcgtaatccttgtatagtcggtaatatggaggaggtggaggatatgctgatgatgtggccatgccaggtacggaaccaactcaacttccaagctgtcacatcacagaatctgagaatcacaacttttgatgtggcctatgtttccttaagctcaataaactgaatctaatttgaaactattgtttacatgtaaaatggaaaccaaatcatcttcacgctagaaaaccagtcccctttcattcagatttatactttgttttaagaatctgtggtcaaatcttctgggtaggtattgcagttgcagttcttgcaacataatacaaacattacatttaagagattataatttgactcactgaatcatcaaaaagcaaaactaatcagttactcccattactaccaatttacagatgcaaattgcaaaccaaaacaaatgcaaggacaactcgcaccgatttgactgattaccacgtgatcacttaccacgatataaaacccagacaagtcgactagtacagtcgcaccaattcaatgttgaacacgcccacgagaccattacccacacttcacaacccccacgcctacccacaggacatcaatcccatagatgaaaggaccatagagatgatgccaaggaagaaggaagcagagggagtggaacagggggaagaagcggagcggatttcgcgcccgaccaccctgggcagctgcccagggtaaatggctcattcgcttgcagcagtgaatgcattgcactgctctgcgtgcgtccgacggttgagcagcaaacgttggcgcaatggcgcgggcagcaggtgtctagcagagtagcagggcgtgcagcaacacaagtacacaacaggcacatggtacatgactctatgcttagactatcttatttgggcgcttggctacttaattagcaggcagatgcaaaggcataccagcaggagcaaaatacttggacaaactgaactggatttttcacctgtgctaacactttgctcaaatttcatactgagaagttgatatgaaagggaccatggcgaatcttgtgtgagtggtctttgcaagcacttgttaagttgtgttcatcggtagacttgcccaggctcagaaaaatttctggccccgccaagcaagcgcctaccggcctgattgagatggctatcgtgttaaagatatcgcggcaataatacgaactaaatttcaacaaaccggcgagagatctgggcattgattcaaccaatcgagatgcaaattggggaaatttagggtgcagaatgaaccagagttagaggtgagaatctatacccggaatgggaaaaacatgaacagttgtttggacgaagcacagatggggatgccaacctcgaggaagggcgcgagagcctccggcgagcggcggcggcggtggcggtggcggagacggagacggagacgagcgaccgaaccgacccgaagccgaaggcgaaccagggttgggttggtggtcatgggccaaaaagcccaactcgatccagtgagcttcatctggaccgtccacttgagatcgaacggtttacgaggcttcaatccgagttcttttccgtttccgtccctctattaaatccttttttcgaagaggcgcacccctaccttccgcctccgcaagaaagaaagaaaaagaggggaagcaaagcgcagaggcggccgtcgcagcagcaacacaagtcaggggaggagagagaggccgcgccgccgcagatctgtggccgcgttagggtttcttcgccggaatcgagcgaggaagtaggagggagaggaggaggaggaggagggcgacgagtaggaggcggcggcggcggagatggacgtggtgaaggcggcgcagctctcggggcggacgctggagaaggtggtggtgcacccgctggtgctgctcagcatcgtcgaccactacaaccgcgtcgcccgcgacacccgcaagcgcgtcgtcggcgtgctcctcggcacctcctcccgcggttccgtcgatgtcaccaactcctacgccggtaaaccttcccccagtactagggtttgcgtgtctcggatcagcccccttctgtttccaagggatctgcgctgctagttcgccttagggttcgcgcaactggtggcggttgtgggtatagttagatctattggcgtgaattgcgttgaacctgcacaattagatctgtggagttctattccagtgacgatttactgtatttatagcatgctatggcacttggttttgcagtgccgtttgaagaggatgacaaggatccgaggatctggttcctcgatcataattaccacgaatcgatgttttccatgttcaagaggatcaacggtatgcagtttgcaagtcttccatttgtttgacctgccctgtgtaactgattgtgttgtactgacgagctgttcttcgtgtagccaaggagcatgttgttggctggtacagcaccggtccaaaactcagggagaacgacttggatatacacgcactattcaataagtatgtgatgtacgaagctttatatcctgtattgttcatgaagttatattcttgactagatatgttgttttggtgcaagtaatctttattaaattgtctggcacccaagttataaagcactgtagacttttcagcttgctagtataacagaaggaactgttttatatataacctagattcaattgctgtttgacttccactgttaacatgagagcaagtcgaatgttgtctgtgcataaaactgtggccctactgcactggactgtaagctcctcagaa

SEQ ID NO: 45241 - DNA, 10827 bp, Oryza sativa
  unsure (1)..(10827): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatattggtatgtgcttttaaatatgttttgttatatagtccttaaggagatactatgagataccaatttttatattgtaaatttggtatcacttagtatctaggtactatgaggtaccaaatagtacaatttggtacttcatagtaccttctcaaagatcgtaaaattgctcaaatttttggtacctccttaaggacggtaaaatttctcatacggtaaagttttcaagctttgaccataatgaaaaaataatttatatttatcgattttacggttctagagaggtatcaaaaggtaacacatttgacactttgattttacactagtaaatgtggcactttcaagtacctatgttcaataaaatttctcttgattaaatcatccatttacaagatattgcctcgttaattctacctatcatacccttaactattgatgattcataggtcaacaatgcaggaattttgggggttacatttgattttggcaacttagatcttaataaagcggtgagtatatcacgagacgacctatattgtggatcaagagtactgtgtgctgcgaagttaagtatgtttcgtgcaacagattgagggcaagagtgcaaacgagacgctggaatggttgatgcaacacaccgtggagactgccgagaatgcagaagaatgcttgaaaataaactatcacggcaacaaaaaaccatacaagcactccttcctctcctccaatcatcacctgatggaagaattgtaactgtttcctctgtttttggacaactatcggtatgtacatatgcacacattttagttataaatattcgatgtgtagaaaatgattcagtgagttaaaatttcaacatcgaatttaactagaattagcttataaaatccaataaatttatgatattatgatgtagtttttgagacaaatctacatgtactatttttttaaaaaaaactaagcatttgagaaattattgacagttaaaatttaaaaaagataagaaaatcttattctaaacaatggtggactgaacacatcaaagcagcttgctgttctcttaaaactaatctagtttcgatctgctccagtttttcagtggggagaaactcaaagaggagctcaacgatttcagcaagctaagcgaggagaggatagacgagctggcagagctgttcgtcagggacttcaaggacggagagctggagtcccggggatggccagccagagccgacgcgttcgcggcctacaagacgtccaaggcgctgcagcacgcttacacgagggtcctcgcgaggaagcacgcctcctcctcctcctcgccgttgcgcgtcaactgcgtgcatcctgggtacgtcaagacggacatgaccctcggcaccggggagctgacggtggaggaaggcgcggctggccctgtcgcactggccctgtcgccgccgggaggcgccacgggcgtgttcttcatccaaaccgaaccagcgtccttcgtctgagcgtgattcctccggaaaatcagacgcagcttgtttctcatatctaggggtgggcattcggtctaatcgagaaattcggttcggttcctcggtcttctgaaaaattcggtcttcccaaccacaagaccgatcggtcttaaaaaaactcaagaccgagcatttcgatcttcggttagttcggttcggtctcggtcatagaccgaactagccatagcagcagtttaaacagcaaaaagaattaataaaaaaaaactccatacaagatcaatgaatcgaagcaactcggatgaagaactacaatatgatgccactagagcatgattcagaaaaaacaagaagcaaatcaaagcaaatcgatctccacaattccacctcaagctccagatcccgtcgatctcccaccatcgctttcatccccgaccgacctcctcagccatctaggtctccagcgcaggtgaaagggcggcgccgaggcggaggcgtcctggctggaggcggcaccgaggcagaggcggcggccgcggcgagatgggtcggagggcggaggcggcgccgacgcagtgggtggaggctggaggcggagggcggaggcgacaccggcgcctgcgcggtggaggctggaggccgagggcggaagtggcgcggtggagacggagccgcggaggccgagcggaggtgagcgcgaacgtgcgatgaatggggaggaatgcggtgctgactcatgaggagggagggtggggcgtgacgcgtgggggcaggcagtgagagagagggtggaattagggtttatgttactaggcttattgggcctcctaagtttattgggccacaattcggttatctcggttaattcggttaaccgagcccaatgaccgaaatacccgaaataaattcggtcttttgatggctgaaaccgaactactaaccgaatttctcggtctccgtcttttcggttcggtctaaatatgcccacccctactcatatcaataagacaatgagcacctttacggtggtcttcaactctccgtaataacggtattattatcgattataagtggtcccaccgtcccaagggttaatttataagttctacttcaagtagaaaaatggtttttctactgtcaatagttaagtagtactataaagaagattgtaaattctatcaaactataaagctaagctaacgtccattaacttctaaaactcaatatgcaaatatgtgacatcattacctcttagcaataattattatttagagtattttaaatatcatgcaaatatgatatattatttacaattttattatatttttagaatttaatatgcaagcaatgtccaatcattatctccacatcatttcacattatttaaatatatacatctatcatttctattataatacgcgttaatccatatataccgcaatgaagcgcatggtatcaactagtactataaatagttactataaatcattgcaaaatacctctaattaagacaactagcatggtggcccccgcagattgcgcggctagtatcattatattttctctcatataatacatatatgttttctcaatatattattcaaatatattaaaatgacaacataattttaaattttgcaataactttatgaaactactaatgtataatattcatgttgcattttatatacgtattagttattaattatttttaatatcaaattttagttatttgtaaattatatatattcctatatagactctagactcatcttttaatatttcttttttttaattccgaattttctgtaaattgtatttctatatagactctaggctcttcttccaatattatttatttttatttctgattttttattatttcaaattgtatttctatgcggactctaaactcatctttcaatattctttaatttttaatttcgaattttagttacttctaaattgtatttctatattgactttaaactcttcttcccatgtttttcttaatctcgaattttagttatttgtaaattgaatttttatatgaattctaaactctacttttaattttattatgtttattccgaactatagttagttttaaattcctatatgaactctatactctacttctaatattcattattttttaatttcgaatttctatttttttcttaattgtatttctatattgactctatattctacttctaatattccttatttttaattctgaatttctattatttcctaattgtatttctatatggatatggactctataatctacttctaatattcctttttttaattccgaatgtcaactatttctaaattgtatttctatatggactctagtctcctcttctaatatttcttattttttaattccgaatttcagttatttctaaattgtatttctatatggactctgccttttctttttcttcgattaatgtgagaatttttagaccatgagagcgaacgtggagacttctttttatatttattccgaactatagttagttttaaattcctatatggactctatactctacttctaatattacttattttttaatttcgaatttctatttttttttcttaattatatttctatatggactctgtactctacttctaatattccttatttttaattccgaatttctattatttcctaattgtatttttatatggatatggactctataatctacttctaatattcctttttttttttaattccgaatgtcaactatttctaaattgtatttctatatggactctagtctcctcttctaatatcccttattttttaattctgaatttcagctatttctaaattgtatttctatatggactctgtcttttctttttcttcgattaatgtgagaatttctagaccatgaaagcgaacatggagacttttttttctattcctttaataatataatagataattgaacaatgtgttggggcaaacaaaagaagattgcaatgaacagattcttgccaatgtgccaatgtcatggctccatagcctcatacagaaataagtacaacagttgcagtttgtcaaagaaatgataagcaagttttcggtctttaagaggtggaacaaaaagaaagaaagaggaagcaagggaggataatacatcaaattactagctgataattgaggatttttcttatgtctatatatatatatatatatatatatatatatatatatatatatatatatatatatatccggttctgttttccccctaatctttgctctatgtcgcgtcttgtgggggcacttcctgttctttctcgctggcctctgtggccgccaccggtgcagcctcctcggactctttctgcttcgattgtgcggtctggatcaagtggttgtagctgcccttctccttgaacagctgcgagaaatggatcttgcagtagaggatcccgttgagcgccgcgtagaaagacgtcgtcaggatgcagcccccatgcgagcacttgaagcaactcttgtggtaagactcaccctccagagttagctgaacaaaaaaatagattccatcaaatcagattggtttagagcaggtacaatagcagactataagccagctataaacatattttaaagagataaaaaatgagagataagagtagcgggctacaaatttgttgccagttgtagcacatacgtaagaatacatgtgtgtatgacaggtagaaccagacattaattatgtagtacatgtttatgggtaactattgtatgaattagctattaaattgactatagatgatttgtagccaatagttagctatactattaaacttgctcttatactcgttcaatttcaatgctatcatctttttaaattttctttaacggttttgacagattgaaatttgtgtgacgctactttgcggtcgtaactaggcagcattctgtaccttctccaatgggtacacagttttttggcaggctgcacatttatcttgagttccagagaatgctgaagatagcttgctaggagctcttccctggaaaaagtttttgcagagtgaatagtttgcggattatcaaatttggtgatatataactaataaatgcataatgtgtgaattgggctataaacaggtctgtggggtttgtacctggtcgctcttctctgaagatttaccacctgagtaccgggacagagagagaattcagaacacaataacttctcaataatgtccaaacatctcgacagccactgtgtcttagcattaccttgcgagaatttctttgagaagctccccgtctctttgaagagctgctcaaagtgcgtcttgcagtacaggacaccatccatcgaagagtagttacacatctgcagatgcgtaaatgttttgaacgaaaaatgtgatagttgatttaattacctaataaaaactgaacatgttgcagggccgatcgatgccatatatacataccgagagggtccccttgcagtggctgcacttgaagcatgtcttgtggtaggagacgccgtcggcggtgaggaggtcgatgaaatggacggtcttgtcgcacgccttgcacttgtcctgcgtgccggtgaacgacatggcggccggggtacgtatactagcaccgggtgattcaccgatcggtcgatggaaaaccttcaggcctcggtctggtccagctcgaggaatcaccgtagctatagcttcccaactcccaactcttccgatcgatcgacggaggagatcgattcagggcgagacgagaggaacgtgggcgtggcgtctccagagaagggagggaggagagatgggcagacagcaacgggcgatggtttaaagggcggggcggcgtgagcacgggagcaaagataggagacgggatgggctccgggccacacagatgacagacggacgaacccggtcgtgcaaaccgggagagaggcttgtttaattttgggaggggcgagcggacaagaattttctatgcctattctatgcctaggtgtcatggcatccatcatttgcatgtgatttaaatagttatagaaaaaattaaaacaatcaattatgatgatacaagtctatacacaatcatacaagaactgaactagagaaacaaaaataataatatcagacagtgaatagtacccgtacaacgcagataaaatttgttatttttatttcttcatatgtagattgattttagacttacatgtttgtatagtatcttatattatcgcagtctatcttatctaattttataatatttttataaaattatttaaactacatgcatacacctagacgccatgatatttgggtatagaaaatattttcccaggccttcacacgggggcgcgcgctcatgtcgcgcgcgctcaactccggctgtggtccttcttcaggtcgtgcgagccgcgaaatcacaacgtggctccatggatctctgcgagacactgtcgtgcggggcagttcgttcttgattatgcagatctctttctggttgggtttgtgtactgggcttcgatccgctctgctcacgacagtctgggtggacaagcgtacatatctgtcacagataggcccgtataggcccatgaccgaataaaggaataagtccattatacctctctcaattattcccctttgtcgaattacatccctcaaccacaaaaccaggtatattacctcctctaagtgttaaaaccagtacaaaacaactcccttaatggtttctgacggtggttttgctgacgtggcatcctagtcatcgaaaaaaaaaattaaaaaaatacgtgagggcccacatgtaagtggcatttctactcttcctctcctccaccactctcctctctcctcccccttctctctccctggacaggggaggcgccggaggcgcggaagatgtggggaccgccggaggatgcgagcgcacgccgcgagggagaggatccactatcagcagcagcagatgcaggtggtggcggcggtgacggggaataggaggatgcaggggctagggccgaagcggagctcgaacaaggaccggcacaccaaggtggatggccggggacgacggattcagatgccggcgttgtgcgccgcctggatcttccagctaacgcgggagctcgaccacaagtccaacagcgagaccgtccagtggctgctccagcaggtggagccggcaatcgtcaccgccatggggacgggtgtcggcactgacatacaggggccctccatccctttcccaaactgcgccctctccaggtcgcaccaccaccaccaccacatgtgggctgccgccgcggcaccgcccgccgcgtccgcggcgttagccggtgccacatcgggttcgcgaccatgtttgccggctacgtggcggcggccatgccgggggtagaactaggactctcacaggacggccacataggcgtgctctccgcccggtcgctcagccagttctaccaccaggtcggcgacgctagtgccgccggtcaactgtcgcacccacaccaccatcaccaacaccatcagcaatagcaggaggacggggaggatgaccgcgatgacggcgagtccgatgaggagtccgggcagtagtaggcgcaccgccaattgttcatctatgcgtctcacgttgtctctttggagaagaaaaagagaattccaggaaggggcatgcagctaatggagggggtatgcttttgttactgttgggttgttcttcatggggatttttatgtctgatttttcctcgtgtggtgtcgaagctggaagaggctactacttgctccagcgacttgttgggatggatcatgatcatcttcagttgttactcctgctgctccatggatggtcgccggtttatccccctccaagtgtttaggtgaaagctcaatctttttcactccacagtcagcacatgacatgctctttgaaaggtagcttgatgagcttatgtattttgccggaggttggcggcgcgaatagacagcgggaggatgcgttgccggcgagcagatcgacgctgtggcaggtgaaccctccccgtgcgggcgccgcggccggcgatcctctccctcgcggcgtgcacccgcatccttcggcggttcccacacctcccgcgcctccggcgcctctccttgccgtgctctgttcgaggagagagaaggggaagaagagaggagagtggtggagagaaatgccacttacatgtgggccctcacgtatttttttaatttttttcgatgactaggatgctacgtcagcaaaaccacagtcaaaaaccaccaagggagctgttctgtactggttttaacatttaggggaggtaatatacccggttttgtggttgagggatgtaattcgacaaagggcaagaattgagggaggcaaaatggacttattccccaaataaatatcaggccagatacactttaattgctttgtataagcgcaatgggctagagatatacacgggccataaaatgcacaatcacgtgctttgcttgcttatgcgaagaagaaaaggcacgtcaaccttttctttttctagatctttcatgaacatgtttttgaccgtgatacggattggtagatttgtctagagctattgtcttctttaaaagaaaaaaaacagcacagaccagtggcggaggacgagaaaaaaataaggtgtggcagcatcaacacagcgaaaacaacataatagggcgaacgctatggatttgtaatgtgctcccatgcaccgctaaaagttactgcaaaaattgttttgatgcaacaaatcattttttttgaccgagaaaactaccagggcttttcctagtagtgtattttcattaaaacaaaacgtatgtacaaagatatagggaaaaaggagcttttaaagagttacaaagtttgtatccaatcaagaactatttgttttcaaggctccttcattctacaaatatgcagaagaacttcgtttctgaataggcgtttccacgactgaaaggatggcacaacattctaaaatattagcccatttctctgtttccaaatatgccaagaagcgatgaaaaagatttcgagaaaaccttttcgagcaaaattcaatcttcctaagattatcatttgaaagaatcctatatgatgattccagttaattcccaagtgttgccaacacctaacactgaaaggacaagtgaagaagagatgaagtctggtttctctctggcctgcattgcataggacgcaagttaaatcatcattctcttttgcacaatgcctcctgtccggcatatcctagtgtttagcttgtcactgaaaagtagccatgcaaagaccttgattttcatgacacattttgtcttccatagctagacaagaggtctggggggctgcagtggcacaaagttgagcttgtataactttttttgcagtgtatgaagatgaattccaaataaagctccaactatcaccttgccctggctgcaagtgcaaaaggttaagttcttcttccagcagcaggaattcctcatagaccagggcagataaaggtagcaagaaagaatcctctaggggtcttgtactcatggccaacacagattcctctttatgaatcaccagacagtagagtgttggatacttgctgctcataagaccatcactccataaatcttcccaaaataaagctgaggttccagttataagagtgcatttaccaattcccctgaaaatatcagtgagggctaaaatgtccttcagccagaaagaacccttgttaagacacatgtgggggactcttgcaagatagtaaattttccatactaagtcaacccaaggcagatcaactccattgtaaagtttaactaggtgtttcataagaagagcacaattttgaagcttcaggtttaccactctcaaaccccccttttcttttggcctgcaaactaagtcccatgaacccaaggatcttcttgtggagtttgggttatttccccctccaaagatagtttttccttgcattatcaatcgatttgatcactgtgacaggtagttgcaaggcacacatgaagtaagttgggatggctgacgggactgaatttatcaaagtgagacgccctccttgggggagaaacattgaacttgttgttaatcttctttccactctatccaccaaagggggtaccgagctcgaattcgccctatagt

SEQ ID NO: 45242 - DNA, 24119 bp, Oryza sativa
  unsure (1)..(24119): unsure at all n locations
nnnnnnnnnnnnnnnnnnnnnnnnnnnnnnnnnnnnnnnnnnnnnnnnnnnnnnnntctgggcctggggctttatctgcaggaataattctaatgagagtatccatttcctgagtgaagaaaggatccacagggttgtccagacaaacatgatcagggaaaagctcattcaaatcaaaccccattgtgggcgaattagagacacccattctttctctaaaacttttatagaacaaagctgctttctgctcatgcagggtgaccacctaaccatcatggtcctggatttgggagattgagttagctctatatatttatgtagcaatggactgaaagaactttgtgttttcttcacccagcaacatccatctattggtgcatctttttttccagtacattttcctgaactctaagagcttaattatgtggcactacacaatctccctgaaactcctctcttgtcagagacctggcctcctcaacaaggtctagaaaatcaactgctcgattgcaatttgcaagcagaacatttagtttagataaatttttgctccagcttaacaaccttttcctaagcattttaagcttaaaagagatgcattttgcagggtcctcaaagtcaggatccaaggcccaagcagaattgactatatcaaaaaagccctccacctctacccaatagttctcaaacctgaaaattggggaccttggaattttagtatcaatcttgaccacatagggcacatggtctaaaatgtttctagtcatgggtagcacagatgtattggggaagttcagtgtccaggaggcagaagtgaaaacccaatccagtctttcaaggagagggttttgttgcatgttactccaagtgtacctcctgcctttaagagggatttcaagaagacctaaggagctgataatatcattgaaaatgaagatgtcattcatatcaactccagccttattcgtgtcctccactgacctgtaaaagttaaaatctcccaagaaaagccaattctgctgactttctatgtgaacattctgcaaccaggcaacaaaatctgctcttgcagggccagtacaagaaccataaacacaggtgagagaccaaggctgtgaggattgtctggaggtgaagtcaacagtaaccgaaaattgattgacctcttttgccacccccatgaacaccttaggcaacaaatcatattgatatgtgttaggattcaaaattcccgaatgaaattttcaaaaaacatttttgtgaatttagcaaaatatatccaaatttgatcacattttgttcaaattttaaattatttttggaagatagaaattgccaaaccgatagattaaacctttatctcggttgtgttatataactactagcgcttatataggtagctaattacaagaagtaaaaacaagataatcggtataggttggtttgctttgtgtaactaactaacgacaaagtcagaccagctaatcacgcatgcatgcactttacctccagtgaagaagttaatccagctaatcacgcatggatgcactttttacaacgagtgaaaacaaggcaatcagtgaagaagtttatcatgcatgcatgctatttaccaccagctaacggaattgaggtatggcgagtgccatatctcgtcataccggaagctccgccactggcacaggccatgcacatcttatatagtgaaagcagcaagctttcttacacgagaatgtgccacatcatcaaaaacatattagccgtcggataaatagttcggataaataatagtcattggatcgaaagagtgcatgtattaaaaaaatcacaaatgggctaaacatatggaaatttccagaggtttcgagtatctattgtcctagcaagtatagatactttgtaaacaaattaacttatatcaaaaccttattaagagctaaggtaaactaatagaccatatataaaagttcttaaacaggaccaaaagttgcgcaaagcgtgactatatggctagttttattgaatatagtggaagaaaattgcattccctaaacaccaagggttaaagaaatccacaagtttgccatgtacagatatagctacgatcaagaagatgttttaccgctgcaagcgtccacatccttgtcttctcctttatatttgcaaaaggccaggtgttgaggtctttttgtgctcgaaggtttttggttccttactttctatatctcccacacgaccaacaggatgagcgtgcacatttctctcttgggcatgccttggtgacttgcgagcattttccaacactcaaacattgatctcggactccattggcttggtgtgacttgttgataaactacaattttgtaactagttcccaaattctcctaatgtatttgtattgaagaacaggtgagaggatgattcatttgcattgtgatagagatgaagtgagtgttgttcggtcaaacacgactaccaggcatgcatctgatgtccacgctctattttgtatcaccagctaagtgaagagcttgcattttgttggcgcctaaggcttccaaatgagggcattgaagtttgtggtaactcagccaagacattgtgctttgtaaacggataaggacgtacattcaccgtggttggttagcttctacggctatgttcttatgtcaaggttcccaacctctactcattcgtttcccgcgcacacacttcccaaactactaaatggtatatttttattttaaaaaaaatctatagaaagatgctgtaaaaatcatactaatacatttttcaagtttttgttaactaatacttaattaagcatgtgctaataagtcgttctgtcttcctagattggttcccatccactggtgacgaacacaaccttatgcatgttggatcacattccataaggctactaggtccaggatggtttgcagatgaggtcttgtatccaggtcttattcttcaagtcttggtgcattgtcctttttttttctttagatgttacattcattggtcgcttatgttgattttggaggctacaacaaagagggttttgtttgtctcgtcacaaggcgtttccatgcccacccatggcttccaagattctacccatttgtgccacaaccatttaagccttagggatttgtaaatttctcgagatcgagcgtcctcaacccttcatttgccataggtaagtgtgttctctttcagtcgatcttgcatttggctccaatgaagtttccggagccaacccatatgaatcgctagcattgcttgccaatcttctccaacgacttcttgttgactgtaagagcagtgattacatctgaggtggtggcatttacatgcacaaatatagttttagacgatatttgtaacggaactctggctacaaggtacaaatgctcacttccctattaagtacttgggcatgccgcttgcgtcgagaaagttgtgcaagccacctttgaatggatggcggggcatctaggaggatggtaaggaaggaacatcgggttagcaggatgcacaacccacgtcaaatcaaagctttccttttttctttgcaaagaaaatgatatcttcaaagaacaagcccacaagagacttgtagtctactaagtctcgtcatgactaatttttttcctaaaaggcgacaattaatcttaaaaaaatgtgttatatatgccaacatcatgtcatatcatgatattcatgaggatgacaacgcaaacggctagctacatgagcgccacgccgtcacgtcaacctaatttagattttcatttttttttttgaattgatcgttgttaaactttgtaaagttatgcatgataaaaacgtcctaccattcggtaagaaaaattacgttgtgaagacaatacttacgtatttgtctttctagcagaccgacagattaatttcctgccaaagtaatagccctcgtgctaatagaagtatagaacttctgtaacttttggggaacttttgggtggtcaaaaaaaatgtgaaagaaagtcgttccaaagaattttagttactgttataactgaactttctaatactgccacttggccagtgactcggcgagaggtacataacacccagtttttttgtaagtattccatgttaatttggacgtcgacagatgcaaaaattattttgatatgacgtagaggaagcaagaccacagagaaattagatttatgtattacaacaaatcaccggcctcgacacaaattatttttcgccgtacttttaagtcgtgctcaacgactggctgcattatatgcacagttactttgggcccattaaattattaaaatgctttaatgtaaaattttgctgctaaaaatgcttagtctattcgttgcatcggtggaaaatgccctcaaaaccagaagataggacggtgatagataatattgatgtcttttctgtgtttgttaccctccatttgtagttctcgatgtcgttttattgagttgtgggacatttgtgtcttgtgccttacgtggaactgcatatgttcctgatgattgcatctgatgatctaataagtcctttggttttggtataagcagagtttcgctgtaaataattactcccttcgtcccactcactatgtcatgtacgtattttaaaatttaatttatatttgatcaatgaatattttattataagttaaatattatttgatgaaaataatatcattgattatcatttaaatttacttttatatgattatgattttgttgctacaaacattgtagtatagtaataaatttaaatttaaagattagttagaagattgtgccaaatttaaatgtatcttagtgagtgggacagagcgagcattgttttacaaatgttaaaaactacttaattctattcaaagagatttgctccggtccagcacaaagtatctcaaagtaccggtaactcacggtaccaaatcgttttcgatcattggatctagctgggcaggatgggcattgttagatccaatgatcagaaacgatttggtacggtgaggtattgatacctcgagatactttttattggaccggagcaaatatcttagagtggcattttccttttcaagcttcagactagtagtatttcacgaaattcctccttttcacataaagttagcgtttcttttataccgaaagcaaacttgaatttctcgggactattcggtggagtagtaccaaaatctccaggatgccctgagagcattacctattccaatctgcaaacagttgtacttcgttccaatctcaaattaaagtccattagtccaagcaattcatcagtacagaatacgagtataacagctctgttgacttccaagttcaacatgctcctcctccatcttgatctggtcctcctatcctgcattgtattgatacctgatcaagaatctatgggctttgctaaattgattgcctctatcccggctgtaccgccgtaccaactaggcaactatgtacaattcaaaaaggaaaaaagaaaagctatatatgcaaccatagaaattggagcatgatattattagtacttaggagtgtatatgaattcagttgttagtgactctaaatgggcagagtttctcccatttttcaaaaaatatcacttctggcattattgtccttgtaaataagtaagctattgtgctcgtgagtaaacgccaattggggggtgtttaggtaggctctgcatgagaaagtcttgaatgtcacgtagtagcggtcagtgtcatagttgttagtagttactgaccaacccagtactaggtacaaaatatgaacataacagatcagcacatgacgcgtctggatcatggagtttatgcacgtctgtctgtcttgagcccctgacttacaagaagagattgcctactggctactgcgataaccctgatttgtctacctttttgtatagtgagcaaaaataatctgatgagtcatgagtttctttcttcaaaaaatatctgatggacttaacattagcacttcttgcccacctttcacgaacactgacgtttcctgaagttgtgcagtggcttcggtttcgttctctcgtatggcccttgatcatagttactctgtcaaagcaagccggatgcgttacaacttgcaacactctgaacacaagaacaagaagtcagatcaaagaagaagaatctgctagtaccatgcatggaccaagctaaaggcatagagaaatgccatgtatgtttagtgtcctagacgattaaggcatcccatcgccacagataacgtagggtcgtcacacaggaagactgtcgccaataattgcatctgtcaatataaaattgctgggatatcatcggaacaagttgtgttaagccgccaaggctcgtgtatcgatcggtttcggagaagatcggaagaatgcatgtctgatttgagttgttgcacttctttcagtataatgcatgtgctcaattgtgtgattgcagtgatgatgtaagatacaagcacgtaactcttgaagtttggcggcttcctactctttgcgaactgcggctatcgatgacaatatgggctggtggtcaggcttgtacctgctgctgcaattagatgcagtaggccggagtaatcaatctgcagttcagtaacagtttgttactgtttacagaagcacgggggaattggaggttcaaatcaaacttgagcagcatcttagttttcgtcccatagggaacttgattaaaccataaaggctgcacaagggcacaattatctttttttaaaaaaacgatccggcactatacatgctaattttattgaatagagcaggactaaaaagttttgtacaaatataaaagaaaaatataaaaaaaaaagtaaaactaagtgataagctccgagagacgttctgctaaagttcaggtcttggtttcctcctccattttttgccacgagcactattgatggattttatgaatgttaaaatccattggtggagaactttttgatgaactgcattggcttattggtcagtacattaaaatcatcggatcaaatttcacactacaaagtggtagctactcaatcaccgtaaaattactcatgattcaacatgaatgtatcttgatcaattttatggtctgagaaggtaaaaaagatgccacatttgtagtacaaaatttgttaacaaaacttacactaaaaatttaatgtatctccctgtacctcccaaagtccataaattttttctatattttggttccgttttgaacttatttcatttacattatttgatggattattaccgtggattatctacttcattgtaggttatattaaatattttagaaaataaacacacaaatagcttaaaacaacctaaataatataatagcagaatttttttaagaaaaatatttttcgaagcgtggagaaaaatccgtttcaataatctaatgaataatcgaaaaaaagggccaccagaacactctgtccttgaattaggacatctaaaacgcaagagtgagaaaaggtcacagaaattgacactacctactaatgcaactgcataccataagttaatgatcacagtcaggaaacgactttagggagaccacatacgtatattttcttagcactagctagcataagcatatctttctgcagagtccaaaacccagtttgctaccctaacaaaatcccctcttgggggaaggattgtatttttaagaagcatggatctgtcttgtgcaatattaattggggtactagtactaaataaactccgtagagaaatgtcaaagaaaaaaaagtattgtgcaatactaaactccatagagaaatgcaacagaaagaaaaaaaaaaggaaatgattgtcaagcaatatgcattcacctactccacgaggtgattaagtttaagaaacagtcagcaaagccagcagcttagcctttcgtcgtttcccctgccctattcagccaaaatgcaaaagaaaatgctcccggctctcaaacttgagagttgagacaatatcaatcaatcaacaactacgcacatttttgcatggtgcattttgcgtccattttatcttgacgtggtcgtgatctcactacgactctagaaggagtacaaaaatacttgctcgttgtttgcatgcgtacacagcgaaagtcccctcctctctttgtagccgacagaagccagccgacattttgttccgtcaggctataccacttgtagtcagtagagtgatgttcagattgtgacagtgaataccaaatactgcacatgtctgtacaagtggcttgcgtgcttgatcgtataagggatttataattatataaatggagaggctaattcaagaaactagcccgtgaaaggacaaaacattacttcatgtattcccaataaaatactccatccgttcaaaaaaaaaaagcaaaccctggatttctgtgtccaactttgactgtccgtcttatatgaaatttttttataattcgtatttttattgttattagatgataaaacatgattaatactttgtgtgtgacttgtctttttaatttttttcataattttttcaaataagatggacggttaaacgtttggcacgaaaccagggtttatcttttttttttttgacggatggagtatgtgttcagtacaacaaaattctctgaacgtcactaaataggtttattttagttcatcccagttcataggctaaatatttgtacgtttcgtagctgtccgtgagcttttaattatgagaccaacatatatgtggtcgtcatgaagtatatctgtgtatacgaagtgttattataccactttgatacagacactctaccgtgcgccagtagttctctgtcaacgccaagcaggggatacatgcaaaacaaacatctggagttcatgtgtccgcttcaaatgctgttgcggtcaaattttattgaactatcaaccttatgtaagatttgattgagttcttgtaaatattttttcaagttttaatgaatagttgagctctctgctttactttaaagaaaaggaccgagttcgggaaagagaaagacctcgcttcactagaagacatatgtccacataaagactaactgaaatgcacaacattaacgctttgacaatattattatacgctaggtccaatcttcaggcatactggtcgcaaatttgtttatttcttgagataagatacgctctgattaatgaagattgcatttttcactggagacagacgagaggtatacttgagtagtggttcttttgttgagagacaaatcatataaaaataatgagcttggttaactagaaatgatatcgtaaaacacagcagtctccaaaagctagtttttttaacgaaaaaaaaagctagttttgtgtactctcgctattggtggatcgcagaagtccacaaccaacccacatttatgtatgtgaactggcaatttcaaaatcagatgataagggaggattcttgcttaattggctgcaggtatcattcttctgaagtcgtttgtaccaaccacaaaattaacaaaaggggttccatcatctcctgattgcaggtgttgctgaaccgagcaaacgaattctctactgcacagttgtacttcgcctcgtcagaaaagattagccacagtacgtccttaaaagccactttgccattataaactagtactaatcatgagctctgtacaatgcgataagatttgttcccatgagcaatcatgcattttgtggcggccactgtatatatgtcccccacaggttaacaggatgggatggaagtggtgccataaagttacgtataacctaattaggacccattcttgaaatcgacaaaagcaagaaataattctaagcattttttcagagaaaagattggtgtgtgtcatgcagatatgcagttcgctggcccggcgaaaaaagatatgcaggtcgctagttcagatagatttgagggcactagtcggtctactttactgtatcaatagctctaaaattcaaagttagtgattacaaaattcaatatatataatcaaccattccaacatactacttttgatttctgttttcttaaatttaatattcgaaaaatttataaaataatagatacaaagttattatactcctacttgtcatatggccttcattttagtttttcttaattaaataatataattctgaacttggaattaatcattacaaagttgtcctcggtacggactatatcagtttatagtatttgactattgccagatttatttgctactcctattagcatgagatttttctccaagtatcaatttagtgtgcgtgtgtgtgtataatgggaaaagaagtgcacttgaactatttgctcaatcctgtatgtaccttttgttacaaatttctcttttgtagcagttaatgtttgaagaatggtcaactgtagtccttcattggtacatgagaaaaaagaaatactttaccgtgtaaagtccactgaagaaattttcgatgaaaaccgactttttcttaatcctttatgtctccgactacttgaaaatgtggataaacattatagttgtattaatgttcatacgagtaggatacgtagatacctgtctacacttctactgtgtttttttttaaaaaaataagtttacagtctttatgccttggactacttagaaatatgaatgaatattatagttgtattgttcatacgagtaggatatgcctgtacatgtttataatggtatgtgcgtatgtacgagcgtgtgttaatctgtaccgtgctttaaaaggagaaaaaaaaaacataagctgtcctacgagtcctcctgaccatgacaatttgtcactagcatccgaggaggaaaatctcctcaccgttgctagagacttgggacgatgcggggaatcttccttggaaagaggtgcgagagaactagagaagggcgttatcaagatgcagggaaatcctccattcctcccatcaaatgcaaagaacaaatgaagtggcgggaccgcgctcccctgctgacagtgcactcggcagcctacaacagcagcagcatggcatccccttttttctctcgtagcgccatgcatgcacgatcagcacctacgcccccgcaatattattatatggctgtcacgatcccacccctttgatgagaggcccatgcatatgcacggttacatcacggtgcacacgaacgacgcacccctctcgtcctcactgtccctagctcttttaaatttctttatggttccttctcttctagtactcgtgaccttctcgcagctctccacacggatgcatatgcttcacccctctctgtacattcacaccttctgtcggtgtgtcgattttaacctgaatcatctgggcactatcacactactagtagtttattcagctgttagtatgttactgcacgacgtgcacatctgtacttgttcaggctcctgttgcaaacgcacaagtcccactcacatcgaacagtccatacagttttctttgtgtgggggagagcatgaaggggaggatcccccacgatttcaccggggcctagtgctcctcttcccgattcggccaactgggcagctcccatccctgcaggtggccacgtacaccgtatccctgatttcctatgcgtgtccgctggccaccgaaacagataagcttatttcctactcctagctagcttagctatctcctggcaggctggcaccaccaccagctcccggctcctgacaaaccgaaccatccaacacgtacacgtacacgcgcgtgcgtcgtcgctgcaggcgacaccgggcgagtgatggcaacgtccggacgtcgggtcgtaacctgtgcatgccatgccaaccatcctggggatggaccggatccactgctcacgtcgacgcgacgtagcgtttccaattgaccgcggcggcgtcggtggggcgacgacgagaacgtaccagcgcgcgcgcgcgcgtcgcgcgggaggaaacgagacgagaggtcgatcgctagcgcccgcacgcggcacggggtgaaacgctggggaggccacgttttttttttcttttttggccccgttctcgtgcggttttgcgccgtcgggtaagcggttaaaatccccacacctaatcaaacgcgggctcgatccgtagccgggggagatgtggtgctcctcctgctcatcatcatatggcaatcttggcggattgattagcaggggggagggggcagcacaaaagcgtggcgttggttccgggtccaacggccccgaatctgaaactctgaaactttcaacaacggcgatcgatgatgagtatcatcggccagtatggctgattgattacagggtctgcgtggctgcaattcgatttcgtttccatcttttggactttctgtactcgcgcggcgttgaatggatagaggggacgggacagggtgtgagcccctgtgttggttcctgctgtgcctgtgctctgctacatcattcttcgcttctgccacaagtcacaaggcctcctttttctcctatatatggagaaaaaagcgcaaataaatattttccgctttttagactctgctgcgctttgggataaaaacaagtgaggaaaatatgcaaaagaaggaagagttaattaattaatcaacgctacgtatatgcgcgccgtgttacgtatctcttgctgactttataggtaggagtactgatttttcctttttaccgctgatgatagtatatacaaacgatgttacttaccaagtgacaagacgtggacgtgttgctcacaatagtttgaaaaataagtaaagaaactaataatgcgtttttagacgggccgcgagaggccagcaaggcgaagagaaaaacggtgccgtttggtagtctttaagctggctacgtcatcgcacaatttgatcgttttgcccccaccacggggactcggggagaagagccaagccatctctgcagctggcttcgatgattttatgaagtgcgtagtacgaagtttacatgcacggcttgactttctttacgacctctctctcacatctcacctcgtgaccaagctggatatagcaggaacagtgccatgcgcccatgcttgcccgtgagaaaaaaaaggggagaagttaagtaaggtgagaaaaaaaaaagtttaaccaggattcgactggatacgcctttgcgtatttatttgcgaaaaaagagaagaagagagtgagaggaaaaccaaacacttcttttattaatcaccaccgttcacgtcgcctataaaactcgtacctacctgtctcctccctgttgaaacggcacaaagctccatccgttctgaaggctttgtggccgagttctcctcccccacctcctcctcctcctcctcctctgtagccgagctgaggccaacgcgagtagtgacattctcctgcaatggggtgcaagtcgtgcgagaagcccaggccgaactaccggaagggcctgtggtcaccggaggaggaccagaagctccgcgactacattctccgccatggccacggctgctggagcgcgctccctgcgaatgccggtaagaccaatcgccgcccgccgatgccgccgacgcgtaattcactacccctgccggccgccgcatgcagcatttgcgctccccaagcataattcgcgagctctaggcgcattgcaccgacaattatgcaccgaggcacacacacaaaatcggtgaattcgcgtagcctggttgcatgcggttctctttgctgaatttctcttgccgacccgtctgaattatgaaccaaaccgttctctgaacaaacaagactctgtttcttagccaattcgtgattaaatgtgcattgtgtgttgctgcttgagagctggtctcacaagaatttgtccggcgatcggtgcagggctccagaggaacgggaagagctgccggctgcggtggatcaactacctgcggccggggctgaagcacggcgtgttctcgccggaggaggaggagacggtgatgagcctccacgccgcgctcggcaacaagtaagcttttctaactagcaactcccccgacgagtctcgtcccagtcgggtccgtgcccagtccccacacacctcaccggcagcgcgcactcgatcgttcgcctttacacgcaaaatgattgagcccggagacaattctccacgttgtgcttgctagctgctgctgctgatgctgccttttcctttttcagtttagtactaatctctctctccacacttaattaagctacctagtgtagtactagtactactactactagactagactattagtaccaacgcaacagcggcactaatctttttcgtgagaaagctagttactctagctgatttgtcccagtccgggcgcgctagtgccgagctggcaattcgggttctagaacgcgctgattgacagattgtgagtgacagagtgagtgaaaggagaggaggagcggagcggaggagcggagaaatcaaaatatgaaatggtggaaagggagaattaaccggggtgatgctggctggccgccaccgcgaccttttccgtagtggagctgatgctgacgcgcacacgctccaagaacgctcctgcgcattcgaaaaccgcgagatttttcggtgcacgttgcgatgatggctagagaaaccgttgtgtgttttttttttcccctttcttcctttcgcgctagtacatttgtttattgtaaagtgcgggccactctggctgagcatgagcaacaaggacaagttgaggggggacggctaggataatgtggacttgcaacgctaaatgccacacagtacagttgcgtgcgtcccagaacaagttagctcgaattaattttttttttggggggggtctatttcttcgatttttctatcttttttgtacaggaaaaacggacactattcattttagttgtacagcgacgacgataacatgtcgtcgactggttggaccaatccgttctcagttgcgagttaatgaaaacagctgccttcacaatgcgaaactgtcacgtaggagtactagtctcgcgagaagattagattctttattgggcgtcgcaattatgtgcttccttacaaaaataaaatatcaaaggattagtggtccacatgaatagactacgtacacgcttgtccctttcaccccacaagtgacacattacatttctttaagctggtgacagaggaaaaggaaacgagaaattggaaagaaacctcaacttgtcaatgcaaaagctttgggttttccactaacccccaccgacagaaaccaagattagtgaattttaagctgtggcatactactaaccgtaaggcagagagagactgatcgatagatcattccaaaaggataaaaataacctgacttaatcactgacagcaatttttctactgcaggtggtctaggatagcacggcatctacctgggagaacagacaacgaggtgaagaactactggaattcttacctgaagaagcgagtggagagcggcggcggcaagacgagccaagggccaccaaccacgcctgcgtcagccgcgagctctcccgccgattcagacgactcgcacagcctgcagcagaagccgcacgagccggccaactccgactcgtcggagccggcgcacgagtcgtcgtcggcgtcggccgactcgagctgcctgacggtgaccacggaccacccgcccgtctcgaggccccacgcggcagtgacacccaaggtcatgttcgcggactggctcgacatggagtacatctgtgggcaggtcgcggcagcacctggtctggacgctgccggattcgcggtggttggtggtgctgcaggcgatcagcagcagcagcagcagcaggtgatgagccaggacggatcggttcatcaggccgatgggccatcgtgcggcgtggacgattcttccctgcagcagcagcagcaggaggggttcggtggcaacggcggctgctgggattttcaggagcagttcgacagcatcgaccagatgcaggcgagcggcggcggcggcggcttctgcgacctgctctccatgagcgacttcgacctctgggccgagctggaacgtaccgcgtgatgggggaacgacgtgctcaaggatcgatttttaattagagcttgttaattcatagatgtcccgtggaaatcaaattaaggggtgtttgtaatactactgcattgtaaattatcgcggtgtatttatagagctgtttaaattagcaacatatataaggaagatcagaggcatgataagtcacttctgtacgaatttatgtttgccactttgctttggagagcatgggcaccgacagaaagatggaaaggaagaaggaaagctgtagagaattgcgcctatggatgcaattattttggtttgtttattgttgacattatctttgtgcttatagtgatagcattatggaacaatctattcatatctcactttcaaagacccgctgtgaagttccaagttttgttccactccatgaactgtcagtgtatcagaggtcccttcctttacacgtaggctttcatttccacataactcgtaatgattaaaagtgttcttgtaaatattggatcaatttcaactagtgttaagaaattgcaccctcttttataaagaccaatctgttagtgcctccactttcttcccttttcttcctgcagaactttaattttatttctttttcttccattcatctctttaaatgtacatatattagtagaagctcccacttaataaacgtcatagggttcatttgttttaaggaaacaaatcctataatattattgtccccatgacgtggttaatggcatgtgagacccattccccatgggcccacttatcagctaccacgtccctactactctatgttatattttgcattactcactcctaagttgtcttttttttggacggagggagtatatttttatgtttgactagaatatcatcgttacattttttttattacatactccctcgttccagaatataacaactttgagcactcaacatttgtcccaaaatataacaacttctccccagcaatctcgttccaaccaatcataaccctctaccattcacttttcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagtgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggtcccacctaccttcactacttaaccaatcataactgtaacgtcccgccttcccccaggccgggcccgcttacatctgatagctttcataggtcatacactcgtgtgcacccgagaagaatttcccggtcggtcacccatcccaaattgctccaggccaagcacgcttaaccctggagaaaagaagttgcaacttgccctaggtcgggatgttacaccttcacccccttaagagagatcgacgcccccgtcgatcaaccctaggccaggaacgtcctctcttggccacgtccatgtgtccagtgccagcgcatgcgccatgctgtgtaaccactcccggtctacaccagccatgcgcaccatgccatgtcttttctgcacactttgtcctcactcgtgtgcacccgggaagaatttcccggtcggtcacctatcccaaattgctccaggccaagcacgcttaaccctggagttgtttggagattggcttccggaaaagaagttgcaacttgttgatatgagtattctattaatcctattaagccttaggtcgggatgttacaataaccctccattattcacttctatctattttcttaataaccgtgttcaactctaaaaatgcttatattctagcacggaggtaatactttttatttctaattttccaacagtgtaacaaaaaacaatattaccatatttcaacttaaaaaatttaatctttcggttggatctcccatcaatgtggagtttcagctttattctatactgtaccttcggttgtatggtatactatggttatgcatcatcccgtatacgtgacgtagaagataggaatagacatagagcattatttaagaaggataaagctttcttcaatttaaaccaaaagaaaattgatcgtaaagaggaaaagtaaatggcaaatatatcaatagtcatttcttctttcatgttcttctaaatggctataaaagcatctcctttgttgatcaaacaatgttagagatggagttcaggttcgagttcccttaataacaacggaaaatacttgttttacaaattagacttgacttatcgagccaggaaattcctatgcatatgcaacatcttgtgatgtctcacgtctctctttgcttgccaaggtctaagtgagtgaagatcaagcacacccttaataacaaaagagagaagttatgtttcaactaaatatataaaacatagctcgcccaaagtttagcatctctaaagcagattatttccgacttccatcctctgttaagagggaatccacaaatgccccatagatcatacgcagactctaatttgactaatttgaataataattcaaaactattttaaagagacagtgattacgagacattcatgctagtatgttgccattcaaaccttccaaataacaacggtaagctatggatttttttagaactacggtaagctatgttgatatactctttatgcttagggtgtagtcacatacatgttcttttttaccccaattaaatatcatcttttggcacctaaaattctattttcatattatttgtcgtagttacacttaataataacaattaaaacactacaacaaccatttacgatatatctatattaattatttagtcattatatttctatgctcctgctaatagattaagggttaaacttgatagatggaataccaatcacaagtagattaaaaaaaaagtaaaagggtctcattgtttgccttatgtttataagccaaagtttaattttgaatatgattttttgttttcttcatcatagtttattttacatcatttgtttttgagttgctatggacatgtatataaaattttactcataaataatttttatttgctaacaactgtggagattatgggtaccctatacccacacggcatggttatccgactagttataggggataacttatatctatagaatatgtaacagattatgacttgggtattacgtttccttgtatattacggaacggcctaaagtcctggtttgataagattgtaaagtagatttaggaaaccgataccatattggttaaggtttctatcttgtaatcctgccccccgtcctatataaagtgggcaggaggccctctagggggcatatgagcacatatgatcgttagatctaaactacatctggcggattcaaatcctcaaacaggagtagggtattacctctcattgagagagcctgaacttgtctaaatctttgtctccgcatccatccacttttaggtctcgtgcgctaccccttttattattgccgaattcatgtttcgacaacaacatatttggagtctaatcggtagtgcttactgcagcagcgcagccgcagccaaccagcccaaatctacacaaaacagttgatttgcagcaacatcaacaaggtgtgtgctacttgttggctgctgctgcactgtggcagccagcacaaactcaatgccttagataataagggagtgtttgaagagaaggggattgaggagattgggaagatacgcaaaacgaggtgagccattagctcatgattaattgagtattaactattttaaattttaaaaatggattaatatgattttttaaagcaactttcctatagaaattttttgcaaaaaacgcaccgtttagtagtttgaaaagcgtgcgcgcggaaaacgagagccaatctcccctatcacccctaaacgaacgatgcctaagtactttgagtaagcgaaacaatggaactggaagattgttttgaatttaaaaatacacataaaaaagtttgaaaagaagaccctgatttatcagcaattgagcatctcggcaaggttctcgccgctcggcgtcccggcccagccttttactcgtgggcataaaatagacagggccgatatcgtaatttcctccttcacaaatcccaaaccgccggtgccctagctatcgacgactcggcggcgacgcgcctccctggctccctcccgtcgctcctcctccccgacccacgaactccccccaatagggcagaaaggaagttcaaatttgctcctgatccgagcgccaaacgcctagattccaccacccaagcctcctctcccaatccgatctgccgttccctcttcgaatcggctcccccttctcgccgattaccgacgaatccgaggccctcctcctccttcgaatccatggatccgcgcgccaggtaccctcccggcatcggcaacggccgcggcgggaaccccaactactacaaccgcggcccgccgctgcagcagcagcacaaccaccaccagcagcagcagacgtcggcgccgcaccaccagcagtacgtgcagcgccagccgcagcagcatcaccaccacaaccaccaccagcagcatcagcaacagcagcagcagtggctgcggcggaatcagatcgcccgcgaggccgcgggaaccgacaggaatagcgagccgaaggctgtggcgcaatccccagccgtcgacggcatcgattcgaggtgagaccgtgagacgcgtaggccttagagtttggcgatagattatgtgatgttcaacttcaagggatgaattaaggaccagtgttgtgggtggcttgtttgtttaatttttttgtggcgaaattggaccaaatgcagtttgagacatatgctttccctgcagcatcctgcgaagtgagcactgcaatttcgtattccgtagtggcaatcactgaatgttttttgtccaaatatgtgttcatatgttgcctaggctggtactggaactagggtttgctgcattctaggtttgtaatttgtgaaactagaagttctacaaacagtaggtaggctggtgaataatatatctgatcattggcgcagatatggttatcacattgatcatatgctcaccttttgtgcagttcacaagactggaaggcccaattgaagcttccacctcaagatacacgatacaggacagaggtaaatcgcatttataaaattttcccctattttttcttcaaagccaggcaaccggtgctttgtatgctaaggattacacttgacaattgtaattgcaaaacatgttgactgtcatctgcgctttgccctacctatcaattgttattctgccaaacaattcagtgtggcaggagttcctttacctttatgattttttggtgtcgcacattgtaagctaattactatctccagtcacaaatacatgtcttgaaaattgacatggccttccaaatacagctttgacactaatttctaatttaatgtattaatagaacccactaaagttataatgttatgaaaaatcacctttcaagacaaatttacatatattatgttcatgtatccaatctaaatattgtaaatggtcttgaaagttttactaaatgcttgtccaaaacaagaattatttgtgacccaagggattattaattccgatgattgaaatttaatttgctaaactgggtttgaacatcttttcacacccatgagatatcctaatgttgctaatcgatgctctttatttctgttatccaattcaaacaaacaaagtttaatcctatgtggtcattgtaatatcatgttgataccttcttgtctaaaacaaaataataccttgatgacttaaaacatgcacattaagtgttgttaagctggaatgccccaagctccttactatcctggaggccacatgactcagttaaataattaaagtttcatcttactgagttactgtgctcttatatgttttcccttgtgctctttaatcttatttgtataattttatctttgtatagttcttccccactgtcttgattgaaagaataattgaattttcaaaagaatgtgctctcatggcttgagtttgctctggatatcgacattcttattttcttgctcttattttttttgcctattcttttattttatttggagatattatttatgagtttatatgatgttggtgtcatactctctgcatactttattatattctgctgttgttgcacaggatgttacagccaccaaaggaaatgagtttgaagactattttctcaagcgtgaacttctgatgggaatatatgagaaaggatttgaaagaccctctccgatccaagaagaaagcattcctattgcattaactggtagtgatattctagccagagcaaaaaatggaactggcaagactgctgcattttgtatccctgcactagaaaagattgatcaagagaaaaacgctattcaaggtttgttccagaatccaaactattaaacttattttgtaccaactctcacagtcaaacatgctataaacctgtgcctttataatgcctgttggacctcctttggtaccgtttattttatattattactttttttggggtgttggggggggggtggcctgtaggggatcttctttagtaaatataatattatattgtgcaagaatggttcaatgattgctcttgttatttgtagttgttatattggttcccacaagggagctggctttgcaaacgtcacaagtttgtaaagagcttgggaaacatctgaagatccaggtcatggtcaccactggaggaaccagcctgaaagatgatatcattcgtctctatcaacctgtccatttacttgttggaacgcctgggcgtattttggaccttacaaagaaaggtatctgcattttgaaggactgctctatgcttatcatggatgaggtaattcatctattctttgcaattgatattatattctcatgaaaactgttcagcagttcagtactcagtgccttcccagttgtatatgttatttcatggctcaaaagattattttataaggagaaattagggattgggctaaaaagaatagtaaaaatctcatttacaatcaaacaattagtgacaaaaaaaattagtgtttctatatacttaatgcaagtattttttttagttgctctttcctaagtttttccttcaaattaatgtttgcatccttcttgggttgtgctgaaccaatgaaccccgtttcttgtgtttacaactgattattctgcttgccaatacccatatgctgaattcttgttattacactatcccttgtttgtacttctttccagatatgtttgtctttagtaaatttcacgaaagcccaggttttcaggcatctgtaatgcaaaacccattgtattttaatttgttttaatgaaccccagattttgggaaacacttgactacctattgcannnnnnnnnnnnnnnnnnnnnnnnnnnnnnnnnnnnnnnnnnnnnnnnnnnnnnnnnnnnnnnnnn

SEQ ID NO: 45243 - DNA, 11331 bp, Oryza sativa
  unsure (1)..(11331): unsure at all n locations
tcatggctcaaaagattattttataaggagaaattagggattgggctaaaaagaatagtaaaaatctcatttacaatcaaacaattagtgacaaaaaaaattagtgtttctatatacttaatgcaagtattttttttagttgctctttcctaagtttttccttcaaattaatgtttgcatccttcttgggttgtgctgaaccaatgaaccccgtttcttgtgtttacaactgattattctgcttgccaatacccatatgctgaattcttgttattacactatcccttgtttgtacttctttccagatatgtttgtctttagtaaatttcacgaaagcccaggttttcaggcatctgtaatgcaaaacccattgtattttaatttgttttaatgaaccccagattttgggaaacacttgactacctattgcactattttacttggattgtaaatttattgcttaagacaacagcaatgacaacacaactaggaatattttggaacatcctgcatacagggaaaaataagcacaaaaaaaagatttgagtagcccattcagagtgtgcggtgtgtctatgataggtacttggccaccgggaggtagggacttagggtgcgttcacgaaacgagaaagctcattaacacatgattaattaagtattaactactataaacttgaaaaatggatttatttgttttttaaaagaaacttctacatatattttttttttcacaaaacacactttagcactttggaaagctaatggaaaacaaggaagttgttgcttggagttgaagcttagagcagggccttagtattagtccttctaaaaagaaccagtgtaatggttcatgaggcgaagtagtatcttcaagtgagaactgagaaacatcgtggtttttcttttttgcaccatttaagattctagtgaactatatgaacctctgttttttgagaatctacgttgcatgatttggcttgataacgataatttgttttggttgtgtagcattgaacattttagttgataagaatttttatcttcttacgagtgaaatattgccttctgttcaggcagacaagcttctctctcctgagttccagccttccgtggaacagctgattcgttaccttccagcgagccggcaaattttgatgttctcggcaacgttccctgtgactgtgaaggagttcaaggacaaatacctgcctaaaccttatgttattaaccttatggatgaacttacactgaagggaattacacagttttatgcttttgtagaagaaaggcagaaagttcattgccttaacactctcttttccaaggttttaccgatgagcacctttgctttgtgttcagttagccacttttacctcccttatagcctgtaaatcatgcacatttgttttgatgcagcttcaaatcaaccaatcaataatcttctgcaactctgtaaatcgtgttgagcttctggcaaagaagatcacggagcttggttactcttgcttctacatccatgcaaagatgctgcaagaccatcgtaatagagttttccatgatttccgtaatggggcatgcaggaacctggtttgtacaggtatggaattctccgtgttccgcatcaactcttgactggttctattcttgatggatatttgttactgttcactgtctagtgaaatctcattaatgtcctactagaactaattgtttcagccgatctgaatgtattttgttacttcatccctgcttttgtatattctttttcttcttaaaaagaagcgttgatgacagtgttggtgtgctttatttacccgcaatccagatgttccgtagatggatttatgtgaatacgcatgtgttatatcttattttactaatgtattcattatttgtacatgtgcatatgttgttgttagctggtggtataattaaaatgtatgcaacctttttgatccaagtgtaattaattttcaaactcacaatgtgtcatacatatatttgagatgtgtggcaacacaggtacaatgaaaaggaggaaacaatatgctaattttaatacttcactaccaagttctgtttcttgcaagcctccataattcacttatatggaatagttttgaaatgttgtgattttgtgcaagtatatagaaatgtgtggatatattgcttacggctacacgaaattctgatattctttcttctattttaacttttcatttcttttttctttgcagatcttttcacaaggggaattgacattcaagctgttaatgttgttatcaattttgatttccccaaaaccgctgaaacatacctccacagggtatggcatttgaataaattcagcttttgatcttaggctttaatctaattaggatgtcatatgctgctatgagaataatattctagaaactaatcttaaccagtaagatgtttgtactaagaagaaaatgcacacacaagtgttagatcaaatgtggaaacatgcacacatatgttttatcatgtaattggttgcccctgtaatttgttcatagtttggaactaaataccaactgttattgtcatggtatctctcctttgcaatgttgtgtaggcagtgcagttctttaactgttattttgttggcctttttctaggttggtagatctgggagatttggccatcttggcctggctgtgaatttgatcacctatgaggatcggtttaacttgtatgaacaattacccaccacaattttattcatgtattttattctgacgtttggttcattgaactaagttttctttctgggaacaggtataggattgagcaagagcttgggactgagataaaaccaattcctcctcagattgaccaagctatatattgccaataatttgacagagttccagcgtgtattcactttctctaagggtaataagaagacaattcttgtaaataccagctcatcaggtaacttattcttatgatgaacaagggcaatgcttagcttttaattttgttatttcacaactaccgcaatggaaactattgttttctgttttttttagttagcctggttttactgtcagaaaatgcaatctgcacatatccatcaaaggcttttttagttaacgtatgtccacatgcgaatgtggcatatcactggtcacatttagtccaaaatgaaggtgactgtaagagcgaaatctgctgcatgaacatattagtgacactaaaatgaatgtaactgggtgttttggcatccctcggttgtcaataaccatgcaaatcatccatgctgcagcacatacatctgagtttgatttggaggttgaaaagcgaggtagatggcagatgtcttggaaatgtaacttttcatacataaaacagtgttttcaactttatctttttttctgagtcttgcctactttattcaaagaactaggagttatcactatttctttttctagaatttttttgctgttgtgcattttgtcatggcatgtgcatttgttactttattttgccttaaaagtaccatcatagtatttaaatgtggcagttccatgttcactcttttaactttttaacaacatagcagacatgatctccgtttgtatatgtgttttgcatgctgagattgcttgctcaagagcttataaattgccaaaattcaggagctttagttgacattgtgttacatgtgcaggttttatcatggatctcctgtggcatatgggaacattcatttttggagttttatttgagatgagacagactactcttccgatggacaccttgtgcttatatcattttggctaactaaattcaaacgccctcactgaggcacacagtagtgtatattgctaggtgcctgttcatgtgcctgtcctggcctcttagctcttatgataatctctccccttctctagatttcgttatcggctatttctcacaggacattttaaccctgttagtggttaactggttgtgggctgtgccatgtcagtgcacacattccagttgacgtgccatcgggtgtggacaagttcatccaacttgtgctctgaactgtcaatgaacagtaagcagcacaacaagcgtcttcagatattagcgaataaatctgtcgcaagccgcgtttctgcatccgtgccatgcagctcttctcttgcatgaggcttgtgccattatgtttagattctgcctcttataattgagtctaatggttctacaaactgagtttacctgtcctgagaactgggtaaaacatgtggtgaggcacatgcaacttgataaataaattttttacttaagtgaaattctcactcctggttcattctatgtttgcctttaaccgtgctggaatattttcgctgatggttaccaaatccacggtgctatggttggtgaaatcttgaaaagattatgttaaatagtcccaattaattacagctatcttgaaggatatcatctgttactacttgcaatgatctactcataataccttgtttgggtgtcttaaatcccaagatacagtctgttatacgggttcgtcgaagggatttgtgcaccctgccatgcttgtaccctgcatatgctatcggtggttctgaaatcctagcacatatccctttcgtttcataataaaacaacgtaatattgagtgtgacacgttctaaaattataaatctggatctctatcagatttgtagtattagtttgtgtcacattttttatttgttataaggttggtttttcatgggattgatggagtatagcatactgtagcagccaagaacagaaagggaaatataatcatgcgcaatgaatgggtttgcgtatcaatctcccttccattgctggacaagcccctctgcacagccctcacgggcgtttagcatggtaagctgagagtggcaagtgttctcaagcaacaggggtggggtggtcgtcaatggctccaacgtgtactaggcactactgaaacatacaccccctgattcccatgcggtcgactattatatgcttgtgctgcgccttgcattcaaacagtaacagtattttgtgttcttttctcatagtcgatttttgcagttgcagtgccatcacggtcaggggatatttttctccggcctgccactcttttttagataagtttctactcatctctgatgctgcgactgtgagaacgacaacacctgaccttgctacggagtattttgtcgtaactcttgtcttgcgatcgtcctggaggttattcaaagctcgactaggctagtttgaaattggaccaccaattgcatatccagaattgatgcactggaaagcgacgccctgtatacgaaatgggcagtgttgcagatcttgaccaatactggaggatctttatcctaagaaaattgtgggaactaggaaaattgtgggactaagaaaattatgaaactgaatactgaggagttgtacatctctctaccttgggtgaagtagcaagactctatcctcctctcctgttccatgccgtctcgactccatcatacaccatgaatgagaactgacactgcgtcgccttggagaacaaaaaacgtggtacatttggctcatctggatcgtctggctgaaaagagcgccacactgcatcggaaccgctacagtgcttcgcctacagcatcaacgacagaaacagcaccggtacatgtaccaacagattaaccgaacagtggcactccgagtcccccccaccaaaacacctgtccgtttgagatcatcatggcgacgcccgccccgcgcccagcccacccgcttcaaccacgagccctcccctctccctgcgagcctgcgtctgcgactgccactgcagtgcagcggccacagcgagcagtggatcgcagcgaggcaggaactcatctctgaactccacatttacttcgcccctctctccctctctctatgtgacccatacgctttcccagactcaaaatccgagctacgctcgtttggccagaagcctcatttaagattactccccctgcttttcgtctcggcatcgccggccttgctcgcactattactcccacgcagttgctgctgctacccccactcatcacactggctgtcaacgtgcggcgctgctaccgtgctacgctcaccaacgaaagctgccccgtgaaaggctgtaggggagcatggagttccttgaaatgcatggtaactggtagagatgttttaaaaataatagccatttccctataaatttctataaatttattgaaataatggagatttatagtaaactggtagagatttatagggaaacttgcgatgggaaatagccatttataaattttaaaaataatgatttatttccattatttttaaaatttattgaagattttttttttgaaatttatagtaaacttcttcaataaattttaaaaataaaccatacattaacttttttttgaaacaaaaccttcagctacggttctagccatagtgtttggtgttacatgctaggatcagtgcactgtaatattattagggggctattataccacgagattatgtctaaaccaaatgataccaataaggaattagactctgatacttatcagtatcagatatagtacatcaattgatacatatggataccagccgatacctaatgataccaggcagataactactagtaccagacttggtacccgtcgggtatcatatatgaagcttagaggggagggagaggagcggagatggttaccggctgcgattctctcaccgtgagacgatggcgaaaaacgcaggcgatgccaaatctaccttccttttccatttcccctccatttcctatattcttcctctttccttcacatcttcctcctctgtttcttctaaacgagacccatcccgtccttttgcattgtgtggctataggagaccaaattgccccctatctatcaatgttaaggcttcgtcacagccatcagctcgaccagtccagtccataccatcaccgcccctgtgtgtgaagaacccgcactgcaccaacgcaccacaaacagccgctgcaaaatctagccaccaccgtgcaacaatctcgtcgtggaatctagccatcttcaggtcgttctttgtcatagcggcgcgaggaagtgagagatcccgtcccaaacacgaggaatggatttcctgtacctagcattcccataaatattatgatggagttaattttgctaagagcaatatagcttaaaaagagttactaactgtacccaaaatttaaacatttcaatctaaatttagctagaaatgcttgtattttaggatcggccgaggaggttgctagatgtacacttgcgtaggacggtaggagtaggcccaaatgcgacatgaggtcacggccacaaagttatgatacacttgcgatgggtacccaacaattagtactactagtggtgcttatcatacagtaataaatacttcatctgaattactcacttgaatgcttgatctgatggcccgaagttactcttcggctagtttgctttggtacaaagtactccccatgaaaggacatataccagtgatagttctatctctcccccgcttgcgtatcccggccactcgactactcgagtagtggcagcagcacgactgcacgacgctagtacccgggcgtcaccgtcgccgttgcgcgcgcgcgctgtacttgcaagcaaaagcccccctcgtcaattgaatgcgtgcgtcgcgcaacgcaacgcaagcacgcgccgggttttattttcttttcttcgtcgtctcccacactctccgcttccgttccgtctcgttgttgttgctgccgcagcagcgcaagtgaaaatctccggcatttaaggttgcgccgcgggggatcctcctcggccacaaacaaaaccaccctcgtcctccgcgcctctgctagcgagtactcctacatagactagccacgtctccccccaaatcttttcgcacttcctttcccctccctttcacccactgaatcactcgaagtcgtcgtctcgtccacggccctgctgcctcgtgcgctccggcagctttgccgggggtgggtgggggagcgcgcgccatggggagggcgccgtgttgcgacaagaaggggctcaagaaggggccgtggacgccggaggaggacaagctcctcgtcgactacatccaggccaacggccacggcagctggcgcctcctccccaagctcgcaggtaccggctggcttctctgttcttgcgaggcaatgctttgcttctgtcacgttttcgtgttcgcgtgccgcactagtgctgaactgctgatcagcacattctgagaatctgtcttgatgatttcggccttagatgctgcttatactcgattgcatctgcataccttcaagctgcaataatcacccacaagctcgattggggctaaaatacacaaattatttcatcgtatacaaagtaggagtactgattaagtcgtacactcggcgagtactaggctcactcgtactactccctgctgggttttccttgatcttcactccaggcatcagcattgcctccagctacgaacactcggtcactcactccagggctccaggctcctaccattaccatgcccatgttgtgctactctcttttcgtgcatgagaagtactcggtattattcacaggagctgagagactctagtccgttccatctggataacacttcgttttgcgttgcatgcagggctgaaccggtgcggcaagagctgccggctgcggtggacgaactacctccggccggacatcaagcgcgggcccttcaccgccgaggagcagaagtccatcgtccagctccacggcatcgtcggcaacaagtaaagtcccccttgctcgtcttcatctccttcacctagcgagcgagtagccgagcaggactggcagactgaccagctcacatcgcacagccactgtgtgctagtgtgcactgctcggtgcgcagctaagctagcgcaccacaccgtagcactgtacatgcacactgtgcatggctcctcactcattcaatgttgacacatcgcattctccgatcatcacatcatatatgatatatcccaaaccggccggctggtgtactaccagtatatatagtagtggtacttgcttgtttggagtatgtacatgtctagtttagcttggagtcccagtgtatatttaggccattccactctaaaatttttctccctatcacatcgaacattttacgtttgaacacctacgcgaagtattaaatataggcttaaaaatgactaactgcacagacacaactaatttgagagacaaaactttaaagctaattgctccatgatttaacaatgtgatgctagattaattaggcttaataaattttactgatgaattctataattagttttttttattattgcccaaacaccttatataatactcgattataatacccgatgtgatacgcaaaatacttacatcccggatctaaacaccccctttactcatttactgtagttctatactgtggtaaatattcaatccagttagatatcactagagtgtactactactagcagcgcattgattagaagtggtggcacacacctgctgtttgttctggccaggtggtccatgatcgcggcgcagctgcccggccggaccgacaacgagatcaagaactattggaacactcacctcaagaagcagctgcgccggatgggcctcgacgatccgccgcccgggccggcggcgggctgcccggcggcgcgtcacatggcgcagtgggagaccgcgcggctcgaggccgaggcgcgcctctccctcctctcctcctccggcgccgcggcgacgacgacgatcaccgccgccaccaccaccacctccgcctcgtcgtcctccaccaccgcggggcccgtcgccgccgccgcgacgtcacccgcggacgtgttcctccgcctctggaactccagcatcggggactccttccgcaagctagccgtggtggcggcggggtcgtcgtccccttcgcgggcggacgtcacgaaggacgctgtgaagcaggaggaggaggcggcgccggccggggacgactcgtcggcggcgtccaacgaggtggaggcggcgaccatggcggtggacgagtaccagatgttcctcgacttcgccggcgaggagctgggcctgttccacggccggtacggcggcttctcgctcttcccgccggtcgacttgctcgaggcgtcgctggagacggcgttcaagtgacccgtacgtcgacgacgaccttgctcgccgcgcgccatgtacgacgtactacgtactccgcagccgcagcagcagcatcatgcctcgacgtaggagtatgtatataagcaagtgttctggggcgtccggacagtaggcgcgtccgtgtgaagggtaggacacacgtacgagacgtgggagaaaattttggggatcaattagggttctaaggataatctgtagcttggggtttaggcatggggggaacatcatggtgtgtattagtattacggccttttggatggcattctctggggggcaaggggcttaccggagatgctctaatacattcaatgatgttcgatctttcagtgttggatatggagctggttttatctgtgttggttgatctcagcaggaaaccaagagaagagagagtttgacgccaagaaagaagagaggaattcaggaaagttatctaccaggaaactacggcccttgactttctgtagaccaacaatggacctcgttacttctgctgattactcttcagccttcaagcactggagctgtgctatagcccctagtttatcctcgtgatctttctctgaggttgtgttgaatatatatacataatcggttatagtttagaacttaaatttatattagatattaggatagtagcgaatcttctgtgagcgtatcttttgagtttacttttactgtcttatgagcatgtcgtgactatcccgacgtacggtaagtatactatcaagattgaggagataacttcgatatacgatagaaacaacatgctactttgaaatgtgagacatgtgtcagaactaaggaagagatcaatttcacttgtgagcctgcctacataagaaagagtggtcgtattaggtggattatgatagaaagaccataaacatcatgaataacggaaagactgttatgactagtgagaggatgaggctcatgtttgtgcaagctnnnnnnnnnnnnnnnnnnnnnnnnnnnnnnnnnnnnnnnnnnnnnnnnnnnnnnnnnnnnnnnnnnn

SEQ ID NO: 45244 - DNA, 7419 bp, Oryza sativa
gctcggtaccaagaagagaggaattcaggaaagttatctaccaggaaactacggcccttgactttctgtagaccaacaatggacctcgttacttctgctgattactcttcagccttcaagcactggagctgtgctatagcccctagtttatcctcgtgatctttctctgaggttgtgttgaatatatatacataatcggttatagtttagaacttaaatttatattagatattaggatagtagcgaatcttctgtgagcgtatcttttgagtttacttttactgtcttatgagcatgtcgtgactatcccgacgtacggtaagtatactatcaagattgagagataacttcgatatacgatagaaacaacatgctactttgaaatgtgagacatgtgtcagaactaaggaagagatcaatttcacttgtgagcctgcctacataagaaagagtggtcgtattaggtggattatgatagaaagaccataaacatcatgaataacggaaagactgttatgactagtgagaggatgaggctcatgtttgtgcaagctacatggggacacggttataggtggagtcatagaagatgggtatgttggtgttgcagtgcacgttcttgaagaccgtgaggcaggcaaaggttcgtcgagtggcttgacgtgagcggcgaaaggaaataacttaagtctaggtacacggaggtttgcacattgagtaaattcagatttgcttgacatattcgctaggtggagtttgttaaaatttgtatctaatatatgtacgtaaatgattatgactcagagtcgaactatgttctaggctctcctaaatagagatacacatatgttctaaccacgtagcaacttagcatagatgattcttttaaccatagtggttatagtcaattatccagttccattcattatgcatgcatatcccttcctccctactctacatcttaggctgtgttctttccttcaagttcccaacccctctccctcgttttccgtgcgcacgcttttcaaaccgctaaacagtgtattttttataaaaagtttctatacgaaagttgcttaaaaatcaaattaatatatatatttttttaaaaattagctaatacttaattaatcatgtagtaatgcctgctccgttttgcgtcccctcctcccgaacgcagccttagatagcttgaagatcaaccccgtctccctgacttcccacccttttggtcccgttcgtttctgctttggattaagattaaaaacgggcatgtaaaacaaaaaactattagcgtatgattaattaatatttaagtactacaacttgaaatataaatatatttgttattttaaagctattttcatatatattttttcgcgaaatacgacgttttaatagtttaaaaagtatgctaatgaaaatcaaggtaaaattttaattttattgagaaaaatgtgctaacgaaaaccaaggtaaaatcttaatttcatcctccctcgcaattcttttgctccttgataatgcttctactttgagccattgatcatcttctgtacataatcgtctttcacatggcatcactttttttcatttcccaaggttcgcacatgtaaacactattattttatcaccctttagtatgtaactttggtggtgccattatcattatcaggatttactaaaccattgggaacaaggttactgtcaccccacggtttggtggttaccacggtagccatgcggttactgcgaaaattataaagtatatcgtgattttaaaaactgagaatattatcacctataataaccaccatagcacgattttataaactctggtcactatacataattcttgaaaatccgttaagaaggaatgtactttttattgataaattttatattatagtagtgctaatatgcatgcatcgagatgcatgaatttttatgtaggaatcagattacggttttctttagagctaacattgctataataccactttgcttaaaggatattgctaccactgagtaaaagcgcgtgggatcagaaaaaggggtccctgatgtgcagtggctgactctgtttgacttgtttctattcagaaaaaggagtaaatgcaccggatagccggtggggccagcccgacgagaaaacgaatttattgccacgctcagataaaaggccaaaccagagcagcgaaaggtttgccacgacacctgcagcacaggagcagcctgttgcctgtggtggcttcatcgccaggaaagaacagaaatgggcagggcaagctcgtcgcccctacgctaatgattctcttctgggagatactattaaatgccgtgccattgtggtcctttggatatgattgtcatttagagtttgtatagttcatgttaaaatttaaagtttggttgaaattgaaacgatatgacggaaaagttaaaagtttgtgtgtagaaaagttttgatgtgatgaaaaagtaaaagtttgaaaaaaaaattggaactaaactcggccttaatcaggactgtcgtgatggataacagtgaagaaacgattcttttttaggagtaaagtaaccttcccacactgtttgctcggtttgtgatcgcggcaaaattttcacttcatacccagggagaacgtaaaaattactacgtatgttccagtcatctagtagaatatttaggcccgctttattcgaaagaaaattatatgatttatatggattttattcctatatgatttttttcctcatatagtcctttgaatcaaattaatggtcactatagaatctcataaaatttatgcgaaatatctcattccgtctaagttttggagaaaatctaatatgaggtaaaaccttatgaatttttttttcatattttcatctctgcttaaattcctatgtttttttatggtccaatcaaacgatcattctcatcttttttttttcaatcatgtatgttaaacttgatactatcaaaataatggggttttcgtgttttcttcattttctcagtcttgcattttaaaaggccctttatacttactccatttcaaaatataatcgtttctaattttatcctaaattaaactttcttagtcccaccgtgtttatagagaagagtattaatgatgatcatttggtgtcgcaaacactattgtcatttcaatacactcgatcaaatttagaataattcgacttaagtaggatgatgcttatgatataggacgaagggtcacaaatctgatccaacaacacgctgtagatggcgagtctttgatcttgtcagagggtagaggatcctagcaacttagggcacctttgaaatggaggattagcaaaagaattttggaggattcatttttctaaggattttttacctatagagccctttgattcatagggagaggataggaaaacttccatatgattgtattcctatgatcaattccataggaaaataagcaagaggttagacctcttgtgaaactttccttcgttgagtgtatactgtggtataatcaaatggctcttctctccatttcctgtgttttcaattcctgtagaattgaaaaaacatacaacttcaattcctacgtttttcctattcttgtgtttttcctatcatgcgtttcaaaggggccccatgtacaatggtctttattagtggtctatctttattgtcatgcaagcatatttggtgacgtggaagagagagaaggacaaagaaagatggttgctacgcatgacaacgacatagagtcgactcttagcattattaggaaattttttgttgcattgagtctaataaagaaaagataactagtaagaaaatattttagtacattaatggttagagaccgtattgtcttaactattgtaacgtgatagactctaattaacgtagagaccatactggtttttgtctttgtacttgcccttaaactccataacaatatgccaatccaaatcattatttgtcatgaataggctcttttggacatccaagtccttacataataactcccatggacaagagaaagaaggcattaatagaatgaacagcctaatatgttacacttaccgaacaacgtctatgtttggtcatgtgttctacaagtgatgttgtagttcccatatggtggagataatttcggtacttgctatatttcactcaagaaggtagaaggcaaattgctttacgcgatccacagagaagtcaacttgattcacttccccggccggggatcctatagataagaagattaggagagttgccaaactctaaccatcatgcatgtaccacacacttctactatgccaagggttgtttggttcaccatcaaactttatcatgtcacaattctggcatcccatagtttgttttatccatatttatttcataatcacacttatgagttaccgcggttaagctaatcatgctacaaacttgtaccctataatttattggcgacactttgtagtttaccataacttggatgcaagcttataccctaccaattatgccctatgttggtcctacagaccaaagacacaccaaggttctagactaataagccataacacctattaacaaaaaaatattttttgtacataaaacttttttatatgtgctattagcgacttacaagccaatgctagaaaataaaatacaatgaaaaataataaaaaaatgaactttaaatttaggttttaaaactcaaattttatttgggcatataggctgaagagcaaacaatagagttgcaaaatgtttaggatttaaggttttgtgtattttagaaaaaaaaactgatctactttcattttatatttcaagaaagcatgggtaatagaacatttaaagggatataactaaaagcaaaatatatattattacaataaatacatatgttgagtatatatactcctttatttaaatagactgcaaaggtggtgacagtgagtttgccaccctatctattcctatatattgtagttttatgtattacaacttgaacttcttaatatgacaagatagctaaatctaaatggatagctatatataaaattaaattaaagtgagtattctctaaaacaaaaggctggtaacatatttgatgaaaattatgccttttagtttcaggaaatattatgatttttttcctttaatcatattaaggcatggacatttagatagtgctacaaatagataaacgataaattacacttactttggtcttgaacaaaatgttttaaacaatcatgatttcagtggttgtatttgtattctactagtatatcctacgactgtaagtgtaacagaagatatcgtaaaaacaactcttccacaaccatcaatctgctagtacaatacatttgtctcggtttagaaattcccatgctatatgtgagatcatagtattgattatacggactacccacacttataaaaaagagtaaatttcacaaaactacaggtgttttgaccaaattatcacaaaactacagatttaaggagttgtatcacaaaactacatatttagcactaaatttatcacaaaattacagattttagattaagtatcataaaatgcatatttaatattgaacttatcacaaaactacaacttttggagtttaaatcctagcaccattgttatggtggagctataaacatcattactttgtgattaaattgattataaacctgtagtttcgtgataatttagttactaaatatgtagttttgtgatacttcatcttaaatgtgtagttttgtgataaatttggtgttaaatgtgtagttttatgatacatcgagttagatctgtatttttgtgataatttagtcatagtatatgtagttttgtgaaatttactctataaaaaaataatgcattcgctctaaaatatagaatattaataatatagttatatggataaattttctttatatttcaaaatggagatagtaacgaaagatatatactacgtgctcaatccttatttaatcttttgaaccgtcctgctttttgccgacccttagtttgtgtttagttcacgttaaaattgaaagtttggttgaaattgaattgatgtgatataaaagttggaagtttatgtgtgtaggaaagatttgatgtgatggaaaagtttaaagtttgaagaaaatgtttggaactaaactagacgtgtaaaatgccacgaaatttgtgggaggacatcacagacgcggcaataccgccaattggctgagatgcacccgatcgttggatgccacgtaccctagtctctatggcattgttggctctgaacaaacccaaagcatggcattttctggctatttactcccagctcctgggctcaaataatgctcaatcaaccagggacgatcggagctgagggagctttacaaacaaccgggtacgagacgagtcgatcagccggcgatcgacgcactctccaactctggggcgaaacgagagaagacatgcatgcagaagttcacgttgtcaaggaggcgatctcagagtaagtttaatagtagtataactctaaatcacctatagataatgtaatagacaattcatacaataattacttactatactattaatatccggtcccactatcatatacatattacgtcttggagtccgtactgcagctggctacaaatttatcgctcgctgctcttctctcttcttttatctttttaaaatatatttataactggcttataggctgctatggtaactgctctcacttttgctcggtgttggctctgggcatcatgcattgaatgcgcctaggacgacgaagagaacggagtcggagggagagaggcgatgcagttggggttggggccgctgcgacgacgcatgcagccgcgcagacaagcgtaggagcagcaggggaacagtagcaggtcagatagcgtgtgcggcgcgagcgagcgcagcattgattgcttgtgaatgtgcactgcctctggcacccacgtcaaattggggaaaagctaggccggtcgacttgaccggacgatgcgccgtactccaactctactactccagtcttttttctcggttgcacgagtactcggtgtaccgatcgggcgggccggcacgacgctacctcccccgtacgcgagaacgtggtgcctgatcggaggagtacgctacactatgagcggggaaagagcgcgggaggcagaagcagaaagagttagcgtgtgcctcagactttgattgcggtacggctccgtctcaggggcggcattcaatggttgtaggcatttggcgtacgtcgtgttttgctcgacgttttgtgcggttattcgttgatgagaaacagccgggggacgacgaggggtggcactgtactggtgggcctggtgtctggaggcct

SEQ ID NO: 45245 - DNA, 9078 bp, Oryza sativa
ggtcttcgtcatccattgatttgatttgattgcgatttcagagctcaggccagatgacacgagcataaacatcgtgaaaataattttccagcaagtcaacctgtcacgttgaacgaaactgcttttaaaataactgaatgagtcaatttgtaccgatgtacgaaggtaaaggagatattatatccggttttacggttaaggaatacgattcaatccaaaaggaagagttgaaagtcgaaaacagacttatacgaagtgacgagccatcaaagtgtggacacccaagagcccaaaacttttgcaggctgtagcagcctatccactgcggatgtcaacgacccaaattcccgtgccagctgttgcggtgttgctcccttcacctcgtgagtcccgtgcccaccaccaggcgcgcgccccacgttgttgcccgttgggaccggagagagttcacgcggcacctgcgccgctcccgctccatcgcgacttccgcggcccgtctatgcgccgcctctttttttttttctttctttcggggcgatttcttctctgttagtgcaagataataatagagctcacttactattattagccaatcttaaagccaacacatataataaattagctataaagttggctacaattttcttctcatctctctatctctcacttatacattaattgtatttgtcttggagcttgtgttaagctagctcttgtatgagagccaacacccttaactttttgttacatctctcctccacataagcttatagtaggattatagctaacaattatacttgctcttagaatctttctcaataagctgataagaaaagttcgttttatgagaaaatgcatcgacgattatcaatcttaacgtgttattattaactgcactcgaaatgttttagaccacacaaagaaaaaatcatgagtcaatgacatgtaggacctacataagtcaatgacatatgggtcagatagcatatctcaaattttacaaaattataatggcatggttccaatttttccaaagaaaaaaaagtacacacttacaagttacaacccaacacaaataactttcgaaagagaaagaaaaacaagtatatggctcggatcgatgtttcttatgccccaaaacacccgatatgtttcttcggtgtcactccggttgcacggtacttagctgctatctcctcggccttgatcacttcttcaccgcgccgggccatcaccattgctctcttttcttcagcttccttatggacgattgcttccttgttcttcgccttctcagcgtactctgccttcttcctttccaactcttcctgtgtactcacaggttaattgtagaacagtgtgggtgatacacatttatgttgccaattctcaaacaagcaacatggactacttaaagaaccaatcactcatggattttgagtgtcaccagaaaacagagcaaatttcttccgtgtatcatttttctatgtactatatattgctcgtacttcacacgctgacaagttaatcaggaattcattgcattgcaattaaacatcatatcctttcccaaaataaaacaaaatccaacatcatcacaaaccattttgaaattcttatagatgagatgtgcagagtattcaaatttcaagcaccagaaaacataataaaattatctatctttttttattaaaaaatttatcttttttttcgcgaacgattaaaaaaaattatcttgacaagtgaaaaaacaatgaacttacttccttctttttcagttgagtttttattactgccttctttgtgttctcccatgaaataatatccaataacttcttagaggccctgacacagaaaagaagtgattcggaaggttatgtgctatgtttcctcaataaacacaacatgttgtaatggagccacatatgccctgacagtaagacatggtttcattttggtttacacatcatgttcgcacggagagagattctggccaatacgggcgattaaattttgattatgtacctgttctccgcttttgccttttcgttctcctcccatgctttgatcaacgattctcgcttgtctgtctccacctttgcaagggcaatatctaaaagtattcaggtgttaatttagctagaggccctcaatttgccagtgtgtaaagggaaaaggacagcataagttaatcacctctgtcatttgaggtccttgttggtgttgctgttgctgttgccttctcagcatgaggtttatcagcaacctctggtatgtgaaaaatcatgatcagataggtagaaatcagaagaatgacttaggtcgacctttgcatggcaaacaagctaaaaagctatagcgttcaagaaatcatgcacactagtctaatctccatttcatatgttgtttgaattgaaaaatgaaaagatgtgaatggctgagcattctcaaatagtattactataggtaaaagactgcacgccaaattcgacaaaactgagccagcaaagtactatactcactctcgacgaagacgacgagagccttggagtcatcggccggcggctccgtgtcatcatcggtcttggagatcaccggcgatgtcgaagccgccgggatgacggccttctcctcccccgcgttcgctgcggcgggcgtcgcccccgcctccttcaatgcctccccggccatcttcaccgcgctcacgctacgctactgactcggcgcggctgcttacaatgaaaccaggcaccgtactgcttttggtagctagtatactatacgtttggtcacgacgactcacgggctgctgcgtagtgcgtactgaataccgactgatacgctgaggcctgagctgtgggtctctttatatacagcttctacccggccgggcttctgcctagaagagcctggagtgagtgcgatcggtccatcatcaatacattagattttggatttgaatttgaccgtaaatacgagggatttggagtacaatctttctccatccatccgatcatcgtatttattgctaactggttgtcacatggctaacgtgattttttccaatcaaataaacttttagggacaacaacgtaatttttacttttttacattaaactctgctagaagcctagattaacttagatttattaagccgagcaggttattgtcacatagtattatctacttgattataaaagtaaattaaaaatttgagaaataaactaaacagatagattaaaatacgtgatcttaacaatgcaatggaacgaaatttaagtttagccgtaaaagtcatgttgggatagttcgatgaataatctttttaagagagaaaactgaaaatccattatagttatcgacggagagtgtacttattttagtaagtagtagtaagcagtagtaagcagtaacgtgactggagaaatatgcgggcgcgtacgtgcggcgcacagggtgccgtcctctccagctcgccgccggatcggtcgtgccatccatcctcaaccaagcgtaccgcgcgggcgatgtaccgcggctccgtccgtgtattccttgactacgtgcgttgcctctcagacgtggaaggcaggggagccgcgagttttccgaatgagctattctgctgcaatccgcaagctaatttacgttgtggctacttgtttctagggtgaaaatggactgggacgattggattatgacattcctattatcctatattctaacccatatttttttaaaaaaattcggaaccaggtacggataatgccgaataacatatcactcatctcatatcctatcccatattatttccttcgaatcggatttgggaacatgtctccatttgtatctctaattcatagatattaaatataataaggtactccctccatcccataatattagacatggtaaaagttacacggtctttaaaattaatctttaacttataatttctcatatgctataagagttgtagcaacaaaatctatctattatattattaaaacagccttgaaaggaggcaccacgttcgctgtgggggctagaaattcccacattaatcggaaaaaaaaagaagagtgcaaatagaaatacaatctaaaaataactgaaattcggaattaaaagtaagcaatattgaaagaggagtccatataagaacccaatacgagattaatcaaaattctaaataaaaatgaaataaaatccgaaattatcaaaaaaaagagagaagagttcgagtaggaatacaattttaaacggaattaaaaataaggaatattgaaagaagagtacatacatgaatccaatacgagattaattaaaattcaggataaaaaataaaaaaataaaaatagaaaaatgaaaataaaaagaagagttcaagtaaatacaatttaaaattaattaaaattaggaattaaatataagcaatattgaaataagagtaaatataagaacccaatagtagattaattaaattcggaataaaaaataaaataaaatatgaaattagaaaaagaaaagtaaaatttcaactaggaatataatttataactaactaaaattgttgataaaaataaagactattaaaaaaataccatctaaaacacatgatgagattaattaagtagcaggtctatagaggagcagagtggtggcggttcataggacatctaaaaactattaataaaacgccaaacaaaatcctaatgatgattaaaacgaaggacgacgggcaggtcgtgaatcaatcggtcaaggcggttggcggggcttctagaaagtaaaaaaataatccccaatgataatcatatttgatttttaaaatctcaattacaataaaaataaaaggcagctggcgggtcgtatatgagtacaatggcagagccaccgatggttgtgggtcttctataaagtaaaaaatgaattccaacgatagttatgtttgagttttataatcccaatggcaataaagagtatgtggcggatgggtcgtggaggagtatattggtagcgcttgataggatttctattatgaaaaaaatgaaacccaacaggacaataaactctaaaaactataaggtccaatttttaaaggttcaagcttctaaaaataaaaaaataaaccccaataataatcatgtttgattttaaaatctcaatgacaataaagaagggcggcagcgggcgagccgtagaggagtacagtgacaaagttgctgtagtttcggcggaacttctataaaataaaaaaatgatcctaaacaataattatgatatatttttaaataataatgataataaaaagaagatgtaatggacggtcgtagaggaatataatggcagcgtttgacgggacttctagaaattataaaaaagaagtccaacaggacaataaagtctaaaaagtttttagatctaatttttaaaggttataaggagaatgaaatagaaacagtggtagatcgagttatataataacgaataatatgatagaaataaagggtgctgatgtgatttttaaaaactataaaatttgaaacacgaggataataaggtttggctttgaaacacgaggataataaggtttggcctttcaaaatcttaagacatcgagataactatttaataaattttaagtaaaattatattaaaaaatatataattttatatgggtgctagccacgcaattgcgcgggccacccagctagttataattatatgaaagtaaatttaaatgtcaatctaatgacataatttttaacaaataaaatttatttcatattatattaaatgttggtcaaatgttttaaaggttaaatcttaaaatacgtgtatgccttattatgggatggaaggagtaattaaattattaaaagagatacatcagaaaaaaaacatataatattacgtgtgggcatgtaaaatagtgattaaccaatcttttatcacatttttaggtggacttataataaatttttgtacatattttataatacggaacatacgggtggatacatgtctttccgtatcctaacccgtatttttccaacgaatttggattcgaactcggttagtatcgggtattccttttttctcccatattcctcccgcgagtcttgagttgggtgggcggtcgggaaatacccgccccattttcacccctacttgtttcagccttctgatgatcgatcaggccttttatacgcgtcgtccagtgaaacttttatccgtttatggtgagtatttgcgccctccaagcatctccaccgtttttttttaaaaaaaaagatgcatctccaccctgcgtggctgccgcccagctgccacggcgtcgagtttgaggatttggatcaggtgcagtcacaatagtgactgcaacttaatcagtagcattagcaccattggatgcgaactggacagctcagatcgcgaactgtagcactgtagcacgggtactgttcacatggccactgtagctttacatctaaaccgttgatcagaaaaacggatggctggtgttgtgtgcagtgttaacttgcagttacaactgtaactgcaccggatccgaattccgagtttgagtatagccaatttaattagccacacaaccaatgaggggcagggttttaagttttaactgaattttgtttcgaatgcgaaaaatattacacatcaatatattatattagaaggaagaagttttaagcgagtgatatacttatcgattaaggccatatttgtttcagcttaagattattgtaatctagattattaaatcagattactctaagctgtattataataagctgacataaaataagctatgagttgtttgtttctctggattattagaggcatctaagagtagtggatctttagccactcaataatctgaaaaaagctagcttctctagaggagattattggattatagtaatctggcttatatgttataataatctagcataataatctacttgtttgtttcagcttacagttaataatccagattataataatcctaagctgaataaacaggggctaaaactagacacttgttagttgccgtgtttgttgcagcccatcatttctttcctattccttttccagcgaggtcgtttgcaaatatttagacgaaacaaattaaatatagtgatccaattgctcaaaaacagtggttgttgatacaaatcgcgcgctattaggtctgtactatcgtgcgttagtttttttatattttttctgttgtgtagtactgtatagtctgtatggaactagccctttattcagcttcccctaaactgtacttttttgttggcaaaactttttccgtccttgtatttttttttcagactataaatacaaacttttttgaaagaaaaactgcaaatacaaactatatgcactcccacacttatataactatataggactccctatctcatccttttcccctttcacaaagatgtatgcaatttcgtgctttgacaacaattgtgacttggaagcagttatctaactagcagcttttgattattctatatgcgtgttacattaagcacgtttaattggatcgtcactataatagtataatcaatggaggttggagattctgccagctagtagaattttactccttttttttccagaaaaaaaatgaattctgattctgctgaaaaaaaagagggtgttactcatgtcgaaaccatctgttgccaagtggtggtgatcccattctcatcatctacaagagtacggccctgtttaggggagttttagattctgagaagcagctgtttggtagccagcttctgagaatctagaaaagctctgaaacccagcttctccagcttctgccttcttagttcatttttcagaatatgtaactatagattctcagaagctgtggactgtttggggcagcttctagcagaagcagcttttgagaaaagctgcagctgagagaagctcctccaaacagggcctacaagtccgatgagacatccaaagtcacctcgccatcagcgatgccaatgactgtttggtggcgccaccacctaccgatgcgaaggatcatgagacaaaatacgattcaaactaccaacaaatttgcccttttgtgtgacagacttagagagggtataggtaggctgaactgcaacgatgatgtgagcggctattggatggtggcacaggaggacatatcaaggtgggaaagacaaagccaaagtaaaaaaaaatccacatgctggtagcatgggaaatatgatgtgagcggaacaaacgagtatttccaaaatcaggaaaaatccttgccgcagctgctagacaagatacagaatgaaatcaagctatggaaaatatgtggagcaacaaatatcgtgagatttatcggcctaagatgttttgattgattagtagcttttttctttttttttctctgcctctttttcctctcttttcctctttcactgtttggtgatcttgtaaatactccctctataaaaaacgaatctagaaccggatgtgacacattctaataaaatgaatttggacagagatatatccattgtagtactaggatgtgtcacatctagtactaaattgattttttataggacggagggagtactttcttcttccctacttaatataacacctgctttgctggctttagtttcaccaaaaaaaaaaaagcccaatccacacagctaccacgtagcattttcacctatcctcaaattaaacacgttaaaaaataggtttgtcctaacccgataatccatgtccctccaatcaaacgcatgctttcttactcacattaacacaaggattgttggccaatttgaggaatgccacccctcacggattgaaacgaaagagaaatcagctcggacggctagaaatgttcctttacacgaacatggcatggacggtagtgacacgtccgacgccttctatattaatatagattaaccacataacaaatacacacacaacaaatatgcatatttcctttctttgtatgtccagtatgttctttctttgtttcaaggggagttatatgaa

SEQ ID NO: 45246 - DNA, 4593 bp, Oryza sativa
aaagccgtgaagttcaccaaaaatgcctctgcgccatatttgtcgagccctgagctttggaggaaagtgagcttctcaagaaatccgagttctgcggtggccagggctaaaatgtagacgaagagcccaaacagtatatgccaaggaagaacacccttcctcacgcttggcgaagcacgggggaagaagaaagcaacaaacccgaatatccactgcaatagacaggcgcattttacaagaagttgtcaacaatcaagtaaagttatatataaaaaaaactctcaccgggcagatatcaactactacaataaaacttcgcagttcaataaatgtgttgtagatctttcagctctgaaaagcaatccattttttcatgtctttcggtggccaggaaattattggtactaacagctactggtgtctgctaacttattcagattcatgagtttttagttgtgaacagcacaacaggatacagagtaatcatttaaccaaacacattcagaaattgatgcaacatcataattgactaaattgtaaaaaaaaaaaaaaaaaaaaaaaactcttctatgtgcatgctttaccagctattttaccagttggttctgttgtaagttgacggtttcagacaaatcataataattggactaagtcaatggcttatatggaatagaattgctgccatatgcaaggggttacctgaataccatacaaacaaattgttccaatcccaagccaagaatgcagactgtagaggttggcaattccactttcattgtgaaatttgaaagcgcagtatatcccaaccgcaccgaatacaagggcaattgcatggagaattagatggatcagcttagttgtatcatgcttccaagtaggaaggaccttgtataccattatagctgccaaaatggagaaggaatattactaaaacttttccacgaaccacagaaataataataataacaacaaaacaacttaccttcactgcctaggattatatagccaataagcataagaacagggtgaacctgcaatgtctcaacattagagatatgggcaaccgatttgaaacgctaatgtacagtagtatcctgaattactagtagtaaggaatatgcaaatgattagaaactgcagaacagaaaagaaccgaatatacagtttaaattttaaaaggtccatttgccgttaagtccaagtttaacgtcttttaaattgggcatgcaaaattaggtggcgcgtttacagaaatgtgtagcaagttgaaatgcaaaatacgattgctttttaacatctttctgtggaccaattgcatttttaacatgacgtcatgacccgcttcatctgatatgaattcaacatcatgcaatcattattcagccctccattttccccatcagatggacaacatgccaatgtgttgaccaacatggatgcatgagcataagagcatccataattcaatacccaacaaaaaacatgccaatgtgttgaccaacatggattcatgagcataagagcatccataattcaataccaaacaaaaaaccaaataaagaatacaccacatggtgcctagttcaataacctactccatcaagcaatcaaacgatccctgattagatgttcaaactgaacgctcaacactttggctaacttaacacatgcagcaaggcctgcaaacttatgaaagtcaacccaattctcattaagtagtcacaaatccgaacaggttagctaaaaaattgcttaactacatacgtatagcggggaaaaaaagcaatcttaacaacaattcatctgttcattcataaccgataacacaacctcgacaggactaaaatttaagcactatcctaatcaccatggcaaaattaacagcaaaaggtaaagcagatgccatcaacatcctgcttttcttgatcaaacgccaaacggatacgacggccaaagtatttttgcgcttccttccttcctaataaagctacctacccctactggatatgactccaaaattttcttttgggaaacaaaaaaagaaaaaacagcggcacccaaaattgtccatccaatccaatatctcgggacggtatcactagaaagataactagagagacggggggcagacgagaatcaagtactcacgttgaagatgaggttcttgtttgtggcctcgaaggcgaggccgccgcggaagtggatgcaccagaccagcaccatggtggcggccgccacggccagcgcgtgcgccacgtacgtgaacggcgccgccctcacgccgagccccatcgcgccccgtctccttcccctcctcgcttcgccgcggccgcgctgtgccgtgccgctgctaccggcggcgggtctcgggtgagtggagaagagaatgccggagcgtagttgtcccccacccccaacgcctcctataattaatactccctccgggaaaaaaaaaacaaaaaacatttaaccgtccgtcttatataaaaattatataaaaaaattaaaaagataaattacgtataaagtattaatcatgtttattatctaacaataataaaaatactaattataaaaaatttcatataagactaaaatgaacagtcaaacgttgaacacgaaaattcagggtttgtctttttttaagacgaaatgagtactagtaaagggatattttggtcttctttaaaaaatccccgtgttgttttcgtgggtttccgatgaggccggaaggtgccaatgtacaccaatcagttgacgccacggctgtatacctattgatttgtaagattgttgtgtatgaaagcatgataattatatttgaaaatggagattagaggtatgtaaaaatatcatatgccttcgttagagtgaaaaggcagcgaagggaaacggaagaatctggtctgatccgtgaccttcgtgtcttcggctccgtgggatttgggaagaaaggaaccggccgccggcggggcccggcatgacaagcgacggcgcgagagaggttggttggtgggaagtactggaatgttcaggcataacaagagttgggattatgcaccacggcattataatgaactgttaaaaaaagtttatatacacatttctcaacaaagggcatttggtctagtggtatgattctcgctttgggtgcgagaggtcccgagttcaattctcggaatgcccccactttttttttcagaatacaaaatcactttttttttcagaatacaaaatcactttttttttcagaatacaaaatgtgttttcttggacattgacaagttctttttttttagtttataaaatgtgttttcttggacattgacaagtttttttttcggtttacaaaatgtgttttcttggacattgacgaggttttcaaaatatacttgtggctacttatttgtattgtaaaatattatgtcaaaatttatatttatactttaaagcatctgcaaaaccgggcaaacataagatagtacgaaaaatgttttttttcaattcaaatgtccacatgatactttcacaaggttacagaatgtgttttcttggacattgacaaggttttcaaaatatatactgacttatattgtaaaatattacatcaaaatttatattgtatttttaaagtatatgcaaaaccgggcaacacataacattgtataatcatgtgatgattaatcttggtgatgaacaattgtcaaaggtgagtgttttaaaaaaaatacagcgaatagtgttttctgttggtgaacagtgcgttggtactatgtggccgaactaactagagggattcaggcggcctgactgggtgacccgatggttagactagaatactttgggttggagtcggttttaagttgttttcatgatttttttagattgcttcatatttataacttctagattgtttctattagtatgtgatactatcgtgtgctgatgtgagttaagttggtgcgaattgtactcaaatacaatttttttattcatgtgcaggtgttgttggagaccataggagtatagccggtgatggatcgggactaggcctgggagaaattaaggtctagacggcaaatgatatcacgtggaatgctcaggctagagaataatgcacctggaggtaaaggtttctatatgatatatacgtggtgttgtgtatgtatgaaaaatgagtcaaatttggattggagttcaagtttgaaaaaattagagtgtggagttgtatgggaatgttgtttttcaggtttcgtaagcttcctatgtgattaggagtcctagttctagttggattcgtggctaggggcagccacgttgtgagtataaatagatgaggaattgagaccggaagatatcaacttttttttttttaaaaaaagaaaagttagggtttgctttgaggtttcgattctagttcgtgagttaagatatgagtgctttagatgcactttataaacatatattagtgtaataaagttgatatattttcaagagttttgtactttcgtcgatacatgtttttttgcataccgacggtttgatcaaagttcattgggtggtctaataagcagcatggcaacgtcaaaccgg

SEQ ID NO: 45247 - DNA, 14662 bp, Oryza sativa
  unsure (1)..(14662): unsure at all n locations
atattttcaagagttttgtactttcgtcgatacatgtttttttgcataccgacggtttgatcaaagttcattgggtggtctaataagcagcatggcaacgtcaaaccggcatcaatctagctgtgtgattggtgtaatttcattaagtttaactataacttttatttccactaaaagtttagattttcggtgttcgtaccattcatctctctagtaggtttggtttatgtattcgatcctatcaagatagtacagaaaatgtttttttctatacatatgtccacatggtttttgttatgtgtaccatagttaatattccctccatcctaaaatataagaatctaggactaaatggaacatttcctagtactacaaaactagataggcatcttatcatccggtcctaagttattatattttagaacggagggagtaggatagtaacgatgtttaaggttttaaatggttaactctaactccctccgtttaaaaaaaaaacccaattctagatttgaatttggacacacccaggattggatttttttgacggaggaaataagtcctcagacatgttcaaaacaacatgctttcgtgcttccgtgaccggtatgagtacaacagttatttgcagatagtggcaatgattccctaattttcaacaccaacaatatacgtgcttcttaaactgctaaataatatgttttgttaaaaaaaatatagaaaatttgttttaaaaattacattaacattttattcaaatttaaaataattaatatttaattaatcgtgcgcaaatggctcatctcgttttttcatattctcagctgatattaccagcgtctcccctctccagctctccttaaaagagcctctgtctcctaaaggcctaactagaatttgcttgaataatttgctactgcagcccagcacaagcgacgccatacatgcgcgacaaaagatcccaagcgggcctgctgtgctgtgtacagaagcggtctataaacctactgagccatcagagtttgaatgccctcccggctggcccttctccggttgaccgtgtgccgcgccacctggatgcgccgccgccgacggctgccgcccgctactcggccccgctggtgctgtcgcgtcagacccatcgccgcgcacccccaccaccccgccaacatcagcgccaggcgccactccctggccatgcccgggctcccctgccgtctccggagcagcggcgccactcgcgccgggccgacgagagggaaaccgcccgccgcgtcctcggaacgtcccgccgccgccgccgccgcgtactactgcccgcttcgcgatattgcggatcgggccaaccgcggacgagcgcgatgcctggaacccatgctgcgggtgcgggccttcgtgccacgggtgtccgcgcggcggcggccactggcgttgttggtagccctgaaatggcgcgtgcggcggaggaggcgggtggcggccctgcagcagcgcgtccgggggcagctcgccgatgttcacgaggtactccgcggcgaggcggccggctcgcagcagcacctcgtccctctgctgcggcgtcatgacgacgtgcggcggcgcggccgctgccgggtggtggtggttccgtggggcgttgggtccggtactccctcggcggaagcccgcgccgtggttgttgctgtagcgaccgaacggtgccgcgttgttgccacgggggttttggcctccgggcttcattgcctcgacgatggcgaccgagatgggtttacgcagacaagaagaacgacagcgcggcacgatcgaactcgggaattgatcgcggggcgctggtgattgataaaggcgctggtgattgatcgagtccgtgttagatacggggcctcggagtccatcttagagaatgtatcggacaccaattctgagcctcccatgtatgaaatcgttgctagtatatttgaggaattcaaaattggaataagttcactttgtgaccctcaaaagcgatcgaaatctaatctgtgaccctaaaccacaaaccggatatcttgacccccccccaactcttaaaaccggtgcaatttgactccctcggcggtttctcctacgtggcggttttcaccgggtctcctttacatgtggcgttgacatagcgcttaggtggcattaaaaataaaaatatgtgtgtgagacccatttgtcattcaccaaaaatatgggtgggacccacataaatcatcctccccctctctctctttctcttcccttcggcgagccgcgagcgtgtgacgacggcggcggcgggcaggagccggcagcgaccgggcgagagccgccggcggccggcggcatgtgggccagagcggcggcggcagaccgaagatggacggagagcgacagaggtaggctcggcccattccaccccggcgacgaggtcccgacgatttctcttcccattccgttggcggtggcggtggcggcaggcccagctcccgcccgtcgccgtcgatggccgccgcatctaccgctctcgccggccctcggccgcccgcccgccgatggttgtcgtcccgtccccactgcccgtcgatggccgccgcatctaccgccctcgccgtcnccgcngtcgctccagctcccgcccggcgcccgacccatggtgccatcgtcagctccctccgtcattcacggcgccgccgagaggacagagcctatcctcacctccaccggcaaagcgccctcactagggaccaagctccctcacggcgccgccgctattcttgaccgccggccgccgccgccactactcacgaccaccggacgccgccgccgctactcccgaccgccggatgccgccgccgctactcccgaccgccggacgccgccgccatccccactgccactccggtggtgaagagaggcggggggagagaatgagagaagggagagagggaggaggaagaaggggaggagagaggacgacatgtgggccccacatgtcatcctctgtgtgaatgataaatgaattatttttttatttttaatgccacctaagcgccacgtcaacgccacgtgtaaaggagacccggtcaaaaccgccacgtcagcaaaatcaccctccaaaaccgccgagggagtcaaagtgtccggttttaagagttgaggggggggagggggggagtcaagataaccggttttatggtttagggtcacggattagatttcgatcacttttgagggtcacgaagtgaacttattccttcaaaatttccccttcttccataacgactgaagttccttactgggcctctagcttttgaagccattcttttcaaatctcacggtagacagggaagccctctttttctggcgtaaaatggccttgccccgtaatacaaatgatgcaccatatgtttattataggagctttgccactgatcggaaacgatttggtacattatactggaccagagcaaatctcttattatggttgcctcggatgtcctgtaaagagaagtccacacccgcaaaaaatcatcgacatgcgggctacagcctacagtacatggaataagtatgcacatccgtgtaaaatatgggttgacatttcacagataaatggagtgcactgcaccccagaaataccctttttatcgtaagctttttctttgtttgaacgaaaggacacaagctatgcctattgcaccaaagagtaataaagaggataaaatagaagtttacaagcagaagggaagaaggaagcaacacaaaaacgaaaaactcatgcaaactacgctagaaaatatcctccaggcaatgtcttgtgactaaaggcactggtctcgaaaagttagcctattcaatataccatttaacctataccgccagtgcttttgaatgcatgagcggcttttaggtgtaaatcacttctttacgtaagttaagagtttagacatatcttcatggaatatctttacaaaataaaacaccagcaacttaaatttgaggatacagggacagggagcttatctgacctgacatgaaaatctacgtactttcctctcgaaatctatttgaggatagggcacagggagcttatctgacctgacatgataatctacgtaccttcctctcggaatcttttccggaagccacacccaacaccagggctgttctggtttcgccagaccagcttgctctgtttttccttcccatatgtaacaaatgaaagtttctgcacaaaattattcaggttttatcttcattgcatctcaaacactagaaaattcacaatatcagaaaatgtttcagcacgtacctgtcttgctctcttgtcaataggagtccatgttggatcaatggacggttctatcctctttttgtgacttgttggttgtacattgaaatctttccttgctctgcgattctgtgctttagctccttccttgcctttcccataatgctgagtcccaaatgaagggctctggtcccccgaaggagtgtctctatctcctcggtatctgaaggattctttaggtggaggatttagaatctttgagttgctatctctcattcttgggatcgacatacctggtgaattactacatctagatctctcctgacgtgcttttctctttgcactcatttgccttagataatcaatttcccagcatgacccctgtgaagttgcatggctaccaaaatctagtttctgaaaagcaagcgaacttgctggatgttgcataatttcatctcttggttcatgatatctgttgtccatatcatatctgtaagagtcgtctacagtacctccatgtgcaagccccttccatgtttgttttgtacctcctgaaatgttccactcaccaggatcatcgttgatctcaaatgcagttgaaaatactggattgctatgagttctgctgcaagatggtctgcttgtgtgaaaagtgcttttgcttggatgcgtaccaccaaattcaggttgccagggtaagtcgaatgtgtccaccatattgccagtccttctgttatatgcttgattatttggtgtcaatccattgctgaaatcatcattaatgacttgattaccaggtattgcatccacatcatgcttcttttgttgataagagaatccctcacttctcatattcaaactttcgtcgaatgtaaagacatctgggagctcgggaattgtattatccatgtcagagaacttcctcaacttagaaggtgagaatacctcagcatgttctgcatagtcaccaggtatttggtttagagaatcagaaaagaggagcttattagttggtactgcacaagcctgcaatgaacgctgtttccttttcctcggagactgcaggaatgcactactgatatctgaatcgactgaagagcattcagtcattacagaccttgattcacctaactcaccaaatttgcacaaagcattaaatagggaaatgatctttggagacaaaagatactttccaactgcttgaatacggcgctcatgtggccaactgaggaactccacaaggctgcctccagaagaaagtaacatatatgcagacacgggattgatggaagggaaacttgtgagaaatgattcagccaggctttctgattcaggtatatctggaagaggagctttataacagctagtcacatttgtaatgcaattgagaattatttcatctgttgacctgggtgtgtgtgagaagaacagctgcaagttcatgtccaaactagcagctgcagtatacaatgaatcagatgagtccattacagcagaaaggaagtcagcttctccctcaaagacctgcaaaagtacaaggaaactgttctcttatgatagatcaagaattatcacattcacaccaaaccaaaacagacaggtgcatttgcatcaataacatagcaatggcctgtgatgctaactatatacgaaaaagtaaatacttctagagggatacaaaattaattaccatgatgcagccagtgaaagagaaactaactgacatcagaatgttggtcgcaatattctctacattttcttttataccagatgtctctgctgatgttgttagttcattggcctcaaagagcgcagtctcataccatactaggcagacagcagcactgagtatcagatccacaggcagatcaatatctcgctccacgacctgcattcctcctttctccagagctagtatctgctgataagatgatcttcgcgaaacaagcatcgtctttccatgatttccagtatttacaactatcactacatctgggacggacagtcttcctggcatgatgcagtcatttttcacacaggaaggtaagtcagtagtggactgattctcttgagggtctttcagcacattggcagatacagaagaagtagagctactcttctcaactgtgggtacacattgtgaattgacaacaggtttattactcagtgtttgctgtatatgtagctgttcatcagcaagcacaacgttatgtgaatcaaaagtattcttcttgttaagattttgtaatctgtgtggttgatcatctggaagcagttcttttgtagcatcagcagcaaaatgtttgctccgtttttcttgaagaccttgcagttgatttgttgctggtatgaagtttaacgaatcaacaatacgcattttattcatcctctcctgcaaatccttctgaagtgtaagcaaaactttatcctgcaaatagtgaagcattcttaggaagttaggatgttccatgttgatcatttgctacaaacacctactgccctattactaagtgtaggccctcaaaaacaaatatgtggggaaaaaactcatttgtatggttttccctctaacaagatcatgcaagaaactcatgctcaattgaagtactcaactacaatggatagaagttatgattacagagctgagactaagtgtttcatattacaatgagctgtgtgtacaagatataaaaattttcatgtagtgcccccctccccaacacatacaaaggctggcttaataataaacaacatgattggcatatgacaacagaataaatggcagcatggagtgagtgataatcaccaatgtagatttcaaatcctggtctttatggttgtcctcgactagagcagctggaaagtccttgccatcaactttgacatagaggaaatgcagaggtggcaaaccatctaatttaggagcgagagataacaaggtagatgatttattcgggcctccatattccagtatgatgccaaacttgtcaaaagggaatgaagctggaatgttccttcaaaatgatgacaagaatggatatggcataatatttaatatcagacaagcaaaaactaaactgtgcatagaaacaatttttttgacaaaaagagccaatgaacttctggtacatttaagttattgtaaaaaagaccccaaaaatatgtctaaactctaaccacagttgatcaacaatatgaacaaccagtgcaagatgactcagtggctcacaaggcaattgatccttcttaaagggcaagctacttctaaaaacatgatcgtcttgtaatatgtccatgactccatgcactaagaaatgaaagttgtggcaaacatggagggactgttaatgtaacacattcatttagctcaccagaatgaattcaataaatcctgcactaattcttgtacagtagaaaaaggtacagcaaataactagctaacccccaagaaccagcctatctgcttgttgaagttgatttgtaataagaaaatgaaaagcaaggaattggaaagaaaattggcttggtttatttatcaaatggacttacttgttatctagcagaatgcaatctgatttcagtaattcttccagcacccaagctgtagagtttgtcttgttcaccagatccacaaaagttgttgcagggttttgtccaaactcaacaaatgtcatcctcatggatgctagcttttgacccagtggcagccagaaagctctatcagcaactataaggatcttttggtcgatttgtttattagatctcaggatagtctcaatgcatgacaatgacggatgagattcaaacagttgcctctcagatttcctctgtgcttcagaaatggaccatagaatatgttttaacctctcaggagtgttttccaagcttctagtcaggttgctaatgtacaaatgggccgcatgcagaccaaagaaacataagtaatatgcaacctgctttaatgcatacagtacaatgagttccatcttatctttgtgttcgcagtgattgtacgagccttctgaaccttctcccgttatcagttcaagaagtttctgctttgagattcctaaaccttgctcatctgagaaagaatgcctccaatatgtgctttcttgcagagcagatgtatagcttgcatggatttgttctataaggccttgaataagatttgaggggctgacaggatgaatttctatgagtttgtcaaccttagccctggttgaaagagataatgcttgctcttctgaatgcgggacatctaaagtagaagtattctcattattggttccactcttagtggcacttctgacgtttaagtaaaaatttaggtcaccagaatgtgatattaactcagggaaggaagatgacttttctggactcggtcttttcatggaactatggtttctagtaccaccttcttgttcgcatttttgagttgcttccaatttttgtggatcatgagacagtggggcaggaacataaatatcgctatgtttatcctcatcttgaagctttggacttctctgaaaatcctccagaaaatcgctaacaaatactgatgtactctgacaactcctttgcagctcagaacttaaatggcaagtttttgcctcctcaaccatgcttgcataagaacaacaaatctcccggttgcatggtccttccagtaagagatgccaatccaaataaattccatcagatgctgatagagggtgtggttttagggagcatagtatttcttgaatgggagggaccctagacctaactgctatatcatcatttaaaataggtgtaggcaatgacctaaatgtatcatcaaccagtgctaactcgcagctaaccattgattcatacaaacgtcttgctggatcaaaatcatctttgaatatttcatcagatatattcatcttatttgtctctgactgaacaagcattttgaatacattatctgaaggaaaatcaatgatctgtacctcctctaaaagaatggagcaaggcaagtctgaacaggtgccatcaggcttgagagggtagagtgctgaatttttctcaagcagaatattgccattgatcctcacaacatccatttctactgcagctttgatttctgctggtttatctacttgaatgtcatggcatggtgcatcttcacaaacaaaggtcagcatgtccatgtcagttgatctcaagaactcggttgatttaaacactgaatgctgaatctgtgcttcatccaagtgtctaacaacattatcaaaaacaccgtatctgtcagtctcagtcagacaatcgtcgagctcccaagaattcctacttacttccaatcgaggtattactgcaccatgatctagtgctgcaatctccaagcagcagtcttctctcagagaagaatggccattgccatcattgtcttttacagggaccttttctacttgatacactgactctggaagatcagattgatatcttatttttatgtcggtctcaatatcaatgaaatcctgtgagaaacagagacgagaacgtgagcatgatgtatcaaagaatatgtttgagttaataaaacacaagggaatcaaatcaacatgttcaccagcaggcataagcaacttcaactgatttatgtttttgcaactttgatggtatgatagtgatagttacataatacagaaatatgacagggaggatacaaatattactagtgaatccacaattaacacaaaaggtaggagataaccgcttatcatgttattgtgtagaagtatatattttgggtgatgcgcgcattacaatcgaaatacaacatggtataagaacggaagtatcataaccatttaactctaagtacaacatgttcatatgtctcccatagctgaactgcagctccatgcgcattattgatcttttgggagtatagaggagcgaattatttgatattgtgatgagatgatgtagttaccaaatggattttcatatctggaacacgaagcaacaacgtgacaccaccaccagactcctcttcaccaaaggatgcaatgtcttcttgcaaagccttagacaccagaacaatcgagtttgaatttgaaaaggaaacaacataataatatcaaccaatatcactgaaacgctgctcaccattaggagatccacctctacaacctcaaatctaagctccttcaattgttcccacctctagcaccacataatgcataaatcgaacatcaattccctaagaacagtcaaagcatgtacaaggctagcaaactaactactatgtcaccttcataactgaggagatctccagaccgtctgatctagagccctcccccttttcatccttctcgcggttgatcacgccatacccctatagaaaaacaaaaaagtgttcgcaaatgctccataggaaattcagcctacagaatccaaacataaaaacttcacttgccttagggattctgaatgcaccaaactcccatgagctgaaatcctcgccgtatccgcctctgtcgtacaggaagtcgtccaatacctgcgtgaagcagaatctagcagatgagctgttgcaactcacagatgccacacgattttctcacatagaaatatcaatcaaccaaaaacagcacagagcaagcaacagcaaccccgagccacccccaaccaagccccgcacgactcgagaacgcgaaacccgaattcgcaggtggctcgctcacctcgtcggccgcgggcacagtcggcacaggcagggcctgcgggataaccgcggcgaggaaatcggagagcgcggaggcgatggggagagggccgagaccatcgtcggcgaccgtggcggctgggagttcgtcggcggaggtgaacgggaggaagtggggatcgggaggaagggcggggacggggagagaggggaagctgaagaactctagggctagcgctttgccggcggcggaggaggaggacggcgcgaagtagtcggtggcgaggaagcgggtcctcatggcgaatggcgcggcggagaacgaagcgaggggagcaggaggttgaagacgaattttttggttttcaaaatgttttgatacgccaacttttgatcttggcttgcggaatgcggagttgcggtgggtttccgctgcattgccttgtgtgttctactaaaaaaaaatgtgtgctcttaattagccgtttctaaagtgtaggaatccgtttcagaaactgggcctaggattaatgggccggggtggtggtgccattatggtcgacgtgaacactcgtgtttcgtccgggaaaaagtccactgtgacttcctcaaaatatatatagctccaatctaatttatattcttaaaccgcaataccggatatcttgattctctcaattattaaaaccattataatttgaatatctcaatggttttggaggatggttttactgatttggcactttgacttggtataacctgttaaatcatcttgtgagaccctcctgttaatgaccctttttatttcttgttttccttccctttcacctctcacctgttaggagggcaggcagcgatgccctcctccctcccccacccaaccctagacatgtcagtggccaaaaccggcaagtcctcgttgcggtggtcgagggggattgaagggttgaagtgaggagggaaagggacggaagacaacaaaaaaaaagttacataggatgactcaatagtttggaccaagtcaaaaacgccaagtcagcgaaaccgtcctctaaaaccgttaagggagtcaaattacacagttttagtagttgagatagtcaagatatccgatattgcggtacatggatatgaattagattgaagctatatttgaggccatcaaagtggacttgttcctcgtcccgaaagcgagtcgtgagcgtgatcgccaacacggcccatttcaaggcgacgtggtgcggctcttcaacatttgggatggcgtcttcgaccatctccacagcacaatggtagtactacctcttctgttccaaaatataacaacatatctttatcaaaatataataaattttaagtgaacacatgacactaggatgtgtctcattcgttaaagggctgctatattttaaaatggatgtagtagctcataatttgatctgtgcattctttttttttgtacaaatacaaattttgatttgatttgttcattcatcttgttagtattaatttggtttgatcatggacaccaagtcatcaaagcctctgtttagcaatggccgggccgccggggctcacgtgctcgttggatcgatccgaagattcctcgtcaaaatttacaatactactactactccgtgtcagagtcaaaagactcaaaacgcctcctcgtatcgtggattcgtggtacaggggctccccttcctctcagtgcgcccgcggcctccgggtggcctccagaatccatatcaggtgcgtctcccactcgcagctccaacaaactccccgcatgtcgagcatttccctctccatcgatccagtatccccagttcccaactactagtttctttcagttgcagcgcgcgatctcgtcactctggtgaccatctgacaagttctcggcacgtcgcggccgggtggatttcgcatgcgcgcctgacgaattcttctcgtgaagcagggcatcgatcgccgggggcgatcagatcacccggtgaggtcgagctccgatcgctcgagtggcgttgccggccagcctggagtcgccggtgaacggcggcagcagagaaccttcagcgtaaaaaggtttgtccttctcgtacaacccgctcgattcttcgtgttcggttccagcgtcgtcggatgggttaaaccacactgaaaactcctgtgccgttgaaggggacacaggacttaaatccagtacggttatcagcatgcccacgtccacgtagtgacgtgaaacaaaaaccaacacaaactcgttcgcacacgtggacgcgccctcctgagcgatcggcgcgagcgtttttaacgctctccagcgatcgactgccgtgcagcactccctcccgcatccagtgctgtgctcaccgtgttgtttcgtctcaggagcagaaggccaattcaaccagccaaccagaggctgatctcgccgaggaagcggcggcgaacaacgctcggaccgcgtcaacgatcgagaaggcagaggagggggagggaggtgcgggcgggcggcgggtgggaggggcggcgatggcttcggcagccgccgtcttcccggacggccggcggtggtgcaagggcgggagctcgtcgtcgtcgccggtgaccaccgccatcttcctcttcttcttcgtcgtcgtggttggcgtcctcgtgtccgcccgttggatcaccaccaccgtgagttcggagttttctttgttttttcttcgttttcgaaatttcagtcgagcattcatggcgatggcgattcatcaatgtttatctgacactagttattttattggcatgagcgcagagtcatctgtcgatcaccaatctggatgagtggcgcacaaagacggtaggtaagctccatccttttgttcgatcgaaaattgtgaaacttaggtagtgtttggttgcaaggatgggatgggatgggatgggacgaacccacttttaggggtgtttggtttaggggtgggtgggatgggttggtccctggagaggaatattcctctcagatccgggaccaaccgatccgccaaaaactggcggacaaactcgtcccacctgggacgagcgacggcgtcaccgcgccatccaccaccttcgcgagctccgtcgggcgcccacgagcgtcgccgcctcgtccacacccgccgccacctccgcacgtccttctccgccgccgccgcctccttgagcgccgccgcctctgcctcgtccgcgaccgccgccgcctccatgagcgccgccgcttgcccgcgaccaccacctccgcgcgtccacgagcgccgcctcgcctccacggccgccgccgccacctccacgagtgccgccgctcatccgcgaccgccacctccgctagcaccgccgccgctccactcagatccagccgccgcctcgcctccgcgcccggcgcctcctccgcttcgtccatgactgccgccacctccacgagcaccgtgaccgccatctccacaaactccgccacctctgcctcgtctacgaccgccgccgccaccttcgcaagcgccgccgccggtcctctataggtaaaaaatccttagaaaaatgaatcctccaaaattcttttgctaatcctccatttcaaaggtgccctaagttgctaggatcctctaccctctgacaagatcaaagactcgccatctacagcg

SEQ ID NO: 45248 - DNA, 3579 bp, Oryza sativa
  unsure (1)..(3579): unsure at all n locations
agtatatagtacaacataacatgatttaccatacaatcaaacaataactgcattgttctctttttattttcctcaacaaacttctaacaatatgaacttctctagatatatgtttgcaatctttagacttatatacaaatatggcctaaaagtaactgattgtagcttatttgaagtaataaaggccagaatgaattccgttacctagaaggagagtaaattttgcaaaactataaaaactttcgatgaaactatattacaaaactattaaattccagcagcggcctaacaaaacaataatgcaccaaattattaggatactacatatgtaaattacgatatcacaaaactatatatttccgcgtaaattcaccataaaacttcaaattcggaggttatagatctcttgcgttattgccaattggatttcaaaatttatgattttgcgatactatgatttataaagttgtagtgtagtttttattactgctccctcggtttcagattataagatgttttgactttagttaaagtcaaactgcttcaaatttaactaaatttatagataaatatagtaatatttatattaccaaattagttttattaaatcaataattaaatatatttttataataaatttatctttggtaaaaaaatattactattttattctaaaaacttggtcaaacttgaagtagtttgactttgaccaaactcaaaaacatcttataacctgaaaaaaaaaagagggagtagttaatttgatgctatataggcatgtaattttacaatatcataccttaaatatgtacatacttaagttttgtgataataattttattattaggaaacactactggagtaatttctgaaatttactctgtttgcgattatttgcaattttattatctcaactcatattcttccttcccctgcaggcaatcctgacctccacgcaggccacatccatcccgggcacccccaccgcgccgccgccgccgcgccgggcctactccatctcctgctcgtcgccgcctctccgccgcgaccccgccgtcccgaagaacatctcccagacgctctacctcgcgctatcctcccgcccagcctgcgcccgcgtccccgagccccagccactcccccctaccaccaccaactcctcctgcccggcctacttccgcttcatccacgaggacctccacccatggcgagccgcgggcgggatcacccgcaggatgctcgagcgcgccagggacacggccaacttccgcctcgtcgtgctccggggccgcgcctacgtcgagcgcatcgcgccggccttccagacccgcgacctcttcaccatctggggcatcctccagctgctccgccggtaccccggccgcgtccccgacctcgacctcatgttcgactgcgtcgactggcccgtcgtccaagccgatcggtaccagggggagaacgccaccgccatgccgccgctcttccggtactgtggcgacgacgagacgctcgacgtcgtcttcccggactggtccttctggggttggttagtctacttctcctggtcttcacatcattgtatttttcttgatggagtgcttgcagattaacattatattctactggttaacattagaatgaatcccaatatcccacaatcaaatcacaggttatttcctatgctgttattgctacgctactgttactagaagtagcacaatgattgtgttcttcatgatagtcaggtccagtaagcataccatcagtgtgcattgtgggaggatgcacatgtttatgtctgctgctgtgtttctgacacagtaaatatatgtgcttgaccattgcagtgcttagattaaagatcattcctaagactgcaccaaaattaagtatgttctttttacgctttcattcggacaaagcaccagagcttaaatagactgtctgtgatgataggccagagatcaacataaagccgtgggatgcactgcagaaggatttggatattggcaataagagggtgaaatgggtggatagagagccttatgcttactggaaagggaatccagatgttgcaactaaaagaaaagagctggttaagtgtaatgtctccagtaagcatgagtggaatgcacgaatttacaaacaggcaagtatttgtgcctatgatttactgtgcctagtcgcacttcaattaagtttaatagtcccctgttctcgcaagtttagtccttcatattccttttaaaagaataattatattttagtatgtgagttatttatcaagaaaacagttatgatgatgtttatgattgattagctattttgcgcatgtttctcatatacaggattggatcaaagagagtaaggcaggatacaaacagtcagatttggctagtcaatgcacacacaggtgtgttttcttttgttaaaaggaatataagagtcattttgctttgttgacagtactgaccattgtgtttggtgacaggtacaagatctacattgaaggatcagcatggtcagtcagtgagaagtacattctagcgtgtaattcaatgacactggttgttacaccaaaatactatgatttcttttcaagggtgctgatgcccactcagcattattggccagttcgagatgacaataagtgcagctccataaagcacgctgttgactggggcaattcaaacaagaaaaaggtatcatcttttatataacatttaaatatcaagcaacaaagttatgtggcactagatatcagttttgatcatgattggctatttctatgagctgaaacacattggtcaacaactattaatttgagctgaaactccatattcacaaactacttcgtgtgatatgctcaccctgatagtgtgggaatcttttgcaagataaaaaatttaaagcttctaatgttctatagaaagtgatgcccttcctttatctatttaatataagcacattgatggagctgtaaataattgcattgtttttctcgtgtatttcatctgaaagttttgtgcaataaccaaagcattgatgaactaatattcaaaactcgaaattatttcttgatgggaagttatcaaccgtagatcttaatccgtgctgacttgtccaatatttagtgaactagaaatttttacttgtcttttcattagtaatgatcatgtttggagtcaaaggttacatttttctataacatagaatattttaccatatcgtcctgtgatagtaatatttatatgaaaagcatactctcatatctcccttctaaaaactgttgaaggcacaaaaaataggaaagcaagcaagcaacttcattcaacaagagcttagtatggactatatatacgattacatgtttcacctgttaactgagtatgctaagctcctacggttcagcctaccaaaccacctgaagctattgagatctgtcgcagagnttattggcatgccaagctataggccgtgaaaggaagtttatggaggactctatggttaagtctgccaacgatgcaggcccatgtgatctgccacctccattcagccctgaggaattcaaagaattac

SEQ ID NO: 45249 - DNA, 2322 bp, Oryza sativa
tatagaatactcgagctgccatgcttgcaggtggactctaaaggatccccattcagccatgaggaattcatagatttacatcagaggatagacaagtcaatgaagcaggtggaaacatggcagcaaaaggcttcgaaatcttgagtatagcaagcattgagagtcctctgtttttcctttcctaccgacatgcatataaagttttggtcaattattcagggtcaatggtcaatacgcatattctgtagtggtaataatcgagagtttttcttatgagattgaatcaaatgcataacatatatagaccttacaaatggttggaattttaaaaaaaaaccccccccccccccccccccctccaaaaacaaaaggaaaaaaaacacccttcatgcttgttaaggaaatttttacttctaactgtcattttttatactttgtttgagctggaaagaaagaaaggattttgaatcccactggaacagtattcctgaaagtttttaccggtcattttgtaccaattttatgagaaacaaaattgctatgaaattcttagatcatactttctataataattaattatttgaggaaatttatgattaagggcatgtttggggagattctagctgttgcagcttctcccagaatcagaagatcccttaaacagtcagttttttatccagattatgagaagctgtagttgtagaatccagaaaatgaattagaagccagaagctgggtagattatgagaagctgtagttgtagaatccagaaaatgaattagaagctagaagctgggaaacctagctactccatattttcagaagctagctaccaactagttactctcagaatgttaagctttccccaaacaggccctaagtacagcatatcctagccgcccctttctcaagggaaatggcgcaaggctaaaattagaccgttttatttgtcttgccctgtccatagaagtctttaattttagctgccttagcggcttcaaaaatgactcactatgtccataaaagactttaattttagctaggcatattaagtaagatattaaaagatcaatatgacattcattaatatggagagaaaacaagaagcagaggcaaataaggacataaaggaagtgtaacgccccgatttccgcgtggcgttaaaagctaattcaccgaaaaccctaattgcgaaagttttgattcttttgagtgatgagtctaagttgtgccaaagatcacaattaaaatccctcaaatgtctcgataccctgttatcaaagatcgtctccacaaaatttccatcctaatataatcccgaagtttgatcccttctattcggagttccgtcctgaaaccccacccgtgaactttgtcgaatgtccgaaccctaacccactccaatgattcacctccgattcctaaactctctcattagttccttcaaaccgattctcaaatccgaattcaatctctcaggttttgattcatctatctttctctctttatcggttcgtcaatctacccttgttttccttctcgaacttctgacccaagtctgaatatgcaaatcgagaccacttccacccttgaactctaaaccccaaggttcaatccctttcgccttgagttcttcccaaaaggatatccgttccgaaataatctcgaagtccgaacccttctattcagacttctcttctaaatcccttacccgcatatcccgtcgagtagtcaaactcaagctcccaagttacaatttctttctctaaattatccatctccctttgactcgtctctgaatattgttcccttccttgactcctttctattctcccgagaccgagtatcaacttcgaattcgaatccagactccagccctaaaacctctccaattaaacctctctgtgaacgtctaatttaccccccccccatggtggtggattcccttctttcatttcctcccaggtccacctcttcctactcttccggcccatatctctctccctctaaagtctagacctatcaaatctacctatttatttcgcccctctctctacatcgatctacctagcgatctatctatcgatcgatcgatccatttatctatctactatacctacctatctgtttacctatccatccgtcaatccatctgtctatccgtccctctacctatcgacctatctctctgtccatctatctatctatctttgaactctttcccaaacaattgtcccaactccaagaatactaggttccttttgaatccctctcaaataactcttgagccgccaaacacagaaatattccagaaatatataa

SEQ ID NO: 45250 - DNA, 7476 bp, Oryza sativa
cgcatctcctcaaaatgggaaaagcaaaaccccccctttccactgcctcgtcctccctttttccttcccgagctcgaccgctctccccctgtcctcgtctctttgcacgcagaggcagagcgccgctgatgatgccgcagcagcttgcgcccccactttggccacactgcgcaaatcctcccgccctcgcgatttgattctcgccgtccaacccaccgcctccaccgcgccctttgcatctacgccgtcgctcgttctcgcgccgctcgtgactgcagccgagcgctcgaccaccaagtcggtttccccctccctaaaccgacctcgcctccgctataaaaacccgagcccctcccatcgccctctctcgttgtctcgcctcctctgcatgccgcaccattgccgccttgacctctcgtcgtcgccgtcgcgcgtgctggtgaagccggcgtgcgcgcggggagcggaagaggactccgggcgccatcccttcttccccttccccggcccgaggccggagagctctcccgcgccgccgccgctcgtcacggcgccctgtcccgacgcggtagccctccgttcctcttcctcgctcaccctctccctcctatagctcgcacagtagctcggatagccctccggtagttcgtagaagcccccccaagccccgcagccgcctggcatggcctcgccgccattgccgcccgctcccgggggccgccgccgtcgccagccctcctcggtgcctctcctccccatccggcgcctgaaacggattccccgagccccatagatactcccaccgccttgaatcgaatcctcatcgcccctccgccgtttcccccttttctcgtcgccggcgtgcgccgccgcgattcgtcgtcaccggcccctcttcgaaggatccgatccgttggctcatcccctctcgtgctcccctttgtaccggtgaactccctctcgatcgaatctccgcgtcgtgcttcggtgaagccccgccgtcagccgccgttggttggagctcctgtgcatcttcctcctctcgcgcggcccgcgtggctgccacgtaggcgccacgtcggtgccaccttggcaagaccgagtcaaggcagcccagtcagcctccccctccgtccctttcccctgtgcgcgcggtccacgacaagtcgagcggctgcaagtaggcccgccgcactcccgtccacaccggcgcaccacccaaaccgcgtccacccaaaccctagcgtcgcatcccgcgtgcaccccttccaccgtgaaccttgccgccgacaagcaggccccgcccgggaccccgcgcggtggaccgcgtacacccggtcgaactccccctcccacgcgcccctaatggaccgatcacccgcgcccgcaccggcccaatggcctgaccgcactgcgcatgaccccttgggccgcgcctaagccgcccgaggaagtctaaatgacatccctcctatccttttcttttccaagggatttaatataaccttttccctttgttccataaatcaattccttattccaaaattccataaaccatttcctttggtccagcacgtcagtgactgtcaataatgttcttgagaatattatttctataaattccataaaccatttctctattctagaaattccatttaaacttccgaaattcatatctctcaatccgtagcttcgattgactccgttcaacttccagtaattccgtaaaattgagatctatctaatggtactattaattagtctaaataggatctttcttttggtcttttgtttaggttttcgattgtttgcgtatagttgcggttgcggatttttgtcgatcagggatttctcgaagattcgtgagatcaagaccctgagcaaggcaagccacctttgaacatcttgagccctataattgaacttaattatattgcttgcaaaatattatgcattgataggattgcacataatatgtttgccccgtctgcgaggcagatcagtgggcatacctaacttgttgcatttgatccttccattgttaaattgttatatcatgtttccttgtaaccacctggtcgagcctcggtattcgtgcactcggtgcgagtatcgacggtcgccgtcaaacttaaaatatggtaaacatcttgggtaaaacttggtttacaaaacgattggaaaacccgacgcctggatcggtgccttgtgaaagaaattgagatttaaaaataaaaatcgtgacacaaggccattcctgggcggaatgcttgtgcggtcgcatttaaggaccgattccttcataattacatccgagcatataatagtgcaaccacatgggtggagtgggacacccctggctgagtaattagctaatcaggggagccttgatgccgagagacaagtggattcgccggggtagtgtcggggaggacccctaggcttcctggcacagtatggtctgggacctaacctgttgttggtctgggacccttctcgtcggcatatggtaaacctgtgttggctttggaaatgccttgtcatgaaagcttggaggtctcccgacgtggctgatccccacaggctgggtgatccgggttagtaatgtcatgtgggtaaagtgtaccccctctgcagaggttaacaaactgttcgaacaaccgtgctcacggtcatggacggatgtgaggtgattccttagcgtagtttttcgttttacccagttttatgaaaaagtgataaggtttgggaaacccgatatttggaaggcaagtggctgtcagggagacagcgggacagggagtccctaaaagtgactggttgtttggagacaaccaaaactctgaaagtctagaaaattggtttggtttgggaaaccagctttgaggccaactctgggagttgtgcaaatcttgataaaataatattgttcactcctcacccccggccgagttgagacttgtcttgctctggtcgcggaatgcacacacttagattgtcaaaatgcttgcaaataaaactgattgaaaaataacagccttcccttgaagcttgcattaaccacctaagttcccctggcttgttgagtacgtaagtactcacccttgctctctatataaacatagttctgccagctctgaagatgaagttgaagcaaagattagggtttcatcctagttcccagccttcgcctgtggtgttgggtgttagaccgttggttccgctgctgctgttgttgttgttggtgtttcctcgtccgcgtcgtcggttgtattctcgggctgttctgagctgtaacctaagttaaggtaaataagtcctctatttaatttaaggattgcaatgattcatatttatcaccgtgggtaccagcgctatatcctaggactggtactgagattgcggtttcgtaggaagcggttcgcaccgtttttcctacgacacgctcctgtcaggtgccgttgtacgacggtaccgaattggggtgtgacaggaagtaccattggttcgatggctaaaataaaaagaaaaagatcaagtagtatttaacggatttaatgaacaaattttcaagcttaagagagtttttagggaccgatggagtatagaggtatattcaaccgcttcaattaggatcatggttttttttacctacttcattggattattgttacaaattatatgttccatgcttctaaacatatgttattttttagactactcgtggcgtcgctgcccaggcgccaacttgtgtgcgtgccaatttgtattgatctgcgtgttcaccttcatttcttttctctagtaataaatattaagttcctgcttgttatccatttatttgttttaaaataatgttttttgtgaaaaaatgttcttctatttgttaaatttatttattaaaatatttaatttattctctataacatagataattcgacacaataatcggatggctagtctattttaagtggaaaatctaggtatagcatagaaagccactccttccatccgttctaaaatataatcgtttataacatttgaaatttgtactataaaaatataagagcaagtataataaagagttataagaaagctgaatgctgagctggatgagagaggagaggagagatattagaagcggactgtaagtttacagccggcttaggcacatgaacaaaaaaaaaatatgtgagacagacaggtggaccatgtatgatggttcccaacctctccttctcgatttccgcgcgcacgcttttcaaactactattttgatgtgttttttataaaaagtttctatacaaaagttgcttaaaaaaatcatattgttccattttcgaaaaaaaattagctaatacttaattaatcacgcgctaatggatcgttccgttttccgtgctagagccaaaagttcccaacctgctctctagaaacagaaacagagatatgctataaagctctagtattagcctttgctctaagcatttgtaagcattattgagagcaatacttgtcccatcaattaatgagccagagggacaattgacaagctagagatgcttgtactactttcgtcccagtataagtgtagatacggtttccgtatccaatatttaatcgtccgtcttacttacaaaatatatataattagtatttttattgttgttattagatgataaaatataaatagtaattaatatgtgactatttttttagtattttcacaaatttttcaaataagacaaacggtcaaatattggatactgaaacccacaactgcacttatattgggacggaagtagtattttgaaatggaggaattgacagcttagcatggccattttatgctttaacccattgttttgtttgttatacagattgtccgcattccaatccgcagaaaccttcttggtataaagctaaccaattgaacaaacacatacagatgacaaaagctggggccataattttgaagcaacactgttcatatatattgaaaaccaacagtaacgaaaatcctgctccataagattcacaaggatccagcatatacatatcgcaagccataatgttaagggaagtgtcatatttacaggtgtcaaaagatgaatacaattgaccaaaaaaaacttatactcaaacatgctaaatggacagacgacttattgactggatgcagtagctactgattggaatttgatagtcagaaattacaagaggaatcaggtcctaagataagacgatcatgagttggtacaaatggctaacacaacagacaaggcccacgactatcaactctttcacagaaaagtggaacaagatatatgatcacagacgctcatctcttaatgagaaaaccaagcaggattcccagaatagcaataaccagcacaaaaactagtgagaaaccaccgtgctgactccccatttgcctccttagaagatcctgttcaattccaatagaagataaatgaaactacgtgagtgttgcagtttagattcagatttcattgatgcacaaagccataatagacaaacaagatgatatttgtagataacgaaatacatctgtacttgtagaaattagtgggttgcaaataaacttgacaaaaaagtaaagaaaaacataaagcgcatgtaaactggttattctgtctatctaactcaaagctaaaaaacgtattagtgtttttttcgggtggactggtcactgctggcctcagtaaaagaacagggaatgagtaaatcatgtggtgattatttattggagatgcaaatttatcgacatagctgttgcttaaacctaactagcttatgcggggggataaattaatctatttcttactgccaaagtaaaaaaatatattgggtcactaaatgtttgcataatcaagctaaccagttcttctcgaagcttcatgttctgttgaatggcagaactcttctcctccttcaactttgaaatcaaggccaatggctgcacatagttgtgaaagagatcagcatattgtgctttggcatcattgtcaggtagcataggaagtcggaatcctctataagaagacctctcagttcctcagtttgtaacaaaagtaaaatgctaacaaagtcaagatatgctagaggatgaagcatccctcagattaagttatcattggcatctaaatatgttgagatgaagagccatgatttatgcaaggagaacattaatcaaaagatcatacatgtagagtggagcaagaagattgacaagcaaaaataaatttatagtagtatgtgaagttaggatttagtgataacatagcattgtcaaatttaacaagagaacattgcaacacatatatcaagaaaagtacatagttttcctcagggaaaaaacaaagtgcatagcataaaacagcacacacatagttctgttggatcagagttctaaaacaagtgtcatgcagaggactaggaaataagaagagcacagcaacactgtaaaatataattaaacaacttctgaagcaatgctcttggataaaatcacacatagtatctctaaattatgacacctatcacaagaaaacatagatgtttcccatctgaagatgcatacctcagaggttactgtttctgattctctagatccttttgttgcctgcaaagagaagttcgcaatttgtttcagatgataaggcaatgaaggatcaatgcactaacaagaaacgacggcggatagctgttagacatgaaattgatgaaagccttacttcttgataactcaagcttcctagaccttcctcagacccgccattgagagatgtcgggtgaggttgagtataaacaacctttaacttcacctcatccaccacattacctgattctttcgtaaactacataggatcactcattaggacacaaagaaagcagccaacataagctacaaatgcaggacacactagaaactagaaagtcggttggttaccatgtctccggtgatatccttcggtgtgagctcttgtgtcactatggcactctgcacaaggaatttgtccttgcattgcatgtccggtggcgcctcccgctgagcttgcattgttactagatttgataatcaattgataactaaattcttagcataaaaggcagtcattcagaataagataatactgacgcaattcatcaaattaccaagaacattggatgtggactggggagccacaatgccgttatttggacggacgcagtacttctttggactagttgtcttaacctggagaaacgatgttgaattaatttagttacttattactgcaatgcatatttcctcggaattagaggccaaaaagattttattaataccttaaacgtgacatattcatctgtcttgtttgttaggtgcagagaacacgagatttgcttctttaattcgactgcatgattaaaaaaaggatgcgaaaggatgaatattctgaacaagacaatatt

SEQ ID NO: 45251 - DNA, 9739 bp, Oryza sativa
  unsure (1)..(9739): unsure at all n locations
aaaaaagaagaaaaaattccccctgagaacaaccctgaaatttcttcatacataaatttctcgaatgaggccgcattaaaatacacccggaaatccatcggaaccaccgaatgaactgcaaaactcccttcaaaaaacccccaaaaagaaattctcgggacaagaaaacgcacaggggaagatgagctccgggggatcgatcccgagcagctccctggagtcggagctcatcgccggcgaatactcccgaggatcaaacgggaagcgatccgctccgacgggcgccccagaggcaaggcctccaaagatcgaatcttttttcgcctcctgcatccgactattctccagcaaaatattattcctggagcagaggaggaagcggagcaaaacggggaactcgttggaattttggaacggaagagagagagagagagagagagagagagagagagaggcgctgctgtctggctgcttgcaatgctaatcctgaagggaaacgatgcgacggacggacgacacaacgctgggaatcctccaagtgtgctgtgctgcgcagcttgctgccactagaggcacacggcgaaatgcgcgtcgctctctgggacccaaaaaaaaaatactcctgcaaaaaaacaacataagagaggctttgtgtttctcttctcttcgtcgtcttcgttttctggaggcggcgagaaggaaagggaaaggggagagctgggcttacttatcgttatcgacgctttctggccgtatttttctgctcaatggctgcttagctttgctccgcgatcaagacatgtcaaaggtgtggtagggatgtactcccccgtcccgaaaaaaatgaatctagaactggatgtgacatattatagtacaatgaatttagacagaggtatgctcaaattctaggttggttttttatgagacgatgagtcgacatgtttttgggaatacgcgaggtgcgcatttttattaagaaagaataaatgtatgtacaagacgggccgaacaaattaaaaatgaagaggacagggtacaggaggggggaagaaaaacagaaagcctatcttctagggaatttggtgacccatctatcaaagaaggaactaccatggccggtatggctgccctagccatccaccaaaggtccgcttcacccgtcatagccctagcgatctccggccaggttctgctttcctggttgaagagccgattgtttctttacttctagattgtccaagctaccagtgtggctatcgtgtcaaaccctcggctatgatccttggtcatcctcttgcggctgtcacacaaccaaacatggaaggactgctcgttgattggaagacattcggaatgtatgtaagcgggtcgacatgtgaatctacttatatatatatcaaataagtgataattaacaggttttcatatcatggtccggcttattatcatacctagaaatataagtgatcgatccataaacttatttatagattaaattagtaggtaatccacgagttaatctacggccactaaattttacttataagtgggtttatgggttggtaacttgatacacttacatccctagctagaattatatggccagtgggaggaatacgatcgctccggacgtactgagagccggatctactcctgttgcaaatctgatgtgaacaactgcaatttagtccggtgaaattgactaagctcctccacaattacttgttttagataggtcatcggtcaatatattgaaactttgagtatgaacataagatgttttttctttcctcgcaatataacatggacatgctttttaagtggatttgtatacctcttttgcgctaataatttggagagcatataactctttcggacaattctagactctagagtgcaatgtatgattgtatctgctcttgtcaagctaacttgggcgtgcagcctgctctttgaaatttaatcggcacgcttggcaggagtaggttctctactgtccttttcagaagagatatggtgcagcgtcagaatcaataacatatgttgcccatccaaacagtaagtgtgtacacaaatcagcgtcagccttttccaagttctccaagtttggtggttccttccaactactacctgtaagtcagacagtccctctaataaggtcctttttgtttcattttaaaattattatactctagattattaagtccaattgctagctataagctgaataataataaactaaattagaataaattgtaagttgtttgtttctctgaattatttgatacatgaattattgggtttgaaatattaatgtctatcatcttcttggctattttggatgcttgttcacttttttatcactgtatataggaaatatataattggtagtggctaaaaaatattgtcatatatatactacagtggcaatataaatttttcttggtagaattttgtgacatcaccattcacggttactcgtattagctattgtcgttgtccatacactgcatacaaattataggagtactcccagttcttttattacacatgaagaatcattgtctaaaacaacccaaatctacaatggcatagagcaccttgaaaacctgtatagcctattttgttttctaattaggatgtaacttttcttgcgaaaactttatagacatgaagttgctataaaatattaaataaatactttttcacttttaaaacttaattaattactacctccatattttaatgtatgacgccgttaactttttgtttaacatttaaccattcatcttattaaaaaaaattatgtaattatcatttattttattgtgacttgattcattatcaaatgttctttaagcatgacataaatatttttatatttgcataaaaattttgaataaactgaatggtcaaaggttggttgaaaagttaacggcatcattcattaaaatacggagggagtataagctaatggtttttctcctattatttgtatcacgatatctctgaataccaggaagtcaagtcaactagccatcgtgacgacaacgacatgccacccataaggagttagtactgtacactatacatatacgaatcgtcgtcctatacaaaatccagttgcgactgtaccagttagttcgggaagaaaaggtaaattataggcggcgttagctcacacgcacggtccaacaatgcgacgcaccagcagtccgtccagcaccccaactccccgcgagtcgtggtccggtccactgcgacggaaataagggaaagaaaacacgtaggtgtggtactatttagtatatacgtcaagacagatcgatccagccacagtgtggtacgtggtggacaggtgctacctgcccgatcgatcgctgggtcttcagtcttctgccgccgttgctcgatcggttagttgagtgagacgtgcacgtacggattggagtgcgtagctagccgtgaagtcgttcggggtgcagtgcaccaaggaggcgcagtacggtgttgcgtgacgactccggccggactgccgcccgcctgcggcctgccggagggctggtgtgatgcggccatggcccgtgggggcgcgttccgtttctccagcgagaccccgtattcgggcccaatggaatatgcatatgggccccttctccgaaggcccgtttagtgtttacaggacgattagaggccaccggtatcgctcttgaggaaaaagtgcaccgaaggtccctcaacttatcatcgagttacaaaatcgtcccccaactgcaaaaccagatatttggcgtcccataactaataaaaaccggtcacaatagctccttcggtggttttgaccctagttttgtcttacgtggcagctgagtcagcgtgggacccacgtggggcccacatgtaaggatgccacgtcatccttctctctcccttcctcctctgtctctcactcttctcatgttctctgggcaaagccggctggcgctggggaggagggcgaggtaggagaggaggaggcggcgggcaacacggcagcagcggctcccacatgatagtcccaactcttttctcttctttctgtctcgcaatggccgccagcggagaggggctgttgctggcctccttcccccttctcttctctccctagatgcaattggcgaatggcagaagaggaacaagacgacgccgaccttcccggccttctccttccttgagctcctcaccgatgcccatgtccacccgccttcctcttcctccacggcgcagctcgcagccgtgctcgcctgagcgtcggctgactatgcgcggcggtggtaatggaaaggaggggctggcaccgaggtggtcgcggaggtggcgcccatgcgggccggcctagccgcgcgcagggtggcactcgcggcgtggtggcggccccaagcaagacgaagaaggcaacaatcatggcggcgtgggccgtgaagacgtcgctgtggcgcggcggtcgccacccgcgccggccgtacctccccgccgcccacgccgttcccgtctccccgtcgacgcccgcgcctccttgtcgcccgcgaccatgcggatgccgcctctctgccaccgcgctcgcctgccgacgccgcctcgccttgccgccgcccaccccttctcccgtgtctccgccaccgcgtcgcctcgcccccatgcggctatcgcttttcggcgtcggcagcttcgagaactccccctcatctcacctccagctcgtgctccccatgctcctccaccgggacctcctcctcctcccgccagaatcctccgcccatgctgacctcttcgaccccgtcctccgcggttgagcgcaccgccgcgacggcgatgggcttctccgtgccaggcatcaacgacggttgctgccaccaccaactaggcgcatgtgcctccccgtcgcccgcccgcgccgccgtgcttccccactgcggccgtcaccgccggccgccattgcggcaccgccctcctcctctcccgcctcgccccgccgaccggcgccctacaggcacatagagagagagagagaggaggaatcgaggaagagaagaggggagagagaaggatgatgtggcatccttacatgtgggccccacatgggtcccacgctgacttagccgtcacgtaggacaaaatcggggtcaaaaccaccgaaggacctattgggaccgattttgattagttaagggacgccgtatatctgattttgcggttgggggatgattttataactcgataataagttgagggaccttcggtgtactttttcctcgctcttgattacatatggaggacggactgattgattcacaaaaatttataatttgatcctctccgaaaactaatttcacaaatgaatcgcgaccaaaacttatttaaaaatgacccttttgttaagcgtcaaatcgtatgacgctgaacttagacacctcagcatcacgtcaactggcgctgaatgctgtgccaccgcggatgggaggctgagtcggcgtgccaacgtgcattcaacgccgtgctatttgacgctgatatgtctaagtttagcgccatacgatttgacgctaaataaaagggtagttttggccgcggtttatttgcgaaattagtttttacaaaaggtaaaattgtcaaattaaatgctgattgattgatattggccatccggcgcagagccgatgctctcgatggaagtatttcagattttcatcgactgctgaatttcacggtcatctacagtatacattgccgcgcgcagggaatgcaagcagcaaacaggccgtgcccggtgcactatattcacattgcttgtcatatgacgacggccagtgaggcaggcaggcacacggatggcccacgcacgcactcagtcgaggtagttgtgatcagaggagataagggcaagggcaataaaaaagacgactgcttactctaatctttatacacgttatttggaggtaacttaatagataataaatataatagttgtctctttacatttactgcagcacacatatcaataattatttaattacttctctctcgctccttcccagcttttctctttcctccaagccaatcaggaaagattattcatgctaattttttgttccgtcgatggtgctgtcgatagaaaggcttcaaaccagtgctaggtgtattggtgcccgtgcatgatcgtcgacagattaatcgacgatgtttttctcttggtactctctctccaccacgtaggtataaaatccaacgtaagcttactattagccggtaatttcaagttattgtacttgccgtaagaggcaaagctcgcggcatcaccgtatcactagtcacctcatggggtcacacccgagcgtgattcagggccggccgggctctcggtctagcgctccgacactccgcgcagcaataaaagagcagcagcagcagtactgatcctgtgcgatccactccacatcccggttgaccgcggcacgcgcgggcgtacatcgcgtacgggcggctcgcgctagctagctccacacgtcgcgtcggatcggatggagcatcgtcgcgtcggatcggagacagcatatacatgcgcgcgcgcgcgtgcgggcgtgcgcgcggccggccgccggccagcacctctccgcgtctcggcgtctttctgtttctctcgactcttgctttctgggcctatatacgctacggcagggagggtgtgtgcgactgtgcggtacgctcatcttgggtggggagacaaaaaggcacggagaaataggctttgtatatacgcccgggtccgccgaccggccggtccatgcgagagaaaaaaaaaagggagtatctagccgggcggtgatggatcggaggtatgctatctttgcggcagtgttgcttaatggattactttttttaactttgcttgaaatacaataactatacacatatatcattaccggagactgatctttactgggtcatgtgaaaatcatattagtatagacatagtagtacgactttcaagaaataggtggaattggttttctttttgaagaaattaaattaaatctcgtgaaaacttttaaaataatgcattcattcaaaaaaatatatatatgaccgtaccaataaattagagggtatgtgcaaacgattgtccattttaactatttgtgtcctttctatattgaagtagcagcagcacggaggcaaaggcggagggtggaaggggacgattgtttgctttgtaggtcaagcagtctgttcttgaagcaacaacaaacaataaatagaatacacaacattaagatgatcaccgctccaatcgtagtcgtcctctaggttctggtttgcgagcgtgagttgtcacatgcaacatggacgagtcatttagagggttgggaagatggcatcactactaccaccattgatgtgtcaaaatactttcagaggttagtttttgatgtagacgttgtcaaaaatccagccaccatggctaagctgagatctaaccaaaacaacactccattgatttttcgttactttcgaacaaaacaatttaagatgcacattttgagagcgcacccacagtaatcatgatgaaatatcagaagaaatcaagaatactataaaaattagggtgccaagtcaaaccagtatgtgcattgttttatttggtcaataatgaatatatttatggactacgataaaattttgaaagaaatctaatgtaactacaacgtaatataatggtaatgtaattatacgatggacgaaatattggaagtttttctcttgatttttgatcgacgaaaatttagcaaatccttatattgagattgacgaaaattttcatataactaaattataggtcgttatattttaataattcgagctaaggcatgcaagttcaattaatttattttaaaccaatatctttgcgtaccaaggtccaaaatactactccatacattcctttatattttgttgtgtcttcagctagcaatttaaggatgaaactactccatacattcctttatatttatctctgttcgtactcatcatggaccgctaaaaacttttaaatggttagattatgataaatgaaaatttaaattaaatttatgtttagtatgtaatacactttgataagattcatctagttaagtatttagattttttaagaaaaaagataaatgatcaaagtttaaatatgaacaatgcttatattagcgacgacaaatataaaggaacagatatagtaattaaccaatgtcgtggtagtcgattatatatctggcaagggatttttgtaactatcatagacagagtgtaaaagttttttttagttgaaggaatcaaagaagttatattattctctttttgaaattttacaaatttatttgccaaaatcttagcactaagcacttaatctcataacgaatgtatggtgataaaaacccaaaacattttctattgaagaaaagcacatgaaatattaaagaaagcaacgcatgcatgcatgggtttctagaatttatattgctagatgatgttcatgagttcgtaattaagacacgtcttttgggacacaatcaggcaacggaacagcaacttctctacactctacaggtgaatagggagtacgaagatagtcctgaaagaaagaaaggataaaaaaataaagaaggaaaagaaaagagaaaaacagggaaaaaagtctctacgaggaatatggttataagcataaacctaggcactcaacaggattccccatctctcttctacacactcagaagtactctaattaagcaacacacatgatattaagagatgatgatctgatgctaattaaacccttgctatatagctagaatggcgccacacatgagagcgagctagggccaccaccaagaattcggtgcttgcggccgctttgccaaagctcgctagaacggagtgacgcccatgtttgcggctgcagcggcggcggcggctgccgcagcatacaggctatccttgagaagaatgtcttcagaaccatcctgaaaatcacgacacaggaagcggctacagatgaattgctcgcaaagcactaaagtaaataagagcagtgcatatgcagtgtttgccgggtgggtctgaattctgataaggctatatgagtgttcaggttacacagataactaggttatgcttgtgtctcccatagtagtatacgttaattctctcgggattctggttacctgaggcttgaaggtcttcttgaacccctgatccggcatgaggccaaaatgaatgtgagggaaatgggcccactgattgcaagcacaaggaaagtaaagccaaagcaaaggcaggtttggatcagtaaaggagatcgaaacaaatccgaacgaaccctagctatagcagctgtggggctaaaagctcccagaaaccacagccgcttgctctcggcatctcgcaagcggccgggcacaagctgccgctgtgtccgtgctgacaatgtaaggtgtccagtcaaatcaagacacgcgaacagctagcatcaagctagatactacaggatgagtaggagttcattaatgcgcggatcagacgaagaaagtttacattctttgcggctgcactgaacgcctcccggtggctgatgtccgggttgccggccttgatnnnnnnnnnnnnnnnnnnnnnnnnnnnnnnnnnnnnnnnnnnnnnnnnnnnnnnnnnn

SEQ ID NO: 45252 - DNA, 879 bp, Oryza sativa
  unsure (1)..(879): unsure at all n locations
tgtgtccgtgctgacaatgtaaggtgtccagtcaaatcaagacacgcgaacagctagcatcaagctagatactacaggatgagtaggagttcattaatgcgcggatcagacgaagaaagtttacattctttgcggctgcactgaacgcctcccggtggctgatgtccgggttgccggccttgatccgctggatctcatccctgtgtagcaattcattataagcagaattaattttttttacgagatgataccacgaatactgattaaccaaagctcaaaggaggatccatcagttttaattaggcagaaggtttatagagaaatcttacttgatgaaccggttgtacgcagatgggactctctgacgcttctccggagctgcaaaagttttggatcagacagcatccgaggaaacatggacaaatgggtaagctcacctaagctatcagtatacatgctgtctgcaaatactgaccggatcgatcgaagcatgggcttacatggccctgccacaacaagacatgatcgcatgccttgttgatctgtactatcatttctagtgctgaggagcgttcttcaagtgaatatagtacatattaatttcacacactcgaaagaaacactggattgaaatttgaaattcaacacgtacactagtacgctaatgtgtgcatatatgcctaagtaggagctataagtagctaattaacccctcttagcaagctttctgttcttaaacctcccaaacaacggtgaataagcaacaagctagcaggagaacacactgtggtgcataagtacctttgactacaaaattctagcgtttcaaagaaagaacacnnnnnnnnnnnnnnnnnnnnnnnnnnnnnnnnnnnnnnn

SEQ ID NO: 45253 - DNA, 742 bp, Oryza sativa
aattcgagctcggtacccagaaaccgaatacacatgtacaaaacccccctataggaatacgcaaggaaataatacaattggccaaaatagataatgagggtcatctccatatcattttgcatttctcgacaaatataatctgtttggctattctaagtggttctttttttctgggtaaagaggaacttgttattttgaattcttgggttcaggaattcttctataacttaaatgactcagtaaaagctttttttattcttttagctactgatttttttgttggatttcactccacccgcggttgggaactactaattcgttgggtctataacgatcttggatgggttcctaacgagctaattttcactatttttgtttgtagatttcctgtgattctagatacatgtttgaaattttgggtctttttttgtttaaaccgcctatctccttcgcttgtagtcatttatcattcaattagtgaagcataaactcatttgatctcctgatattaatcaaaattagcatcctttttcctttagaaagaaagcctttttccattttagcaaaattctttttttctatttctacctgctcaaggtattcatcattccagtacaacttgtgcagtagaatgacaacagattcgtgtataaggactagattagcttagctacctatctaatttatttgtaaaatttcgggatctgtgattgacatggaaaataaaaatactttttcttgg

SEQ ID NO: 45254 - DNA, 1560 bp, Oryza sativa
aatatcataattctcagccataatgtaagattgcatcctactacaccaatgagaaaaatccgttccatcgaaaacatgaggcttagttaaaaacttattagaagcagccatggcaaaaactctagatcggttaaaatccaaagaagcaaacaaagctttgataccacttgtaggattgaatcacaagaactaagccaaccaaagggggggggggtgaatggttgagatacccaaaaaccaaaaacttttagcggaaataaaagttaccctcgaaatcgatggatcgcggtctgaccgaggtagtcgtccggtctgaccgtctgaaagccaccggtctgaccgagattgaaactccggtctaaccgcctgatcagctgtcgcttgctgtcgccaccgccggtctgaccgcccttacgccgccggtcggaccgccgcgatgccgccggtctgaccgccactgagatgccggttagactgccgaaacccggtgaaacacaaatcgaagaactctcaaagtagatgacaactttattgtttctctctgtgtttacaaagtgcaccaacaacactccttacaaaaatctcgactaaactcaaaaccctaactaaactagctctcaaaagcaatacaaaagcgatacaaagcgatgcagggaagactcacgctccccctctatttatacatgaggtaggcagcctaaagccacgaatcaaactcatactaagagtcctaaacaccttaggaaaccctctagtacaagaaagaacctttacataaccaatcgtaccaaatttgactccttccaaattcgactccgcatcccatacgcatacaatacctccatcatatgccatatggaatctccatcaaccacgtgcatcaactctagccttagtatcccgcatgatatttgaccaccacggacatcgtcttaccaccaagccgactcccggtccatcaccgcaaatactctcccgaggcatcgagtcacctacacatgaaacaaacaaagaaaccatattccgagactaagctatctccaacttgactcattagtagcaaacaacagtattacatacgtataatatccatctagaagccataaccatgaaacaatcacggatatccaaagaaacaacccgaaaccgaaactgacacagcgtcgaccggtcagaccgcgggctgcgccggtctgactgcgcaatacacgccggtctgaccggcacacccagcccggtctgaccggtcccgacaaactagtaaatcctgttcattttctgaaaattgattatctccaaaaccacttcgacgataatctccaaatatcaaaaccaataatcacatatgccaattgttcatcacaaaataagaatcaaaacacacattgatcttacaaatgattcatcaagaagctacgccatatagcaatgcaacctaattttcattatgcttgtagcatgacatgatttgtaggtgggtggaagttcttttggcgccatttaggttgttacagaatgtattagttaatttgtttgttagataaatacctcaaattcaat

SEQ ID NO: 45255 - DNA, 778 bp, Oryza sativa
aggatcgtcaccaccggcggatgggcaggcaacagcaccgacgaaggcgccgccacggggattcatctacattgacagcaacggtgatgacgacggcgacggccacggcgacggcgacggcggaagggcggcgaactacacgcgcggtgatggccggaacggaagggcgaatagctggattacggctctgaggaacgaggaacactaatgacgtgattagggtagagaatacgatacaagttcgtagggcactactggaatacggagggtatacgctaagaaaaaaaaatccaaattgctttacttttttccggtgctttaaaattggtgagaatacaggtggcatccatctaggatggtgcctcacgcgctgaggattggggctccgcacgagagaatttttttccaattcaggggtattggatgttgagtgttgagatcaataagctgccgcagtactatttatctagacgctggcagtcagagtcaagaccagacctgttgtaagccatcttcatctctgctctgctccaccggcagcctgaggagagtccaataaacctgtcacaaattcagattgcaacattttaaacatgccacacaattaaacgttatttggaacctcagaatcagtaatcctgcaatcgtttggaaacgcattaaagtatcaaactaaacagaattggtatgtggcagcactacggatctagcaggcaaactacaacctgttagcaacccacaatgtgccaaacaactccccgtcgcatacagatcatgc

SEQ ID NO: 45256 - DNA, 720 bp, Oryza sativa
ggcccgcagccgctcttcccgccgcacatcgcccagccaccgccgccgacgtcggtagtgggcttctccgccgcctccggcgctggcccgccgccgtcgtcgcccgcggcggcggcaaggaagaggaagaactatgtcagggcggccttctcgccgacgacgtccgaggacgacggcgacggcgccggccggctacggccagagtggccacaagacgatgggacgtcgtgtgacgtcgccgagttacgacgacgtggcgacgcggagcacgccgcgccgcgtcgtgtcgcgacggatcgctcgtgcgacgatggcggcggcggcggctcgacctcggcctcgtcgtccgtggcgcgcgctgacgccgctacggcgctgtcctctgactcgccgccgaccatatggtcgtgcctggactggccgtggtcccaggaaacactgtttctgtagctgaagtgagtggggagttgacttgggaagatgactcgatagtacagtactggatatctacttgcaaggtgtaattagttactgatggatacgtataagtagtggacaggtcaaaggatctgaacgtagctacgaaaaaagaatacaacttgtggggttcgcccgacgctggaaagaccaccgagctagctataaacaggttgcacaactaacgaacttaattgctaatacctgatgaatattagaaatatactagtttgccacttaatt

SEQ ID NO: 45257 - DNA, 952 bp, Oryza sativa
cgcaatctggtcacgtggaggcataataagagagatcatgcttgtgccatttcctctagctgactccagagccttgattagcttcttaatcttccagatctcaatgttcctatcagtttcatggctgtcagacatcttgacagagcttggatgactggctcacctgtacaatgccaaaacacagggatataagggatttgaagggaacattaaccagacagttcactcaagaaaaacttgcaaacagattaaaaaaaaacacagaacaaagacaagtcatattattgttatatagtacattcaactttcttgttgacacaagctctgttcatgataccaaattggacatggacatgctaaataagaaatgatacctgtctcctgtacaaattaatcaataatgagactgatttcttcaaagcagcatgctctattactttatacgtaacacagtgaaagaacaagaaaaacaaccaccgtttatcttactaaatatctcacaacaaaatttcggcagcaaaggtactatcaaataaccacaacactcagcagacaaggttaaaattaaaccacaacactcagcagacaaggttaatattgcccaatgggtggcaaattttggtttggtttaggaaaaggtaggttacgaaatgtgaaaaaggttttcatttgcatatactcaaatgatttttgcagctaacatgaaacaatcatgaacacatacgatgttatcactaggttacaggtacttggtaacattttttatgtgggacaaacatactgaaataaaataaagcatggagttaacccccaagacaaatgaaggacctgcatagccatgtaaaattttcagaatcggaatgtcacccagataaaataataaaaccaacataaaatctaaattatatccaagaaacagaatttagtttcaataatcacaaaaccgaaatag

SEQ ID NO: 45258 - DNA, 1330 bp, Oryza sativa
  unsure (1)..(1330): unsure at all n locations
nnnnnnnnnnnnnnnnnnnnnnnnnnnnnnnnnnnnncagaggctggcttggcaatactacatgaggatacccataagagaacaatcatgatggactgggttcaacgacaagaagcaacgtaggagtgtgtgtttttcccttcccgggagcgccagaactcctctcactgctagaaacgtatgacgcctagagtgcatgaggatgtaaagttcatggagcgggtactgccaatgcgaggttatcgaaaagctttgccgtgacgcgtctcatgtgttgggatgaggctcatgtgttgggcagtcgcggagtgcgggtaaagtgtacatccactacagtgtgagtaaaccaaatctattcgaatagccgtgctcgcggttaatgagcactgggacatgtattacacttggctagactctaaattctttaacttgagtgggatggaatattgcatgataatttttatgctgatggagccacttcctgagaggcgggaatgtggacgtcctcagaaaatcataacgactctatggcgggaagctatccttgggatcacaatggatggtggacagaaccgtcattgtttaatatgaacaatggtattaaaacttgattagtctttgctaggtcttaggcttgtgaaaagaattataaaacttgctttgcgcaaatgaaccatagccatcctttgaaatcctctgtcatgtgcatcattgctgtggtggcttgctgagtacgggtggtactcacccttgcaaatataaattttatcagaagcgggagatgaagcttcggaggatccctatgcctactaccaggagggagatgaagacgaaggcgcccaataggtcttagtacggtcgttgcctgtggcaatggcatgccgctgcttaaattctgctgccttacctatttctgcttttggatgtattccggaccgcttggtccgatgatttaagactatgcctgcaggcttatgatgtaataattcgtactagacattcgtgtatgtgtatttggtatttcagctatgaattcgtgtgtaccagactacttgatccagggaaatggtactgtttacacgattgattcctgttataaaaacgggggtccacagttgttatgcatgataacggctcagagtcgactcttagtatttatttgagcaaattttgttgcatggtagtgaaagaaaggaaagaagagtaagaaaaaatatttttgatacattaatgattagagatcatattgtctctatctgctgtagaatgctactctctagataacgtagagcttatatctgactctatctttggggatcctctagagtcg

SEQ ID NO: 45259 - DNA, 758 bp, Oryza sativa
gcctgcaggtcgactctagaggatcccctaagttgcacccacctagcaagtttgatagcaagtttatgtgctatcagtgcaatttactcaaaataatggtaagactatttaagtgtgttatcaatattacatatttgtgactattttagtctggtgcactgatgttcatatgatgttttatatgagatgaagacctatgatataatagagtggactacagtaagtcctaggctagattcaccccattttcaaaaccggctataaccgtgtttttaccgggtacaataaaggcatgcacacaacaacccatcaattttaaataaacttataataatttaaattttggataaatttatatggtttctcacgttttgctgtgatattgtcgccgagatgtggttggctgcaaaagtttcaaacatccctatatcaccatggatcatatagtaaaaatacgtggtttagttttgttttgacacaatatactagacacgatataaaagtgagatataacttgaatgtatcaatgtgcttgtaactgatatgcacaggtgcatgagggaacctcaaattagccaacacgtacatttgcaatttgcaaaggacaaaggaccgctcaatgtgatagccaaattaacatgataaacagagatagcaggttcaccttcgcttctcttgagttgtccaggacaagatgttgtcataattgctactccctccgtattttaatgtataacgccgttgactttttaaccaac

SEQ ID NO: 45260 - DNA, 2675 bp, Oryza sativa
  unsure (1)..(2675): unsure at all n locations
atctatatagatatatatgtctagattcactaacctctatatgaatgtggaaaatgctagaatgacttatattatgaaacggagagagtagtatatatggagaaaataaatggtccctagctttagcttaaccaaatcaacataaggccggccatttgtcaagtttaaccaatgcttacagcaggcccgcaggtcaatttgctccaactacttaatttggcatatataaataagtcagatgtatatatcgatcaacgcctgtgtaggatcaggggttatttaatatatattcggctagaacttgaattctactactagtagtagtattttagtatcaacttgatgtatcacatatcctataaataaggatccaaaccataataatttgaacggggggagtcattttacaacttaaataaacatccatgccatgccatgcatgcataatcttctatgaccaaactatatatatacgcctagtggtgtggtttgagcgcagtgatattacaaatgggatagaatgatgaaaaagggatgattaattaattaatttaacccacaatgcatgtacataaagaaatactataatgtaagcacatatctatggtctatcactagcaaagtagcaaactttaattagtgctttcatgtttgatgactagctagaagtactaggccgtgcaaatgtctgccctaaactttctcccatcaagatgacaagaagtaacatctcaacaaccatgcaagaaagcatgaatgtttgcaagatgctagctactagctagatgaatatatataggtatgatcagatcgatgcaggtacgcatgataaaaaccatgcacgtaaaatttctccagagtgaagaaaaatgtcgttaacccttacaaattaagaagaaacacaaacgaaagggggaaaaataaacaagaagatggaagcaagcaaatcaaaatcatcttctcgccaagaacttgttggcgatcgatgaataaaaatggatgcaaatctaggaactaaaactatcatctccctcctcgatcgctgcaacccaatgtgtacgtacgnnnnnnnnnnnnnnnnnnnnnnnnnnnnnnnnnnnnnnngggctctcttggtctctctctttaacttgctctccatggccacggtagacgagagccgcaacatcgaccgatgagggcgagggcaacgacacgacggtggcagccgtggccgaggcggacgaagttggcggcgacagctgcagtggacaaggtcggcggcagcggcatacagaggcgacgagcacggttgacaaggacgagggtagcggtggtcgcagtggacaaaggcggcagcggcggcggacgcggacgtgcgcgacgatggcggcgcggccctggacttggacgctccgacgcaggcaacgacgagtagcacgggtgcatcgcttgctacaggcgggcccacgtcctcgggccatgcgtacagccgggcgactaattagtcgcccgcttgcgccctctcccctcccctctctcctccagctcagcagaaaatcctacatggatctcctatcgcccattattgtacctgctctaagttgccaataagtgttgtggtaattaatgatgaatattcctacaatgctccccatgctactctctcggttttaaatatatgccaatgtgatttttgagatgacgtataagcatttgttttattaaaagaaataaaaaataagttatgattaaagtaaatttaatgagaaagtaagtcgtcacaatgacataaatggtacttataaagtatttttaatataagaaatagtcaaatatcaaatctaaaagtagcgcctcatcgatgatgccccattaggtcccacatacatgtgcctagtgtcactaagaacctgcagtaatgagtcctcagtagtgtccgtaaattggcaccactagtggagtatcaagttttacctgtaccgtttttattataaaccggcactaattaatgataattcattagttactttaggtaaactgatactgataggaggaactagctagcgagccgaaccatatctcaggccaagtcaacagcccaagagcccgtagacatcgatctcaagtctcccctcgttgacctatctcactctctcccggggcatttaactatttgctacttttaaatttggtgtttaattattttttactcatatgtcaatgatacgtgggacctcatatgtctataacatgtgggtccatatagcaaatagttaatcgccacatctaagaatggaaatagttaaatatctcccctttctcccccttctccattttttttcaatctctccaactcgcgacgacgtctaacttggcttatgacgtcaatcagcttgagaatgagaatagcaaggccaatgagcccacaggtagcggtggcctctaacctcactgccctacatctctatgttgtcgacgcgcttcttaacgtatataggtgccaacgacgagctcctcctgaagcatcaacgtaggcagcgacctccttgctcgctacctagctcttctttttcctccatctccactagggtttctcctcacgctggcaccccgatccatatggtggagaaggtcgcatgggtgccaaatccacccccccccacccaccccccaagctcaggcctacaatctga

SEQ ID NO: 45261 - DNA, 2399 bp, Oryza sativa
  unsure (1)..(2399): unsure at all n locations
gatataggcaacattcagtagaatttgttttcttctattccctacgtcccaatgcaagtataaccttgtcttatattcagaaaatgctttgtatcacacgtccgacgaaacggaaatatcggacgcctcgtctaccctactaaaaagcctgatggatcggaggaacctcactgtaacatgtatgctacctgtttcttttcatttttttccctcctctctttaaatattttttcttctaattacttatccgatctacgaaccgatcacaccgttgtattcgttgcaattaaatctttacaacaagatatcatatgattatattatttcaaaagaaaaacatgaatttcaaaccgttaaaactaaatgtttcatacttgatagtgatatgtttcaacgtgcatcttcagtgtgtttcacaaaattcctgaaacttaactgccactacttttcctctcttctccaccttcatccaatacaatacagtgcattatatttttagcaaagctttcaaaagtgatttnttctctttaaatttactttatccaaatcttatgatccggatcacantcattgtattcggttttaattaaatcttttacaacagagatatcgaatgattatattttgataaaagaaaaacatatgtttcgatccgttaatacttgtttcatacatgacagcgacatgtttcaacatatatcttcaccatgtttcataaaatatttaaatgtttcagttgctgaattttttttcaccatatataacttaatgtttcacctgttggccaactgcaacatttgaccgtctgattttttttgggtcatcggacgtccgatgggtagattgctcccttatattcagtagaatatattactacatccatcccaaaatgttgctacctaggatgggttaaattctatcctaggtagcagtattttgggacggaggaagtacatctgtactaagttgcacttatattgagggcatgtttagttaccaaacaaaatttttcacgctgtcacatcgaatatttggacacatgcatagactattaaatgtagacaaaaaaaaacaattacacagttcgccaggaaattgcgagacgaatcttttaagcctaattgcgtcatgatttaacaatgtggtgctacagtaaacatttgctaatgatagattaattaggcttaataaattcatctcacagttttctggcggaatctgtaatttgttttgttattagactaagtttaatacttcaaatgtgtgtccgtatatccgatgtgacatacatgatatatgggcaaatatttctgccaactaaggctctgttttgttcccaaacaaaaacttttcaccctgtcacatcgaatgtttggacacatgcatggagtattaaatatagaaaaataactaattacactgattacgtgtaaattgctagatgaatattttgagcctaattgcttcatgatttgacaatgtggtgccacagtaacatttgctaataatggattaattaggcttaataattttttctcgcattttaaaggcgaaatctattatttgttttgttattagtctatgtttaatactttaaatgtgtgtccgtatatctgatgtggcacgccaaaactttttgtctcgcgaagtaaacagggcctaaacaagccctgggttagagggagtaccacacatgacaacttactactccctccgtttcaggttataagacgttttgattttaatcaaagtcaaactgctttaggtttgaccaagtttgtaaaaaaatagtaacatttttaaacaaggcaaatttattctgaaaatatatttaattattaatttaatgaaactaatttagtattataaatattactatatttgtctataaacttaatagactaaagttaaaacgttttataacctaaaatggagggagtagctatttcacctctgagaatgtctcttttttttcccttctgttatggtggaaggatggtggaagttgtcggccggtgactctctgaagtttctacacgcacaacttttccttcagaaattaaacatttcaacagagaggaacaaaacgaggcacctatatgcatgcttatttttctaactgaaacacgcacgtgttagacgtgcgctagttgtaaaagctcctgttcttctatacagacacgtagtaattaactagtgtaatgtacgggtctggatgatccaacggccagaattaatcgcatcatatatatgccggatgaataacgtacttgctaatatcatatatgatgctagctgagtacacatatatattactccctccgtttcaggttataagattttctagcattgctcacattcatataaatattaataaatctagacatatatatatatat

SEQ ID NO: 45262 - DNA, 1547 bp, Oryza sativa
gtacccacttatagttttacatatttcacaaaattttttgaataagacgaacggtcaaatatatgctaaaaagttaacggtgtcaaacattttgaaacggagggagtatatacatcttcatctcatcaccaattaatcaaccactaccctttgttgttgcgcctttgtttgatcatctcctgtctccaaatgctttaatttaatgcatgaccaaagctaaataaagcttccatatgactgatggcctgcagtgcatgcaggcgatcgatatgcccaggctttttgattcatcaacacacacacagtacacgtacacgtacacgtacgttgaatatatatcaaaggcgatatggaatcaacaccacgatgattagcggtgatagatcctgatatgatcctatatgatactgtccgtgcgtgcgtaccctgcacttacctgagatttgcatcagcaaaactactgatctcatgcataaagctaaaaaagcttttcaacaatatttttcagtcgtgcatgcacagcagctagcacagagatcagctaatcaacgatcaatcttgaatatatacatacttctttaaatatatatagaaggaatacgccatataaaatttaattaggagagctacactggtggagaaatcatctttcgtcggtcggccgatttccacaatagtcccggatgcaataaaaaccggggctaaagatgatctttagtcccggttcaaaagggtaacgggcatatttgatctttagtcccggtttgtgttaccaaccgggactaaagatcatctttagtcccggttcgaatgctgtcaggacctgtcaggccccccccgggatctttagtcccggttggtaacaccaatcgggactaaagatcttaactttagtcccggttggtgctaccaaccgggactaaagtcccacccctatatatatgtcttcttcctcctccagctgcccgagcaagcttcaaaattacttcaaaaaagaggggaggtcatgccaaaatttctattgaatttattttggtgattacatacaaatcggaggtgcctaaaaggtttgcaacttcatcctccaatgttttttttgtcatactacatttgcacctatgttttgcacacttttttttgtctccaaaatttagttgtaagttgatgagagagaaaatgtgtgtggggaagaaagaatatatagaaatttagttcatttgctaaacaaggttttataaaatagttgagaaggaaaactctagtgaaagttaatcttaaataatagaaaacaaactaaaatgaaaattaaaagaagtaaaacacattaaaattagtttaaaactttacaaatagtttttaagaattatttggtgtaatattttatgatttttgtatgaataaagatatcttataattattgtatgactgtcattattgtaagaataattatttgtgtgcggtttttttgactcatgtagatggatcggcaatggatgtacgctgaccggcggtccaaagagtttattgacggcgtgcactattttttg

SEQ ID NO: 45263 - DNA, 3453 bp, Oryza sativa
gggttagtgacaaggcatttggcgatttattgaaactcgtcaagaacattcttccggggggaaacaaattgcacgagacaacgtacgaggctaagaaatagtctgcccgttaggactggaagttcataagattcacgcatgtccgaacgattgtatcctatatcgcggtgaggagtatgagaacctagaagcatgccctgtttgcaaagcactacgatacaagattagacgggacgatccaggagaagttgacgggcagctaacaaagaagagaattcttgctaaggtgatgtggtatttccctataataccacggctaaggcgtttgttcaggaacaaggggaatgctagaatgttgcgatggcacgctgaagagcgtcaacaggacgggatgctgagacaccccgccgatggttcgcagtggcgaaacatcgacagaaaatttaaagaatttggaaaggacgcacgaaacatacggtttggtttgagtacggatggcatgaatccttttggagagatgagcagcggccatagcacttggcccgttacgatgtgtatctacaacctccccccctggctatgcatgaagaggaagtacataatgatgccgattattattcaaggccccaagcaacctggtaacgacatcgacgtgtacctaagaccactggtcgaagatcttaaacagttgtggaagaaagaaggtgtccccgtgtgggacgaggacaaacaggaggagtttaacctacgagcgctgctgttcgtaaccatcaacgattggcctgcacttagcaacctatccggacagtccaacaaggggtacaaggcttgcactcactgtatggatgaaacagaaagtacgtatcttaagcactgtaggaaggttgtatacatgggtcatcgtcgattccttgcagcaaaccacccggtacggaagaaaggcaagcacttcgaacataaggccgaccaccgtacgaagcctaaacatcgcagcgggaaaacagtgtttgctatggttaaagatcttaaagtagtgttcggaaaggggcctggaagccagcatatagagagcgaagatggtcacgcggcgatgtggaaaaagaactctatattttgggagttaccatattgggaattcttggacgtacgccacgcaatcgacgtgatgcacctcactaagaacctttgcgtaaaccttcttggcttcctaggtgtatacggaaagtcgaaagatacactggaagcacgtaatgatctgaagcatatggaacaacgcggcgaccttcacccggaaccaaaggagaaaggaagccattacttgagtccagccagctacactcttagcaaggcagagaaggaaagtatgtttgaatgcttggagagcataaaggtaccgtctggatactccacgaatatcaagcgaataataagcacgaaggagaagaagttcacaaacctaaagtctcatgactgtcacgtgttgatgacacaactgctaccagttgtaataaggggtatccttccagacaatgtccgggcaacaataacaaagctatgtgcattcatgaacgcaatttccagaaggtcatcgatccggatagattagaagcccttcagaatgaagtggtgcaatgtctcgtcagttttgagttgatatttccaccttcatttttcaatataatgacgcatctgctttgtcaccttgtaaaagagatccgtattctcgggcctatgtacctacacaacatgtttcctttcgagaggtacatgggcgttctgaagaagtatgttcgtaaccgttctcgtccagaggcaagcatcgccaagggttatggaacagaggaggtcatcgaattttgcgtagaatttatcgaagaccttcgcccaatcggggtacctgaatcacgccatgaagggagactacgggaaaagggaactctcggaaggaaagcaataatgacggtagacaacaatttattccgtaaagcccatttcactgttctgcaacactcttcattggtagctccttatatcgaggagcacttggctctagttcgcgccaggaacatcggtaagtccgatgcatggattacacggcatcacattgatactttccccgcgtggtacgacaacatctcatgggtaacgagtcgatcaaccaacaacttgccttcctggcgaggggaccgtctgggtcgatcgcgacattccagggatatgagatcaatgggtacacattctacacgagagcccaagacatgaagagcacgaaccaaaacagcgctgttcgtgtcgatgccatgggacacgatggaacaactgccacgtattacggtgccatcgaggacatatgggaacttgactatggtcctctcaaggttcctctgttccggtgccaatgggttaggttgactggtggagggtaatgattgatgacagtgggatgacaactgttgaccttaacaaggttggatactcggacgaaccttttgtccttgccaatgatgtaacgcaagtctttttcgtgaaggacatgtctagcaaaggaaagaagggcagagggcctgatgagcctaagcgtcaagtggttctcccaggcaaaagaaaaatcgtcggagttgaggacaagactgacgaggattacgatcagttggatgggcaaccccctttcacggtgacgattgaccctagcatcctcctatcaaatgaagacaccccttactcacgcagcgatcacaaggagggaacaatagtgaggagaaagtacgtgcggtcaaccgtcaccgccgatgtaatgccgtaattattgtgtacacgatgtaaactattttggatgtattgattatccatataaatcaattgatgtatggcatatgttaattacgcacgattattagaggtttcaacaagtttaaatcatgtatatgttagttatatgtgatacttacaatttttaaaagttttaaatcacacaggtggcaatttcatatgtatgttaattagagtttttaacatttaatttactagcattcatatgctaattataattgactagaggatttttaaaagttttaaatcacgcaagtggcaatttcatatgttaattagagtttttaacatttaatttactatcattcatatgctaattataattgactggagaatttttaaaagtattaaatttaatatatttttaaaactatcattcatatattagagtttttcacaatttaatttactatctttcatatgctacttatatatgactattcgaatttttaaaaggtttaaatcatgcatgtggcatttacatatgttaattagagtttttagcatttaatttaatataattcctacgctaagtacatatgatgattacaatttttattaattttaaatcatgcagtatgtacacacatatcttaattagagtttttatgatgaactactgta

SEQ ID NO: 45264 - DNA, 63780 bp, Oryza sativa
ctgcctagggcaaatccccgcgccgacgccgccgtatctcgccgtcgtctagagctagtcgtcctcgccgccgcctccgcctcctccgctgccgccgcatctctggggtgagagccgccgccgccagatctccattcatgcatctcgatctctccgatctcgatctctctccgtcgcgccgcccgccacgagacgccgcgccacgacgacgacgcgccacgccgccgccttcgacgccgcgcaacgccgccgccgcatgccaacgccacgccgccgccgccatcgccacgccgccgccgccttcgccgccgcgcgcgcaatgccgccgccgccacgccacgccgccgcgccaaccgccgccacgccgccgcgccaaccgccgccccgatgccgccacaccgccgttaacgaacgagaacgagaacgatcgaacgaacgagagcgagaacgaacacgtcaacgtacgttgccgcgacaacgtgaacgagaacgagaacgatcgaacgaacgagagcgagaacgaacacgtcaacgtacgttgccgcgacaacgtgaacgagaacgagaacgatcgaacgaacgagagcgagaacgagaacgatcgaacgaagacaagcgagaacgagggaacgaacgtgaatgagaacaagcgaacgaacgtgaatgagaacgagcgaacgaacgtgaacgagctagggaacgtgaacgagcgaacgaacgaggacgaacgttaacgtgaaatgcaatatatatatatatatatatatatatatatatatatatatatatatatatatatatatatatatatatatatatatatatatatatatatatatgtatatatatatatatatatatatatgtatatatgtatatatatatatatgtatatatatatatatatatgtatatatatatatatatatgtatatatgtatatatgtatatatatatatgtatatatgtatatatgtatatgtatatatatgtatatatgtatatatatatatgtatatatatatatatatatgtatatatatatatgtatgtatatatatatatatgtatatatatatatatgtatatatatatatatatgtatatatatatatatatgtatatatatatgtgtatatatatgtatatatatgtatatatatgtatatatatatgtatatatgttacttcgcatttatcctaatacatttttttgtatcttgcagaaaagacgtgttgtcggagtcgtccgtcaagcctgagtggaagagctagccctagaaggaattggagcaggcaagtgacgtaataatataaatgattgttatatttgtaatgcaattaattaagattattagacctgtaattagacttatcatataagattgtgtagtgttctaatattatttgagttttaatataagattattttattgcaaattagacttagtatgacattattgactagggaattggtgcgactcctagcaattgactattgtagtcttaattagacttagcatatacgcacgaaacacttagcatacattactattttagtcttagcatgtaatattatttgagttttaatataatattactttatttgtaattagacttggtatgtaattattgactacggaattggtgcgacaagtagcaattgactattgtagtcttaattagacttagcatatacgcacgaaacacttagcatatacatgactattttaatcttagcttgtaatattatttgagttttaatataagattattttatttgtaattagatttagtatataattatttactagctagggttgtataatatacgtcacctagacttagcttatatcacgattcgtaattagacttagcacgtaaggttgtgtagggttctaatgtacgacatttacacttagcatacatgacttagattgttaaaacataaatgtctcatgacttagcatatacgcacgaaacacttagcatatacatgactattttagtcttagcatgtaatattatttgagttttaatataagattattttatttgtaattagatttagtatataattatttactagctagggttgtataatatacgtcacctagacttagcttatatcacgatttgtaattagacttagcacgtaaggttgtgtagggttctaatgtacgacatttacacttagcatacatgacttagattgttaaaacataaatgtctcgtgacttagcagatgtttcttgtatcaacagatggctgaccgcgatgaggaacagatattgtacgatacaatcgcggagggaagcagccagtactggaatgaagaagaggggaacgaggatccaaaccagtacttgaacgaggaagggaacgtggagagggatgcggaggggaaccagcaggggcacgtggaaagggatgtggaggggaaccaggaggaggaggctagtggtagtcaaccctccgttggacagaagagggcacgcgggcaacgaggtgcagcgaagaagcttgagggtcggcacatcataacggaagtggaagaagatggacgtcctagtgccccggccgaagccgccaagaactatgtacgtcacagcggttgggttgtgcgggataacgtgcctgtcagtacggtgtactggcgaagaacaagggcacgcggagatcatgagagctttgtcccagattcggagaaagagatgctgtggaccacaatgctcgagacattcacccttcctgcgggtacagaggacaaagtgaaaaggtggactctgaagaaaatggcagaacagtttcagagcttcaagggagatctgtaccagaagtatatactgaaggggcagacaccgaacttcgacacattcccaaagctaagggatcactgggacgagttcgttgcatataagacaggtgaacaagggcaggcgatgatggaaagaaacaaagaaaatgccgccaagaagaagtacctcaccacttggggtcaggaggctatagcgtcgcgatgccgaagtgggagcagatggaggctagcttgattgagaggggtatcgaaccggcaacagccaattggccggaacgatcgaagttctggtactatgctcacggtggaacgctcaacctagctgatggctcactggtcttcggctatcagatacaagaggttgcgcgacgactaacagatgcagtggaagcctcctctcagggcacgttccgaccagacagagatagggacgagctgacactcgccctgcagactccagagcatccaggacgaactcgagggaaaggggtgattccttggaagattggtttcaaggaggacatccacacgtacaggaggggatcctctagagtcgaatgaggagcaagagagataccgaggcgaagattgcagacctagagttccgggtatcgagctacgaactcaacatgcaagaggaggtggcaaggaaggttgatgaacgcatggccgcacatcggtcccatgatccccagccgaccattcctcctgcaatggtgagcccgtcaggaaaccgtagcagctgcgcctcaacggggcaggtaggatcacagagcatggacgccatgcaaacacaggacgaatcgacctgtcccgttgatgacatcactcagcggacaccatgtgagctgcatattcctttcaagaacttatcaataaaggtaagatttagccattccgctagttgctgcttatatatgttgattactaataaataatctctcacaacatgaaggtggcgtcgggcatggccatcccaacggacccttcaggtacttaccactgcaggccgattccagcaggatactccaaggtcgaagttgagttggtcgaaggcgcgtacgaggacctcgagctggattaccatggaggagacggtgagacgcatctacgagacacatgccatgccattattctatggcgcaggcggtacatcatcctccatgggcgacaagcggcgtctcgtgcaccatctcctccggctccgccatctcctcctcaggatcctgcaccgtctcctcctcatgctccgccagcaccgtctccaccgcaggctccagcatcgactcctcctcaggatcctgcaccgactcctcctcgtgctcctacacctactcccccgcaagctcctcttccggcaccttcaaagtcaagggcccccccagctccaccgcttgcccacacaagggcaacaaagaaggcgaaagttgacgccgccaagaacaaggacccggggtacgattgcacgcaagaggagcttgacgcttacgttgcatcagaagtcaagagacaattcaagcctcgaagtccagaaaagaagattcctatagaccctagtgtcaggaacttcttcaggggtatgtctgcatctgtcaaggaggccatcaagctatcggactatgagcgaacgctgaagaaagcatcttctggaaagtccaaaccagtccctcagcttggagagcaaccaaaccaggagatcgagccgttggtgaccggtaaagaaatgacgatagaacaatttattactgacaccggtctaactatggatcaattgctaggagtcgcaccaatcgaaaaggcggaagtgaaatacatgtacgaactcggtaaaccgcttgtcaagcctgagctgctgcagtccctacccacacaaatgtacaagttccatcagctgtacatggagatgagcgccaccggtagagagatgatcggagcgaggatcagggacacggacttcttgcaaggagatgacattctctggatcaatttcaggggaatctacgaactataccagctggacgccctcgacgtctctattatgagttgctggattttgtaagtatatcgttcagttagatttcttactatacgtctcctttaattaattaggtccttgtatataagtagaccatagaaaataatatactcccttttatcgttgtagaatggagattcaaagggcccgacggcggagggttttcgatactggattcatcgaccctcggaaagtaaacgtcgcaatgctcgaccaatatccacaagaaacagaggacaatctcgtccatctcctgaaggcgcagcattacaagacgttcatactgttgccatacaacacagagttagtttaattttactgtcttcctacataccaaatttcattcccgtacgaacttgctaagtgtttcatatgtaatgcatcccacgcacattgcagattccactgggtgcttttactcatcgacctggaggcctgcaccgtcaacgtatatgactcaatggataaaaaagagtctacgtttgacaaggttttcgaacttatagacaggtaccgtcataagttcctttgttaattaagaaaatcttgttatgttaattgctactacgaatcatagctttaaactccatgtagggcttggtatcggttccgtcatttggtccgcggcaaatggagagaaagacttaggcggaagttcaaatttcctgtgagtacacatgctctacatttatatttctccgattcaaatacatacaagtgtatattaattagatctctcgttgtttgtcatttatttgtagtgcgcaaagcaaaagcagggaactaacttgtgcggctattacgtgtgcgagtattgccactgccttgcagaccaaatcatcaccacaagagagctcgatgtacgtacaaataaattcaaaatttcattacgtagcgatttcttgtttaattactaatcaatttcatacactcatatagtttattcgcatgagggataacctgaccacacacaaggaatttatcgcggcggttcaagaacaactcatgggattcatcaacgaagaaatccttgatcccaagggtgaattctactacgacgaaaacacaattcaccggtccttagcttctgagctagcagcgagtactactacgtcgaaatcgtagctagctaggacatataatggattataattaatacatgactacatatgtttctatatgcatgtgtacacattttctataatgtaaatatattttgttcatatatatatctatatacatatgcatttgcataacatatatatatatgtataaatacatatatattatgaatgtatatacatataatataatataatatatatatatacatatatatatgtatgcatatatatgtattgaaacatatatatgcatggtttatatatatatatatatatatatatatatatatatatatatatatatatatacccatgcaccaacaggggcatgcaaaaaaaaaaggtcagctcgatctttagtcccggttggtgttaccaaccgggactaaagatcgatctttactcccggttatttcacccgggactaaagatagcgatctttagtcccggattggtactcccggtttggaaaccgggactaaaggggggttacgaaccgggactacaaagggtttctccaccagtgctagtaagctagtaacacttgcatctatcgacggttgagaaatgtacgtgcgtacgtatggctttatgatcggagctacatatgcctaacgataaaccgtacaaaactttaaaaataaaaaagaaatgctttataaataaaacctctctactacaaaagaaagccaccttaaatcaattaaaaagttccaaaacttaaagtttggcaatgatcgatcatccctgggattacaatcgagctgcggatcatgcaaccacaagaaaatttacagcggatcagtgcaaccacaagcgaaactactatattcattctaaaatgttgctacttagaatgagatgtgtcaatattttacgacggagaaagtacggatcagtgcaaccacataggaaactaccatattcattctaaaatgttactacttaggatgaggatgtgtcaatattttaagacggagaaaataatagtactccctctgtcccactgtcccagaatataatgcctcctccaacaaggatgagtcagctagctcataaatctccacatcagcttttgtatgatgtggaagagagagaaaataaggagagagaatgcactatctcttcttcaagagctaagctcctaaagaaaatgtaagagaaattatggaacccaaagcattttaaacaatgtgctatgagacaatctattggagaggtagactttttgctatctcttgtatgaggtggacaagcatgagctagtgcactagctcaatcatgaaggaggcctaaggagttttagagttggacacggttattaagaaagtaggtagaagtgaatgatggagagttgtggttggatgagtagtggaggtaggtggaaaaaatgaatgatggagggttgtgattggttgggaagataatattggtggagaagttgttatattttgggacaaatactaagggctaaaatttgttatattttaggacggagagagtatcaaacaagatttattaatggacatgaccacataaaaaaactaagatcgcgagctactggactagtcctagtagagcatgaatagcagactataaccgactataaatatattttaaagagataaaaaaaagagagaagagcggcgggctttagatttgtagccagctgcagtacggactccaaaacataatatgtgtatgacaggtgggatcggatattaatagtgtagtaagcagctattgtatgaattggctataagtgatttggagttaatagttgggtatactgttaaacttgctcgtagtagtgtggagtagagtgtgagtgtgtaactgcagctagctaaggtagcagtcattatcttaaaaaaaaaagctaaggtagcagtagcacgcgcgggcgcgggcaagaggacgcattgatggacgacggcgagaatgcattggcgcgcgcggcagtggcattgacgccggccggaccacgcaatccgcgacacgatctttgcatcatttaactccacaccccccacaacccggccgcctcgacgtcgcgccgtgtcgtgtgcttgaaaagaaaaatgaatacacccgaccgtcctgtgtacgtacccccaaccgcatcgccacgtgcgcacgctcatacgtgggccacacatgcatgtactccctccaaaaattcacggtaacatcgttaatttctagagctggatatattcatagtcccataaattatactccctacttccctaaatatttgataccattgacttttttaaatatgtttgaccgttcgtcttattcaaaaacttttgtgaaatatgtaaaactatatgtatacataaaaatatatttaacaataaatcaaattataggaaaagaattaataattacttaaattttatgaataagacgaacggtcaaacattttaaaaaaaagctaatgacgttaaatattttgaaatgggggagtatatttttgattagacggtaggccagaggctgcttttaattgaaagccaaacggcctagttcagctggggataccagcgtacatgaaggacaaacttcacacgaggaggaacaagtgctcaacgagcaacccaacactaacacataggaaacacctccaaaaaaactaaacagagcgatcacaaaagggttcagcgcaaacacagtggccaagattcacatagctctaacagctacagctctaaggggaaccagcaaactaaacacaaaaattaacccactcccactcttggggtcctcagggtcgatcaacaccatcagcttcatcctttccaccagcgcttccatcttgattccttcctcaggtcgtcatagcttcctccactgcaaaagattagaggtaatttaaaaaggtatagtcagtacgtggggagtaaaccagttttcctctgaagatcatattatttctggttatccagagattccaacaaacagcagccaataaactcaaagtaactctaatagaaaattggttagtgtcacccttgcaaagaaaaaaaaactcctcaaaattcctagggatggtattcctatttaaagtgtccctgcaaatgcaccatatcagtcccataaatcaatggattataattttgtaaaccattataatttaacctacaaattttaaatccagcgaggatctataatatagagttgtgtaggagtaccaaacaagacctaaattagtttcattaaatttatctgtgatctagtgttggaagtgctattatgttttttctataaaattcaataaattaaacttgaaaaggtttgattagaaaaagtataaaaaagtatcttgcaatatggaattgaggtggtagaacagtgaggttgtgtactagtataagattatttcgcaaattttgtttttcaacttttttgaatttagagaaataataaaattcgataaaaaattattcaggcctaaatttcggcaattaatttctaaaatttcagattctccggtgccctcagcatatttttgcatacccaaatactttctccgtctctaaatataagatattttggttggatgtgacatacctagtacaacgaatttggacagagaatatgtcacatcgaaccaaaatcccttatatttagggacagagggagtacttagtaaaccctagtatccatgatccatctgtagtccatgcatcgctgacatgtgggccacgcagttgctaagctaagctacaaacagtgaggctgtgtacctgctcggctgcaataacttgggatcctgccaagtttaattccagttgatactgtttctgcaatccacaaagcgtatgatggtgattacattaatgtgttactacgactttcaacttacgacgacgacgacgatatgatgcgtctttttttggtcctcgtcgccggcaatcatggtcgcacagtaattaacacagtggtgtgtagtggctaaaagctgcatatgtcatgtcatctctctgaaaaaggctggctgttattatgatcttagcagctataatagctctgactgattaatgatccgtaaaaacataatgatccaagcagctacgagacgcgtgaaccggttaaagaatgttcggttctttgtcttgttgactggtaatctcagtccaaatatttccggtgcagagaggagagttaattactatagtactaattaatagtagtagtaatagtagattgtttttgcttggaccagctatataattactatagtactaattaatagtagtagtaatagtagattgtttttgcttggaccagctatatagccgaccaggcatgcatatgcagtgatgcaccgaattaacctgggtgatctattggggaaacgccaagaggaactctctgcattcacagataatacagattgttctaatgctgtacgtgtgccttaattttgttttggcatgtcatgtcttaaaatgcagaggtcgtgtttggtatctttgatacagtctctaattcgcatatttcgtaattttatttcgcatatggtggccttccatcgtttaccccgtggtttataagctatagcaaaattttaaattttaaaatgtttttgggcttttgtatcgtagtttaccgaagaggctgttctgtggaagaaagctgggctcctcccggattagggtggctgtcttcttggttgctaaactgatgacgcgagatataggccctatgttttaatcctgttctttgttcttctgtttgttgttgttatttaaaactcctccaattcttaatacaaatgatgtgcaatcgttttgcgtatcctcaaaaatagtttagtatttagtgttcgttttcaaatcgcaaaagaaagtttcttcaataaattattttgtagttgctataagctgtaggacaaacgatgaatgccattttttttgcccctcgactgcatgaactaaaacatgacttgcattttggatcagaggtggtatgatactttttgtagcgtttttatgctatgtgcatcaatgttgtatgatttagatggtacagtagccaagggtactaccattgtatgcctacattacaagtttttcaaattgcctgccaagcttttgtttccatgattggaaaagtttacctttctctttgctgtttgtttctgaatcgcatccatcatccatggatttcactgtgactgagggttgcggaattaagttgtgtacattttgggctataggctttttaattagtcccctgtcccctgcctgggtgaagatgctgtgcttggattttaaatgacatggtagtagtagtacgagtacatagtacgtagtattcatctgtaggctagccaactctcctggtgaaagctttttttatgaagttgtgagtagtagctgtaactgcatgcatagacaacgagtttaactgcagtacagtaacattggcttccaactcgcaatgctgtattgttgttgctgcgtgtaacagtgctctgggatctgcacatttctgggccattattgtgaatctcttgcaatgaagcaaaactgtgtcattatactgttccaatatagtagcagtacagatttacaaggacactggtttggagtgaggctccatgcttttttctgcacacatggtagaggtcagtaaattacctgtaaaaaaaaatctgtaacagccttctgatctataaagaatccaggccaatccaaaaggcaggaaaacaaatctcacttgtgcttgatagtgcaaatagagtatttatgtaactcgacttgtttggtactgtaccagttaatgagcaggttaaccataaaacatactactgtttccattagaatctcacttgtacatggtagtataaatttcttattaatttttgtcacataaaaaataccgctgtttccattagaatttctgaatgccatacatgtgtgattggttgggctaaccatatcacaatttaatcaatgtcgtcagttagcccttccaaaagtaactgaaaagattgtttgtacaattgcacatctcaaaattgctttcttttcctgtaaatggacgcttaatgacaaatcgatcgtgtataacttccatcaaaagacgaatctatgaaatttcaaaatgggaaagtccctgttaaccggatatgctcaagggtgcgctttagaccatactgaagaacagctcggttgccagctctaaaaccatcgccataggccattgaggtatctgactcaatttggtgcttgaaaaaatcaccaagctttcgctcaaactgagatcttcccccctttttcgatgatgtggatgctgatgaggatgaagacgttgaagcaccattactgcctgatcctgcaatgatctctgactcaatccacatgtgagcaagaacttggcatatgccctcttctacgtctggactaagtgtgcgatatcctgcaagtagatatgcattatagcatgaaatgtccatatacattttttaagtaaatgagagagtgatgacagtggcaagctaatgtaaactcttcctcatacagaataggactgaagtactgaatcatgcgctgcaatatggattctctctttttctctattattcagcaccttccttagataacagatttgctaatatcattactattagttttgatttcatattcagcggtggacagcatgtggtgatgtgactagcttgtattttgtactgagatttacaagattaatagtagtgttgattgttttgtcattgccaatatacttattattagtggcatataacggaggattgccaacaatttacatggtaactccccaagttcacccactcatggacttgtacaatcttgaaagcaagatgaccaagtttctagcgaagaatatagttttagttgctatattcttggttcaggtactcagtcatatgctaaatggcaaattggcagtctcaccacaatgcaaaaaaatcctggccctatcaggcaatcaccctcaccagaatagctagtcattataagtgagaagtaaaccacacagttttctgtaggaatcttgaaccatgatcttttttagtctttaccacaaccaaagaccgtgaaagttcaatgctctagattaccaatgtgttgtacttgtacacccaataagagtagaacaattagtacactaaaaagagtagaacaattccattgatgtatgggcagtttacattgatttgtagcaactcaattgcttttactaacctgtttgtctttgaacaaacatgtgctatttaattgaaaataaaaggtccttttcctcttctctgacttctcgtgtgttattttattatgatgtttgtccaagaatgaaaatgagaattaaaaattacctttaagtcgcaaccacgcatgcatcatctcatgagctaaaattgaacctgtcaacaatctgcaagaacaataacacattaaaataccgacaatgtacttcatgaggtcccaatacagaagaaccaaatgataacacaacaaataatttgcatattgtactgcagaagctacagtgacaaggcacaagagtaatatcttttcccattaactctgtagagtcagcatgcagtccagaatatcttcagtgaatccataacattttttagaagaatgtattctccaacacagaaagaaatattatttcaaatcagttataaattcgaatattcctcctagtttttgttgatattaaaagagtagcaacaaggtaacaatggcattatgaaacagatagtaagtggttcaccttgggagaccataaagaatgagaattgcagtcacttcacatcgacgagtcaacctatatggctccgttatcatttccataactttatttccagccattcttggtctcctcaatatctaaaatattaaaaataaatgctggaactcagtcagaagtcagaacacagcagaccaatacaattgaaatagaatttaaattatgaaaagatccattcatctcatgctcagaatagttctcaccgtgctgacagtttgctcttctgataagcataaacctcttgtttctggaagatggtggtgaccctggtttccacaggaaacaaaatatttactaacattagtatagtgaaaaacaggagaatcatggattgtccagctttggtcaacatacagtcttctctccttccatggcttcatttaaagcctgtctttctacaagaagcaagggaacttgttgttccactttcatatttaggccttcataaaattcctgtatttcaagataaagaggttggcactcgctcgtatccataactgcagaatcaaggcactccaggcagagtttgcgaccatcgtccagcaatacatatcttgattcccttggctgataagagcacaagccattttttgatgaactgatcaaaattttgcaacagcaacatatctgaccaagtatgctgaatcagatttataaattcaaacatggtaattgaacgtacctccattctttcacaactacagcatcttggagtaccgtccacctcatgtgatggacagtatttttgtaaccagaaaggatgtgctctatattcaatcaggccattcatatttgtaggaatctgaataagaaggaactgtaagatggcgcatttaaaaaaacaaaaagaaattgtcggctgttacttaacacatgttaacaactttcacatgtcaattatttgctgccccatgactagtgcttttcaaatgcaaacatggccaatcagctatccacatgattcaaggctttcacaattgtaatagaaaatgagaaaaggtgaatatgcatgttaatcatatatcagcaacagtaaacattgcaatcatgatggcatgtggagtagtttcctcatttaacaacagcacggtatatcagttcagaggaagctttgatagtactaggtatgaaaatatagaacaaaacgatccgtcttatgcaaacagataagagcaaactaatgaagcgactcttacaaattgcttgcagacatcacattttgggtgaaagcgctccttgtagcatgttttatggtatggatggtttcccgacatggagaactgcatagtcatatattggttgactataagcatagaaacattactcttgcagacatggataactgcttaataagtaaacaaaggagttacctcatagtcatatattggttgattacaagcatgacagcgaaaacattctggatgccaaacagctcccatgcaactaaggaaacgcccatgaccaatctcactgtgacatccggcacaagtcctgaggaaataagcgtatatattaagaaacagtaagagtaaaagcaactcgcagcatcccattctcgcttaccaattaccatccccaagtatcagtgcagctctttcttgcattttaacttttgggtaacaaaatatacactaatcacttttttgctttatgacactgtaaagaacatatcctgggtgcttctggtgaaggtataatggaaccctgcagattttgcaggacttcaaaacatgcatgcaatagtgcaaccataggccacagtcactgcaagtttaatcaatgaacccaaaagggggtgatttcttctatggttgacacctacataccataaggggtaatctcctgtgcttgctgtggctgtggtgcagctgacagctgcaccaaatctcagatttagcagtgtctgtggctacaacagctagcacgacctataacctagatagtttgaaccttcttcacaggggtaaaagaaatatttacaaaaatttaatttggcaaaactgaggtccacagttttcaaactcgcaaaagagctgctcagctgtacaccttagctctacagaattgtatcaaacaaaactagggagattgcctttgacctctttagttcatatgcaaactcacactgaaaatctggtacataagttttttaaatcaagatacacccactaaaatatatctgtgaaccccttacacaaaaatgtgatatccagggaatgaattgttaaagtcagcacgccgcggggcaatacaaaaacaaacaaaagtggtgttttaaaaaacagtagcacgtagtctgtatggttcaggacttaatttattatactgctttatggtgaatactcgtatcagtagttatgtggcacttcaacatcaatgaacccaaaatagcatgtccacataaagtatctactacaaagtatctagttatactaaagtaagaaaaatgaaaatgaacctgaatccagaagaaaacataaatggcagtggttgatacatattgccaccattggcgttgccattttcacgagcacgaggaggcgattcaacattcaaactttcctggatagctcttgcaagttgttcatcctcctccaaatgcatgtccttttctagatgagtgaaagaaaatgaaacaaaaagtattgcatgttaaatgcatggattcatcgatcatagacacagaataccatgatgtagaattgcttgataggtagctccaaacagcattttatataatacttccagatgcacttttattacttgggtacagttctaatccaaacatttggtacagaagtatatacaaaatgtccacactatgattttcgatttttacatctagaaccagagaactcgcaccaaacatttcaccaacacataacaaaaaatagccacaattcaacatgtatatttctcatgaaagaataacacatatataaatttctttttctcacaatggatctgtttatgctttgccgttgagtattaacatactattctatattgtgactcaaaagaaaaataatgttggcctagtccttgtataaatgtgaaactaaaaaaagatcaaccaagttcagaaacagagagtgtgaagaaacttatcctaaacatggactccatatgaacatactgtatcatcggcaatgaactagctccaaaaattttctgataggtgtggaaataagcacaaggggctctcttaaaagttaaaacgctaagcactttgacagatgtcatcgaataaaaatgatatgaaggaacagctgctggaagtaaagaagcggacaaatgtcagcctttttggacagtaagtactcaaacagcagaagtactagtattagttaccatactaacctattgcctttgcctttctttgttcctcctctaatagagagagtgatatagcacgagcgatatcttcattgtcaaattctgacgggacatcctaaattgaatttgaaaatagatcagctacatagtcaaaagatgtagattcccattctttttaagcactaaataacagatactactacaatggcatataagctcattatatttggaagcaatttgtgtcatcctgaacctagaggcatatgcacaaaaaatcagtggtatagtttttgttaatacttaattcacattgaccaatcaccaaatcacctgaaactcaaccaacaaaaccacataacagtattacagataagaaaaattatgtttatatgacctactaagcaagatagcaatgtgaagcgatgatgtatttttcagcaggggaaattgcatttgtgcacctccaaattcggagattagaatagtacagatttacaccaacagaactggtaatagcgttatgctctgcatacaaaggaagacataaaacacacagaattgttctccctaaccagggtaaaaaatttcttgttttgtacaagagcgtcaagatatagttacattttacactgtaagtggcgtacatacaccatgctgatgagcatgagaagtttgcaagagttgcaattgtgagtacatgaggtgcaagactggttgggcctgttgcctcaacttacaacaatctacatcgtcaatgacaagttgacggagatcagtagccaacaatagcaagtcgagttgaccaaatgtggactctagtgggtacaccatctaaacacgggaaccacatttcccatcaaaaccaacagtttgcagttttctatgtccatatcagtaatggcaaaacttttgtgtatggatgtagccaacactttcaagagggataatgatctatccgcaactgttaataataaaaatattttagaatatggttggaaagttagaacatgatggtagtttttttttcccacatctattggtatttcttttatggcgcagaatcgcagtacattgtttatagtttaatggacaaacagtcaaagaccaaaattttgattgtgaacatgccgcaatggcatatgttatagaacaaagggagaaacaaagtgagatttaatactctatacgagggtgcaatccaagctttttggagcacatttcaaatgcatctcctttggctatcctagttttataagaatgcacttttgccctaacacgaagataaccgtagaacaattaatgagctcttactcctgagaggtaaatgtataacacagaagaacttaccgtcacaactgcggaattagagggtccattccatatcgtctcctccgcgggtttgctgtggtattgcccttccgagattttgtgggttgaacctctaaaaaatttggtcaaccaacccatagagctccaaatggcaatgttggaagggacacttttatctgcaatcaatccaagatgttaggataccacaatataacacaagaaaaatttcaagcaagggatcaacaccagagaatcataactagttaccaaagttagccaagttagcagatcgattgcaggtccagccgtttgagtaccctcctcctcactcaggcccctaaaccagaaacctcctaacctcacaggaatggttaacaggatagatcggagatcaagcgatgattctcacagaccccccactgggttttctatcgctagcagcgtcgcattagaacgtaagcctggaatggctcaaaaaaaaatgcaggttctccggcatcaggcggggattacgagcggcggcaagatcgagagggggggcacacgctccgcgtctctatcgtggggaaggggacgaaatgccaatgcccaccaccaccaccaccaccaccacccgcgtcggtgctaaaattgcgcggagaaaacgaagggtggggctccgatcacctgatcaccgcgtcacccgcgcccctcccgcggacgggaccgccggcgatccgccaccggcctttgctcgaccaccaccagcagcagcagcagcaccgaaaacccgacaacgaaacgaaggcaagctacgaccgacgacgtccgacgtcgcccgccgcgacggaggagggggcacgctcgatccccacctccggcgtcgtacgcccgccgtgcccgtacgcgcgcgcgctcgggcggcggcggcgagcgggcttggcgtggggtggtggattcggggtggggttgtgcgggatttgggaatctgtctcgcctcctcgctgctgctttgccttgctttttgtggcacggcaggaggaggcaggtgacccgctcccccgtaacaccgcggggaagttggggggttaatccatctgtttgcagcttggtaaccgtgtaataaactaataacactgccttaaaaaaacgaaaattttaaaatgggttggagcatccatggttgatagaggagaaaatggtgagaaaacatgtattcgagaggatttgaacttaaggtcaatgcattagatccggtttagatgggattaaaagtaattttaagtctctatcgcatcggatgtttgggcactaattataaatattaaacgtagactattaataaaacccacctataataagtttttggatctaaataccatcttactctaagtagctgtcctatcaccgagctacgcgccggtgcattactccctctaacttgacgctagatctgtttgttcctgtaagcgaatacgaccgtctaattgtgaattagatgaaagtttacaagttatcgaataattatctgaacagatataaataaaatagcgtaactacatatttaaaatcaaaatacccacttcacaagaaaggactagacagcctatacatccttaaagttgtcatttgtttcttttcccttccagaaagtcaaatatgcagttttgcacggaacctattcgcttatatcggattggttatatttgtttttggctctggttgcgtttttttcagggttttccggaggaacccgacgacggacggacggaccaccgccgtcaccgcgtgagacgacgaagagggacacgaaaccggcgccgggaggcgagcgagagctcacgcggagaagcaagcgacgaggagtcgtgttgacgccggcagagcgtacaggagacttggtggtagtagttgagcgctacgtttggactttgaacctaggcatggcgctgtttgattgtcaccagtttgaattttccatgtgcaatcttccaacgaccatttttttttcctaatatgtagtggtgtagagacgagtttctgaaggaaatttgacccactttggctgtttactgaaattaaaggcagttctcatgtaagcatgacagaaaaccttggtgttagaatttagtgagcaaagaacatgattacatagggaggtgctggtgcaggcaaaccatcagcgaatttacattgcattacttcactccacggacattttgacagtgcgttttgtacttctctgtattgcgaaattcggatcatactagtatcacatttacattcatgtacggagtacttagtttcggtaccagtttgtggaagtcatatgtgctcacgtggttgcttgtacaagactaattcctgctcaagctccgtcctggcatcacccaccgtcacccagacctcggagattttctcaacggcgccttcaaagagatcaacaatggtgaacgcccgcgatgtcggaaccatcagtcctgttaatccttcgagcccagtcttttcgcttgtggagattgcaggctgcctgcttgattgcgcatgattcactctaggcacaacggcgccgttcagatatatagtccggttagctccaaaggcaatcatcttccgaaggcctctcccgtaggcgaggctcttgtgcatgtgaccgaacacgaccagcggtatcgaaactccggtttctctttgcagatcagatatggcttgctccagatctgcggaggttcttgtctaagatggcgtattaagcaactgtacaagtggaagtatcatcgatggaatatcagacctggatcaccatgatcaccaccaccagcaacccaatcccgcccacaaatatcctccattcttgagcctagacctgtgtaaccataatttaatgtaggcatgttacagcatatgtgtgcaagtgcaagtatatgtagtttgctagtttaaacgttcagacacctgttggcccattgtgtgccagtaatatgacagcatgctcctttggtgcatttgtagcagcatcatatatcctctttgcactttcagccatatcattgacaccatacctacataataatcgtaggatcaaataaacaatggtagacaagtttccaattatgaacaagagtaagagttcaccaagtaaaaaaaggtagcagtattgtgtctgtcttatgcactttgttttacgaggtggactaaccatccctgactacaccaccaaaataataatttactatagcttcacacttcttattacagtgtgctatgtttattttatcattaccaatatatactgcgctgatcgacaagaatcaggtcaaagcataatcacctactccaccaatatccttaccactgtagctcgatttcactgcatgttactacacagcagaagtagtatgcaataagaaaccaacccggtgaagcaactaagaatgacagctatcaacaatatatatcatcaaactctaaaatattcactacctaatacagtagtgctacagatgagaacgaagtataagttggtaactctactgtttattgtgccattcacccatcatttcacgagttcacatacatcgtttgcttcttaattcaatatgaaaagaagggaaggtaaaaatgacttgtagaccaaaatgacaaggatataccaaactagtatctttaggaaaagtatgctgcaactcatttctcttatgccttacctaaattactgcatgtttcacatgaaccttgtaactattttttggatactgtggatcattaggtctattttacataaatctattataaatagcagtagtattttttcagtagagccctcttctactgtttcatgaaaaagaaaggacaactaaggactccttagtaaggagaagtatataccaaagaaaactgataaacatgtgtatctattggttagcatgtctcttaccaaccattttgacagaagctttggtctaaatatcctattacccccgcaggaaaatggtcgtccaccaacaacactcagctttattgttggaaaatccaaacatttgtacccaacatgctgctcaccaaggctgaaattggcaacaaaaaataacaacagaaaattacttgccgcaaggtctgcaaaaatagtaccagagtctggtgaagacaagttataacccagaatcatcctgaattgccacagcttattaaaaatcatggaataatcaggccaaaatttcctgagaatcacattttttccagcaattactagcacagttttaaacaactcacttcttcttggatttaagtgcagtatcagcttcttttatttctttcaaaaaaaaaagagatgcaaatcatgaaatgacctagcaacaatgctaaaaatcaaagtaatacctgtttagtgctctggtgcaactgaaacaactttaaataatgcaagttttccttcaaaataacaacaattgtgcaactcatataacccattcattggcatttcttacaatagaaattcatcaaatgctagtgttaatcataacactgttgtattaaacataaaagcatattcacattaaaggaggaacatcttacctctctagctgaagctggacacgatctaccttcctgaatgccaaccaaggatacattcatcatttcatcaaatatcagtgcatttatgttgaacactatccttgttggatgaaagaattattcttacttctctgaaaactgatacgtgtgccaacagtcatgattcccaagaatagctgctttggggagctgaagatctgaaatgcttttaacaagttgaacattctcgttgccataatcacctgccataaatggaggacagcaaacaggagatgtaaggaataagcatttaagtgtaacttcacaaagtaacgagtatattatgtagtacagatataatagggcaaagggcgcacctgtaaaaagtaccaaatctggctgcattcacacggagagaaagttagatcttctgggaataagaaacataatgttatagaaaataaatgtagtacggatatttttctatcaaactccagtgtcattttggcagctggactgtacatcagtacatgttgatggcaggcatacaaaaaggcgtagaacatgaataaagaaaaggacagactgcacttcagatgatcttacatcataaaactagagacatgctacaataatcagatgtgaataacttaatgcaatacacagatacaattgactgaatttatctggatttgcaatacctggagaaaatgtagggcttttgagtcttcctcaagggtccaatcattatgctgcaatgttcagcacatcacaacagccaattagtgcattgttctcatcaagaggatattataatcccttgagccataattgatgttataaccaagtcaagcatgcaaataaagtaaaagccatcatattcctcttagtacaagaagtaaagcacatctcgacaggaaagcgagctaagagatttcaaacccacaagatcaacaaagcatggtatcaaaacacactatcctagtgactggttcaagccacaatatgttgtcactccgctaaaatctcactccctgcatcttctctccaagaagacattttacagttttggcttttcacattgtagttcacaaaaaaaaactatctctgcatttgtcccttcagatggaagtcaaagctttatccctcatgaacctcttcgcaccaccaaattcacctccatccaaactactactactacaatcaaacgccaccttaaacgcaaacccccacacagccacagtgatgaatcacactcatcatgcactcctctcacagcatctcaagatcggagctaaactgagctaagaaagtcaacaagtatagatgcctcagtttttttcttctttttttattttttttttgggggggggggggggggcgggaattggtagaatgcttccgtccccaaagccatctccctctcactccgaatcccctatgctacgccacacgaaacccaccgagaatcgcaaggccacaccagcacccatgtctggcctatcccccatcccaggcacgccgcaaaaaaaagacggaggaagagggcaaggagggggttaccacgtcgccgacgaccgcgacgcggacccggccgcgtccgacgccggcgctggccatgctcctgcggctgggcctgggcggcggcgaggaaagaggaggaggaagaggattcgcggaggcgcgcgcgacggcggcggcggcggcgaaggagacagcggctgctcccgctgccggccacgacggagtgggaggggaggagcgagaccgtagcagtgcgggcctcaccatttctttcttccccccttcttttttttcttttctttttccctctcgaaatggtggcgtgtgctgccgtgccggtcagttgtcccgtgacacctggcgcctgacgtcccgccgcagcggttgggtggcgaggttgtaggatcgaatcatattaagtaagccaattagaaggggtgaatagttgatatactcaaaaacccaaacttttagcggaaataaaagttaccctcaaatttgatgtagatcggtctgaccgaggttgatccgccggtctgaccgagctcatgtcgccggtctgaccggtgttgatccgagctcatgtcgccggtctgaccgcctgaagattgcctgccgcgtgtgaagtcgccgccggtctgaccgcctctcctccgtcggtctgaccgccgcctgtcaccggtctgaccgccggtatgtcgctggttagaccgccgaaacccgatgaaacacaaatcgaagaactctcaaagtagatgacaactttattacttctctctgtgtttacaaagtgcatcaacagcactccttacaaaaatctcgactaaactcaaaaccctaactaaactagcaactcaattgctctcaaaaacgataccgggaagcctcacgctccccctctatttatacatgaggtaggcagcctaaagccacgaaccaagctcatactaagagtcctagacaccttaggaaaccctctagtacaagacacaaactttacataatcaattgtaccaaatttggactccttccaaattcgactccgcatcccatacgcacacaataccccatcgtatgccatatggaatcttcaccaaccacgtgcatcaactctagccttagtatcccgcatgatatctgaccaccacggacatcgtcttaccaccaagccgactcccggtccatcaccgcaaatactctcccgaggcatcgagtcacctacacatgaaataaacaaagaaaccatattccgagaccaagctatccccaacttgactcattgttagcaaacaacagtattatatacgtatagtatccatctagaagccataaccatgaaacaatcacagatatccaaagaaacaacccgaaaccgaaactgacacagcgtcggccggtcagatcgcgggccggccgatctgatcgctcgatcaccaccggtctgaccgacatacaccacccggtcggaccggtcacataaaataacagtgaatccgattatcacctgaaaattgattatctccaaaaccacttcgacgataatctccaaatatcaaaaccaataatcacagatgccaattgttcatcacagaataagaatcaaaacacactttgatcttacagaggtgcccaacacgcctcccttttgagcttcgcagtctaactataagaactttgcgaactactccctccgttacacctccgttacaaaatatagaagcatatcatccgctactacgttcttacgtagtatttcgaatattttacgacggagggagtacagagtgcaattttatataaataaggttgtgtttacgatgataaagatgatatgtgttatgagaacttctatcacaaaaataatggagtaaattacatcgttggtacatgaacttgtcaagtgggtgcaatctagtgcacaaacttgtaaaatactcgttttggtgcatgaacttgtctggcatgtgcggaggaagacaaaaagatattacgtggctaatcttattatttaggggctcaataagatctatgtaaacatatatctaagaaagtttattattagacatacacatcttcaataataatagaatggataagagatcgtataaaaagattaaaacagagcaatgatataagagtgagaatatatatgaaattcatcatttccatgatgaaggataaagtaggaccaaatatataaatattgcatgtcttatgtatactcgctacacgtcacatctaatcaacatcagcttcgtaaaattaacattgtcaagctattttggtcatcgttcgcacgaagtagacaagtttgtgtatcgaaacgaacatttcacaagtttatatactaagttgcacccacctagcaagtttgatagcaagtttatgtgctatcagtgcaatttactcaaaataatggtaagactatttaagtgtgttatcaatattacatatttgtgactattttagtctggtgcactgatgttcatatgatgttttatatgagatgaagacctatgatataatagagtggactacagtaagtcctaggctagattcaccccattttcaaaaccggctataaccgtgtttttaccgggtacaataaaggcatgcacacaacaacccatcaattttaaataaacttataataatttaaattttggataaatttatatggtttctcacgttttgctgtgatattgtcgccgagatgtggttggctgcaaaagtttcaaacatccctatatcaccatggatcatatagtaaaaatacgtggtttagttttgttttgacacaatatactagacacgatataaaagtgagatataacttgaatgtatcaatgtgcttgtaactgatatgcacaggtgcatgagggaacctcaaattagccaacacgtacatttgcaatttgcaaaggacaaaggaccgctcaatgtgatagccaaattaacatgataaacagagatagcaggttcaccttcgcttctcttgagttgtccaggacaagatgttgtcataattgctactccctccgtattttaatgtataacgccgttgactttttaaccaacggttgaccattcgtcttattcaatttttttatgcaaatacaaaaatacttatgtcatgcttaaagaacatttgatgataaatcaagtcacaaaaaaataaatgataattacataaatttgtttgaataagatgaaaggtcaaacatttgttaaacagtcaatggcgtcatacattaaaatacggagggagtactaactcccgcgtcctttctagttaaaattgtttactgaaattctattggtacaatgaaaaacatatatacatacacatgtcacattggacttgagaattgaagccccagaaaagagtagcaatggagctcctaattattttcttacaaaagaaatacacaccacaaccacctctaatgcctccttggaacctaggaatttggttctatatgaatattgaaccaatttctatgaaaatcattacattttaatttaaaattaatgcatttagaagagacttacatttttgggacactactcaaatagatatattttatctcatatacaattaaaattataagttgacaaaatagttaatatgtttcaatggttggccataatactcgctcgcaattgtccaaataaataaagccctcatgaaatagaggattgatttagtagtacttctagcaaaactataagttctatcaacatcatgtgtatctctaaataaggcatgtccatgcaaagcttgcatgcaactattaaatctagccatttgtttctaagtcaagcaacctcctcaatatctcagagaccacatgagaaaatgacaagaagttctctccgtctatttgttttcctaacacaatatgcatggtcaattaggcaacgtagctcttatatcgtttttagcatgaaaacatgccaaattttctatacccataactatttcatgattttcttacattcataatcattatatatcgccagtacattaggcccagcaagatgaataatgccatctaattttccacggctcgatgactgccacgtgtccagttcctccgaagcagccatcctcagccgtttgattcgcgtataaatagccacgggcacccgagcccaccgcctatttcaccacccgcttcccctcccaccctcccccatttgttccaccaccagctggacggcgagacgaagcggaggcgagggcggaggcggagcacccctcgcggcctctcgctttaaggttcgtgctctctctctctctctcctccgccgaatcccccaggcgctaacgctggaccaaatgcaggaggaaaccctagaggaagcgagttggtggaggcggcgggggaggcgcgatgacggggccgcggggtggcggcggggaggacccgccgcggacgtcgtcgggcgcggcggcgtcggcctcggcgtcatccggcgtgccgaacgagccgctgaccccgacgtcgatgctcatgtcggggcagcaggccgggctgaaccggcgcgggtcgaggagcgcggcgatggcgacgttctccatggaggtgttcgacaacgaggtggtgccgtccacgttgagcagcatcgccccgatcctccgcgtcgccgccgagatcgagcccgagcgaccccgcgtcgcctacctctgtatgttcggatgttccacgctggaaccatttttgtgtgcctgtttttttgggggggatttttggtgattttaaggcctagattggtgcattttggtgtttaggggagttggaatgaggcaagcagctcgaaatatttttttcatggcgtttgatggatgtggcgaagcctgtgaagtagcgtgtgcctgggtggttttgtgcttgcaattctgtcgcaacgattgcgttcagattcatccggcgtgtgtttctccgcgcatatcctggctttgcggagttagatttcgaatttgacccccacttttttttttctggaatctatttttggataaggttcgctcacgaatgcatgacatgttcatctcagaacacccttgttttgtttcgtttgattttttttttgtttcaagggtgtttgtttggttcgaatcatagggtagcttaacttgttcgatcggtttgctttggaattgtatcaaccagctcgagtgggtgattcggatgtcacgcttattactgctacttactgtaagaattagagggattttctagctttttctgggtttattttgatctgttccggaccttctggtctgaatataggtcggttttacgcgtttgagaaggcgcaccggctggatcagaactccgtcggccgtggcgtccggcagtttaagacggctctgctccaacggctggagaaggtgacacacatttcccccttcatatttttcgcatgatttggcagcttagcgtacgttgtgtttcatctgttagttctgttcagtatggttcagttcgcgcatgttagcttgctattttgcctttcccgaactttggcctgcgtgatttggctagtgtgaaattaatgttatcttaacttctcatcatttatataagagctttgtttggtaataagtctagttaatgcaagtaatataaaaaatagcttaacttagttgtcaaaatgatcatataaaacaaataggcaaaacatacacaattgaagtcatgcatggtacgtttttacccaattttgcttgtatacggcattatgtatttgatgttatatacgaaaaactaagcttattggaattctaattcagtagaaactaggtcaggtgataataataacagctggtgatcaaattgggatgaattagcttaatctcactaacacattggagatgagatgaaacaagcatgcaaaatgaattcattgaacaacctgctacacaaagcacaattttccagaaccagaatgacgtgtgatgctgttttttcttttgtttcagatgagatgttttatgttctaattaacttctggtaattgagcatgaccaaattttatttattatgcttgtaatcctttttcagtaatgcgacgaaccgtttggagtaccctcttttttttttaaaaaaaaaaaatctgatatattgtcgatcatgattttgagtcgatacatcaatttcacatggtattattttccatttgcactgatcatgtattcattatcttgatttccacccaaattatttgagttcagggcttgtttggttggcagtcataagttgccacaaagcttagtcgtgcaacaacttttaagtctaatgtttggtccattgctataaatcttcacttggaatcttatgcaacccgcaggataacagtcccagtctcgcgaaacgcgtgaagaagaccgatgcccgcgaaattgagagcttctaccagcagtactacgagaactacgtccgtgccctcgacaaaggggaacaagccgacaggtaattccttaactgtgctccaggtctataatgaatccactccctttcttgacatatccagtcccatgccaatgtcacctgcagggctcaacttggtaaggcctaccagacagccggagttctcttcgaggttctctgcgctgtcaacaagaatgagaaggtcgaggaagttaatccggaggttcgtattcaacatctactcaaattacggtcgttctttgtcaacgaaaatctaggtcttctcaaatgcaatgagcttctctaattcccaatgtgcagattgttcgcctgcaccgggatgtgcaagagaagaaagacatctacacgccattcaatatccttcctcttgatgccgccagtgcatctcagtccatcatgcagatggaggaggtatgtacaattcacaataacggtatctgaaaaacaatggaaccgtgtactggttcagtgaatgaaactggcgtgctaactggtttggaaccttaacagatcaaagcagcagttgcagcgctgcggaacacgcggggcttgacctggccttccacatttgagccagaaagacagaaggggggtgatcttgatttgctggattggttgagagctatgtttggctttcaggtttgctagttattccacacgagtcaatttcagtcaattctattcctaagttaacaccagcttatcttcttgtgtgcagagggacagcgtgagaaatcaaagggagcatttaattctcctccttgctaatgtgcacataagacttgagccaaagccagagccacttagcaaggcatgttcctttgccactttttactttgctgatttgactatatggatatcaatgtggataatgaagtaagaagcctgggatcagtatgtattcattgtctgactttattcattctagtaaacaaaagcctcagcctttgatcaaaacaattttgtttcttttataatgatttagtatattcaatcagctgggatttggagtaacctcttgcaaaatttgtgccgacaatattgccttctatcacattccaaaagttatcactgtaaaattcaattgattgaactgattaggtgcatgtctttcaaatgtgcagctaaataatgctaaatacatccttcatttcctgtgccacattccttcttttgtttcctctataattgactggagcttttctttcaaccctgaaacagcttgatgatcgtgctgttgatgaggtgatggctaagctattcagcaattacaggaagtggtgcaactttttgtcacgaaagcatagtttgaggtacaaaaaatcccttacctttgttttctaaatagaactgttattattctcttattgtacattgtgttgatgatttcacaactgcagaagtcctcaaggtgcacaaccacaggaaattcaacaacgaaatattttgtttctaggtctttatcttctcatttggggtgaagcagcaaacatccggtttatgccagagtgcctttgctacatctttcacaatgtaagtcacacctttttgggtaaaaaaaaagtaaggtacacctttttaacatattaagtatcaaagcttaatgctattaacattatcatgtatataattagatggcatatgagttgaatgggctgcttgctggaaatgttagtattgtgacgggtgaaaatatcaggccatcttatggtggggatgaagaagctttcttgaagaaagtagtcacacctatctatcgtgtcataaaaaaggtatttgatccatcagaaatcatgcaaaatggaaaaaaaaaaggtttcttcaatactaatgattgtggcggtttgcaggaatcaggaaaaagcaaacacggaaaaacaccacactcagcgtggtgcaattacgatgatctaaacgagtacttctggtctgtttacaatcttatcttttgtacacattgccaacatttttcattttctataattcctaacctatttcattcaggacaactgattgtttctcgttgggttggccaatgcgggatgatggtgattttttcaaatctgtgcatgattcaaggcctgtaacaacggtagaaattttatccatctgtcaatatctcttggcatgtttgattgggattgacaaaacattatttataggctggaagctcatcacaaaagggttctactaaaagcacagggaagatgaattttgttgaaacaagaacattttggcacatcttccgtagttttgacagaatgtggaccttctatctgttggctctgcaggtactaactgaaatttttatatgattttttcatctaagttattgtttcacagtcttgagcagcaatcttctaatgattaaattgaacaggcaatgctgatttttgcttggagcgattatacactatctcaaattcttcagaaggaccttttatattctctatcaagtatatttgtcacagcagcatttctacagttcctccaaagtatggtccacatctcagctgcttgcctttttttattgcatgaatttgtcccctgaaacagctacgctttaatacgtcaggtgacattgccttcttggtttgtgtatgtcactggatcttgctaatgttgccacaggcattggaatattagcttctttattgtgtctttgtacttgttttgttttgatacatatggatttttaggcagaaaatgtgcactagttttgttttgttcacaatgctaagtgagcatctgttgctgaaactagtacctttccgatgtgcacattgcatagagagagcttctctctctctctctctgaagacacttgtcgggttcaaaaccggtccacctgaattatattcttaaaaaataatcaagtactggctaggcaaaactgtgaacttggcaaagtattaccaagggggaggaggagagtgctgctcttccaataggcaaaccttgcttgttcatctccttcttcagttgacccttttactaaccaaattttatgccttctatacttttttgaaactttatcagttctttttcatttctattaaggcaacctttctatttagatcagtcatgtactatgttcttgagatggtgttgagttggcagctcctattagaaaatgtaactgatcttttatttaattgatggcaggcattttagactttgttctgaacttccctggtcatcataaatgcaagttccttgatgccatgagaaacattctgaagataatagctagtgctgcgtgggctgtgatccttccatttttctacattagcaccgcatctaaagtcaatttaccaattaaagatctggataaatggtttcaatatgttaaaggagttccacctctatatatcctagctgtggcagtgtacctgatacctaatatcctaagtgcagcactcttcctgttaccatgtttccggaggtggatagaaaactcagattggcgtattgttaggttgcttctgtggtggtctcaggtattcacagcagacttctttttcaattttcttttctgttctgttaaatgttcatttcgaaatttctactatgagaaaatagtttctttacctaatctattgtttggtactagtaggatggaacataattttgagggattggatttgaacacagaatctcatatgttcttccctgtatatagtagctctggaattcctcaagttgatgaatccgtaaactttcatctctaaatactaagtatcaactctgtattctatctatccacgaatctcatgctgaggcatacattatacttctcatttgtttgaaaaagcatgatcttggcagtttcatagctcttcaaagcttatgcagatcgatgatcatattctctaatctctaacaaaagttcatcaactgaacattatattctgtgtttgcaagagctatataactgaataataaagatatgtatgtgtcatgaaagtaaatggaagcaaaattccagaggtgctactggaaataggaaaaaagttgggaagtaactaaatgtagtgaagacaataggtgtattttggtatgccaacttataaatatgcccaagcaatgtgcctttaagtaaaataaatggatgtctttcctggatataacaacaatgaacatttttttttttgctcctgctttctagtatctacattactctatgtcatgtggtttcttttctattagctacactaattgtataaataactgcagaaacgaatttatgttggccgtgggatgcatgaaagcagtgtttcactttttaagtaagttagtttttttaattgtttgcttttttatccatgaaaaaaaaactcattctcttgtattcaactcaaaaggtatacactattttggatcttgctgctatgctccaagtttgcattcagttattttgtccaggtaaattttacacttggatattttggaaagatgatttgacaagatggctctgatgctcatactaatttacagataaaacctctgatcaagccaacaaaggacataatgaatgttcataatattcattatgagtggcatgaattctttccaaatggtaatcaatgtttatttttggggagtgttattatgtatttttccaaactgataatagctgttgtcttttcagcatcatataatgttggtgctgtcatgtcgctctgggctcctgtactcttggtatgagcttatccaacttccatattagctgaccacagtgagcagtggggtcttattatttttccggggtcatattattcatttccttttcttttgaactcatgtactaagtcataaatgttcacttgcaatgccttcaattcttgtaggtctatttaatggatacacagatatggtatgccatcttctctacaatatctggtggtgtgtctggagcacttggaagacttggagaagtaataatgaatcttgaacttttacctgtaactagttgttttactttaggaagtcatgaacattagtatgtattagaggcctagatcaccacatggatgggtaaggggcatgcttctgcattaagcactcacataaaccaataggatcttaactctacaagtcttaagtgctatagaagaaaatagtattgcattcttttttatgaaaaagacctaccatagtccaaacattttataaatagagaatagcttttagcctgaaaatgccaaaaaagttctgttggaagagtaacaactaaatgtggaagttgattaatgattagtttttatttctcaaggagaacagagtacatttatttgagtatatcttagactttgaacttcgctctttttcatgttaaggcgttaagctcatgactcaagggctctgttgccctatgttaggtgacaactctcttctattcaaactatattaacgaaataagtttgttactgtccttggttccttgaggaggtacccaataagtacatggtattgttggtacctcccctctccataagatgggaggtactgggtacctcatgaggtaaaaaaaaacatggtatttcttattaaatagaagcatggtaaaagagcctacctaaggaccatagaaaagctccaactcctttttaaccttgcctattcttatttaattgtgttataatagttaatccgtatatgtaattgaagctgaatgcagcgctgacctagtttcttattgacttgcaattcttctatgaatcagatacgaacattaggaatgctgagatcacgatttcattctttgcctggggccttcaatacatttttggtgccgtcagataaaagacgaaacaggcgcttttcactctcaaagcgcttcgctgaggtcccaaataatagtaacaacattttttttcatgatggatcttctaaaccctcaaatatttatactacaaaattgattgcacaggtttctcccagcaagagaactgaggctgctaagtttgctcagttgtggaatgaagtgatatgtagtttccgggaagaagatcttataagtgataagtgaggcccctggctcatgtttaggaggaaacatgttatcatttgctcatagcaatgcgtttaatgaacttctgctattcagggaaatggacttactggtggttccttattcgtcagaccccagtcttaaactgatgcagtggccactcttcttgcttgctagcaaggtttggcagaataaaattaaagcttctcttttctcctccttacgttctgtgttcaattgcatgatcgcaatttattttgtgggaaactctgcagatacctatagctttagacatggcagcacaatttcgaccaagagattccgatctttggaaacgtatatgcgcagacgagtatatgaaatgtgctgtactggaatgctacgagtcattcaagcttgttcttaatttactcgtaattggagaaaatgagaaaaggtacattcctatatttttgctcttcccaccattcttgtttctacagtagaaaaggctaatgtgagttgagtaaagaaagaaagcccctagttctttttctgaagtttccttcctttttttcccccattttagtgtcaacataatcttggaaacaactgcttcgatacaaaacagtgaaattagagtatgcccatttttttttcttaaagatatcattaccattatttattactaggttttggtttctatggaactttggtactttggacattaactatttgctctttgcttcaaagctttcaataaagttgggtaactcctttggtcagtaaacagtttcattcttattcttacaaagccaaaattcctttggtcagaaaaatatcagctttatattgatgtgcatgcgagctatcattataatacactgtaagaatagagactggccaattgcatatggcttcacaccatgctatgtccaattagaggacctggatgtccaaattgaactaagaagatgcccaagcatcacagctataaatggagagggataccgtgacagctcataatttgtaaatgtgcaatggctattacgtaggcatttgtgcattcatctttcatgctagctttttttgtttaatttatttttgtttatgcatgttaccttaaaagcatgtatatcttggtattttgcttcaccattctttccccagaatatgttttgcttcacttgtttgttcattgactgctacaggattattggtattatcataaaagaaattgaagctaacatcgcaaagaacacattccttgccaattttagaatgagcgcactgccagtcctgtgcaagaaatttgtggagcttgtatctgccctggtaatacaatgtttactacttctactgaattgtaatactgtatgagaaatgcagtgttgttttgttcagtccttagaacatgtcatttgtcatgtattgaaatattctaagattattttactcacatccacagaaagaaagggatgcctccaaatttgacaatgtagtattgctgcttcaagacatgttagaagtaataacaagagatatgatggtcaatgaaatcaggtgacactttttgtactcaataaaactgactttctttctcatggcaaactggtgagtaatctcttatactacgattcgttcacagagagctagctgagtttggtcatgggaacaaggattctgtaccaagaaggcaactttttgcgggtactggtacaaagcctgcaatcgtctttccacccccaatttcagcacagtgggatgagcaggtcatatcatcaatatcttgtttgtcttttataactaggaaggtgcactaacttcacttgtgtccagatcaagcgtctgtacctccttttgaccgtgaaagaatcagcgatggacgtgcctacaaatcttgaagcccgtcggaggatagcatttttcactaattctttattcatggacatgccacgtgcacctagagtacgcaaaatgctgtcattcaggttagtctcatatatcaacctgctaatggtactgctgtgtttctgcttttatttccatctaaaatgaactctgcagtatttctgtcacgtttcacacatagcacactgcatagagattgtatgtagcatttctagaaaatagaatattgaaaacacgtgttaaaactaaattaacagaacacatggaaaatttggcagcaactaactgatgtttcttccactgtactcctactaaaatatttaatactttaaaaataatcttgtaaagtaaaatttgggtcgagttttggtgtgatcccacctcttaccactgtagttccgtgagtatttggccaactgtcctcgaactgaattcctagtgtgtgctcaccaggaagggggaaataggcattaataccatgcaggaatttgccatgaatgttaggtttttttagctgaagccgttgatgatgcctgacatgaatcaaaattgtgttcattgtttatttaaagctgagttgatcctcaggttcatttcttaaactttatgctattattcgatgtattaattatactgtgcccaacaaataatgcgagcagctactgacctgatgccataattctgttaggctgctttcaatacttggaatttcaacaagcactgcttgcctttgttctgattcatgtcaggcagtccagttaatttgattcactgtgatcttactatgagtctatgagagtagctactctttaatccgatgaaatgatatttataaagttcattgtattcgtccttattatagcatgttttcttgatgataacactactgcaaatcattctaatttgtgaaatatgaaatgtacaaaacgaagtggttgaccatcctgatgcagaccttgtaagccctgtacaacaccaccaggcacatcaacaatgtcgaatctagaaaaagacactgaatttgccacaaatataagccttctatgcttaaatttagcaatgtgtttttacaattttcaacaatgattgtgcattagataattgcatatcacctactgtcctttgcagcgttatgactccatactacagtgaggaaactgtatattcaaggaatgacctcgatctggaaaatgaagatggtgtctcaattatattctacctgcaaaagatttttccaggtctccactcatgttttatttttctttgcacttctaaatatggatacagtcaccaggattctgtcctttactcttcgctattcttgttatagatgaatggaataattttttggaaagaattggttgccaaagagagagtgaagtttggggaaatgaagaaaatgtcctacaacttcgtcattgggcttctcttagagggcagacactctgtagaacaggtgaatcaaactggctgttttatcttacaaaataaggatgattttgttgattccttgttaaatgcttttcttgctgtgaatagttagaggcatgatgtactacaagagagccttgaagcttcaagcttttcttgacatggcttctgagtctggtgagcttcttctctccaagctgagcattccctttctttttgtgccttcataaatatttttgatcttatgccctgtcttgcatgtagagatattggaaggatataaagcagttgcagatccagcagaggaggagaagaaaagccaaagatctctgtcatctcaacttgaggctatagcagacatgaagtttacatatgttgcaacttgccaaatatacggcaatcagaaacaatctggtgatcgacgtgcaaccgatatcttaaacttgatggtgaagtgagtcattttgatgatctattctaaactaataagatatagtaacattttgccatactacaagatacaccatatctatcccctggagcaaaaatgttttcttcttggatttttggagattatatcccttggtttacatttattttggttgatggcatttaactgacaaatacatgatttctaggaaaatattatgcactctgcttgttctattaagaataaatattattttcttttatgagcaaagtaatttcaatctgaacttgaaactgtagttatcctggtttgcgcgtggcatacattgacgaagttgaagagagagacggtgaaaaggtgcagaaggtcttctattcagttttggtaaaagctcttgacaatcatgatcaggtaatcatttccacaaagttgaattaccttgatggcattttgatatgatgtacatctcgatagagcttatttacttttgtatactgtgaaggaaatataccgcataaaattgccaggaccagcaaaattaggtgaaggtaaaccagaaaaccagaatcatgcaattgtctttacacggggtgaagctctccaaacaattgatatgaaccaggtgaattgaacggttgttctaaaaaactgaagagctatgctgccactcaagatatatctaatctgttgcattcttaattatttttaggacaattatttggaggaagctttaaaaatgcggaatttactggaggagtttcacgagaaccatggtgtgcgccagccaacaattcttggtgtgcgtgagcacattttcactggaaggtctggttggatgctttgcagttgttactgaatttacttctaaaaaaatacatatcagtgcctaacatctaatattcttgcattgtagtgtgtcctctctcgcgtggtttatgtcaaaccaggaaacaagctttgtgacaattggacagagagtactagctaatccattgaagtaagtcagcatcggtttattatgtcctgatgagatgaagcggaatccattaatattatgtggaacaatgggattgcggcatgttggaattagcatctgtagcaactgactcaaagtcaaataagttatagatgatttttttggtattatttcaaccgttgaaatgcatatggatatgtgtctgagattaagtaaataagttgtcaaagattaaatcaaccaagtgctatttgtcatcttggccattaagaaaaacatgaagacggtttatagcgtgacacaaaagcaaagggaatcaagtcttatagtcttgatgttgcatatttgacactttattttctgttcagggtacgttttcactacgggcatcctgatgtatttgatagaatttttcacattacacgaggtggcattagcaaggcttcctgtggtataaatttaagtgaagacatttttgctggtatgtgattctccatgtatttctgacttccccatttgtgctgtcggataccataggcttacacttctgttccaggtttcaactcaacactgagacgtggaaatgtcacccaccatgaatacattcaagttggcaaaggacgagatgttggtcttaatcaaatttctctctttgaagctaaagtggcatgtggtaatggagagcaaacactcagcagagacatctatcgcttgggtcaccgctttgactttttccggatgctgtcgtgctactttaccactgttggattttatatcagttcaatggtaagttggtaacttacattgacctagtagagtgaacacaggacaccttcatgcattacattcgttatgatctgctaccatcctttttattctcgtaaggttattgtcttaattttgtgcagatggttgtcataattgtctatgtcttcttgtatggaagactttacctagcattaagtggactcgagttagcaattatgaagcaagcacgaatgagaggtaacactgctcttcaggcggctatggggtctcaatctattgtgcagctaggtcttttgatggccttacccatgtttatggagattggactagaaaggggttttagaagtgccctaggggatttcatcattatgcagcttcagctctgctctgttttcttcactttctcccttggcacaaaatcacattactttggccgcacaattctgcatggtggtgccaaatataaagcgaccggcagaggctttgtagttcgccatgtaaaattccctgaaaactatagaatgtactccagaagccattttgtcaaaggacttgagctcatgttattgctagtggtttatcagatgtatggtgatgtggctacagattcgactgcatatatacttctgacatcatcaatgtggttcctggtaatcacttggctgtttgcaccattcctcttcaacccatcagggtttgagtggcaaaaaatagttgatgactgggatgactggagcaagtggattagcagccgtggtggtattggtgtgcctgctaataaagcttgggagtcctggtgggaagaggagcaggaacatttgcagtctacaggttttttcggccgcttatctgaaatcatcttgtctctccggttcttcatcttccaatatggtatcatgtatcatctgaatatctcagctggaaacaaaagcatctctgtgagtcctctgttttatttcttcaagatattttacataccttttgtcgtttagtagcatgcttacaaatacaaatctatgacttccctctcaaaaatctgattttgtgatttcaggtttatggtctgtcgtggctggtaatcgttgctgtggtgatggtcctgaaggtatctcattttctttctagtgatcaaaacaagaatggaaaaatacatgacagttgatatttcacacatagttaaactttctttcccctttatgtttctgaccagtaacttttctgcaggtggtatccatgggaagaaagaaattcagtgcagacttccagctgatgttccggcttcttaagctgttcttgttcattggatccattggaactctggccattcttttcacccttttgcatctaacagtcggtgacatattcgccagcttccttgcctttgcaccgacaggatgggccattcttcaggtacttcctcaaccatcaacattgcacttttaaatagtgtcgtcgagtacccccactgccacctgctaggtccagtaccaatccatataatttcagaaatgaatacaaggcattaaccatagctgtccactccccttgtccacttgggatgctacagttattattattattattattattattattattattattattattattattattattattattattattattattattgatgaaatagagaagcagtgctcccccctttcaatttctagaaacacgacgggctacggagttcagaaaacaaccagaaaacagaaattcgaacatccagcaaaagctcacaaacaatgccatcccatcacctgtggaaccttcacccaaactaccagctaaactaacagagctacagaaatccaaagtttttcatccatccatgcctcctgcaaatacagcctcagcagaaactttgtctccaaaacatgtaccaggacatcaacagattgaacaaaagaggatcagcttcctatcttccatttcatcactcattccttttcttctgtttcttagagcttccctcgccaggttcttctattccagtctgccagctcctatcctccagccatgctttgagttgtagatgtcatttgctacctgctttagcagatggagaccccattatagatttcttgtatttgccaccgacctctgcaaaattgcccacgaggagatccgagagctgatataatgaattagctcaattgggtgtgataatgattcattcttgaaacaggctttgttcctagtcttcaaaattgcccacaatacagctgcacttctgatcgctatccttctctgtaagtttctgtcatatttatttagccaagcacccagtaaatgatgtgttttacatccttcaggatgtagaggccaggttttatttaatccattatctaaaaaaaagtaaatgatgtgtgtcatggataacccccagatcagaagtgctagctgtatcatattccagggcaggtcaggagtaaattttttcttccccttccaccctcttttcagcaagttatatttggttaaaaggctattcttcagaatcagccatataaatattctaattttcaaaggcaccttgaattcccagagatttttgtatgggaagttcaaatgttatagtagtattgcaaagctctatgaaagaatcttgccgggaccgccaaagttctatgaaaggatctaaaagagaagccctatttactctcaattttccacactaacacgtctttctcattattcagagtacttgtctggcattggcagtcattctgcaacttgtgtcatgatctaactgtaacatgtcttaggcgaatatgtatctatcacctggcggcttaaacttatccagtacatatcgcctaactgtttgtgtcatcgtgagaaaaacaattcaccgacttccaatctgttttgtcacagatatctcaagccagcaagccggtggtgaaggccttcgggctatggggatccgtcaaggccctctcgaggggatacgagtacctgatggggatcctcatcttcgtccccgtcgccgtgctggcgtggttccccttcgtctccgagttccagacgaggctgctcttcaaccaggccttcagccgaggcctccagatctcccgcatcttggcaggcgggaagaagcagagctgagcccgcacaaagtccaccaagtgaccgtacataagcatgcacaggtttaggcgaacagcatcacaagaggttaggtccaggattgatcgttgtacagtggagaagtttgttcaggaggcgtcgtacagctgctgacttgctgacccttcagaagttccgttacttttgtacacacagggcgatgatttttttttctttttaggcattttcgagttattacatctccataccatattattcttacgtctgttacataggctgttgctgagtattgtatagatagatgttgtatgcccacaaacaggtgcatcaaagcattttcgttgatttaaatgcaaaagatgagattgtttattctctacgtcaaaagaatatacaccatgtcacctgagacaatgctgttacttatatccatattttgaaatagaacatgtctcccttttctcagctactaattattattgttatccacgcctttggtatccaagagtactccaccagacgaaagtgtgggcattgtatgatactccactcttttttttttgagaactatgatagtctactcacggtgatagtattacattactagtctacaccatagatgatatatttaaatggagatcaagatcactcacctcaccgaaatccgaattcccaaacaggggatgagtcatccattccaggggaagcaaacatcaattgctaatttgcaatcaatacagaaccggtaactaactaatgcacctttcagcttgtccaggacatctccaaggcttttgacttggtcagatgggactacctacttgcgctcctccaaaatagaggttgcccgtaaaaatgacgcgaatggataaccggattgctgtccacttccacctcaaagatcaccctgaacggaatccgggtcgaaacaatcagacacgggaagggtttgcgacagggtgaccccctatcccccctcctcttcatcttagctatagaccccctccagcgccttttagacaaggttaccgacatatgagttctaagtaagctgcggggcagagttgtgcgcttctgcacatttatgaatgctgatgatgcggccgtcttcattaatccgatcaaagaggatgtgagcgccttcgccgatctgctaagtcgttttggaaaggtatcaagattatgcacgaacctacaaaaattgcaagtggcgccgatcatatgtgataacataacctggacctcgatgacattctacatggcacgcctacaactagggcaagcttcccgatgaagtatctggggttgcctctgtccactggtcgtctgcgcaaagtaggccttcaacctctctacgacaaatcgatgagtcgagtagctagctggcaaggaagacacattggcctggaggggcgataaaccctggttaaatcggtgttcacttcacaacctgtttttcttctaacgggactgaaagcatcaaaagagtccctagaggtcatcgacaagcaaaggaggaaattcctatgggcatgcggtgaagctctgacggggggcaagtgcgggcaagtgcaaaataaattggacacggacctgcctccctacagcctcaggaggactgggcatcctgaacttggagaaatttgcaagggctttacgtctgcgatggctttggaatgagtggagatcaccggaaaaaacatgggtgggatcgggaacgccctgtgacgacacggataggttactctttgcagcagcaacaaccataacaataggggatggagcgaaagcaagcttttgggattcggcttggctggaatggagaatactaaaggatgtagctcccctgatctatgcggcctccaagaaaaagaatagcacgctacaacaggcctcagctacagaccaatggctgctcgacctggacctgcccgcagcctcaggctggacaacggagctggtcagttagctaatcaatgtctagagtgcggtgcacaatgtgcaattcacagagaacgaagaggacaagataatgtggaagctcactagccacggtgaatttactgtgacatcggcctacaaggcgcagctcctaggtactacagccaccaacttcaacatcctaatatggaagccgtgggcaccacacaagtgcaagacctttgcctggttgatcatccataatagagtttggacctctgacaaactggcaaccaggggttggcagaacagctctttctgtcccttatgcagacacacccaagaaacagctctccaccttctcgcagaatgaagatacaccaggaaaatctgggcggcgttatctgaatggactgggtgtggtcaactgaatcctggccaatggcaaccagcttcatcggtgttagagtggtgggaggccaccgctaacttgaacgaagccccaaagaaagcactccgcacgctaacactcctggtcaactgggaaatatggaaaaagagaaactgcagaattttccaatacaaagagctatctaccggaagtctgttggctaaaattaaggaggaggccaaaacatagtcttgggcgggggcgaggcatcttggtagctggcttgaattttaattttagcttatttggaccgaaggtcttgagccttgattttcttacttgtaaagtttactcctctattcaataaaattggcagcttgccgatttgttcttttttttagcttgtccaggtatcatggctaatgatcgcctaatggctcactgtgaattaactacacacgtgatgacttggcaagtggctagattgctctcaggtcagccgctgtgcgtgaactgaagtgtttttggtttagtaagcaagggggcgaccggatgctgttctgcccaataatgatgtttgtttgggatttgctttagttgttgatccatctgtggctttaatccaacaaccatgttattgttccttgtagtgaactcgttttgttcttaacaaatttcccatgtaattcttcatctactaaacttccttccatcttaactttccagcatgttaggactcctttgaaaagcatcattgaaaaaaatagagaaataagaaaaacgtagataatgtaagtgtagaacagattattaccaaacataaaaaaaaagaaggaatgattgtttaagtagatcatagaaaagacatatgaatcggatgagagagactcaggaggtctcttttataaaaggttggagctattattaactttccttcaaatctctttagagaaaattatgatagataggaatcaatcttttgttttaaagttcttaaaattttttcttctgtaaaattttctaccaatcaaaacgccttatacaaaaatttcctccttccaacaagccaacgatatactagtataaatgaagcgacccgcacatctggaaaacattttccacatacactagcttcatatatacggaaagttcagattcacgtgtcccgaactggacctaggatttttttaggttgcggcgcggaattattacacgttccaaaaatccaaataaagcgcgcacaaaattaaaaataaaaatgtggagacagccagagccgctcgtctcgtctcgtctcgtccggccagccagccaagccaggctgcgccgcgagacaaatccagcagtagcgtagcgcttactggaaaaaaacacacacacacacacacgggcatcgcgaggacgccgcgcggcgcgggtgcggggcgcgacaacgacgcgcgcgacgtgcgtgcgtgcgcccgcccgctcgcccacccacggcgcgccgcgcgaatggcgcccttctcctcctcctcctcgccctcgccggcgctggcaccggcctcctcctcctccaccgcctccacgccccgggccccaaggcagcagctgcctcgcggcgcgtcgtcgtcgtcgtcgtcgtccccggtgtacctcaacgtgtacgacgtcacccccgccaacggctacgcgcgctggctcggcctcggcgtctaccactccggcgtccaaggcatgtacgctctgctttcctcgccttcgatcctggttcgccaccgacggcgctgacacgccggtgtgctatgtctgtggtgtgctgcagttcatggggtggagtacgcgtacggggcgcacgacggggcggggagcgggatcttcgaggtggcgccgaggaggtgcccggggtacgccttccgggaggcgatcctggtggggacgacggagctgacgcgcgccgaggtgcgcgcggtcatggcggacctcgccgcggacttccccggcgacgcctacaacctcgtctcccgcaactgcaaccacttctgcgacgccgcgtgccgccgcctcgtccgcgcccgcatcccgcgctgggtcaaccgcctcgccaagatcggggtcgtcttcacctgcgtcatcccgggcaacggcgccgcggtgcggcgcaagggggaccccccggccaccgccaccgcccccggcgggaaggccagcatccgcagccgctccgctcgccagggcgcggacgccgccgcgccgccgcggcccaagacgttcttccgctccctctccgtcggcggcggcggcggcggcggcggcggcaagaacgtgacgccgcggccgctctcgacctcgccgtcgccgacaccgcccgctcccccggcgtttaccaccgccacgtaaccgcgccattcctttactttttacagtttcatctcatctttttgtactcggtaaaaaaaacctttgtgcataaacttaagattaaaattaatccgagatttgctagtgccagtgccctctggttggttaattaggctcttattaataattagctcgagcgttcatctaatctcagtcagtttgccggattagtgaagtgaattttggcttttactacgagcacaattttacgtcgaaatcaacgacgtgcattgttagggcgagtgatgcaataggaatatattcctcttcttttctttggatttaaccaccggcctacgatgcagacaccgaaagttgcgaatgctgatgctgagaaagaatatatgagttaccaacaaaaagaaaaggagagaaagaatatgtgctttgctaattcattcatgggtatatctatcttatcatctctagggtttaaacttcaaagtaactttttttatagaaaagaacggtgtgaaatccgtatatttcttaaaactctatttgtctgatgtcttcttatttttctaattgtgtactctctctattctattttaagtgtagttgtgatttttcgtatccaacattcgaccgttcgtcttatttaaaaaaattatattttttaaaaaaaagccaatcacaatgtactattcatgttttatcagaatattaattataaaaaattttaaataagacgaaaggtcaaatgttagacacggaaatctacaactgcatttaaaatgggaccgatgaagtagaatatctcaaaatattttttaaaaaataataaaataaagtgatatgtgatatatggcatgcaattttaaattttacttacaagtctataaaaagggaaaaaaagtaattttctatgatgccgcgttggtgtaccgtgttcttgctcgccgtggaccggcgcgaccgcaaatgggcgttgacggctgagacgacgtcggtggcggaccgaaacagaatccgggcggccatgcatggtcaaaatattgacaaccattgtccactactggagaaacgcaaaataggtgcacatatcaaagctcgcatcgcatttttagtttagcagaaagtccacgattctaagtgaaaatcatttgacttccgaaccccttcggacacaggaatattcttggtttttttaaacaaattaagtactatctccatattttaatgtatgacaccgttgactttttgtccaacgtttgattattcgtcttattcaaaaaatttatgtaattattatttattttattatgacttgattcgtcatcaaatgttctttgagcatgacataaatatttttatatttgtacaaaaattttaaatgaaacgaatagtcaaacgttggtcgaaaagtcaacggtatcatacattaaaatatggagggagtaatatgttaaacattagaaataaagtgtacatggataagtgatagaacattgttagctgttagagctgacatgagggcttccttagtgggacacatgaatattcttggtgtttcatgtgaattgttcagtttcacgaaaatcctcaataaattctctgatgaataatacttctattgaatttgttacttctagccgtcggggttcaaattattgaggattcgtaaatttggaagtgtcacatgtataatccatattatccgcataagctggttagaacagaatttttaattatctttcaactttttaactttttatttttaaaataaactcttccaaattttttttttaaaatgggaaccttttgatcaaccatcccgcctgacgtggacgctgctagcaatgggcgtgccaatcttaactagcgtgaccaaaagaccagatttggttttggagtgtttattttaaacaaaataaaaatttagaaggttcaaaaaaagtttttaaaatcattagagcatcccttaacgatagcttcccaaatcagctctgaaagggatatgtctcatcggatattagattgttatattttggaacgacatagtactcgtaactgattagaacatcccttaacgacaacttcctagatcaagtttgggatcaatttgcttggagctgcagatataaaaaaaaagacttggagtgagagcattactacgaacatttttcaagaagaaattataaacgtgttggaaataaaggggttgtttggatgggagggactttagtccctcacgggactaagggcatgtttggatcagggactaaagttcacatttgatgtttggacactaattagaagtattaaacgtagcctaatgaatctataaccttgctaatttgcgagacgaatctattgagcctaattaatccatgattaacctatgtgatgctacagtaaacatgtgctaattatagattaattaggcttaaaaaaattatctcacgaattagctctcatttatgcaattagttttgtaattagtctatgtttaatactccaaattagtgtcaaatattcgatgtgacggggattaaagtttagtccctgaatctaaataccacctataatttttgtgaggggctgaaattagtcccccatccaaataggaccctaaacttgggacttgtatgtatctctggagctgcagatatatgttcaggtgagtagggtggcctggcactgggcgtggtagtagctggaactgggctatgggagagaaaaaggtgcagtggacaatggacagtgcctttctccggctgtctccctgccggccgctggaattatttgggggcaaaggtttggttgagtgaaatcatggaacgtgcagtgcacccatgcaacggaagagtagagagaggggggggggggggggcagaattttatggcgagtggggttgcattttgcagtgctagtgcactgcacacctcccaactaattcctgcgggcaataattctgcacctggcccacccaccaacgtggcttttctcaagggttgcagcttagaacaggtataagagctgtgagaaagcagaaagttgagatggatgagagagggtaaaggagagatatgagaaacatgctgtaagagcaagtttaatagtatagcccactactagctttaattcatctataatcaatctaatagctaattcatacaatagttgcttactatactattaatatatggtcccacatgtcatacacacattgcgtcttaaagtccgtgctacagctggctatagatatgtagcccactgctcttctctctcatcttttatctcattaaaatatgtttatagctggctaatagtctgctattgtacctgttctaaggttacagacggcttaggcatatgaaccaagaaaatttgtgagacaaacagatgaatcatgaagagctaaccactcggctgagagatatatctcattaaaatatgtttatagctagctaatagtctgctattgtacctgctctaaggttacagccggcttaggcacataaaccaagaaaatttatgagacaaacagatgaatcataaagagctaaccactcggctgagagataggctataaagatctatacattcagcctggttatattatgattcttgctcttacgtgtgctcgatctgtaatagtacactgcacgatcaattgagatccagtgcagtctattatcgcagtcctgcttgcgttgtctataatctccaagtgatcatatagacgctagcatttggctgtttggttcccaacaatattttgctaggcatcatttgtcaataaaaattaccacactttatctaagatgaggcgatcaactttttagacacaatttacaaaggttgagggaatcttgtcatacttttagtcattagcacatgaaacccaatttattataaaggaatcttgccacaactatagttacaaccgaacatctatcaagttgatcaaatttacctaaccttagacataacaaagtgtgacttgaaaccaaatattcctgcttagtcgcttacttctcaatacatataatgtctaaaaagtctaaaataatttatcatcacaaatatatactgctatttctttcaaataactatctatataaacaattaatgtttagaccatatgtccattccccacagcagtttcggttatgtcgattataaactgtaacagtttattagctataaaaaataatttataaataaaataagagttttaataatttataatttatatatatctttattaatttaaaaaaaatacccgaaaaaaactctagtttctctgccaagcaataagagcgttagttctctgttctggtctattgctatggtcttcacgtgttagattcagggtttcccaaaccgtcgaggccagggttaccacgccccggcggtaagcacagttatcgcgcggtaaccgtgaaaaaccgtacgaaaccacgcaaaatttatcaaaaattcaaattattttttaaatttatttgaatttaaggaggttaccgtggtatttctattaccgtaccccgcggtaaggccagtaaccacagtaaccgcgcggttaccgacggtttgggaaactctggttagatttcatgctgagtctggctctcatgtactcccttcgtcctgagttcggctgtcatggaaaccatccgttcaaaaaattatatattttcggactttctaaagtaaagttatcattcttttactccggttagcacatcttccgaaccgctacatggtttttttttaaaaaaaaagaaatatctatacaaaagtttcttaaaaatcatataaatattttttttcaagttttttctgagattaattaatcatatattaatgagtcactctattttgcatgcacgtggaagatcacaacccctccatctgaatgcaccctgaacttatccaagtttatggtaggattttttttttttgacagaagggataagaccttggttaagactccaataaactctcgtgccagtaccccagtcaagaactgggaactttggtgtccaccgctacgattgttggacagaaaagcaaaagcagttcagatagctggaaaaaacaccgttcacaaacaaattgtagtggataagtcctatagcgaacactgtagcaattgtggttcaacaatgctgtagccgtgtactgtcaggttatcaagcccatatcatgtttggagtgggagacaaacctggacctcaaaatcaggtgaccctaaaatttactacatttgatctttgttagtttgtgttttggatgttgacacaatcttcggtgcctgttcatcatcacttcatttaactatatatttattaaaaaaattaaaatataactacatgaaactatttttcatgataaaactattaaaatcatttatacatactgtagtccttttttttcatttaatagttggtaaacataccgaggtttcactgcatactttaggacatcaactatttgagaatggagataccgagattgtaacttatgaaacaaaaaatattttggttattggcatttttcaaatttagaatttcattttgcgtttagcatcgagatatcagattcttgagtacggatttgactcctatatctcgagcgctgaagttgtattttttatactaatacacaaacagtactggatccttagacaacaactccttttccttgtaaagagaaactgtgggcaactatgtcaaagatggctccaatttccgatatcaccagatataatctgactttccgtttggtagggtgtccagcaaacaagagtagcaatattgtggtgttagggacagaaaaattaccttggctgcactttttgaagaagttgcatactgtataagtatttggatagacaacaacaaggcagtcgccgaagatccaaaagatgaagtgcaggcatcatgtgggacgtagcaaatcgacctgttcaagaagctggtagctacaattaatctaggaacaaatagtagttcaagagactgatagttacaatctaagaacaaatagttagacaggatagctcagttattaagcatttagtacaagaaatatatgaacagaaagccatcagttggccaagagcgattatatgccacacggcttattagcaacgtaaaacttttatacatgtattcttagcaacttaaaagacaatggtaaaaagaaactacgttgaaaataccctaaaatcaacttactttgaaattatgctgtaaatttcggcagctgctaatttgttataggggacaaaatattatagcaggcataagtctattggcggtccatgcttggtatggacaaccaacagggagtccaaatccaacctgaccataggcccatgattatcaatgcgggcaactgggaggcggcgcgaggagctggcaggagaaagtaattaaagatgtgattaaattgtgatcacatgattaaccgccgaataggaatggaatatgaaatcctgaatatggctgaactggcaccttaaagaaataaagcaaggttaacctgaattcccatggcttgcttgatattgacacatcactttggttttgggactcgatgcttctttccatagaaagacatgagcagctggaaaagtggcaacctgaaatccaaaggaatttggtaatattaagtggaagaaaagaatagattgctgataaacattcaaagagaatgatggtgggtttgctgattgaagtgccggttcccttaggcaccaagggatttcccttccatataacaaatcaaactacctttatgcatattagtggtcaatctttcacaacgttgactgactgcgatctagacatctaggataagcaataaatggagggattattgtcattgtcatctggaaggtcgagttttactgacaaaataattggaaagcaaaagtaacttacaagttgtaatcttgccagcaaatctgcaatcatgaacctgctaccttcggcaatccacaagtattaggttatttgtttggcaatgtatccagtataaggttaagtttaaaaatgtctcgtttgtgacaaaaaccagccctatagaatgacttgattataaagtcgaacatatggcaatcagagagtacaccatttccttcaaatacacggtgaatctctatattattcaccactctaaacaagccagaagatccattggaaatccactttaagtgatttcataaaaatataagtatccttgtcaaattttccatctctgcataatctcatcaaccaataatgtatctgagtgacttcatctggattctggagcaatatcctgcgctgtcgtgcacgaaattaggtacttcaactcattaagttttctaaggcagcaaagccaatcaatgaggataatgtatgccacaacattagtaaaaccttgaccatggaccaggctcttggttatggaagactttctccctaatgcaaagagccaaagactatgaataaaaatgttgaatgtctttgcgattggacgatacttttgtcgatcatgtacttggtcaagagcttcagaacagccatttgcccatatctaacagcccgctcatcagagtgttgtatgcagagttgcagaccctcgctaacaagcacaaggcatatgaaaccctcagtcatggagaaggcaattcggaagaacactcgatgtaaaagccgagggatccaatcctttcacttagcataacatccaactgatcaagtacttcctttgcactacctttcttgcagaggccattaaggtatatgtattgtaggcgagcatactgtgcttccaaccgctggttctactactgttgaaacctgctctgaacagagttgtaggtgataacattgggaggacaactagcccgatccgtcacggccatggcggcaatatgcatttaacactggacgtgcaagtgtacatcacttattcagcattcagtctgaggatgccccatgcctcggcgaccttcactgcatgcgccacagccggcaaaccccgtgatgagcattgagttcatggcaatgccggcctccaacccgtgctccccccccccccccgatctccaggatgagcttgcaggcgaggcgaggcgaggtcgaactgcaacatccacccgtacgtgcagcttgaccatgaccatgaagttgtccgacgcgagcatttcgtcgaacgcctcgtgcgcatcccccgcccgcgcacgcgagctcatcgaggagcatgctgtgggaggagcacgtcgcgcgtcgcgccggaccaccgccgtcggtgccgtccacgtcgtagtctcgctccacctgccgccgcagcggaggaggtgagtcgggtggcgctttgggcgtcgtcagagtgttcgggggagggggaggagagcggcggtagaggcggaagaaaccatgcgcgaggggtggtcgccaatggaagtgaccgacggcggccacggccgcggcggaggcgccggcggctagaggagagtggtaagcgacggtgaagggtgggggaatcaaacgccgccgtccttaaaatttgaggtctctttggatttgatgaattttgcagaaattatagggaaattgaacaacggctaaaaagaaactcttgttaaggtgtgctggtttctactgaagattgattgatcgaagttagggcaaaaaaaatatataaaaaaaggacattagcccatgattaattgagttttaattattattgatttgaaaaatggattcgtatgatattcttaagcaacttaggccttgtttagttggcgaaaaaaaattttttgggtgtcacatcggacgtttgatcggatgtcggaagaggttttcggacacaaataaaaaaactaatttcaaaagattcgtctcgcgattttcatgcaaactgtgtaattagtttttgcttttatctatatttaatgcttcatacatatgtccaaagattaaatctgacgtttttggaaaaaaaatttgggaactaaatcaggccttatatacagaaagttataatgcgaaatgtatcatttaacaatttaaaaaccgaggtatactcataaaggaaacgagcctaaatcgtgcatttcaaatgagacctgcaattctcaatagtggttttgtggagtgaatttatgagattgccactaaaattaaaatgaatgttctttgggaggtaggaattgaaaaagcacatgaaatgcgagaaatatagtcatgtggaatcttaaggaatataaaaattcggaaattgttcaaccatgttgtttggatgcttttatatgaatttggagacaaaacaacacaaaggaaaattttccaaaagtttagctcatgttagatttccttccaaattttcatgaatctggtcatttcattcaaatttcaaagggtacattcctttgttccaaaggagcatataagaaaatcttccaaaagatactcatcctgcgttttttttaaaaaaaaattaaacctttgttccaaaggagtctgagataattaactgatcatcccaccgtctttccactatcaccctaacccaaaaatatattggtcaatggttgttgccttgccggagtcattagagatggagaaaacaaaatgttgggatacaaatctcggagagttggagtcaatctaaatgttagaaatttcaacctaaatctctaaacaaaaatgtattcacacatgtatagcaatttggtttagaagggaagttgtacaagatattatcttttgcttcacaaacaatgaaacaaaaatgactgcaaaatcctcctgctctctggacaaattcaagcaagaatatttgaatacaaaaaaaaaaaaacttgtacccacgaattttctcacttgattatccacacaaaatttttctcatcatcttgcacgcgaatgcggcaatcatgaattaccaatcacaaattcacaagcaaaaaataacatataatttttttccatacaatccaacgcaatgcaccaacgccatggacgccatggatgcatggccattaattacctcctcttcttcgtcttccagaggtgcacgacgagagagaagccgccgccgtcgttcatcgccgcctcctccgccgtggcccagtcggccaccgtcgccatgctcccggccgacgacgccgccgacgtcgacgccaccgacaccgccggcgacgagtccgaccccgacctgaacggccccctcctccaccctctcctgtcgctgtcgctgctgcaccagctctcggcggcggcgccgccgccgccgccgtggtggtggtgcttcctgttgaaagagctctgccttagcgcgagcatgccggcgtcacgttccatgtcgatcttggaggtgtccgcgacgtcggccgtctcgaaccggaggacgaacaccgcgacggcgtcggcggcgaagagccagccgtggaggtcccacgagacgcggacgcggccgcgcgggaggtcgagcctctcgctgccgcggaacttccaccggagccgccgcacctggagcgccttctcgccgtcgatggcaacccacatgacggcgtcctccaccgcgatcgacacctcgtgcctcccccccgcgacggcgacggtggtggcgtacgcctcgccgccgccggcggcgaccgcgttctcgcggcgggtgaggaggaacccggcggacggggcgagcagcgcgaggtcgcccgccgccagcacgagctccccgtcgacgcacacatgcagggaatacctcgccacgggctccggccgccgtccggcgaggcgggcgcgggacatgtcccacgtgaacgcgacggcgtgcccgccgccggcgaacctcttgcaccctcgccgccgccacgggagcaacggccggagcaagaaccgcagcgcgggcgcggcgccctccccggcgaggtggagctccgcggcgaggacgagcccgagctgcccgcgcgaccacgtcagggtgacggtgccgaggtgcgtccagtacaccgacgtcgccgacgcggccggcgccggggacgacgacgacgaggcgcccgcgcccccgccgccgcgtgcggcgaagcaggcgagcggcatggcgcggcgcggcgcggcgtggcgtggcgtggcgtggcggcttcttcttctcgatcagattggtttcctttcgagaggcgatcgagtcagagagtggcttggcttagttgcaccagtgcggacgtagcggcgacttgagagggagcaggcgaaagttgaccggatttctttctctctctctctctctctctctctctctctctctctctctctctctctctctctctctctctctctctctccatttttcacatttctttttcatttttttgtatttatttgatttgatttatgtctttgtttatgtgtcaaactgtccattttaaggctcgtgtatttccttttcagattcagaggatatgacccaaggaaaggaaaattagggactttctaccaataatgtgttgttacttctgttactaactccagtcaacagcaacttgtttttaattttttataactcaaatgtgatgccactttgacagcaactccaatttgggtatcatatatgttgtgagattgtcgtaaaagtgacaataagcagagctaatggacaagggacaacaaatactttctgttttaaattatttatcgttttagatttatgatcatgttccttaaaccttttcttaaaaaaacaaagtttgacatcatgtttatgtttttagattcatcttagggggagtttttataacatataattcacatgttattaaactatatgattctttataaaaactagtgattttagatattttttattcagacaaatctaaaatgataagtactgatttgaaacggagggagtttagtaaattagatttagtgtcagaggcagttaagagtttggtcaacggcaacaattccactgtgctacctgcagacagtcagcgacagtgaagggaacaaatgtggttttcgctctggctcgtagtatttttttaaaaaaaaacaatccatcattttttctttgaggaaaattaatccatcattaattgaacaatgaaagtccaaacatcattaatctgaaaacaatgtcaaaaggagatcttccaagtcaggactgacaaagtcgtaagcgtgtaaagtaattttcattttttttgatagagaaagaagattaattaactttttgttaagtctagccaactttttatgcagttttcaccaggacatcactatcgtatattcgtatcatcgctggtgtggtgtgtgttctcagctattacaagtctgaagtctccatcggatcaagaccgttgatatggccacgtggtcgtccccaactactcctatactactaatctatatggacagtacagtatgaaatggagtagtagtattcagtagtcagatcaattattcagtattcagtattgtagtacatcatatctactattcttatataattgtcgccattattgtgattataggcagccacatcaccttatttatttgagccatcagatcaatgtcaaaatcttacagtaactgttagatctaagcatctccagtagaggtcctaacacagcccctgtactaattttgagagttgagactaaaaactcaggtccaataagaccactactaaagctcctaaaataagaaggcctctaaattatcccctcgagccccgagtcctaggggctttctccgcagcccccatccatggcagagatgcgcgggagaaaatcccaccaccgaacgggtactatttttccgcgcaaagtatcctgctagcccgcaactaccggcgcctccacagatctacgctgctcctcctagccggcatcctcctccctggtaggcctcctcctggccggcgcggcggcaccctcctcccctacaagcgtcctccctggtaccctccttcccggctggccacctgcctacccggcatcatcctccccagatccatgtttgaaaatttcaaattaaaatttgaatcatgttgtttgaaattgtaaatttaaatatggttgaattccatgcgctagaattattttatgtttgaattattatagtgttaaactagatataaatataaattctatactaaaataaaagagaaaaagaaataggggctaagttatgggggctactgctagagttaatgacatatttaaggttctaaagatttgggagcagcccccatttaacctttaggggctttaaagtaggggctactactagagatgctctaagagcgggtaaaataggagttttaagctggcggtagaatggccccgctagcaaaagcaatgagctggcaaaaagaaagaaggaaagagagtgtgaatgggcgattatattaccaccggctgtacgtgagcttcgagacaaggtaagcaactgctattggcctatacttgcatgtgaattgtgaattgtgataggtcagtgaggtctgcaaacaaaccatagtaattggcatgtctaaa

SEQ ID NO: 45265 - DNA, 28390 bp, Oryza sativa
  unsure (1)..(28390): unsure at all n locations
nnnnnnnnnnnnnnnnnnnnnnnnnnnnnnnnnnnnnctaaactattgacaaataaccgaaccatatactgcagccttctattatatgaagtgttttttttaactaagctttgggtgacacggccaattttaccgtcgtcagcgggcagtactattggacctgctctaaggcaagtactatgggcatccaagcacatgcccaagataccacataggattaaatagtgagatggaggagagaagaaggatgagagagaaatagtcacctctcatgcaaggggcagctcctacccaaacttcaataaatatgtgagagtgttagatatactggggattgtgtggtagaggtaacctattatacatatcacctcttaatttaaatatgtatatcatgcatgaaattggatgtgtagtcacccatactataaaacttgcccttagatgtctaattgttggtcaccctcttttgcactcatgtgtcacctagccataaaagctaccttcaaagtaatttttgcactaatcccaactattctctcaaaactttctttcaattcttattatagttaggacagtcatcacacatcatcacatcctccatcggcacatttgacatttttgtatttacccacgtatagtttatatctagctacatacacaggtaaaaggaaaaaaaatcaaactatgtgaatagtacaattatatatgcattgtttttttatttttgaaatttccaaattaggcactctcacacagaacaaaaatcatgctaagagataaacaattgtcatctatcattctattcaaccttccctattttacaccttcacaaataaatcttatttctttataaaaattctcgccgcaacacacgggcatcatctattatatctataaagttcatccacactaaatgcagttaatgttaattatctcttctctcatgaagtcacatcatattaattatttttagcctttggatgatcatcaagaatgtaaattgcatctattttcccaaaacacaccatacaatccaatcatttataacctttagataattgatcaaggtaaaaaaaacatataagcacatgaaagaaaaacgtattgtagatattaagaaagaaatttttaaaactcacatctattgcatcatcgcacaattcatccacaccaacacgcaaggtacccatctaattttacttacaccaacatctactgatctactccctccaattcaaaatatagcacttagatttatctaaaaaataataatatcttcacatgtatttccttctcaaccgataacaatcttccatcatttacatacttagtatttctaaaccaattacatttttttctatttaatttcacttttctaatacatgtgtttaaacctaaaacttcttatatttcagaacggagatagtattaaatagtacttgatcactgatgatttgtcacttctaacagtggtatttaatgatttatcaatcaatatctcctcactaataaaagaaaggttgttcggaaatcgtaaatgattgttgatcggaagccatatattattacagaacaatcacttccgatcaggcaaaagaatatctcggtcctttatatcatggacacatgatacgaaattcttaataatatatggcttggtctatctctgttgttgtttctgtcgtgttcgtcatctctatcctccaataacctgtctgtggttgtggacgtgtccattcttccatgagataactacagtatactccactgacaactaactacactacagtagctcagtttcattcaacaactcaggtaagcaatcctctcattctttacgggcatatttctaaaccgctaaatggtatgttttatttaaaacttttaaataaagattatatatatatatagtttgtgatagttaattaatcccacgctaatgacctttcacttcttttaccgtggaaaatctcatctgaattactgaaatgtaagagtagtaaggctgcatttggatctccatatagacaaagctaatatcgtgttctccatgaacatgttttccaaactaataaatagtgcacttcatataaaaaatcaaatataatttaatttttaagtttatgataattaatagttaattaaccatgcactaatttacttgctctagtttccaagccacttagtagctcagcagttctgcgggaatgaacacatcctaagggtgagttcggaagtgagtttgggtttgacaactttctaattctccatgagcatgtttcccaaaactgcattaacgatatgtttcatgtaaaagttttttatagtagtttcttttaaaaaaataaatacacctagtttttaagtttataataattaatattcaactaatcatatactaatagctcatttcgtttcacgtgcctaaaatatctcatcccacgactacagccgaactcagccttaagagtatgaatgcactgttcttcactattcgcatttcgtggcaaaatctcataatcttttcaacaaagcatgcctaatcaagctaagtactcatgagtcaatgagtcatgacccttttctcccttcagagaaagcagagacagaaaaagattaatgtatactcagtcgaacacttcaatctgaaactctgaacctttggtcccataatctgaaactctgaacacttttatatgcagtaataatcatgaacggcacggcggattgaacatcaactaatagatgatcgtgtaaaagatggtgattaactcgatggttcccactggtgtgaatatctgaaaagtttagcggccaaattaaacagtgggagttggtagttttgacctcacctgccttcgctttgctgcttggtcagtgtgaataaatgtgatctccaagcttaacttcctcacgcgtggaaaagcacacagcgtaagctgcttactgaatactcagtcaagcacctggtccaagtaagcaaggtagtactaccagactactagtagtagtattaaaagagtttactagtaatgtgctccataaaaagagttttggatatttgcagattgtttaattttttgatcggaccagtagtttcaaagttaggaaggtaccagtaatatctgccggttttatgagtcacatctggatttttgcgtttgttcggttgaaatttggagcctttgttttgtgtgcaatactgcaatgcattggttagccttctgtttgactatagtagtgtagttccttcacttttcaaaaggaaaattcagacgcttgaacgagttcgttctctctgaatgatacctgcgaagctacatttcgggccaagaagttggaccatttattcattcagacgaacaacaattgcgccatcaagataaagcaaagcgaaagtccattcctactccctcaactataccccgagtcttgtttcgtgtagcacaaaattgggtagaaaatctccctgaaccattaaaacatgatcattttacctccctgagcagttttgatggcggttttgtactatgaggcgtctttgtggcgtatccagaaagaaaatagcggggggggggggggatctaaatgaaatatacaaagctatagctcatctttcccatctaagtatggcaagaaaaattagtgggggctctcatggtactcgtgccagtagtggaggctcgagctccactgctgccatgctggatccgctcttgtctccagatcaaggatcatcccagctgccacctcactcatccctcagtcgctctcaatagtgttgttgcccttgcaaccttgtcgtgactaagctcggaggagtgctgctgtaggctcatttccttgcacccagcctcgccatcatgtcaccaacaacaccaaattaccccaccgagtggatgggaacggaggacggtcgtccaatgacccaaccttttcgagctctagcaatgggctgggtcttgaagcacggaaggtgggaagcgacacggtggagacaagaccggtggcgtcggaggtgaaggagagagacgactagtgacatcgagaggaggcctacatctcccttctctctcctctcctcttttgccaggaggccatccgaatatattaagaagaagaaaagttattagaaaaaaggcagaagctatcgagatcatgtgtgtaccaaagtgcgtgtccaagaaccaccaccctctctcccgtctctctaatcctatatacttatgtagttcatccccactaagtgtagttaatgttatttctctcttctctcattaagccacatcatcacaattatttctagcctttggatgatacatctatggttcaaattgtctcttcttttttctcttttaaaaacatgcaatcttaattatttttaggctcaaaattgtatcaaattgttttagttttgattatcaaattacatcttatttgtacatattatgcaacttaatttttcgcagcaacgcggcggggtattcatccagtatggatgatgaaatgactgggttttaataattcgggaaggctttataccctactgaggaatacgaatcaaactcgggctacagttaagggagacaaaaatggacgctttcgtcaataacagcagatccatacctaaccgtgatactcgttatggcccgaatatgttgtacacggtggcgcccaaatatgttcttgtggtcccttatacgtgtgaagggaaattaacacaaaacaagcatagttcaccatggctgaaaattgccgtggaaatcttcagcaaacgaaatacgaacacgccgatactgtctgccattatctgatctaactacttccactagccaccacccgttagcgtcaggggaagcaaattcgcggccgtgcaggccccctatcctatcacactgcattgctgctatagctgctacaatctgcagctgcaatggcgaacggatcggacaatgcaccattgattgctccccgaccaagccgcggattcttttgacaaatacggacagaaatctctcatgcagacaacatccgcgatgatctctgaatctctctctctctttctcttgcactgcactgcaagccagcgcgattagtgcagaggccgcaatggccaccatcatgagcgagctgaaatgaaatgaatccatcctcgccgcagcacgccgccccggcggccgccatcaatggccctgcattgcatgcaatgtgaggttcagaaagttcagaggtgtaactgctgctgctgctctgcaggtggatctcctgcgcctgaaaattcgtccttgggatgccgggatctcctcccacatcgatcgcggggggattcgttgcgttcgtacgcctcgtgcgctcgtcagggggctcgatcggaccacggtgtagcgcataaaagttggatctcttcctctttttcttttgccctttctgcacttgcctgaatcttgatctgaatatctgatggacagacacactggtaagaacttcagaaattggcatgtttgcaatattggcctgtttagatcgcctggcaaaattttttcaccatgtcatatcgaatgtttggacacatagatggagtattaaatataggcaaaaagaaaaattaattacacagattgcgtgtaaattgcgagacgaatcttttaagcttaattactccatgatctgacaatgtggtgctacagtaaacatttgctaatgacagattaattaggcttaataaatttgtctcgcagtttacaggcggaatctgtaattgttttgttattagcctacgtttaatactttaaatgtgtgtccgtatatccgatgtgacacgtcaaaatttttcactcctgaatctaaatacacctatatcaatatcgattttatcctctgtcagggttggtggtggattggatttggatccaatgtgggggatgttggggttttagtggacagaaatgtcttgaaaaatttgcgaaactgggatgattttcgctgacttttgggttgaattggtatggaccgggaattgccactttcttgtcgctgttgttatcagctttatttattacaccatttgcttggctttgatttgtgctctcttggacttatgagagatctcattttaaaacacgtgcagttatactgtaaacaccctggatgaagagtgtgtaagattatacccttttctgttcccatgaggatatatatattttaccttgatttttgttagcatgtttttcaaatggtgcgatccgtgcgaaaactttccatatagaaatcgctttaaaatattacatatatccattcgtcaaatttgtaataattaaaacataattaatcatgtgctaatagctttatcgttttacatgcgtcaacttaatctttatcttcatgagtttcaaacaccatcatgtgttttgtaaaaatgtcatcaccagattcatcataaaaaaactttcaaacaaatatattttattatatacctcacaatataatatttttcaaaaaaaattagcgacgcatagtgtggcgtgtcaaaagtgtgctggagactacgtagctgttcgtttggcgactaaacctcattttatcgatacaaaagttgaccaacacttaattggtcatagagcgtgacaacgttaaaaaaggaaaattgagtatataacatgcgagtgggtataaggcctagtaaagggtgatatgtcgcaactatatcaaccattgagagtggaatctctccggactataattataattgtaacaattatagcaactagtaaaatgtggcatatcgaattctcttcacctgcaatctatgtaactgagtaactccagacttttttaacacgccctactacatattttcgcatgaatggaaaattcaggtgggaatctctcccctctaatgacttgttaaaaataattgaggcacacataagttttaacacggtagcctttggcacttaaccaaacaagccctacgtgcacatcgaactctaacaaataagagcagtagtaataaaaaatataaacctaacttatcaccatgggagcatgaaaagcttgaagatgaaattaagcacatgacactaattaaagtagcagaacaaaaattgaaggtctcaactgcaaccctattatgctctaaatgatgctaccgtatacacaagctgctccagaactcactgtgaccaaactaacctcgatcagagttcttcctcacatagcttactaaactaaaaaaacaaaaaaaaagaaagaaaaaaaagagagagagaaagaaacaggagatggagcagagaagaacaggtagatgaacagggcacatcagcaggagatctccatggagaagttggagtcgaggagctcctcgatcatctggtccacgtactgctcctcgaggaacccgccgctccactccgccgtcgccgccgcattgcccaatgcgccggcggcggcgggaagggacggaatcacggcgcgcgacgacgcggcggcggaggaggaggtggtggagtcgtcgtcgttgctgttgccgcgctgcgcagcctggacggaggcgaggttgaagcggtggagcttggcgacgagcgccgcggagaggaacgacgaggaggctgcggcggcgctgtgcggcggcggcggcggcgcggcctcgtcggcgacgtcgtgggggaagttggtgcgcacgcgcgggccgcacatgatccgcgccgcctcgtcgtacgcgcgtgccgcgtcctccgccgtctcgaacgtgcccagccagatcctcgtcttcctgcaagcccaaccaagaaatcaaaccgccatggccaagaaaccaatctacgcgaggaagaaacaaagaatcaatcaatcaggaggaggatggcgacgatgaattacaggagagggtggcggatctcggagacccatgagccccagtggcgctgccgcacgccgcgataccgctgctgcggccgcgccattgccgacgtcctcgagctcggcgacggattgcgcgtggtcgcggcgagagagagcgcgcgctcgcggcgggagagcgaggagtgagctcgaggttgaggaggaagtgaggtcgaggtgatcagtgtggtgaggcgagccatgggggcggtataaatagggagggaagtgaagcagaaagagtagcgagctcagttcaattcaattcccggcttgtttgaattcaaagcaacccagctccagggtggggcccgcctctgtgcctgatcagtctatgattcctggggcccacctgggtcgagccaaatttgttccctctgatttgtactccctgtgacactcctccctctcagaaaatgtttgcatttctattgcttacgtataagcatttttagggttggatacagttattaagaaatttggtatgattaaatgaggggagtgttgtgattggagaaaaattagaggtaggtgtgaaaattgaatggtggaggattgtgattagttgagaagagaatattgacggagaagttgttatattttgggacaaattctaaatgttagaagtggttatattttgggacagagggagtaattagcaaagactaagaatgaagtgaaaaaaatatccctttcagacatcttattggttaaattttgaattttgacttgctcagattcccctactaagcacatgataggttgaaaatacctgaatttccgtggattgaaatcaatgtctcgaaaatactcatattgtgtaatgtttcaaaaaaaatactcatattgtgtataaaatttggatcctacaaatacttatatttagaaacggatggagtacttagcttagcttttgtttgccattttccctttttgtttacttattagtagtagaaagtttgattataaaaagatagaggacatgcagaagtcaaggctagtgtcgacaatattcccctagaacatccaaatcatggcattgcattatccagtgaaagtaatcacctaatccagtgacctatattaagggaagaatgaggttataataattaatctagtttatttagttcaggcctaactctagacttatccacagtgcaaccatgttagttcagttataatgtcatatggtaggtaaaccagagaaaactaatgtatgctctcaggaaaaaagagagcatgctactaagctctgaacttcggattccccacaagaacccaaactagcctacaagcattttcttgtgcaatggtactactactgaagtttttttttaatataaaactctctgtttttatcctagtcatggctagggtaatcatttttacaatgaaagtacaattctcagtctctgcattagggttcctttgaaacgcgggataggaaaaacatagcaataggaacaaacataaatcaagtgtcatgagtagccgaatcctataggaaacgaagataccgggaatttggtagagaagatgtttggttacttcataggaaaaccacaagaattttgaatgaaatacttcattcgaatgggtaatagtagataaaagacaagatattaagatacatgttgccttggactttccgaaggaaatgcaaacatgatgagctttgatgtaataatgtttggaatcatccaattcctacaatctaaagggctttcattaaaattcctatgaaaatccttggttcctagggaggcccttaatgggaatgcacgcaactatatcttttcagataatggatgctctattgatctcaacacaaaatacatcaagatgatataactcgtaccaagaacactcttgacctttgcataactaagatccatgtagccaataactcacaataatatgctaggatcattcttgttcagatttgtccctagaagttgattcttttgggggcagatagtgtaactaaagataatctagttaaaccaaattgtgaaaagctcaattagcccattatacatcatcctagctagctatactatactagaatagatgatgatcacagccaagccaaccaaccagttgcaatggctagctagatgttgagataaccttattgggctgctaacaatgtagctggttggcaccatccatggagccagagtgtcaccttgggaagagcagggtctgcactgatctgcaccttgggaagagcatgcagatggaactaaactgaacccaagccctcccccaaaagacaaaaaccttgcaaatattgcaatggctgctgcgcctgctgaggcatgatcagtcatcactcatgcattgcctttgcctatcatgtctgcctcctgcttgtgcagctgtaagtatgtgcatcttcagcgtcagttcagaactctgcaattgtctgaagctctgagtgcctgcatgtgtgtgcgcgcgcgctgtgtgtcattgaacccgatggctgtgcacatgcatgcaccgtatccaccacacgatcttggctcgtcccttctcatgttggacgctagtgtggtgttttagcaaattaaggctccgtttgaggagcttaagatcctggaaaatagccagtgagaaattacctgatgagaatctaaataagctgggcttttcagtttatagtttatatattttctggattttacaactacaccttctcataatatggatgagaagctagctgatgagaatatgaaagctgttttatcagcttctgacttctagtttattttctatattctgtaactacattttcttaaaatactagcatattgtccatgagctgcaatgggatttaaattagttaaataaaattatcattaatatattattaccatctcttaaatattctatatatttgttactgacatgtggattctttagtcccacaccattcttttttcttcctataaaaagtagagagttggtgagagtacttgacatgtcttttttttttctaaaagaaagttgggagttggtggccaccaccactactctgagtatagataggtgaaattttgaactatttaggagaattgaacaatctagaagaatctatggttatcagaagctctctaaaataggatctaaatgggctcaaccagctgtgaatttttatcgttattttagctgatcgtaatgaagaggaagttgggagtttgtccttatgtttttctattcatgttagaacttattggctacatgcttaacgacagaggctggggatgtaaataattttactatctaaaaaaaatcagccgctaatgcataatgcaggccattaattctaatcagggatcagtacaatgtgcaatgtacatacatgctgctaccatgtacagtgttatgctggatttttcctgatgatcagtgtgagtcagggtatgggcactgaccagggtttgttttggaggctcatggttgagacactaaactatactgttgtgccatgtgggttctaaatagtagtgttcttaggtgacagtgagagtagctagtctgtctaatcactgctgatagaatttggaacccttcctccatgctggttaactctgatgattaattgtttatcaatcctctgacaaatgacctaataaccatattgtctcctctgcagcttccatgcttgaattggcatccattcactgattcacatactatatgcattgaacctcacaagaattggacatcacaactactagttatacacatagagataatagggatagagcttaatctaatgagcctcacaacatggcagcacatgctgttcaagcccagccaattaaaaacaaatctgtactgaacctttactgcaacaacaatctgctgatgcgcacatagttcctctcttgaatgataagcttacaaaacgagaattttatggctctgctcagccacagtcccaaactgttcttactgggagtctgtcatggtcgaaaggacaaggccacaggcaagaaccgatcgatcggccggccaatgctgcaatcctgcatgcatgaacacgaacactgacaggatctatccgtgatccgcctaaccggcacagagaaaagttcagaaacagaaaaaaaaaagttcagagaaacaggttatcagtatggttcttgaggcggctacgtggctgcacggcggctcgtcaggccggcccctacgccggcgatgggggaggaggaggaggaagacgacgacgacggtgaccgtgatgatggatggatggtcagatcaggtcagtgattggattggattggattggattgtgttggatttggattggttgggttcagagtttaggagtggagagaagcaaagatccgagtacaaatcttggccatgatccgcacgatctgtggcgctgtggctacacaaacatcactgtgttagtagctctgcatgcatcgctagatgctaccatgctgatgaaatcttgtcactcactcactcactcaccatgctgctgctaagctaaaaagcttagctagctatggagcatggaaaacatggcatgttcttgtgaaagattactaacgtttccatgccatgtgctgcctaatctttattactactaaagaaggtttcagaataaaaagagagaaaagatgtacatgaacaatggaagctagcagggtgttgctacctgctacctaacacatgattcactggaagagttgctgaccaaagtcccaagctaattaaggattctttcaacagcatatatcttaatatctcattatctagatcttgatatcttaacacattatatgtgttaattatctatatgcttcattttacccaaaaaacagcttcattttactctctatatgttgcaagcactgtacattacctgaaattttattgggaagcaggcagaggattacatgtcagttctgtacatgggtcaaatgacgttggtcactctgatcatctctgcactggattgtgatccgtgtttaatgttgatgtcgtttggccccctcctcacacggaatatgaactcattatctgacgattgtgacattgcgaatctgatgctcttttttgagaatacgatgatctgttgttgcatccgagttcaatccagttggcagattaaaactagctgaatgcctcaaaacctcacaaattgtcggcaacatgtgtgtatcagtatcatcatgcagtgcagatctttaatcaagtagtagtggtatcctttttctttctctcaattcagtaattaaaatgcatttcatgctgtttaattaaatataataactctcagatcacaatctgttatcttaataaagtagtattacaactctcagcaaaatgcagtgcaaatctttaataaactagtatcctttttttcccttctcaattcagcaaaatgcattgcatactgttttatttaaatataactctcaagatcacaattgattcaaagagcatgatcacaaattcaagatcatggcaacctagctttcatttgtttttggaggttttcttttcttctgaattggaatatttatatgcataatgtagcaaaacaaaaacatgcaaggaacataccaacatggactgccaagtggttaagaaacgatctgacattgcaagtggcctgattagacatgcaaacaaacagtatttacacgtgtcgcttaatcttggtcggcacatgaacagcgcttaaattctttaattagtctctgaagaaggtcaggtctcctctgccactggcaaagggcagcatccgaaaaccccatgtgaccatgattgcgagatgtcgatgaatcataagacgatgttagtggccaatgagattgcagaataattcagggcgtgccacgtgtccctaatcagcatcaagatttttagagtacagcagagatggtgttatttcccgataacttgtatgtcggcgagcagggatgcaagtatgcaactggaccgacccattgctgatgcatcttatcataagtttgaattggaggaattttagacatttttctttctcgtggatatttacgcctttcttgacctcttttatgtgaaaacgcttgtagcgcagtggtagagccttcagtattggggacaccgaccaagctagggttttgcgagaaaagaaagaaagaaagaaagaaaaacactcctgttagtagaagtgtgctcatatggcttgtttggcaactcgaaggaaggagattgggagtttacatgaaaaaattaatggtgagattaagaccaaaatttgatttttaatcccaaaagatttttctcgactcgtcggtctgagtttttttaatggagcacatgggttctaccgttttttttctttttttttttacaaattttatccattccaaatggaaggcctaatgtttgtagcgtggatcttttatattttgttccaaaggattggtcaaagaacttaaacagcaaaggatgaaaaaaaatcctaatttaagagaaagagttacaagtgggaacactttttttatttactggttctctgtgttgttcattattttttcatctttttggagaaaaagtttttcattcgtatatttagcatgacatgaagaaaacctaagtattcttaggcccatacctatatttagcccatcgaaacgagtccatgaatggccggaatttccggtccatgcatagttgggcaaggaatacggccatctaacaggcccaatatgagcccattaggcccatctggcccacagctcatctgcatataaaccctcacggccccgaaatgctgcggcttctccgttccaagggtttcctcgcgccgccgccgccgccatggtacgcacctcggttcatctctcctgccgctcttctcgtctcgggatttgtttactcctctgattgattgggtgttcggcgcagccgtcgcacaagacgttccagatcaagaagaagctggcgaagaagatgcgccagaaccgccccatcccgtactggatccgcatgcgcaccgacaacaccatcaggtaacctccgccgtcgccgccttgaatccgatccgtctatggaagggagagacaccagtttccgatccgatccctgagctgctggtgtccttcaggtacaacgcgaagcgcaggcactggcgccgcaccaagctcgggttctgagcttggggaggagaggaggacgaggcgccggacgccgctgccctgggaagaagaagaagaaggagaagctagggcttatgggttgcgtcgtgttcgtttcgaggttttgcctgtcctgaagagactatcagtagctgtgtgtatcttggagcatcataattttgctgattaaagaaccactttcttatcctgcctaaagttgtctgaattttatctcagctgcagtggattgatcagttgaactcccttgttagcataatctgaatatctgattatctgcatattgcctgaatccatttctgctttagtttttggtactgtaaatagctacaccgtttagggtgtagatgaatgacctgttgagattttggtaggggattgggctggtgagtttctctatacttttacccttgatttaacagtgacctgctgtagccatttgtaatcacaggggttgcatgtttgttcttagtcagagagcaaagaacctttgatagcatttctacggggacattagaaatctttggaggatttaacttccgaagcacagctgcttctactccagtgagtttaaccaattgggcatttctggagttgtagggaatttgtcactagattgatgattgaatttccagaaaaataccatgggctggttgaatacatgctaatgctgcaatccagtttgaagctacttcctccgtttcatattataagaccttctagcattgcccacatttatatatatgttaatgaatctagatatatatgtgtgcctagattcattaacatctatacgaatgtggacaatgctagaaagtcttataacctaaaacggaggtagtagtaaaaacttcaccctgcctattgcttgaatccatttctgctgtagcttttagtaccgtaaacagttgcaccatttagtatgtaggatgagatagctgctgagatgttggttggtttaggttgggttaatttagccgtgacctgctgtacccatttgtaatcacaaagggcacataagttcttccttgttggttaatttgtgtgctgcatcactttggaggagacatgcttatacttcaatgagttataaaccaatgagatcttaggacaatgatgcttttgcatgcttctaaatatcagtcttcatgtaggcctccttggagcaatattgttcgatcgtgtgctcttttgattagatttatgaattttgttagtaatatgagatgacagattcataggatgttggcatgatatgtttgctaagttggtgctcgttttgtaagaaaaataaaatgctgcccctgtcctttctgggtgtatgttgtttctgtccccttgttgcagagttcttttgctttcatgcttcctacgaattggtgagttaagagagggactcccttttgtggtaccttggccctgtttagattccaacttttatctttaaacttttaatttttccgtcacatcgaactttcctacacacgttctaatttcttcaaactagcaattttggcgtggaactgaacgcagcccttattgagcccttttgtgtgtgtgtaggtgtgtgtgtaggaaagttcaatgtgatggaaaagttgtaagttcgaagaaaaaaaaaagttgaatctaaacagggcctaagttagtttaacatttttgaaagtttgttaagtttgattaagtttttagcaatatctaaaacatcaaattagtttttattaaaactaatattgaatatattgtaaaaatatgtttgttttgtgttgaaaacgccactatgtttttatataaatcgatcaaactaagaaatttgattaggaaataaaatgcaaaaacgaactgagggaatatttagcaaaaatctaatattgaatatattgtgaaaatatgtttgttttgtgttgaaaatgctactatgtttttctataaaatcgaacaaacttaagaaatttgattaggaaagaaaatgcaaaaacgaaatgagggagtaaaatttagcaataacatggtactatcgtgaattccgagcgatcatcgctgactccgctgaatttctaaacctgaaaggcaagcagatttgttttccctcctttctcctcggagagactatggattcggcaccccatatttttaaaaaatcaggtgcaattctacccacccgatgcttggtgcatagagtactctccctctctctttccttactgtataaccacctttttttatcaaacttttctctcttaatcttaaattatttatatgatttgtaatccgatcacacggttatatttgttatgattaaatctttaaaacaagatctttattatcacacatgaaacacgtgatacattcagtcgtaactagttgtaactattcaaacatcgcaaaaataaaacgtgcaacttttgcaaatgatctagtgtaacattagaaaataaaaatattctctgcaacttccaaataataccatatgtaaatatgtaatattagtaaaaaccattgcaaaaataaaaataaaaatatgaaacatggtcaacttttagttgaaacattatcttctcacctttgaaacataaaaaaatcaatttgtcaaaacctatacatttttttcgtcaaaatataatcatgcgagctattgttgtaagatttagttgtaataaatacaacgatgtaatcggatattagatcatataaatattttaaaagaaaaaatggtttgaaattcaaatttaaggagcccatttgaatcgcgggaatgaaaaaacgaaggaataaaaaacacaggattctaaccgtaatggaagtgtaaaacagagaattgcaaaatacaggaatgacggtttgattggactatagaaaaaaaaacaggaattggatgaaagagatagactaaaaaaaattcgaagagctttgagctgttgctaagtttccttcaaaaatctctatagtattatccatttcataggaatatcaaaggattagatatgatgcaatcctttaatttaaaggcactcataagaattttttctatagaaataaaatcctctaaattccctgtatttttccttcaaatcaaatggccctaaaatatattatatcttacatgcaattgtacccctctcaccatattacgtcagtggtttttttttttttttggtcttgctgtcttgcgtgtatgcagtactgttgctagagccgatcttgttgctgtcttgcatgtaagccgtattttctccccattttcccgcggaatcctgggcctcacaacgcggcgtcgtggcgaagtcgcgacacgtgcggcggtcgagcgccggtgcgtgcgcgcaggcggaggcgccccgcgaagctcgctcggtcgcccatggcggaaaccggaaaagaccctataagacgccccgcgcgaccgccattgcctcgccgtcttccgccccgccccgcccctcccctccacccacgcggagaaggagaggaggagaggagaggagagagggaggcagcagctcgcccgccgccgcccctccctccgtgcccgcgccgcccaccccgccgccgggcaccggccaccatcgtcttcatcatcttcccaataaaccccccatggcgtcctccctctccctcgacgacatcaacgacgactccgtcgacctggtacgcacgcacgcacgccatgtgttcgtccatcgtcctcctcctcgtcagcgtctaatgttgtgtaaatgttgtgatgtgcagtcgaaggcgccggtggcggaggtgttccagaagctgaaatgcgaccggaaggggctcaccggagcggagggagagagccggctgcggctgtacgggccgaacaagctggaggagaagaaggagagcaagcttctcaagttcttgggcttcatgtggaacccgctgtcgtgggtcatggagatcgccgccatcatggccatcgtcctcgccaacggcggcggccgcccgcccgactggcaggacttcgtcgggatcgtctccctgctcatcatcaactccaccatctcctacatcgaggaggccaacgccggcgacgccgccgccgcgctcatggccggcctggctcccaagaccaagctgctcagggatggcaggtgggaggagcaggaggcggcgatcttggtccccggcgacatcatcagcatcaagctcggcgacatcatccccgccgacgcgaggctgctcgagggcgacccgctcaagatcgaccagtcggcgctcaccggcgagtcgttgccggtgaacaagcacccggggcaggaggtgttctcgggctccacggtgaagcagggcgagatcgaggccgtcgtcatcgccaccggcgtgcgcaccttcttcggcaaggcggcgcacctcgtcgacagcaccaacaacgtcggccacttccagcaggtgctcaccgccatcggcaacttctgcatcatctccatcggcgccggcatggcggtcgaggtgctcgtcatgtacccgatccagcaccgcgcctaccgcgacggcatcgacaacctcctcgtcctcctcatcggcggcatccccatcgccatgcccaccgtgctctccgtcaccatggccatcggctcccaccggctgtcgcagcagggcgccatcaccaagcgcatgacggccatcgaggagatggccggcatggacgtgctctgcagcgacaagaccggcacgctcacgctcaacaagctcaccgtcgacaagaccctcatcgaggtgtgctccaagggcgtcgacaaggacatggtcctcctctacgccgccagggcgtcgcgcgtcgagaaccaggacgccattgacacctgcatcgtgaacatgctcgacgaccccaaggaggcacgcgcggggatccaggaggtgcacttcctccccttcaaccccgtcgacaagcgcaccgccatcacctacatcgacggcaatggcgactggcacagggtgagcaagggcgcgccggagcagatcatcgagctctgcaacatggccgccgacgccgagaagaaggtccacgccctgatcgacagctacgccgaccgggggctccggtcgctcggcgtgtcgtaccagcaggtgccggagaagagcaaggacagcggcggcgacccgtggcagttcatcgggctgctgccgctgttcgacccgccgaggcacgacagcgcggagaccatccgccgcgcgctccacctcggcgtcaacgtcaagatgatcaccggcgaccagctcgccatcgccaaggagacggggcggcggctcgggatgggcaccaacatgtacccgtcgaccaccctcctcggcgacaagaacagccaggtgaacggcctccccatcgacgagctgatcgagcgcgccgacgggttcgccggcgtgttcccggagcacaagtacgagatcgtgaagcggctgcaggagatgagccacatctgcggcatgaccggcgacggcgtgaacgacgcgccggcgctgaagaaggcggacatcgggatcgccgtggacgacgccacggacgccgcccggagcgcgtcggacatcgtgctgacggagcccgggctgagcgtgatcgtcagcgcggtgctcacctcccgcgccatcttccagcggatgaagaactacaccatctacgcggtgtccatcaccatccgcatcgtcctcggcttcctcctcatcgccatcatctggaagttcgacttcgccccgttcatggtgctcatcatcgccatcctcaacgacggcaccatcatgaccatctccaaggatcgcgtcaagccgtcgccgacgcccgattgttggaagctcaacgagatcttcctcacgggggtggtgctcggcacctacatggcattggtcaccgtgctcttcttctacctcgcgcacgacacgaacttcttcacggatgtgttcggggtgacgtcgatcagggagagcgagagggagctcatggcggcgctgtacctgcaggtgagcatcatcagccaggcgctcatcttcgtgacgaggtcgaggagctggtcgttcgtcgagaggcccgggttcttgctgctcttcgccttcttcgctgcgcagatggtggcgacggcgatcgccgtgtacgcgcgctgggatttctgccggatccagggcatcgggtggcggtggggcggcgccgtgtggcagttcagcgtcgtcacctacctcccgctcgacgtcctcaagttcatcatccgctacgccctcaccggcggcaaggccggggacagcgcccagaaaaaggcaagctcgccgccgccgacctctcaaccttagatagacttggagatggattttttctttcttttttttttcctcgagaggggaggggaggatatccccctcgtcttatgtatgtatgatgtttaaaaggttattaaaaaatttgaaaaaaatatttagtaagatagatcaatatatgatatgttattctataaacatgtaaattcgaattcgacttttataattagaaacgaaaaaaactgactacgaattacgtgttatatttagagtcgaatttattattttttaagtaaatttcacaaaactacatatacttaggctaaattattagaactacatgtaaagtgatgtatcacaaagttacagatttaacaataaatttatcacgaaactacatgtcgtaaaactatagatttaattataaaattatcacaaaactatatattttggagttcaaatctttaattctagtgctatgttatagttataaatgtccaagttttatgtttaaattgatattactttctccgtttcacaatgtaagactttctagcattgttcatattcatttagatgctaatgaatctaaagatatacatatgtctagattcattaacgtctatatgtatatgggcaatgttagaaagtcttacgttgtgaaacggagggagtacatttgtagtttatgataacttttttgctaaaatctgtagttttacaatatttcaccttaaatctttagtagtgtaataattttagtggtaatttgatgcatcatattaaatatatagttttataataatttgaccaaaaattacccatgattttatgaaatttactctattttttcttcttctagttatgtaagttgaatttgaacatacattttatgaagtgacatgtcacatattgatctatctagctgattttttaaaagaatctttgctaactttttaagcgacgcgaaaaaaacgagaggacctttcctgaaggaatgaatattgtttcgtagatggattctaatcacttgggtggatgtccacccgtttattatatgtcaactaaatgattatgaaaaaattcaaaaaaattgacaagatatatctatatgtagtatatcactccacatacatgtaagttcaaattcaacatctacaagttgtaacaaaaataacaacttgtaaaagttgaattttaaattgcatgtttgtggagtgatatattacatattgatctatcatgttttttttttaaattttttcataactatttagaacacgtgcaagatgtccaccgggtgattaaaagagttcccctatcgtttcctgtagttttcgccatgattgttgtgaacgctattgatgatgatggttgtgtgtggcgtgcgtcgtctccagtgagggaatcctgggtgtttgtctcgcgcacacggcgttcacgacacaaggaggaggagctcacccagccccgccgacgcaaccgccggccgcggcggcgtttccgaccttctcgccggcggtaaggaggagctctccgagcaggccgccaagcgcgccgaggtcgcaaggtatataggcaaacccttcgaaaaccttaacccatgcatcctttcctccggccggccggacaccggccggctggccggagacggagaagacgacgactgagccggcggctgttgcatgtattgcagatcgactcggtggtgaagctgaacgccggtggccggagagcttgttcatgttgccgtaagcgtacgtctcgtgtttgcgtggttttgagcgggaatgagcttgtgagaaaaacaaaaaaaaccaaaaaaattcagtccatctgctggtatatacatatttcatctgttcagtttttcagtacatatatcttgtcaactgtgtatatttgtgcatgtctatatataccctatatacaagtgttcagttgaaatttgcaaattgtgtagatatactccctctgttttttaatagatgacgccgttgactttttctcacatgtttgaccattcgtcttattcaaaaattttatgcaaatgtataagatataaatcacacttaaaatactatgagtgataaaacaactcataacaaaatctatatacctaattaaaaaatacgcaaggtttccggtagtaaatttcgtccgtcctccggtttatccacgcgaacgatccgttttgaccgtccatttaacgagtccgattggaagttgcctcactaaaaatattcatattattaaattttagcaacgccctatgacacaagcatcacaattcccagttggttagccaacgaagcttctgaatggtaggtttggagttctactgccaccaccccttagttttctgctgcttatcctctcttctatttttcctttttctctcctaagctgattatatttttttaaagtacatccatatatttaaaatccatattaaaccaacaatatatgtaatttcttattgtgcttttctacactttatcacctcctcttattaattttttttgaaaagtatgtcctattttttcactactaaaaaaaatcatttgttgccatgaaaaaaatcgtggcatcaatactaaaattgtggtaatagatacatgttgccacaattttaaaatcgttgctagccgtggcaataaatagcgtagtaataggttattgcaacgatttttatttagtgataataaatttagatcttgccacggaatggatgtggcaaaaagtcatattgcaacacttcacatcgttgtgataaacattattgccaccactccatatgtggcattagttttacgtaccaaattaaaacttcaaatattaatctagcatcctatctatttatctatttattttttttatatcgtgtcttggctagaattcgaaccccagacctatccttcatgcgtgctctcctttatcaactcacctaggcatcaattctgttagaaaatacatatcgttccatttaagcctacctaactgagatttgaatcataattttgaatatctaaaagatttcaaatgaaaaacttatcacctacaaaattgtagatatcgttgaaagctataatttccacataaaatttgtctcaatccttgtccatatgaaaaaaattaagttaaattatgagacgataattttttattgtaacgaatttgttgatcgtggcaacaaaaaatagtgaaaagtaccaagtactatgtaaattgccacaaaaattaaaattatggcgatagaacatgttttttgtaacagtacgattttttgtggcgacatcttactttctattgcaacaaaagtactaaataaaacaacgattgtagatcattgcaataaaatataattatttgccacagaaaaattatcattgcaatagtgcaatatattgctacgaattattttttgttgtaataatttggtggcaatagctcaattatcttgtagtgttttttctctcttctaagcttgattatatttttttaaagtacatccatatgtttaaaattaatattaaaccagcaatatttttaatttcccactgtgtttttttaccacctcctcttattaattcatttggaaaagtacgtccatgtgattgcaattaatatgaaaccagtaatatatgtaatttcctactgtgttgttttacgttttatcaccaactttgtatttttttttcattgataacataaggaatatctttcaaatgtcaggatgaaattcatgttaaaccggcatacatacatacatacatatatatatatatatatatatatatatatatatatatatatatatatatatatatatatatataattttctactatatttttctatacattatcatcttttttataaaaaaaaacctagcattttatcatcgataacacaaagaatagttcttacaatttgaaggaacctaatttgatgaaaattctaatgcaatttttttaaaggtatacatataatagcatacattactttttaaatatgtatgatcaaattagatttatgattggctacaatgcaatcctgatcgaattggaatacagatctggtggcttgtctttctcaatgcctaggtggatccttggttatcttcatattagtgttatcattaacaaatttgaattgatattatgtttctcctcacatgataaatcatattcagctttagtaacacaccatttattagttcgaagagatatttgcaattaagtgaagcaagcgctaggagatagcttccatgtgggtcaacatcatgatccatgatatcaaaatactacgcatgcaagaggtcatgaaactaaacaattagttttcccgatgcaacgcacgggcattttttctagtaaattataattacgtaaattttttgaatagacgaatgatcaaacatgtgaaaaaaagtcaacggcgtcatctattaaaaaacggaggtagtatatcttaccagcaatgtgacttcatggcttcatcgactaaaaaaatacagggtttattgaaaatgaacagagtttgcgacatgggcaatatgttacatgcaaaactcacatcttcgggcctgttccctttgatgcaaaaaaaaaaccttaccaaattttgtcattggcatagttgccaaaattttggtagaatttcttatatagttaccaaaatttggagcctgttcactttgatgctaaaaaaaccttaccaaattttggcaattttagcaaatgtgccaaaattttggtaacttgccaaaattttggtaggatttcttatatagttaccaaaatttggcagcaaactaaatgtagccacttttttggcaactttaccaaaatttggtaaggttgaaaatggcatcaaagtgaacaggctcttggtagcaaactaaatgtagccacttttttggtaaatttaccaaaatttggtaaggttgaaaatggcttcaaagtaaacaggcccttcattccctgaagtttacagaagagattcgaattctttgtaagagtacaaattgatggccggaaaaataacgacgaagtcacaacattcaaatactagtattcaactacagtactaaaaatctaagatgtcaggagaagattagtaggcctgaactatgtttcctggaatgagagataagctgctaattgggagatggcgtctgaagatatccaggcatttgagacgctcactggaagtcctacggaaggcatcgctactccactgaattctttgtttcctacgttatagctcatgccatgtggattgacccagattagcttcatatttcgatatgctgtagcactttatctgacattccaaaacaggaacaggatagcacttaaggatcagttcgactaccaccatcctccaagttcctttgctcatttgaagttctaaggttctttccagcaagtgaattcaggaggtattaggttttcgtcgcaggaaattacagccttggcagtaagctttccagccaaaccatggaacagaagacccctggcaccaaggccaccaactagcaaaaactacagttgctcctcttgcctatcacatcattcaaacaacccaacagcggcaatgatccgttggctgtcagtggaggcattgctcttatcccagcccttgcttgtacaaatttccatttagttattcctggataaacagcagaggcttttgggagcagctcttccattgcattgagagcttcatcatcagatacagatgaagaatagttttctgacttccactgccaagtcgacccaatggaaacggtacgaggaccttggaatgccagccaagcatcagataagattgaaggactttgactgccatatgtttctctgcaggaatgaaacacaccaattagataatcccagttgatgctgtaatgacttaagttcaattcttaaacacaaagaatttcccttacattgtatctgatggcaactggaattcagctataactcctcggcatgttctaagaggtagcttatttgtgagttctggaagtgagctagctctagcaccaaggcagataattactgaatcataatcacctgcagatgtttgataggatctttaggttagaagaagtccatactgaagcagcttcagtgaaccatacaagtgttgcattttaacatttttcttaacagaggtctctgaaattaacaattgtaaattgacaagaacaaatctttgcttttgcttcaggagtagacactgtgtgcactttcagtttaatgttaatggaaaagccaaaattgaaagcatggtataacaaggtccatgtttgtccttgctcaatcaggtgattgagcgagaatttacctgccaattgctgtagatcatcgacgtgttcgttgtacagcttgcactctttctgttcgctggatgataatgatgcttcatcagacatattttggcatgcgaagaacaaagcctgcagagcccccaagaatgggtatcaagaatagatgacaaatcattgacaacgagatagcgtgaaggagcacaccacctgtaaatatttcttagggttgatgttcagcgctaatggcatgtaaactgcaaagttcaacggaacacataacccagggatcagacactgtgcctcgtctgaatcaagaacttgaaggctgcaactctggagggaactctgagcattctaacttggataggtcgaagcagtcaagatcgtacaccagaaacaaaaaaggaagcacctgagcatatcagcacaatcttaattcagcagtacctccagcaatatgtcagcagttttctcgcttgtaggcggccgtataattcccctgctcagttcagttaaaccacttctcataatgtgcacacacaaatacagcagcccacaaaagacatgccaaacagaagcaataagtaaatccataacaagtctatctacaaagaacaaggaattgccttctccagataagggtctcatcttggctagctccatctgccccagcggctccattcgcttgctccgcgcaacgcagcagatccatgcataactactg

SEQ ID NO: 45266 - DNA, 752 bp, Oryza sativa
  unsure (1)..(752): unsure at all n locations
ggcgttcacgacacaaggaggaggagctcacccagccccgccgccgcaaccgccgcggccgccgcggtctccgacctcctcgccgccggtaagaagaagctctccgagcaggccgccaagcgcgccgaggtcgcaaggtatataggcaaacccttcgaaaaccttaacccatgcatcctctcctccggccggccggacaccggccggctggccggagacggagaagacgacgactgagccggcggctgttgcatgtattgcagatcgactcggtggtgaagctgaacgccggtggccggagagcttgttcatgttgccgtaagcgtacgtctcgtgtttgcgtggttttgagcgggaatgagcttgtgagaaaaacaaaaaaaacaaaaaaaattcagtccatctgctggtatatacatatttcatctgttcagtttttcagtacatatatcttgtcaactgtgtatatttgtgcatgtctatatataccctatatacaagtgttcagttgaaatttgcaaattgtgtagatatactccctctgttttttaatagatgacgccgttgactttttctcacatgtttgaccattcgtcttattcaaaaattttatgcaaatgtataagatataaatcacacttaaaatactatgagtgataaaacaactcataacaaaatctatatacctaattaaaaaatacgcaaggtttnnnnnnnnnnnnnnnnnnnnnnnnnnnnnnnnnnnnnnnnnn

SEQ ID NO: 45267 - DNA, 833 bp, Oryza sativa
  unsure (1)..(833): unsure at all n locations
ctatcagtgtcctttaggaagctctgaacgttagtgtcatgtctgcatcagttcttaactgtgctcaacttggccgacatggttttctaggatactcctaagcaacctttagttgcaagttattgcagaattaactgctgctcattaggagttctagtactattgtgcaggtagcagactgaaatgtttcttgtgctgtactgtgcattccagtttagtgaagagttaatggggtttgtacagtgtacagcaaccgtgtgtttaaaggctgaaaagttagaacttctgaggctggtgccacctgcgagatgcataaacacaagaaagttataacttctgaaaagttggaatttaatggcgtcttttttgttcttttcctctcacggatagcgtagcagagctgcaggatgcagttctactagggtcatttgttactggtagagtgccggaattgccaaccctgctgtcatttgtagtatttgcaaataatcaagatccaatccgctcaaatactttggccttgctatctttgtgggctcatggaaccatggaaccattcgccagatcgacatttccagctccatcctgtttggcaatggtttttctctcataataagttccaagatttcgtagtacgacacgtacacctgttggattgttcttctgtctctgccaaatcgttgatgtcacaagctaagagacgatgaagtatagataaataacattatgtttcatgatgcgtgaaatttaaaaatagatcatttaacttactattcaggttgttcaaattgatgctatnnnnnnnnnnnnnnnnnnnnnnnnnnnnnnnnnnn

SEQ ID NO: 45268 - DNA, 710 bp, Oryza sativa
cgctgcaaatccgacagtggccaaacaattatttttaccagctctactaaaaaaaccttgaaacagctcagcatcaaatcaaggactgcattttcgtatgccaaatataggagaaaatcatgtaaaacactgagatgtgatgctccaagcatgtacaacagcgatgaaacctagctgaattggtagataaaagggacaccccaaggtgaaaaacacaagacaaagatgataaaagagtggcatgagagatatggtgtgaacagaacaaaagagtggttcataacaaacagactgaaatgccacaactaatgaccaggaatccaggatcatatgcagcgccaaggatatcattagaatttcccaatagatcgacataggcgggactattctgtttgctttctgtttctttttcgttttcaggtctcttcacacttggtgatgttgtaaattatttataccctactttttttaacattaaataatttctatcctacttaatataacaaaagacacaaaccaaaattagggcgaaacaggaaaataaaacgattggtcttaaccaaccagaaaggataagaaaatttatactggaaagtagatgtgatggaagaaaagaaacagaaaaggtagtaaaagtttttataattaaagagtttctatagtaaagactaattgtgatcattgtttcctatttatgtttgagtgcaaag

SEQ ID NO: 45269 - DNA, 806 bp, Oryza sativa
attctgcagttatgcatacgagcgagtgccaacctctttatcttgaaatacaggaattttatgaaggcctaaatatgaaagtggaacaacaagttcccttgcttcttgtagaaagacaggctttaaatgaagccatggaaggagagaagactgtatgttgaccaaagctggacaatccatgattctcctgtttttcactatactaatgttagtaaatattttgtttcctgtggaaaccagggtcaccaccatcttccagaaacaagaggtttatgcttatcagaagagcaaactgtcagcacggtgagaactattctgagcatgagatgaatggatcttttcataatttaaattctatttcaattgtattggtctgctgtgttctgacttctgactgagttccagcatttatttttaatattttagatattgaggagaccaagaatggctggaaataaagttatggaaatgataacggagccatataggttgactcgtcgatgtgaagtgactgcaattctcattctttatggtctcccaaggtgaaccacttactatctgtttcataatgccattgttaccttgttgctactcttttaatatcaacaaaaactaggaggaatattcgaatttataactgatttgaaataatatttctttctgtgttggagaatacattcttctaaaaaatgttatggattcactgaagatattctggactgcatgctgactctacagagttaatgggaaaagatattactcttgtgccttgtcactgtagcttctgcagtacaatatgcaaattt

SEQ ID NO: 45270 - DNA, 1144 bp, Oryza sativa
ggtgcaatagctgcctgtggtgaacttggagcgctgaagcatggaaggcagctccacgcacatcttgtacagtgtggatttgaggcaagcaattctgccggaaatgcacttctaacaatgtatgccaaatgtggcgctgtgaacgatgctcgtcttgtgttccttgtgatgcccaatttagactctgtctcgtggaatgccatgatttcagctcttgggcaacatggacacggtagagaggcacttgagctatttgaccagatggttgctgaaggcatagatcctgaccgaatttctttcctcacaattttgacagcatgtaaccatgctggtttggtagatgaaggcttccattattttgagtccatgaagagggactttggcattagtcctggagaagatcattatgcacggctgatagatttacttggtcgctctggaagaattggagaagctagagatttgatcaagacaatgccttttgagcctaccccgtccatttgggaggcgattctctctggctgtcggactaatggagatatggaatttggtgcttatgcagctgaccagctgtttcggatgataccacagcatgatggaacatacatcctactgtctaacacatattcagctgctggacgttgggtcgatgctgcaagagttagaaagctaatgcgtgatcgtggggtcaagaaggagcctgggtgcagttggatagaagtaggaagtaaaatccatgtgtttcttgttggtgatacaaaacatccagaagcacaggaagtctaccaattccttgaagtgattggtgtaggatgagaaagcggggatatgttcctgatacaaagtttgtgttgcatgatatggagcctcatgaaaaggaatacatattatttgcacatagtgagaagctggcagttggatttggacttctaaagttgcctcctggagctacagttactgttttaaaaaacttgagaatatgtggtgactgtcatactgcaatgatgttcatgtcaaaggcggttggacgggaaattgttgttagagatgtcaggcggtttcatcatttcaaggatggagaatgttcatgtggtaattattggtgaatatttttttctgcggggatcctctagagtcgacctgc

SEQ ID NO: 45271 - DNA, 791 bp, Oryza sativa
  unsure (1)..(791): unsure at all n locations
nnnnnnnnnnnnnnnnnnnnnnnnnnnnnnnnnnnnnnnnnnnnnnnnnnnnnnnnnnnnnntcagtcttcggtcattgaggaggttttggtcatctcaaaattaagattgacttacattaaaaaaaagttaggaccaagcaatacggtctcgatcatgaccaaaatcatctagagttatccaaaaagatcatctagggatgcaagcatcacacagagtccaagatcatcaaaaaaccaaacaaacacacaatcgtcaaaaatcacaaaacacatgaacccatctccagccatcgctcatggatctctgctactgccagcacacacgcaagcatcgaaggctcggagcggcgtcctgcgaacacactgttgtaagggagcacgtgatgtggaggagtggaggaggaaggttggatatgtggttagtggcctaccgcaccggtgctagatgggggcaacgaggtggtgcgggtgtgcaacagccctcccttcagaaccgcatagctagtccatccgacgggcggacccacttacacataccaccacacttacattttcgttctcgctttgtgtaaaagggttaatctgggagtggtatagttggagggacacggccttgtaagttggttccacccttgttaaactagcaaggttgtactaaacatacgcacacagctcacatgggctacacatgcctcatcctgattgggccaggatgtcccaaggtgcttaatggaggcagcaaggtgatgcgggatgggggacagctcgggtaccgagctcgaattcgcc

SEQ ID NO: 45272 - DNA, 1102 bp, Oryza sativa
acaaccgtcccactgttgacgcaataaccttatttttcctttaagaaaataaataattattgcgtaataaatcggtaataattctagaaattcatttaaatagctcaaaacttctaaaattcatatttaaatcgtcctcgaatctgtttcttccgtgccaaagaatggtgacaaatcaaccacattgaatgtgttactaactgtgtaatcaccgggaagatctatcttgtaagcattgtcagtgattttctccaaaaccctgaatggcccatctccatgtggcataagcttggacttccgcttctccggaaaacgatccttacgaaggtgcacccaaactaattcaccgggttgaaatagcatcttctttctgtctttgtttgcctttgcagcataggactgaattatcctctcaatggtctccttcgtcttctcatgcattttcttcacataatctgcacgctttgttgcttccatattggcacgttcttgaagtggcaggggcagcaaatcaagtggtgtgattgggttgaagccatacacgacctcaaacggactgagttgagtagtagaatgtaccaccctgttatatgcaaactccacatgtggcaaacaatcttcccattctttcaagttcttcttaatcatcattctcagcaacatagaaagtgttcgattcaccacctccatttgtccgtcaatttgggagtgacaagtcgttgaaaacaacaacttagtcccaagcttagcccacaaagtcttccaaaaataactcatgaacttgacatcacgatctgatacaatagtgcgaggtactccatgcaagcgtacaacctccctgaaaaacaagtcagctacatgcgacgcgtcgtcgcttttgttacagggaataaagtgtgccatttttgaaaatctatcaacagctacaaatattgaatccctccccctccttgtcctaggcaatcctagaacaaagtccatactaatatcctcccaaggtgcattaggaacaggtaatggagtgtacaaaccatggggattcaatttcgattttgctttatgactagtgacacacctttgcacatacctctcaacgtcatgc

SEQ ID NO: 45273 - DNA, 19938 bp, Oryza sativa
caatttttaattgattcaaccttagattcatcaacttatacaccctgtccataaacaacatatccaagaaacaccaccttttctctgcaaaaagtgcacttttcaaagttagcaaacaagcgttcagacctaagcatctctagcacttgccgaatgtgagcaagatgttcctccattgttttactatatatcaaaatgtcatcaaagtacactaccacaaatttcccaatgaaagcccttagaacatgattcatcagacgcatgaatgtacttggtgcattagtcaaaccaaaaggcattactaaccactcatacaatccaaactttgttttaaaggcaattttccattcatccccttctttcattcgaatttgatggtaaccactacgcaaatcaattttagagaatatgacagcaccactaagttcatctagcatatcatcaagcctaggaataggatggcgatatctaacagaaatgctattaattgctctacaatcaacacacatgcgccatgtaccatctttctttggaacaagaataacagggacaacacaaggactaaggctttcacgtacataccctttgtttagaagttcttgcacttgtcgctaaatttcttttgtttcctctggattggtacgataaggtggacggttgggaagagatgccccaggaatcaagtcaatttgatgttcaataccacgaattggtggcaaaccagctggcatttcttatggaaacacatcatcatactcctgcaaaacatgagaccacactaggaagagatgttaactcattagtagaaatcagtgcatctttgtatagcaagacaaagtgcaacatagtgggatcatctctcatttctctcatttctgattttgtggctaacatcacaagcttctctccttcacttttctttttaccattttgttttggcttgtggctctcactcaccgatttgtggataacaatcttttgctctctttttttatcactctgaacaacaacttctagcttttggcaattctcatttataatttgtgaaggagtcataggtcgcagcactatgtccttttctttccacctcaacttgtactgatttgtacggccatcatgttgcgccgcacgatcatattgccacggcctaccaagcagcaagtgacacaccgtcattggcaccacatcacactccacagtgtcacaatagtccccaatctgaaatgttacttgcaccatgaattgtatcttcacttccccacaatcactaaaccattgtacatgatacggatgaggatgacgcaccagattcaaaccaagcttgttgcatatctccttactagctaggctatgacaactaccaccatcaatgattactttgcataccttgccatcaacttttgccttggtctgaaataaattgcatcgttgttcatgatcaatcttgggctgaaccgtcaaaacttttggagtaacaacaagtgaaggtccctcttcaaagtcataatacacaacaccattttcctcatcctcctcttgagcatcatcaaaatgcgtcaaatcagcagctagatcatccttatcttcacttgttgattcatattcaccatcctccaaaatcagcattgtcttattatttgggcagtccttctgcatgtgaccacgtccaaggcatttgaagcactgaatattgctactctttggtgtagaacccaccgaagaggtgctgctacctgtaggaacaacaaatttcttgcttgcactttgtgtactctcctctttcttacttgctaaattgagagaaggagagttgctggagatgaagttcttgctcaagttaaactttggggtcggtctacccccactggacaaagagcgagtagtaaatgaggtgttgtgtgccacctttgcatcttcttgcacttgatgctctgcctttgtagcttggtgcaccaattgcacaatagtgttgtatatctaaaaattgactatgcgtttgacgggatgatttagaccaacaaggaaacgtgccattgtttgctcttcatcttccttcactttggctcgaatcatggctttctccatctccttgtagtactcttctacagagcgtgttccttgcctcatattctgcaatctttcaaaaagatcacgcttgtagtgactaggaacaaatcgtgcacgcatctcatgcttcatctctacccatgtagcaacagcaagttcatcgtgttcctccctttggttcagcatttgctcccaccaaatcagagcatactcatcaaattcaagtgatgccatgtgtagctttgtttcttctgtgtagttgcgcatacgaaatatcttatcaaccttaaattcccaagtgagatactcctcaggatcattggtaccacaaaattttggtatggtaaccttgagttttccaaatctgtcctcacgctcgccattgcgagcacaatgccgttggtgcccatcatctttgtaacaccctaaaaatcctaaatatataaaatgttgtttaattggaattattagaatttattttaaaagcctagacgagaagatctaattttaattaataaattccaatataaaatggggccagataaaatttcattaaatactttgcttaactctataattcctagatttttctgggatttatttgagctaaggaagtatttttaataaatggaattgcatttaatgaataatttaaattgaaaaaggtttttaaaatcctcttttggctttgggccgaaagtcggcccaaaacattccctctctctcctcttcggcccagtcagcccgcagccgcccgcgcgcgcgctcggccgctgacaggtgggtcccacctgtcggactcgtcgtcctcctcgcgccgtctcccggccggaaccctagccgagccgcgccgccttctccttccaaatttgctcgcgcctttccttctccggtgaaatcaatagaggggaaatgatcttcgggatctcctctaccttttctcttttggaatcgtcggctagaatcgtttggaaatccctggattcgagttcgattcggatcgatctctctcctccgaaccctagactttccttcatgtcgccggtcgccgtgggccttcgccgccacctccttgcccctataaaaggacccccaagcccgccgctacctgccgccaccctcgccttcgcctctcgtcgccggtagagccctagcaccatgtagcctagcgccccgtcgtcgccgttcgtccagccatgcgccgccgccgctcccgtcgtcgtcgtcgctcggggaggtcaccgtcgtggtcgccgtctcgtcgccatcctcgtccgcccctccgtcgtcgccgtaggcggaggactgtcgccgtcgtcaagccgaaggttgccgccgcttcttcctcgatgccgtcgccgtccgttgatcttccgccgttgttttggtcaccggtgagttcgccgcgtcgccctctacgtgttggtgtcctccgttcgcgtcgtcgcaccgtcgttcgccggcgagtttgcgcgcccgagccgccgccggtggtgacgtcaccgctgacgtcatcgtcgtcgtctctcgtggtctggccgtggaccgatcgatcttggccgtccgttttggatggatcaatctcggccgttcgtttccgtgagccgccgccatgcacccggttcaccgcgaaccctagccgctgacgcaataaacccctttttccttttcaaaaataattcattattgcgtcataattcaattaaaatctaaataaatgatttaatccgatttaatctttgaaaattcataactaattcatcttagctcggatttagttggttcaagtctccaaatttttctaaaattgagatctacatgttaaaaatatccacatatactgttcatgcttgtttatgtgctgttttggtgttttgctcttttctctttagattccgacgtttccggagagtccgttttcgcaggagaagaatttgaagagttccaaggccagcaaggcaagtcacacagatcccaaacaaccctttgagcatgttgaacctgtttaaagctattgatttattttaacttatgcattgttttcgaatgtcattgggtggtgagcctttcccatttaactatggccgaagatgactttattttcctatgggttataatttgactagcatggaccttatatattggattggttcagctagatattatttatagttgcttagccgtgcttagaaacattagcacactattgggataacttatgactcactattatttaatgatggcttaatgatagctcacgatggtcaatcgtgattggttaattaattaaattgccaactaaaacttgataatggtgggttgtgagcacatggttttgatggtcgtgctcatgacaattaaggaccggttcacgagtttcggttgtgaaacattaaccgtgccaaccacaagccagcgtgggcaacggctttaccttttgtatatcatggttcattgcggagcaccagactgagaagtggcggagataagcccacgagggtcgctggggagtccatgccttgtttataagggggtgattatgatccaggaacggtgcactgtggtggattgtgttgtgcgaggggtactgtcacagctcctttccgaggtaccatggtggtattgaggcacatggtaacatgttgtggagctgtgtcttgtgggtacagtggtacacctctggccagagtaaaactattcgaatagccgtgcccgcggttatgggcgggtctaacaatgtctttcgtgattagtttcacacttctcaccataataaaagatgctataactggtaataatttgattagctcctggtttggaatggtatattcctggtttggagatagaactgtgcagccgggatggttgttcagaatggttgggcctatgcaacagggtatgttgtatagcgttggattaatattgtttaattactacttaactattttattaaactctgaaatgtttattaattgctgtttatgcaaatgaaaccctactatgccatcctttgttatcctgtgcacttgcatatttgctgcgtggcttgctgagtatgtcatatactcaccttgcaatcattcatcagaggaagagttctacagtgatgctgatggtgtggaggattaggtgtagccctggtcaagctgcctgtggagtggagtcgtctgcgccgtttatcttattttttccgctgcttagatctttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaatcttgatccaacgcgaagtctgcatcaacatcatcttcatgtgcaccgatagcatggccacgaccagcacggccgcggcccctcccattgccaccattaccatgtccacgcccatgtggacgcatggcgtgtgcagcagcaatattgcgtctttgttgtgcttgacgtttctcacaagtagcagcatcaccatccgtctcatcaagtaaggatccatggacactatcatcctcaacatcaggccttagaagatgttcaagatcttgaacaatattttgcctcaattgctccatattgttgttcacttgcacctcaaaatcttgaatagtcttttcgaacttctgtgatagttcatctgttctcccctctagagtgtccatcctggaattcatctcccttcgcaacacatctcttaatgcattgtattggagacgggtgattggttcattgttattaccatcctcttcaacatcttcagtttctcctattcttgccatggttagttatgaaaaaattcctatatgcagcagcgaatagaaagaaaaaaaattgtggaatctctcaactacacccaccaattgatgttcttacccttcctttcttgagatgaggggctgattacaccctgatggtagtagacaactcaaaggtgatggttaggcgaattcacagttcaggagcaattgcacaagtagtaaatatgtggagcttggagggctaagtgttggtcctagcaattctaaattcaagatattttcttgttaagtagtaatccaagctagaacaaaatgcctagttgctaatcacaagatataaatgaagtgtacagcactcacacgcaacgataatgggacctatgcaaccaagaagagagctacacaaaatggatatgaaatcaaaagctcatgtttcaaaagtacaaggagtgacgctagctgattgctcaaaatctgaattgggctaccagatttgcacaaaacaaataaagactaacttctgaaataaacaatagatgtggtgacgcagcacttctcttttttttttaatccttcttgttattttttttgctttctctttttttttttgaactcttatacttctttttttttgccactacgatcagcacaccggattgaacaatacgggtatgactgtaaaaatacaaccgtgcaaagcccaaaagcaacttcctacagctagtctcaatgggttcaaaagtattcgcaaaggatagaataggctcactatttttttttgtattattgatatatggactagcacacaaactgaaataagactcaaacaaaactcagaacagccactaactttgttgtgtccgaaacacgcagataatggccgaattaagatgtcaaccagagataatgatttgtaggacaccacgtgctctttccaaaaagtatttaaacactgatttccaaccctctatgcaactttgatgactattttactgaacgaaatatgcactgaaaattcagaacgcgacaagaaacaaaatcaagcaaacaagataaattgatataggctcaagtgtaacatgaaggaacactaagatcagcaaccaaacacaagtctaatggattaaaacctaacaaaaaaaacactagaaccagattgcaaactatgggctattttttttagcgtttttgtgtataggatagaaataaaatatgtagctagggtaaaagatcctaccgagacaatcgtgctctgataccaagatgatatggggaaagcctgaccttctcgacgtaggatccggatacaccgtgaaacctcacgaactggatgaacaacacgctgcccgtgcaacgcacctttcaccatgaattcgcaaaaccacatgctttgataggttgatacacttgaccacgcaaaagtggatctattgccctctcaattccctgcaaggaaaagcaagaacaatctatggcagaactcccaatccctctctctagtttggcagcggcggcacaaaacctaggagaagaacaagagcaaatttgctgcaattttcattagaataaatgtggtctaacctttctagtcgagcacaagtgtcacgcccagaaattcacgaaccagaatttctaagctgaatgtgtattaaacccctgtccaggaccagccagggtacacaaacgacaatcgttgacatacagatccacgtctgacaaaaatataaaagattacaaatgcagcggaaaagataaaagcgagctaagcctgaagacttgactcctgcagcggcaattccattccacaggcatccttgacggcagcgacgaaactaacttcttcgagacatctccaactgagaagaacttcaactctggtgtgggggaaaagagagcaagacagtactaccactgtactcagtaagtcataccggaagagaaggtatgatgcaggatatatccaagggaggctaaaggttcttttgcataaagctagcatttaaaagcagtagttgaaagcagtaaaacagttgcagtaattaatcaatattaaccaatcactgttcaacgctacaccacgttgcaacaggcccaaccaaccacctgaactacaccagttcattagctaactaggggtgggactaatcacggtgaatctggtcgaccgcccataaccgcgggcacggctattcgaatagttttactctgatcagaggtgtacaactgtacccacaagatatagccccacgacacgttttcgtgcgccgacatgccaccacgacataccggaaagaggccgtgacaggacccttcgcataaccccctctaaccgatcgcaccacaccttagggttcgcccccgtccccagcaggcaatggccagcccccctctcgtgccgcggtgaatccagaagccgatcaaccggacaccccggccgacccaactccatcacgcccaccctcgcctgggtacgtcggctagaggaaagctacactacaagcccagccgttgcccacgctggcttgtggtaagtacgataagttcttccagggtttcccgcaaaccagtccttaatcaccatgggcacaactagcaaaaccatgcacccacagcccaccatgtagtgtattttaattaactaacaccattacggtggcattaatccaaagctataccaataatcaaagtctatgcattaatgtgatccccctttgtgtactagttgaactaagcatggctaaccatttcctaaaccaacatctagtcattttaaaacccaagttatcaatggcataaggtaaacaatatatggctgagtagtaggacccatcccacatgatattgtaaaagaatgcaacatttaatagaaatacgggacatttgtaaattgggtacaatatgatcaattggaatgcatgacttgccttgctctcgcactgatgagaccacagcaacgtcttcgaggaaccgtggatcgacgaaacggccgaaatctacgcgacaaacaaagcacacaagcaaaacatgttataagtctactaaaacaggaaacacaaccatttttaatggattctatgcatttttatgaatttactgagacttgaatggacttaatcggagctcgcatgaattagttatgaattttagaagattctctgtgtttattactataaaagaaaaagtctttaattaattattgcgcaataaaggtccctgctgacatcatccaagggagggtggtggcgccgacagatgagccccacttgtcatagactcaagggcgccggtccactgtggaccgagtccacgggaccgaggagaggtgaaccatgtggcgcacacgtggaaccgacgtggcaccacgtggtcggccatgcgggccacaggatggacggccacgatccgccgaaaggcagatcgggtggctggggatgggcgtcatccaagccggcccgggcatggcgcacggcggtggcgtccggctaccggcgaccggcgaccggccggcgacccgggtggccggcgacgcgggtggcggcgcatcgcggcggcgcggatgcgaggagcggcggcgctagagagaggaaggaaagggggagggggttctcaccgaggtgttcggccggccggagggaggcgacgacgaacagcgacgatgagcgaccgagagacggcggcgaggggcggacgagctccggaaccacctagggaacacaatgggagggattagagggagaagggtggtccacggcgagaggaaaacatggccaaaggcggcggcaatggtggaacctcaccggagcgcgggaagaagcgggctccggcggtggaactcgacggaggggaggtggacgaggtggacctcggccgcgcgaacccgacggcggcggtggtgtggtgcagtggcggccctagcagcggctagaggcggccggagtagtggaagagtcggcggcgggtgggtgcacggtgcgggagcggtggagagctcgggagaggccggcaagtgagggaaacgagagagggggttgtggggaagctttataggggcttgggaggggcggacacagccgggaaacccccctgatttggccggcgacgtgggggagtggggagagagttaggagggattcaaatcgaatcccgccctttgtgggcgcgcggcgcgggcgggaaggcaagggcggcgtcacggcgacgtgggcgcgggaaaggcgggtggcggagtgggcgcgggatggcagagtggaggaggtggggcgccggcggcgtgggcagttggggctccggctccaacggccggaggtaggagacgaccgtcaggtgggccccacctatcggcgaccctagggaggaagaaaggggcgcgggccggcccaacaaggagggagggcgcgggaggaggaggaaggaatgggccgacggcccaaaggagaaaaaaaaaggggaaaaaaggaaggaaaaagggaaaaaggaaaataaaaggatttttagggatttttttaaagcatatgctcatttttaattggtataaaattatttccaaggctctgaaaattccactaaaaatcatgttagcatattttgacatgtagaatccaagaaaaattccacatgccgattccgattattatttgcgtttattaattaaggattcaactctaggttaatttgaaccaattttttcggacgatttattttatgaatttatagcaagggaggggaacttcagggcgtgacaacaaggccttacatacaattcaaatactaggaaacaaactaggagtcaatttggaaactacatattacaggcacgaattattttgatgattgtgatgtgactgcttcgagtcttgtagcccatgagcataatctggatcgggcttgaagttatctttccaacaagtgctcatacaacccaatcggagtccgtatgactgatttgggcctcttttagtatggcaacctcagactgctacccgagtccgagttgggccttctccttcttatcttcagttttccggtacagcaactctcctttgttgttggtgctgattttttctatcttgtcgctggtgccatccctccacacctccctctcggtaatattggtatgggtttgtgccattaaacaaaatattggatcagagagctcttcctcttgtctttcggtctccaatgatatcattccttcaaatctgagcacaagaaaagagcaactattaggtagtaaattatgctcactaatatcataattcaaagtacttaggaacatattcaccttattttgaatttcccgtgcacgtgctcgtgtgataggtcccttatacgcattggagattgttggatcgggagtggcagttgtagaagaatgtgaggagctaggtaggtcctcatcacacaatgggataattacaatattagacctcttagtatcatgatgagctgcatgctcgggacatccggccatgtttcattggtcgtaattatccaactaaaatacaactgagtggtgggctgtgggtgtatggttttgctagttgcgcccatggcaatttaaggaccggttcgtgggaaaccctagaagacatacaacgttaccagaagcgggaatgggtaactgcttgatctgtagtatagctttcctccggctgatgcatccaggcaagggtgagcgtgatggagttcggatgggccctgcgatggcctttgcggctcgttgattcgcctagacacgagaaggggctgcccgctgcctgttgaggagtgagggcgaaacctgaagtgtggtgtgcttggtcagagggagttatatgaatggtcttgtcacaatcactcgacattgtgatatgtccggccgggcgcggtgacatgccggtggattgtgtcttatgggtacagttgtgcacctctggccagagtaaaactattcgaatagtcgtgcccgcggttatgagcgatcgatcagattcaccgtgattagtcttacccctaataaatcgactcaatgcactggttagtttaggtgggatggttgggcctattcaacgtggtgtagcgttgtttagtggagatataatattaccttaactaatcaacagttttactgttttgctcaataaatgctttacaaccgcctttatgcaaatagccacaacccttcttgtatccccttgtacgtctgcatcattggtgtggcttgctgaatatggtggttgtactcagccttgctattattcccccttttcaaaagtgtagtgcttctgagccgaagacgatgttagaggaccaagactcagaccccagttgagttttgcctatggagtggagctgaagccccgctaggattgcctttttccgctgccgctacttttgtttcggtgtgaggactaagtgcctcttctgtaagtattttactctttatttacgtttggatctgtatattaatttgtcgttttgtgtaccctggctaattcctggacagagatttaatacacaaaatagtctgaaaatttgggctaaattcctggacgtgacattatcctatcatattattatttatcgattggtttctattggattatattattattatattttattatcatcggtcaattgtctttatataattatctgcattggacatatagccgattgctcaaaaccttatcgacatcagctaatatcagctatcagctggaattactccatcggcttgtcagccgatcggctgttttatttgctgtttacatatcttgtcagttgcagtatcaaactgactggcacgcccgcatctcatcaacatcttggacctgcactggagctaaccagatctctgtcatgccttgaaaatcgcctaatttaataattcaattattaatgcatttttagaaattatttttttaaaagcctacaagttgaactctaataatctagggaaaatttcaacataaaattgagctagataaaatttcattaaatactttgcttgtttatctgttttctagatttttctgggaattatttgaacaaggaaggtatttttaataaatgaaacatcatttcacgaattattttaattgaaaaagtctttaaaaccctcccctaggccgttgggccgtttccggcccaactcttctcttcgcgcgcagctgtgcggcccacgccggcccaagccgagccgccgccccaccctctcctctcagccgccgacatgtggggcccacatgtcggggccttcttccacctccggccggctgagccgagcccgagcgccaccgcctcctcttcgattccgccccaaccggccatctccgagttcgattgcttgaggggaaatcatctcctccttatcctctcccttttccctaaagtttcggagatcaattttgcccggataaaccgaatcgaattcgttttgagtttatctctccaaactaaccctaggatttttcggcttcgattcctctcgtttggagttcgatctctttaatccgagcctataaatagcatcccctagtcatcctcttccatttgcctcaagtcccgagcctcgccgtcgcccgtagtgccaccgccgcgtagccctagcgccgccgccgccgacgccgctccagccgcgccgcgccgccgccagcgtcgtcgccatcgccgtccgtcgccaccaccgggttcgcacggtggaggagcaccccgtccgccccttcgcaaccgccaaagaccgccggagcgccaccgtcgacatcgagccgagccgagctgccattggtcctcgtcaccggacgccgtacttcgttatttcttgcaccggtgagttcgcgtcgtcgtcctcttcgcgtaggtgtcctcggatagcccggccgagccctctatcgctggtggtcgcgtcgtccagtgccatggtcggcgatgatgtcatcgtgacgtcatcaatcctttatttaattcgtaataattttctgtattagttgaaaatcgattaaacttcggaaattcataactaaatcatcgtaactcggattcgagtggttcaagttgctaaattcatctaaaatcgagatctacatgtcaaaaatatccaaatgtactgtttatgcttgtttttgtactgttttgttgattttgttcatttgctttagtttccgacattccggaggagagcgtttacgttgaggaaggttcagaagcgtttgaagaagctcaaggaaagtcacatagatcccaaacaaccctttgagtatgttgaacccgtttaaagctaatgttttatttcaacttatgcattattttcgaatgtcatcgggtggtgagccttttccaattaattaatggccgaagatgactttattttcctatgggtaataaattgattagcttggaccttatatattggattggttcagctaaatgctctatatataattgcttagccatgcttaggaatattagctcattaatgggatgaatcatactacattattaattatggttatatttaatggtagctcacgatggttaactgtgttatgataattaattgataattaaaacctgattaaaggtgggttgtgagcatatggttttgatggtcatgctcatgacaattaaggaccggttcgcgagctactgttgtgaaacatttaccatgccaaccacaagccagcgtgggcaatggctttaccttttgtatagcatgattcattatggggtgccagactgagaagcggcgagaagtccgtgggggtcgctggggagtccattgcctctggttttgagggggagattatgatccaggaacagtgcactgtggtgagttgtgttgtgtgagaaatattgtcacagttcctttccaaggtactgtggtggtactgaggcgcatggtgacatgttgtggagttgtgtcttgtgggtacagtggtacatctctggctagagtaaaactattcgaatagccgtgcttgcggttatgggtgggtttaacaatgtttttcgtgattagtcccacactactcactattaatgataatactgtgataattaaattgactcctggtttggaatggtatattcctggtatggaggtttgatttgtacaaccggggttggttgttcagatgaggttgggcctatgcaacacgggtgtgttgtatagtgtttatttaatattgcttaattacttaactgttttactattctctcaaatgttaattaaatgctgtttatgcaattgagctgtattatgctatcctttgttatcctgtgcacttgcatatttgctgtgtggcttgttgagtatgtcatatgctcatttttacaatattcattcgtcagaggaggagtactttagtgcaggtgatggtttggaggattaggctttgtccgggtcaagttgctcgtggagtggagtcgccatagctgttctgtcttttgtttttatttccgctgcgtataattttattcttttgagagtaactatccacctctgtaataatttattattttgcgagtattaataattgtttgatagtactctattatcaatttgttattgtatgcctcagttaattcttggacgaggatttaatacacatgtaaacgtttggaattttggatagaaattccggacgtgacaatctcccaggtcagtgtgtattttgcatcaacaccaacaagacaataaactctaaaaactacaactacaagatccgactagtaatcgtgcacgtacaatgcacgttgtgatcaatataaattgaattgagcatattataagcacagaatctgtttatctacatgcattgtgtaaatatcacctttgtctagaatatggtatctgtaaggtctggtagttcataacctaaaatgattaataaaatatctatcacacaaagtacttttgttacattgttgatccattgccaagtcaataagacagtgaaaacacagacaacgatcgaggtcgctcctcgaatcgaggaacacatgttgagattgctagcacgtacggcttctgaatctcactatcactaatatatgatacgtactatcatttactcatcaatgacaaaaatggtaaatactgaaaattcaaagaaaaaactccatatacaaaattgtaattgcctttcatccttggaccaccaatcaatcaaactgggaaggccaattgttttgtggccttaggaggaattattcaacgcatgctgccaatccacaccccttccatataaacttaaagcctaatggcataagtggtagtaattctgatcaatcttatgacttcctgaactcatcctaaattcctgaaaggcattaatgataaaaattacagcaaaattttcatgatttgcattgtgcaggcaaatgatacagaattatctaaaggtctggtacatgttgatttaccccttaacacatttccattataaaaaatataccagaatatatgggtgactctacccttcaggttgctgctccccattaagagcattgctagcattgtttggatgcatctaagttgtttcatcaatactttattgaatttaagaaaatggattggatttaacaacaaaaataactgttaacagcatacattacctaatgtacattgcacggtaagatagcttaacactgaccaaataaactttttccactttccttacaactgatgagatctgctacaaaccctccaattccaaggattatggtagcacatactaactcatggtaaaattgaaagcaacttatagatataaattagttcttccatgtaattattaatttatatcctagttatcaagtaacattatgtttagaagccattgcatgaattagctcctatcaatttgcacacctgtaaacaatacttaccgtgcaatgaaaccttacttatttttactaaaactaaacatgtgtacatggcagcatgcgtaaaagcagcgcacggcaacatgaacttctagatacatatataagacggaaaacttgtaatagccaagaggcaaaatgcttacctatacaatatttggcccgctccaatgtaacccctagaggaaatattgagataaagatttagaaaataagaatcaccttcagtttttgcatactcatgttcagttaagacgcggcctgtgctcccagcattagtcggcataacaatgtagcattagtttgcaggaataaaaaaagtagtgtagaagaatatggggttagccttgtcaatttcagaatcacgttgttgtgtcgggcagacttagttttcatactttgctactgatgccccgctccagttatttgaatatcagaaatagatgaaactcagaaatatccagattgaagagctcacatcgtaaaaattaatagatatataaatagattatactctttaacattttgtacttaagtactgctacagctaccaggtagccatctgtcaggatcagcacttcagaagtatacttaagaattagaaagataagcatttgaggaaatatacttaagactaacagcatttgaggaaataagtatggttctatgtcgtttgtacagaatatagacactcaccgttgtggaactcgtgaccacaccgctgcccatcgtagacctcctacctgaatatgtatgctaggtcctgattcaagtgactggccaaaaaaaaaaagaagaaatcatgattcaatcattcacagtcaaagttcaatggttggattcaatgaaatgtgcatttacaagggacggctatctataaatggataagcaaaatagagtgaaccgatcacggcatctactctcgaaatgagctatctcattctcatctatataaatccagagttgagaacgggcaattcacatggatgactatttatctagacttgcatctttgacagttataagagtgcccgctaccttcttgatcgatttgattccttctaatggagaaagcttcctgtttgctgcaagtcgtacctgagctgtcaaatgcgcatgtgaaaatgtttagccatcaatgcatacatacgcatgagtaccacacagaataggtttgcagaatatgcatacataccctaagggtttatttggaatggaggagaaacacaggaaaaatgaaggattgagttcctatggattgctttactgtggcgtcattcggatcacaggaaaacattcgtaggaaatacatagggaaatttcctgcgctagccatatcactggaagatcacaggaagaaaaacatccatgctgacctcttttttctctcctttcgcgtgggaacgaggcaaatcatgccatcaagcaactaaagcacattattaggttgattaatgttgtttaattcactagtagtatgtgataattttgtaatagtgcacctattttcttctaaagattcctatatttttcctttactccatccacacctattcacattaaattcctatgttttcaaatcctctgttttacacttgcattcctatcctattcctatattttttctattcctatgttttttcagtcctgcattccgaatgagcccttagtatagaaaccaaactcagaaatttgtgtttcacctttttttctgagagagaaacatgattccatataacataatttaagatgcacacattttatgagcatacaggttacaccagtgactataatacagctgtttaaatccctttttcattaaaatgcacattaaaatgaatagtgctcccatagaccgtttgtcccataaaatgtacactccactgaatttgttagctatagcatgtgacaatacaattattgtggactgtgaaaaaaagaaaccatttttattttggtcatagatttagaaaaggaaatgagtttgaatgaatatttgttacttaaattgctcctaaggtttttcaaccttctccaaaaaagatgaggcaatgactccagttatttctgtataattagtgtatttgtcaccctaggtattatttgagggacaatatttttatgaagcataaagattgaatttcaatccatctgccctggtttgaaggtaaacatgattttatttttaagattgcattttagtttacagtagatgtacattgtagctaggtctgtcatttttatttgtgaaactcagtaggtgtaactgattattatttggtttctatacaacaccactctgttaattagtgtggaatcacttcacccatctcctcttattattttatcctctgaccgataaaattagggtgctatatggcataagttatgcacgcaatattgcttatcaagattttctaaagtaaaacgtctcaaatacagcttcaaacaagttgacaagcgggcatattacatcaatacaacagtgtattgtttcaggtccatagaaatatacctaatgctatgagagctatacattcccgattaagatggtgaaacttccttgaaaacaagaattattcattcaatatgtgcttaccttttaatttggagcaattaggcacaagcaaggtgattctttctgttccctcaaggtcttctatttataccatttataccccttggaattggctgtgcttgaatcctaaaaagcagaacataaaacaagatataaataaactcccaataaaatgctgcaaaactcccaatcagttaagaaagatgtatctctagcatctaggtattcattaaaggattccggctcatacaaaaatcttttcacataagaacctgtgctgaaaagcttaatagatgacgaagaaaaatagttagataaacggatggatagcatagagacatagaactcacttctgctacagtcgtgaccatgaaatccagggaaacaatggcagactgcatcaatgcaatcacccttaaaaaactactggcaaaaacataagacccaacacaagggtgctaacttggaggatctaattcactttgattattctctatctctctctctctcttttgaagtgacatataatgatataaacagatacgcttttgggcaagtcgtgttcacagaa

SEQ ID NO: 45274 - DNA, 3637 bp, Oryza sativa
ggggtggttgcggtgggttgctggtgagtgcaggcgcagcaagcaggagcggaggggcggcgccgtgcagcggggcagacacgatccaacaagagctgcacatgcaagcacacaacaacagttaatggcaccgtataatcctagtgtgcttctactacagtaacctgacgtgtcatagctaaaaaagggcacatcctgagaggctttatggtttgtgatgtagaattgcaagcatatttatgttataaaacatattttatcatctgtataatgaaaaaaaatgccaacaaaagcataagttttttttaaagcgaacttgaaaaacagaacacatcaatgcccctaaagagttaacttagcattccttaaggggcctaaatgtattaatggccaggaggagataatgtattagtatctcttagaaaatctcaaacttaagaagaggaaactaaattagagaagaaagcctttaacatttacctgtatgcagcatggtgtatattgaattggtcttatgtctgtggtatttgtcaatcaccaaaaaataggcaaaaaacaagttttaaagaatggtagaacaaataaatcatgctagataaaagaaatcaagtcatacaaagagagctaaaatagaacagcttagataagcatgttcctgttcataactgaaggaacactgcaactatgctcctatggacactctgtgaccaccaacgaaaagaaaaatacattagtagaaatcggcaatgtgctctgcaaggctagatagattagaccttatactttgctcttaccatatgataaaatagctcatctttgcagtcatattagaaacaccactctgatctttcttctgtaaatagggctgcaaaggaaaaaaaaaacttagcgagctgcttgctgtaagatatgaaagaccaaaacagccgagccaccagaagtaaacataatctagtgattaacacaagaaatgcttgtcctatacctgcatgatgtgctagaaaattgaaaatggcttgttttattgcgcttaaaatggactgttttattattcagtagcttcatcaaacaggcataattgtattaaactaataattggtgttcacctttgcatgtaaaccattgaaaatgaggtcaatacacacatataattacctatccaatatagttgaattcacttttttagataaatatagttgtatttgttaagatgatagaaatgacctacaatccaaacctcaatttgtttggatgcagacagaataagatgaggggtatgtatgtgtgatgcacaaagaacacgaatgatgctggagatggccatcaatgtgtgcacaaagccgcaccattcgtcatggatacaataattagaattaaaggcaggcgagcttgactacttatgaaatccccatcaattccctggaaaccaattgacaggacgactcaattaagaaagtaagtcccgaaattgaaaattaacgatcaagtgtgttaccatgaattcactaccatgaccctagaatagcaacaaagacaaaggttgcaatcttgcttttagaatacatcgagcatgagcaaaatagctaggagtagataaatggtttaaaggctaaaaaaattaccaggttttgattctgacaatacacttaatccatgtagatatgtgtaactttatgaaaagaagcaagaaacaggctagttgaactggtagtggttgtagtctgaacattagctgtaagaaagcatgtcaactgaactgtaggtagcaaaaaatctgccaaaaaaaaacctattaatggcaatcggcaaataacctgcaattaaatctctacaacatgctaattgatgtaagttgtaactgtccactgtggtgatctgcatcagcttgtttcgattgatcttgccaagcttcttgatgtacatcggctggccttcctgatcaacagcatggtatccctgttcggaactcctgaccataagaacatagcagaactcctaaccacaagaacatagcactggagttcatcaatatatcaaaccaaatattattcagacactgtaacttattaaatcaaatgcgctttgttatctggtcaccttcaacatcatgtcgactcctatctctttcctccatctcagcatctctgcccacatttgcatcgtcttcgattaaccttcagaaacctgcatcagaagagaaggcaaagtcaccattagcaaagcaacttttggtgaacctttagcataatatggtagtcatcgtggttgtccaggagcaggccgtgcgcggcgaggcaatcgtggaacacggcgacgacgcgttcctcgtcgggatcacagacttcctcgattgacatggccgccgggtaccggaaatcgacatgctgccgcctgccacgcttccggaccatgtggaaggccttctgccgtgacgaccccatcctccgccgccgctagtcgtcctcagagttgggggtcacacggtgctaaggtggtccatgcagggagggagaaaattgcatatctaccatagtataaaaatggctttgctagaataccataacttaaaagggctttgctggaatgctactcctaagtcgtgggtattcgctgcgatgccatttttgtggttttttgcatttcgaaattattattttttctcaattacactttttctcggacgtttatgccccgggcccggggtcaacatgctgaatctctctacctcttgctgcttcgagacttcggttgcttgaggacggaggcgtgaggagaaagtgaagcggcgacgctggtgccgcccaccactgccgccgtcgcgccgcctctccccgttaccccaccatgccgccagctgcaccgcctctctccccaccacccccgaatcccgctgctcccctcgcaggcatcaccgccgccgctagctgccgagtcagctaccgccgcgccgcctctccccgttccccggcggcgcttttggggtagatgggggacgggaagcggcggcgggagcagaacggggcgacaggaaggcgacgccggcgagaccgcgcttccgctcggtcgacaggaaggagagagcgggatgtggggcggatgggggacggggcaagagaaggcgaggacggcggcggtgaggtggctcgacgccggcaagaccgcgcctccgcctccgctcggtcgacaggaggagatgcgagcgagcgaaagaacttggaaaaaaaagaacggtatggtttggatagagaggaaaacaaaatccaagggcagtttcggcaaaaaaaaaaaaaacttgaaagcgagcaaaatctttttcattagccaaaaacgatgaaaaaggcaaagtgtcagaccgcacccagttgagaatggtattccagcaaagactatttaagtgatgttatactagcgaagccacttttatgcgatggtaaatatgcaaatttctcttgtggatgaaggaagaacttgcaccaggagagatgtcatcgccgacgttgccgtcgcagggaagacaccgtcgctgcagggaagatgcagccgctgctgtcaccgggaacacaccgctgcttccgagaagttgccgccgctgttgttgccaggaacatcccgtgatcccgtcgctgccaggaagatg

SEQ ID NO: 45275 - DNA, 2227 bp, Oryza sativa
gggggtggtcagagggagaaggagaaggtgagcgagagagtgaggcgaggaggggacgtggacggtcaaatccgcctgccccgaccacatggagatcggatccggacatcggccgtcggagacggcctgaggcaacgcgaggcagaggtagaggtggcgcgctcggtggtgacgacgacaacgtgccacgaggggaaggcgcttggcaacggtggaggcggcgcccagtggcggcacgagacggagacagagagagtaggacgagtgggagaaggggacgtgggtggcggcggcggctagggttttggggtgaggttaaggttagtgggtgtcgttttgcgtaaaagcccctatgcttccatttatcacagcgcggtcctaattcgtgatctttctctccttttcatggaatatacagcttttagaagggtttccacgtaggaggaacctacatcaaattacacacaaaacagagggttttttttggcaaaatttccacccccgcgcactatttttatcctacgtggcatgcctgagcggcagcagcacccgcccaacattatgttttctgatgtgttgaatatatgaaatgatttattgcttttgtttcgaataagacagaatttctgggctggactggacctagtcacaaattttgacaatttgaccttttgaaaaaactaattttacaaatgaaccttcgccaaaacttatttaaaaaatgaccattttttcaacgccaaataattctatggagctgaacttagacacttcagcgccacgtcaactggcgctgaatgctgtgccaacgcggatggaaggctgagttagtgtgccaacgtacattcagcgccatgctatttggcgctgaggtgtctaagttcagcgccacacgatttggcactgaacaaaagggtcattttttaaaaaagttttggcggcggttcatttgtaaaattagtttttgcaaagggtcaaattatcaaaaattgtgggatctagtgctctaactgtaagaatttccgttaagagagaatacatgtgttgaatatatgtaatgatctaccgctctatctttaagattttctgttatatcttacagaatgcatatcgactcactcactatgacatacttacaattatgggctgtatccaccaaattagatttgagctcaacatgaacttcaaaccatagttttgaagtaatcaataataacatattaacattgccattcctaacatataacagtacttgtgccaataaatgtttcagagatactatacttttaaagtattcatacaatgttcgacaatcggcacacatagtacagaacatagaaggcgcactccattcgcacacttagtacataaaatagacatgactgcacaatccatttgcacgcgtatttcagaaaatattttcagatgacaagaagtacaatgttactcttggagatacagtacatgattttagtcagatagaattgttacctgtttcttgtgcattgtggaggagtccctgggtttcttttacaagagaagagagagttttggcaggctttgttatctgacgatctttgactgcaaagagcatgcagttttcgatatctgacatgttcttgaaagccgtggacactacatcattgaaattactttcattgaagtctttgagggagctaggtttgagatgaattatcgctataaccacctgacaggtaagtttcactattctcagacagtcagctgtgttttcattatttgcttctattatcttcttgagcttcttcgccagttcatcattcacagatgtgacattagaaaaaagatctgcatcaaccaaattgtcgcatatcaccacaagaagggatagcagagctgctagatgtttcctctcttcagatagctcatcatttttctccaccaaggacttcttcagaccagctggttttggaggtttgctttcttcatcattatgcatttcagaattattgctttcccttgcctctgatacagtttcctcatctccttccgttttaccgtataggataagatcaagaatccgcaacagttacaataatataattcatctcacaggaactgacttctagcaaatatatttagtataagttataaccatgtattgtaaataataaaatttatatcgaaggaactaaatattagcaatgtacttagtataagttataaccatgtgagtgtatctatatcg

SEQ ID NO: 45276 - DNA, 7823 bp, Oryza sativa
aatgtccaataactcatatttttcctttattctgtcaaacaaagaatattctaacctaaacattgaaaaaaaagtaatttgctgtttatcccccactgaaatggagaaaacgtttatggtctatgtaagcataaatatgcatctagactaaagttgtacttttctaaagtatataagtttagcctatgcattatgcaagtttaggggaatgctagatgattgataaatagcaaatctgatatagataacctcccactattcaaatttctaaaaacaaacaatctagagcgaactactaatttagggttaatattgtttgatcgggcatcacattaactgaattattcagataactgcatatggttgattcatgctaatgatgttagaaagagaaagcaattgaggtttaccgacatcagcagcttaaccacatcttgctctaatagttcgtagctccttgtaaaacgagaacataagtgctgtaatattgctgctgcacttatctggcattccttgtctttaacaagtatatcagtgagttgatcaacaactgttccatatctcttcacatccagtgcatctgtggactcgctttcacagatttgctccatggacatgcttttgcagaatatctccataacaggtacctgtccacttgcaccttgagtagaaatcaatttcacgagcgcttcccctgcttttggcctcaatcatctcataccactgttggcaaggaagatgtggtacaacttcttaactaaattctcggtcatggctgcagataaacctattgatatttctgaaagaacatccatggcgttttcctgaagttgcaaggaaaacttgatttggccgtcaaggatccccagcaagttgtggactgcatcattgctagctgagatttcatggcacagcactgtgccggcttctccaggagcactgataagccgcatcaccagcctcaacaaaatgcttaggatatcaacccattcactgtcatattctgtctcgaggaacgcgggagaagtgattggtgctgtgatcttggggagcagccattggttttgcacatctccctgcagttgtgctcgtcgcgtgcgagcctctcaagaatctgcaggccccgatgaatcaactccttaccgcctttcggcttcttcaaggtgtcagatcttggtgaggcttctagcagagaagatatgcagtgcagagctcccgctggcatctgggctacgcgcagcgcagcagcgacatcggcgacaatcctcgcggcacgctctctcatctcctggtccggaccatcccactcaagcatctcgatgagattctggacagagtgtctcgaggacagcagctcaagccgtacagagcgctgcttgttgatggccaagacgtcgagcatccttagcccatccagatgatcatccggggatgcagaatccagcaacccaacggcgtatgtcaccaggttccagtcacctggcagcttgggatcattcgcacacttggttttggtttcctggaggtactgacgaagcagcatctggtagtagccgccgtcgccgtgcccatactcctctatgctcgccggaatcggcaacatttcgagggacaaatgcagcaggagccagaagtagaagcacaggctatggagcagagccagagagtagaagatgaacagggctgccctgagctttcctttgctcgacgcgtctgagccatcgtagtcgtgctgtatcaggcgcgtcagcgagatcgccattgttgccatcggcccaaccaagcttacgatgaacacggcgtcgatcagaagcagtcctataagcagtgccatcgcgatgagcaggaccaagagcatgacacacagcctccagcagcgcacggcgcagccagcggagaggttggcttcgaacttcgagaggaacgtgaagtatcccccggttatcataccaaacgtaggattcactcgtgccgcgtaagtctcgttaacgtaatcgtagacgctcaagaccctgttgcattgggttaccgcgattaagatcattaataactgacatcaaacattatatattttcaaactttaacaacttatttttttaaaatttgtaaacactaaagtgaggtatgccctaaatataagcataaaacttttattcactttggtctaagggcaattaaggggaaggtaaaaaaaaagtcaggtattgagaaatggagtaaatgcagcgaggaagatcattaattagctactaataaaacacatgaatatgaaaataaatgattcataaggctgtgttccatagtgaggcgaggcttgccatttttttttctttttgacaaattggtcctttctaaaaacttattttgaaactaacccgtttaaaaaacttcaactaaaaataggtccctaggtcagcgccagggatgttggcgttgagattagccggcttaacaccaaaacggttggcgctgacccccttgccaatgttgcggccaagccgatcccctgctggcgtgggaggtggttagcgccaactgccttggcgctaagcccactaatctccgcgccaaccgcgttggcgctaacctagcggcctatacctcgtggctgagtcgccccggcctaggcactcctctcttatttttccaggcccggctagggttcgttcgtaccccacatagccctctctcctccctcccaaaatcttctcaaatctccctcaaatcgaacgttattttgtgggcattgcttttggaggttgatttgtaaggtaaatcctctccaaaaaccctaatttcctcaatgtttccctcatttttgttgagtattttggttgaaaccgtgggttattgaatgtggctcgggatgtggttgaattagggaatgtgggtaagtatgtcatgttgtagttgtatattgatgttggtatagaggattcgtattgatttgcaagttttgtactcttttgctacgggtgaatttgggagggatgtatagtgcctttgtattgtgaaatattttggggattcatattgattcatgttcatgttgataggtatagatcctaggaatattctggccggtggttagtcgttaaaatttcaaaaaaattgtaggtagttttggggtacccatgtcatttttctatctttgaaacgacatactattttagaatcatgcactcttatttatcagttaattgatgtgattggtacgactccattttggtggttgtgtggttgacgaaagtatcggtggaagccaatttgagaggatgactcttaattaggccgttagtgtttcgtgccaaacctacatttgaggagttaattttccgcatgaaggatgaattggattggagcatgagtcggttggtatgcaagggagacacgatgtgggcgccgatcccatatcacataagtatgtgttagatttgaatggacaggtggaatggaaaacatatgtagatataatattgggctcacagtttaaatcgcttgaggtgtttgcttgaaagatagaccacagtgaatcgaaaaaagaaatttcagacctcaatgaaaatccacgcatacagtcatgaaccgaagaatgatgtgtttgtggttgatcggaaggaagaattaattaattaagatatggaggtagggtttaggaggatgtggatgtatgggtagaagtaccagatgagaaggatgtggaggtaggaaggctttgttagaatcaattaaggaagaagtggaggtaggagaggaagtacaggttgaggagaatgcagaggtatggtcggaagtaccggatgagaaggatgtgaacgtagggaaggatttgtcagatgatggcttggatgtgactcaaatggagaataagatggtagatgaacctgatgataggcaaatgacttttgattcttggggatgattttggccggcatgcatttctgtttgtgaggttttagatgaaggctggacaaagacctagaatgtcatctctctgcctagggccctacctcctcaaacaaacaaactcagcaccaaagatattggcgttgaccctcagcgctagagcagagcccaacagagctccaacataggagctgtgttgggtagcccaagcgcaagtgacgtctaagtccctaagtcccatagctcagcgccaaattagctagcgctaaggtccaaagtgtcagtgccatttaccctggctctgaggtttgacggctcagcggatgcaggccgcccaacacaggagctgtgttgggcggacagggcgcaagcggctaagtcccagagttccacgccaatcacagtggcgctgagattattgactcaacgccattccgattgacgctgatccgctgccatgtacacttggggatcggcttggctgccacgtggataggttgctcagtgccaacgggcatggcgctgagttgtctaacctcagcgctaaggcggttggcattaagccgacgatctatttttggttaaagttttttcacagtctagtttcggaataaatttttgaaaagatcaatttgtcaaaaaaggatgaaatagtgtcttcttgaattcaagatctatatattgtggactagggttggtaatgggatggaacaggagatcaattcgacgggaatggcaccgcgccgctcccttgcgggttcacctggccccattcctggacggaagaaccgggcgaaatcacaaatgatacaattcatcatgagctagctgaagcctaatccttatttcttcttgtgaccatgcactctctctctctctctctccctcgtatccgtagcatctctcctttttcctttgtcctcccccttggaccactcctgcattaccagtgatttctttatgtgcgatgaagccattgatcctcactagctagtaagcgtctttatagtgactaattatcttgttgtcaccattatattttagatatatctagtgactagatattcttcaatcatttttatcgtattactagtgataaaaaaatgttttattaaacatatcgactgtgacgactcatgtgtgataacttatgacgtagtcacaatttatttaacgattagtgataaactaacgtgtactaatatctaatcatgtcaatagcgaagactgaactgtgatggaattagaccactcactaattaaccggcatccgtgctagcagcagggttggaaatttcggaccgaaatttccgcacctccgatacgatataacttcggctgaaatttttcaattttttttataaatttaggtaatatttgttcaaattaatttaactaaatccagaaatttcgggatttcgatgaccctcgatcaaaaggactcaaccgatagagtgaaccctggctagcactcatgctaaataagcagttttgtgctagggaatttcgtcgatatgttaaaaggggagggttaatttcgtcgatgacttacgtggaggcaagaatcatgctgataaacgtgagaaaccaaaactccttgatgggcagcgcggagacgaagccgccgaggaggacgaccgtcgaccacgtcagcgccaggaagcccacgccggcgacgaccttcgccgtgaacgcccggattatcgcgatgctgttgatgagggcgtccggctccggcctccctgcctgcagcgccgccgccgatgatcctccctcatgctgcccttgtatgacactgttgttgttgttgttgctctctctcatttgatcgatcttccccctgctaattgcttctatatatatcttctcctgcaatcgaataggtagctgtaatatgtagcggctatctctagtgggatatgatgcccgatataaccaagcgagaagagagagagagagaagaagttggcatgggttaagttccaaccaaatactgcacctatatatatatatcgaaccaacggcgaaaactctactccctccgtttcaaaatgtttgacgccgttgacttttttaaatatatttgaccgttcgtcttattaaaaaaatttaagtaattattaattattttcctatcatttgattcattattaaatatatttttatgtaggcatataattttacatatttcacaaaagtttttcaataagacgaacggtcaaacatgtgctaaaaagttaacagtgtcaaacattttgaaacggagggagtacttgatagttcgagctaaggtcggcattgcagccattgcatgaggatgtggcgcaatgaggatggaaacgcccaaagcttgttcctcggtcctcgttgcacaagattcggttagccaggtgtattcggaacttagagttcccaactcacccctctcctttttcacgcgcacgtttattaaactactaaacgatgtgttttttgcaaaagtttctatacaaaagttacttaaaaaacatattgatctattttttttaaaaaaattagcaaatatttaattaatcacgagttaatggaccgctccgttttccgtgcggggagtttagttcccaactccctatatccgaacacagctgtggtttttgtgctcaatttattatgtagcaagggcttgttcgatgagccctaatgtcattcctaactcaatgactagaatggtgtctatagtattaaataagctgctacctagaatagaaaatgatgtggcaagcgaaaaaatgagaaaagagaaggaaaccatgtcttgcatgagacatggtttctacgcaatatccaagacatcatgtgagataagtagtattaaatttaagtatgaaatagtggtgtttgtattggaatagtagtttgatgatgtggagcttatagaaactatgtctaatgtcttgggttggaaatggcctaaagattgagccccagtacaatgcttttcactagtagactttcgatctaatttgatcaaagggtttagatctatttatactaccatttcagttagtagtagtagaaatatggagggacattattgtcaaaaaaatgtgcggaggggtataatcgtcatttagtagtgaataaatattgtttccttcttttttagatttttttatggaacatgagcgatggcggtgcaatggatgatcgtagattgatttaggtggggagaaacataaataagtgacaggtactcctaatttacccctaataataagtgacatgatattatagtaaattactaatttacccctaataataccggtagtattagagagaaccagagcatcgctcaaagattgaagagatgggaggagattaagggaattaatcggtgtagaattattctcctccaaatctctttcaacccttgtgtaagggattaatggacactcttcagcttatcaatcgtagccaaaaattaaatattaaaatttaatgttattgctgatttgatatcttttctaccgcagtctattttttattattatctttaaactcgttaagaacaatatattttaagttattaataagtattatgatttataatcaattacggaaaataaagtaaattttagaaaattgtaacttttgctgtaatattagtgacatgtttcagtttgctgtaacttttacgttatatgctgctacagttgtcacctatatgtactgtagcagcatataatgtaaaaattatagttttgtgataaattcttacgccattattgtaacaaactgaaatatgtcgctaatgttacatcaaactgatagttttatcgccaaagttacagtttttctaaaatttacttcataaaaaaaatgaaccagccatacgtggcggaggattcccaggccctgttttgggggggggggggggg

SEQ ID NO: 45277 - DNA, 27729 bp, Oryza sativa
cttttctcagcttcccgagattctaagggatgagcccattaaagttgtaggaaattacccacctttgccactgaggtacacccctctccccctcatccaacgcttccctgtcgaacacaccgagccgcgcgagagagagagacgaggcaggggcgagcggcgcggcgcagcgcctccccgccggaaccagcccccgcgcgctcgccggagtcgccgccgagctgtccttcgtcgcgcccaggccgagccccaggtcgccgcgcgcacgtggggggcggcgccgacgccgacgccgcgccagatgtgagaggtccgcaccaacgccctcctgcggtccttccttgccggagcccggcggacggcccttcctcccctccgtttcggctcgtcgtcagctcctctgtccctcctcgcgtccgtcagctcctctgtccctcctcgcgcgacgcccccatcagctcgccggtccaacgtcgccgtgagggatccccctcctccctgccgagctacagcaccctattccccactgctgcacagtgagtgacaatgatgaagactatatgccaccaatcgattcatctgaagaagaagaagaaccgtatgttagcacagcaccagatgatggtgacatgtgcacctttcgggatttaattgcaaactctctgatggcaaatagacgacgcggtacataaaactatgcatatggttcaggttgtattttgctatgtggttgatgtatatatggtagtggttaattaattagtactttgttatttgcatatatagcgatggcaaattaggcttttgtatgtgcttgatgaacacatttaggtggaaaagtacaatgtatgtgtttgcattaagtgattaatttgaccctccttattgccttaaaaaattggagcaatgacttttttattagctacaattatgagagttcagtattcacaacagtacttttaaaaatttgtatgtacatgggtttaccctacacaacaaatagttatcaaacaatcaggatcatctacttcaggggtatttcagggaattcagcatcttagcacaccaatcagcaaacccatagaagctccccaatcaggctcaggtcagcttctcagaatctccagctagcttctcagaatctcagctccctcaaacagaccctcattcaatatggatacaggtctgccgtctaccatccccaaggccaagccatcgtgccatggcgttagatcgtgaagaggagaaagaggaacatgtactcactggctcactgctcaagcaacgaaccgacaaagaagagcaatgctcttttttcctttttctttattcttccagtggacccagcactgagttctttctcttgttggataatgaagcaaagactatgccatggatcccgccctttcggtggctgtggttcaactttaggctgagttttttttttgttatatatctaatgttgcaattgtagtataggtcttaccgcatataaagaataactcttataaaaattataggagtggattatcttatacaactgagtttatcttagttcaacaattattagctttttctgaagattgttttacagtgcatcattgggttgggccttttttcaaaaaacccaaaattgccttatgaatatataagcttaacaattgatatatccaagtttaaattttttcatatggcctccttacacaatatgaaagttcgtatataagttttagatttttcattttacctttttaaaaatataatttatctattatatgctatacaaaatatttttgttttattgtttttaatgtaaataatctttcaaatgtgttaagaaactagctatagggtgatctcgtccatataaagataggatcgcaaccgcgccttctccccacttggcactccttggcaacaaccatcgcgtctacggttgccacccctttcccatctataaattgtaccacattgatcaataaatgaatgactcataatacgttatcaacactttcattcataatacctggtaattgatctctatttgatataattctatagattgatttgtttatataagtatgtaatagagtactagctggtacattatttttaactatatcttgctctaaatattgttccatcaactattttcatgatatcatttgaaatctatttatcaagctaagtagatgatattacagccgatgcgacatatttagggttttatattctttgacctacttagcctatagccgatttggtctaactatattggctgagtccatcaacaatacgtcatcgacctatcggctgatcggctattggctaactcactttgcttattttttccttgcttgttgcaggatcaaaccagctgacacgcccttagcacactcaagacaagtcttggacctgcactgaagttaagcatatctcccagactaccgtgtttctcgtcaacacgcgcgaggatgaagctgagtgacaccgccttcatgtgcatgggctggtgctggaagggtgggcgctgcaatggtacatgtgcatcgtcatctttgttgtcatcgggtgtggcagtgaacatggctgccaggatcgccagccgcctctatcctcctctctctcccaggcttgccgacctccccctctctaagatgatgggattgacaagcagaccccgtattttttcttctcacttcacttacatgtgggactcacatattatttttatgagtgtatttcagaaaactgcaactatagtgataaaactatcagtttgctgtaacatgtaatatatttcggtttgctgcaacaatagcgtggggaaattatcacaagactgcaacttttactctatttttattttgctgactaggatatcacgtcagcgaaaccagctatccatactgctacacgacccaaaatacacggtattgtatatgttagggctgaagatttctggtattggagataagggacgtcaaacaactcaatataaaagttgaggtactaccggtgaacttaatcctggtaaaatttcggccccggaaggtggatatgccggcccattacaccccaaaccctagagaaatccatccactaacttaaccggtggaaatccaccactccgggccgcctcccgtcttctcttctcgagcggctcccgcgccgcctctccttgttgtctcgtcgcgcgccggcgcctcctctcgtcgcgcaccggcggcggcgccagcgcctcccaccgcatccgcctgcttcccctaaggcaccgcatccccttccttcccagtgccggcgccgcctcccttccatcctcggtgcaggcgcctcctcccttcatccccgctgtacagtgctgcacagagtcgaaacagtcttcttcaagcccagatccacggcaccaggtacaccttgatcctctcctcacccgcttctcgtgtgtggacagaagcatagcagttgatatgccatacatgccttctttggggttctttggtggaatggcttgatacattctgtttgagatgcttgatttctactgcattttaactgtatatacttttcaatcaatgtcttgtctagttccatatatgtacatggatatcttttctcctgctgttagaacttgtatggttaagttcgctgcaaagtgattttcttgattctttcactattcagagcgtatgttagttcatctgttgctaagttaagatcttaaaagtctgatcaaagaaaagaaaaactcagaaatggtatatatcatagaactctaagttgttagttcagtgtttaacttgcaatgagatgtttttataaatgaagagttaattttaatcatgcctggaatttttacaagtttataaataaagaaaccatccgaagttttattacccaagcgatgcatttcaagtatgaaaaataagttggaaataggtttaaatttattgtccttactttttgtttttcatcatcttagactagatgtttttgttttcatgaaactagaaactcaaaaaagatttatagtgctgtgtggttatagcactcatgaacctattcctatcatatttggtcttgatttgtttcagtttattcatcaggttggttggggaatgcagttcattagtgagatatcattatcagtgctattcaactactgcaattcattatcagcagccactgtgttctgctaaacacatgtggtgctcaggttatgaacttgataggtgaagttaatggttgggtcaatatatctcaactgtggaaacaacgtagcacatgtatctgctcatgaagtttgcactttcggtggcaaataaaatttaatttaaattgtgtactttaagcatttttactgaggagtgagaagagatgtttcccagtctaagtttccatatattcctatgacatctatatttttgttgtttcatctgtgctccagttgctataacctggtttgctaatttgttatcaagaaatcgtgttgtctttcttttgtcttcctgttttgttaaataggccactgtagtgacactggtttgttattgaaacaaccgtgtataagtcaatttcgataatttttttttggccaaatgattgttatactgacttctgctgttaccatgttactatttaatagattttgtgagttctagctactagccaagaagcatggctgaggaaaccagcaacgacaacctggtggttcaaggcaacgagattgttccaagcaatggggaagctctagctgaggaagttcagggtgatgaattggtccttgcggaggacttaattcaaggtgacgaggtccaaggaaatgaattggtcagtgctgagatgagtatccctccaacatcaaggcgccgtaggaagaagtctctagtgtgggagcacttcactattgaagctgtctctggaggggctacacgggcgtgctgcaaactgtgcaagcaaacttttgcttacagctctggttcaaaaattgcgggcactagccatctcaagaggcacattaccttgggttcatgtcctaaaattaagaaccaagagcacaagctattactgactccagctggagggactgacaatgatggtgagggtactgtggagcgcccgtctaagaggcgttacagatatactggttatgcaaatgctgcttttgatcaagaacgcagttgctcatatctggcgaagatgatcattttgcatgactatccacttcacattgttcaacagccagccttcactacctttattgacagtctgcagccacgtttcagggttgtagatgttgagacaatggagtgggaggtgtatgctgtttaccagaaagaaaaggaaaacctcatgcaagcattcaacactatgcctggaaggatcagcctcgctattggattgtggacaactagccaaactcttggctatgtttcacttgctgggcagtttattgactctgagtggaagatgcatcgaagaatgctaaacttcatgatggtgtcttctcctcattcagagaatgcacttagtgaagctattagtacaagcctttcagactggaatatgaaggacaaactattcaccatcacattggacaatgattgctcatcacatgatatatacagtgcgaatctgagggattatctctccaacaagaacaacctcatgctcaagggccaactatttgttgtaaggtgttatgcccatatcctgaatgcagttgctcaggatgtcattgcttcaattcatggtgtcatctataatatccgcgaaagcattaagttcataaaagcttctcctagctgtgaggagaagtttgcagagattgctctgcaactagagatcccaagtaccaagaccctttgtctggatgttacgacacagtggaacactacctatctcatgctgctggctgccttggattataagcaggccttttctactctagagacaagtgatgataactacaacgaggcaccgtccgctgaggactggaaaaaagttgaggctgcctgcaattacttgaagctattgtatgactcagcacatagcatcatggctgcagcaaatccaacttcaaatctctttttccatgaggcatggaaacttcagctcgagctgtcaaatgccacagggcgtgaagaccctgttttcagcagcattgccaaggatatgcacgagagatttgacaagtactggaaagattgcaaccttgtgttagctattgctgttgtgatggatccgcgcttcaagatgaagctcgttgagttcagctactcgaaaatttatggtgttgaagctgcgaaatatgttaaggtggtggatgatgctgttcatgagctctacaacgagtatgttgcacagcccctccccttaacgccggcttacgttgagcaagggggaggtaataatgcacctgctagcgagaatagtactcaagcaactgctccttcaaccggcgatggacttgtggacttcgatatgtacctttctgagatagctacaagccagccaacaaaatctgaactggaacagtacctggatgagtccctcactccgcgcatccaggaatttgacattctgaactggtggaagctcaacactctcaagtaccctactctctcaaagatggcccgggatatcttggccattccgatgtcgatggtgagcagcggcaactctattttctctgctggaactggaactcgcatgcttgatgactacagaagctcatcgcgtccagaaattgtggaggcgctcgtttgtgccaaagactggcttcagtatttaccagctaccccggaggcaccgagtacagcgctggtcaaggtggatgcagcataggctcgccgtgattccccctttttgtgaagcaacagcatcttatgtgtattttaggcagggattatgaactgattgtgatctgagcttatcctcctagggtgtaatttgttgtattgaactctgttaactctttcatgttgttatgtacgctttgtctgtagtatgccatcagagttgtacctgacattgcatgtagtgtgtgcgctggctgcgtaatgtgtatcagttggtgccttatgttcgtacttcccttaattatcatcctttgtaggcttgtagcatgcggtggtggtttgcggacggcttgccgtgcccgtcgacaaaagcatcgggcaacaggtgaagaagccgcagcagcaggcgttaactgtaagtacgtcctagcacggtgtatttttaatcctaaattgtttcaaattctaagtacatgtgttgaatatatgaaatgatctattgcttttgtttcgaataagacagaatttctggactgaaatggatctagtgctctaactgtaagaatttccgtaagagagaatacatgtgttgaatatatgaaatgatcttccgctctgtctgtaagaatttctgttatatatcttacagaatgcatattgactcactcactgctatggcatacttacaattatgggctggatccaccaatttagatttgagctcaacatgaacttcagaccatagttttgaaacaatcaataataacattgccattccaaacatataacagtacttatgtcaataaatgtttcagagatactacacttttaaagtattcatacaatgttcgacaattgacatgcatagtacagaatatagaaggtacactccatttgcacactaggtacagaaaatagacacggcagcacactccatttgctcgtgtagttcagaaaatagataacttcagtcttcagatgacaagtagtacactcgatgatctgttattcttggagatgcaatacatgattttaatcagataggactgttacatcttgtgcattctggaggagtccctgggcttcttttacaagagaagagagagttctggcaggctttgttatctgacaatcttggactgcaaagagcatgcagttatcgatgtctgacatgttcttcaaagccgtggacagtacagcatcgaaatgatttccattgaagtctttgatgcagctaggtttgagatgaattatcgctataaccacctgacaggcaagtttcactattcttagacagtcagctgtgtttttgttatttgcttcgattatcttcttgagcttcttcaccagtgctgcatccactgatgtgacataacaaaatacatgtgcatcaaccattttgttgcatatcaccacaagaagggacatcagagctgctagaaatttcgtttcttcagatagctcatcatttttcggaacccagggcttcttcggaccagattgttttggaggcttgctttcttcatcgttatgtacgtcaaaactattgctttcccctgcccctggtacagtttcctcctttatttccattttactaattagatcaagtatctgcaggaataataatatattaacagtatacttataatcaagtgtcatataactgcatttggttaattcgtgttaatggttttagtaaaagaaaatagtagaagtttaccattctcaacagtttaaccacacatagctctgatagttcattgtacctaacaaaatggcaacataagtgctccaatattgctgccgcacttatctggcactccttgtcttgaacaagtatatcaatgagttgagcaacaactgtatcattttcacaaaatacatccttgacaaatacctgcccatttgcaccttgagcagaaagcagttttgcaagttgttctcctgcttttctcctcaatctgcttgttcctctgttggaaaggaagatgcaccacagcttcctgatgaaatcctccgccatgattgcagggctaccaattgctatttctgtaagaatctccatggcattttcctgaagttgcatgggataagttgcattttggccaagaatccccaacaagttgcggaccgcgtcctcacaagccgagatatcatggcatacccttgtgccagcttctccaggagcactgatgagcagcctcaccagcttcagcaaaatgctcagtatatcaacccatgcattgtcataatctgtgtgaagtaaagcaggagaagtgattggcgcaatgatcttggtaagcagccgttggttgcagcagatctctctgcagttttggtcgtcacatgcgagcctctcaagtatctgtaggccctgatgaatcaactctctagtgccttggggcttgaaggagctcttgtcatccatcgtcccaaataagaatttcttcgctcttctgtccatccttagaagcctgtcagttatctgctcatctattgcagtattcatgttcttgtctttttcttcttctcctccttccttgtcttgatcctgtttctgtggacctttttcaacctcttggcagtattgtcttagtggagatacttgaagcagagaagatatgcactgcagggcacctggtatctgaacaatgtgtaatgcacccgtggcaacatctgccacgatccttgcggcgcgttctctcatctcttggtcctccagtgccgggtcagtccactgaagcattttgatcagattctggatggattcgctggaggacagtagctccagtcttatggatggcctcttgttgacgacgaatgcatcaagcatccgtaaaccatccagatgatcatcccgggacacggatttcagcaatccgacagcatatgtgaccatgttccagccaccgggcaagctcagatcatctgcacacttggctttggtttctcggaggtattgaaggagcaatttttggcccccaaagtccttgttaaggccgaattctttgcttgccgacttggacaacttctcaaggaaatactgaagcaggaaccagcagtagaagcacacactatgagccagagctagggagtaaaatatgaacaaggctgctctgagatttccattgtcatcaccataatcgtgccgtattaggcgggtcattgagatcaccatggatgccatcggcccaagcatattgatgatcagcacagcttcaattaaaagtgcgaggaataccactactatttgcgcgagcaccatcagcacaataccacacatcgaactgaacacgaaggcagcagtggaatgctttttcgcagacttttggaaagccgtaaaggtttcaatcatactagttgtggagttcaacactgcctcaacactctcgatgctgtaatcgtggacggtcaagaccctgttgcattgggtttagcgaggaacatcattagctatcaatcgtttttcttcaactgttatatttgatcgacatccaacaaactaatgaatcatatgccattcttttttttacaaaacaaaacatgctatagctcaaaattcaaagattgtattttggtggatccttaccggcatgaataaacaatttgatcttaataagcataaaaacgcatttagttcaatgcaggaaataaaaatacaaaggaaacaaaagagtttttcaaaccgtgcaagtttaggctatactttgcgtatgttgaaatgccggacatgtagggaaagaaaaccaggtaactgataaataacaagactgggaaaaatgcttcgcaagtttttttttttttttgccagtgaggccaaaatgcttcataagttgtgggggcatgttaaataagcctcctaaacaggtcagaccatatatatttgctaacactcgtaagttaacttagtgagagtcactactaaaaaagttttttttttcatacggccaaaacctatttttgcgtgtgggtgggccgctcgtctacccgaaagtgtctatgaaaatcactatttttgcgtacaagtgtttatgtcgtctgcacgtaaaaataaaataaaaaaaataaaaatccccaaaaatcaaaactccaaaccctagctaggtgctatccgccggcgacatcgtcgcaacagtccaccaccgctcctctttgtcgccctcacctcctctgtcaggctcctcctgccaccatcgcaggatccacgtagggccgcatgagggagggccccaccgctgctgccccacgcctcctccatcaagctctcgatccgtccctcccgaacccggaggcagccgctcccacctgcggtcggctgctcccgagcctactgtcgctgctcctgctcgtggttggcctctcccgtgcacaccaccggatccgcttaggggacgaccgccaccgtcagatccgcgcgggggagggcccgtcgctgttgccgtcgccccttgcctcctccaccaggctctagatccgcccctcccgagctggaggcaggtttatttacagtccacctgcaacttataagggttcttgcgcagaaaaaatgtttttgtagtggtgaattttaacgatacgacaagcacaacatatgcacttcattaattcttgtattttgatgaacaggcacaccacaacatgaacgagagatggtgggaagaaacccacgtgaggtagctcgaactctcgaggcggtaggattgaaaaacatagttccatcacctccgacccctcttctaggaggaagatgcatagtttgtagtcgcgttccaggaatcctaattcgtgtgcacgcaaggggcgcaagttgcgcacagttttctgctgtgtgacaacaagctcagggtaggggtaggggtaggggtagggttagggtttcagggtggggtgagcgaagggttttgttagggaggggtaagtgggggatcgggcttagagtattggcctgcaaggcggcggcagcggcatcgccggagccgtggggtcggcaacgggcagtaggctagtgttggtggcaagggcaaagcgaggtggagggggggggggaggaggccagctgagcgggacagcaccatcattttgatgccttttggcgccggtgataccaggcgatggcatagtgaggatcgacagcgagaaaaggaactgacttggttgattgaggaagcttttcggagggaggaaggagggggatcgctagatagaggtctttgcagccgccgtcatcgaaggaggaaggcaactcgactgtgattccttttctccaacgatggagctcgcaataaggaggaggaggagactcgctggaaggccatcaccggaggaggggtgtcatcgtcgggcttgtgtggagagagatagggaagggtgcgtgtgattgtgtgaggagataagatggagagagagagaggggaggacacgcggaaagcatgaatcctaaatgactagagagtgtgatagaaggatacattaaggatctagtgacaaaacaattgctgattgaattgagtttgagtcctgtgggaaaggattggtttcagttggtcaaaagggtgattaggttccatggtaaaatctggctaggtgcacatacagaggctaaacatgatgttatgatgtctccacatgaaaagtggaattggtggccactctatcatggcagcagcttaccaaaggatcaaagtttacatggccagggtttaagaaggatgtttagaacaatgtgaagttttccaacaagcaaaagctgaacatggcatggctccagatttgttacgaccactccatgttcccctacaagtttgggaaatacctaagtcaggcagattttatattattctagtggtcattgataaattcacaaagtttgcctagttgattcccctatctcatcctttcacaacacttactgtagcccaagctttcatgtccaatatttatgagactttgacatgcctaaaattattatatctaatagagataggtgtggcaaggactatttaaacttcccgtaaaaaaagaactatttaaattggcatatgtgaaattgaacatgagctcatcctatcatccctagacagatgggcaatcagaaatgctaaatcaatgcgttgaagcatttttgtggtgtgatgttcatgcttgcctgactaaatgatcacaatagctctctcaagctcaacattgatacaacactgatttccatagagcccttggaaaataaccatatgaaattttatttgccagaaagcacacttattttggtgaagtgaatctggggcagagcataatgcctgatgtgcaggtttggctacaggaatactcacagttgaatgtggttctacgtcatcaactgatcaaggcacaacaatggtggttcatcaagccaacaaacacagaactgagaggtggttagaattgggggatctagtatacctgaaacaccaactcttgatacaccaaccctatatgcagataactgtagcatgacgttcctatcataaactcagtttcaaatactatggcccctacagagtgttagattgggtgagagctgtggcatacaaattggagctcctagtgtgtagtcagatacatctggttgttcatttgtggttgctaaaaaaggcattgaaggttggaacgcaagtaattactgatctccctaaattatgttgatactacagctgaagtcgtgcctgaagaagtgcttcaacaccaactgatcaagagtggtagggcaatgattcctcatgtcttgatacaatggaccagactgccaatggagttggcaacctgggaaaacctgtgccagctatgacaacgattccaagatgcaccagcttagggacaagccggttcttatgaggggggaatttttgtgtccttggaagcatgagttgtgttgttggggtcaaatgatgtatgggccatgggcctcgtgggttgtcttgggcgaaacccagttgtaaatggtaaaagacctattgactcgacgggctatggtatcgaagaagagaaaattgaatacccctaccgatctccgcttacctctgcctctagcttccttgtcttgctttctcctttctccatgaaatccccatgaaatctctaccaattggcgagatgccaaagcaattgccatgattcgtgacagagatgcaaacgacatggactctatgtaatttgcaaaacatgagttgtagcaaaggcacatggttggttttcaatgagaaaggggtttacttgcttgcccaaggaccagcatagagtccaatattcactttataggttgtaaggcactgaagagcagataaaaagcacatagagagagtgacacaccttaggagagagagaacatggcgagattgggaagcgagtttgtaaagatggggaaagaggcacaacaacgtgataagagatcatagagagatgcatatagggcatattttggcaaaaggattatgagacatgggattgagaaagggaaatgggtaaatggctaagattgaggtgtaaaaaaaaggatggctaggtgttaatgccaaaatatggtaagattctttagtggatttggttagggaaagaacacaatcaaccgatggaaagtctgtccagaagagaccaagttcaagaaggagtcgtgaagaccatggcatggcagcttaatttatctattaattatgcagggtttagtattttttttctttttatctttaaaaagtttggttagtgtctgattaggacttgtgttttatctttaggaaacatgagtcatttatgatggggattcatattggctcgaggttataaatatgttataaatatgtacatctagggttcttctaatctatctctagatcaatacaactttcaacatatcgccaccctaatttactcctgtcgagttcttaatttcgagcatgggctgcatcggtttagtccgagacctctggcgagaagtaagttccgtcatcttcgcttgcatcggcgtggctaggacttcctcggttaggtccgatattctattcggaccgaagcaagtgttgcctatctggtatatcgtctctacttttgattgcattattgtttagagtcacattgacttagttaggacttccttcgttcggtccgatattctgatcaagttggcgtctctttaaagataatgctattttaagatagatttgttatatccatcaggtttgcatagatctatcgattcatcgagtttagattatcacacgcaattttgtactgtctcggttaggtctgatcttttagattgtattgataatctaagtcttgttaagccgatacgtttcttgcttatgtttcattggagtgctaaccgatgagttatctggttactagttctaagtgttacatcggcttatatggattagttagttgttggataaatctatctatatcaacttcaatcttataccgtctcggttaagtctaatctattacgattgtctttgataatgaaaagttcgctaactgattgtaacaaaggcttcattgtttatctaactatttgagtctatttgtgtcggatttccaaccgatccaattctgcaacaagcttacaaccgaccgttcagtcccatcaacatcggctggcctcaatgaccaaatgcattcagtgctaagtactagcattggatccttcaactgattctacaccaaaccatcatttatccgctatcggctgacacacacttttggcccacttgagattatcatgatccgcgcccgggtctcctagtctccaacaaccgatcgttcaatctatcagctaattgctgctacttgacatctcttgtcagttgcagaattaaactgactggcatgcccgtacctcattgtcacatcctgattttcgttttaggatttataaattatttaataaattattattagaatttatattaaatgttcattaatttacaagtgaagttaaatgtgagaaataaaatttcctaaatataaagcatggctggatttaagttttattaaattctccatggttaattatactctctggaattttctcggatttttcggagctcaactcttaatttggaaaagtaataaaaatcctcctcctcagcttgggcccttttcagcccattccttcctcttctctctcccttcctcagcccatcctaaagtctgcattacctccctctcacaacagtgtcatcttcttcctccagagcccctgttctgcccgatgccgtgcgttgcaacgccaccttctccgttcgatccggccgaactgttgatccccttccaaaattgattgcaaaaacggattcctctctatctcctctacctaatcccgaagaaacccccatcaaattcgttatctatctcacgaattttggccgtttttattcgggtgaactcggataaatcctaacttccttcaccaaatccatccgttcctgagccgatctcctccacccatgcctataaatagcatcccctagtcgtcctcttccgtttgccccaagtcccgagctccctcgtcgcccgtagcgctgccgccacgttgccctagccgccgccgtcgccggcgaccttccagccgcgtcgcgccgccgcggtagccgtcgccgttgccatccgtcgaagccgttgggtgcgcacggaggagaggaaccccggccgccccttcgcagccgccgaagacagccggagcgccgtcgccattgttgacccgagccgagccgccgtcgaacctcgtcgccggccgtcgttcgtcgtcgtccgtcgttgttctttgcaccggtgagttcgcgtcatcgtcctctacgcgtagatgtcctccgttagcccaaccgagccttcttttgccggtggtcgtgtggaagccgtgccatggacggcgatgacgtcagcgatgacgtcattaatcccttttcttagttttctttattagatgaaaatcgattaaactttggaaattcataactaaatcatcgtaactcggatttgagtggttcaagttgctaaatttttctaaaatcaagatctacatgttaaaaatatctatgtgtactgtttatgcttgtttttgtactgttttgttaattttgttcatttgctttagtttccgacgttccggaagagagcgttttcgttgaggaaggttcggaagcgtttgaagaagctcaaggcaagtcacacagatcccaaacaacccttggagcatattgaacttatttaaagctattgttttatttcaacttatgcattattttcaaatgtcatcgggtggtgagcctttcccaattaattaatggccgaagatgactttattttcctatgggttataatttaattagctagaaccttatatattggtttggttcagctaaatgctatatatataattgcttagccatgcttagaaacattagctcattaatgggatgaatcatactacattattaattatggttatatttaatggtagctcacgatggttaatcgtgttatgttaattaattgataattaaaacctaattaaaggtgggttgtgagcatatggttttgatggttgtgctcatgacaattaaggaccggttcgcgagctactgttgtgaaacatttaccgtgctaaccataagccagcgtgggcaacggctttatcttttttatagcatagttcattacagggtgccagactgagaagcggcgagaagtccgtgggggtcgctggggagtccatgcctctggtttttgagggagtgattatgatccagaaatagtgcactgtggtgagttgtattgtgcaaaaggtactgtcacgattcccccctttggtggtacttcggggcatggtaacatgtgtggaatcatgtcttgtgggtacagtggtacatctctggccagagtaaaactattcgaatagccgtgcccgcggttatgggcgggttgagcaatgtttttcgtgattagtctcacactactcattaataataataatgtgataataaatttgactcctggtttggaatggataattcctggtttggaggtttgatctgtacgaccggggttggttgttcaggtttggttgggcctgagcagcatgggtgtgctgttcagtgttgattaaaatttctgattaattactctactgttttactactcttaactctttgctaaatgctgctttcgcaaatgagcctatattatgccatcctttggtatacttgtgcacttgcatatttgctgtatggcttgcggagtatgtcatatgctcaccttgcaataatcatcaaaccttagttgaagaaaaaggatccggaaggagaagacgtttggcttataccccagttgagctgcttgtgggagtggagctaaagccatcgctagaccgttaattccgctgctgtttttcttttcttttctaagtatgtaacgttattattatgatggatttgtatattaaattgtcagtttgtgtatctcggctgattcctggacgaggattttatgcacaaataagttcagaaattactagtgaatttccgggcgtgacactcatcaagatctaggacctgtattggaactaagtagatctctcatgcctcattgttggtgtgatcgatgcacatccggcacgtcggacggaaaatttcgtgtcaacactaggatatggggcatttgcaaatttgccaccggttttttcaatattgtaaggatgccactcgaatgacagttctagtgtcatttttgcaattttctagtggcagttttgcaataacaattcaaagtagtggtaaatttgcaattgcccctaaaatgtttaccctttggagagtggaatatcatttccgtatcctatttgccaaaggagtccatagtatttgaataagagcaggtggtgggaaagataagaaatgcttggtggaaccagggtttgcaaaaccgccggtaaccgcggttaccaggcttaccatgggggttcggtaacccttaccggcagtagggtttgccaaattttgagcaaattcaaaaattcgaaaaaaatcaaaaaaaaagcaatgtagtgcttgatttgtagtgtattatggtgaagaaatttcatgaaaaagagtcaattaggacataggaaaaagaaataatgaagtgggcctaagcttgcactggtcatgtggcccattaagacccatacgtggagaaaatatcaccaagtactctcatctctctattttttttgttattatccccaaattctacacacatttaagtgtttctccaattctttttacatttttttttcattttgttcttctttcgtccaaacatctcacggttaccacgaaaataccacggtaatcgctccaaaccatgcggtaaccgtgccaaaaccgtgctaccacagattttgaattcaaatttttgaaaccgaaatttacgcggttttttcacggttaccgcgggaggggggtgatgaggatataactagctcggatataaccatgactaccttatgtattaatcaaataaaggtgcatatgttctacattagatttacttgttatatatttgaacaaacgttgctacacaatgagttttgtgtgttttcgtttgcagaggtacttgcttgggcgaaggaaaagagaccgagcgtaactgatgcatggatgattaaagaagttgattggggaccaaaaccaagacgttctccaagtctacttctacctcaccacgtcacttttggtccatagaagacaagagatcaagttgtacacgttttgtattcggatttgggcctcctaacagcatcaacttcaaacaaacatagccgctgatctagaaggaatttcggtgttcacgagtacttgttggaaagcttatggagtctactttcagatggtttttgtcccacgtcaaaatacctaccgagctgccaggaatctgcaaaacaagccacgtatctcatccagacggaatctgactcgggttttgggccttgtaattgtgtcgtgggcttagcccaagggggtgtgcgccctagggcaaccctaggacgttcctaatcatattaattcggtagccgtcatcgtttagagttgagttttgcttagattattctgtcaagaacaatttcgccgctagatcggtttgtggaaccccaaattcgagtgcttaatcattcatatgcaatttggttgcaatctatcctgttcttggttgtgttcttcgattcgcttgcagggattagccttctcggcgaggtcaaccaggtttcgacatggttgataaccagaagagacgtggtgctgcgattgcggggctcagtagcgtgttcgttcagaagccggatcgagttgtgtcacgactccgcccaaatcgactgtttattaatacctatcggaagatcggaaccgaacatccctcataggggggggttggtaaccaccccgaaaacggttaggggaaccctgggcggaactagctagaaaagtagttcaccaatatcactaactaatatcacccatgatagggtaaccttgggtacataaaaagtttaacaagaaatcttgatagatatataacatcttgttagttgacgctaatgagtctattgtaagtcggccccaagcggacaagcattgttgcgttggtcagggcgaccgctgtcacacccggagttttccccttttccgtatttgctaaatcattgctaaatcatctatagaaattactttcttaaccaggaggaaactctaaataacaatgtgtttaataatcagaattgtcacggagattttttttcgaattttctttgctttaaatcactaacaggatgttcaacagaatattcagagcaaaggaattaatgaagttaatttaaaatgttaggagttgaattaataattctttccccactcttctttggttgtgaaccgtccccagttcactctccccgtttgtggtatgctgtatctgtcagtgttaaggataaggcataccctctgtcctacgacttacggaatataccaataaggtataccctcacgtatacggttggtttccggatatgccgttagaaatttacctcaaattatcggaaatatctctacgagttaaggaattgctgaaatcttactcggaaggggtaaaatctctagtatatcgtgtcggtttacataatctccaagtcttacttgagggtcaaggtatcccacggtataaaagggacccctagggataggctatgggcatcgcatctcatcgccaacacacccaccaaagtttacgaagccggagtccacagagccaactcaccaggagatctcgtcgaatccctcgactacgatctcatcggtatcacctgttcggttactctctttgaattgtaatctgttctcatcatcatcaatcccatataaactggactagggctattacctgataaggggcctgaaccagtataatccttgtcttttgtctgttttgatatcatactacgtagatccctgttccaacgtaccccaataccctattcctccggtctgcgagtatcactcgtcgacagtatccaccaaccccgttgccgccacggtttcgttttgtatgttgaaccgagtcatattctttttccggtcctgtttccttttcctttcccaaaatggcaccgcattggttttcctttcctttccttttttggtcccctcttattcgtatccaaatcccatcccctttccctagctgagtccctctccccctcttactaaacgtgcgcgtctcccctcccagtctcggccggctgccgccttccccctccccttgcgcgccgccgggcccacctaatctaaacctactctaattccgcatcctcttatttaagttcccatacccctccgtttttttctattttccttcaccgcaaaaccctagccatcgcctcccctacgccctagccaccaccgtcgctgtgtcgccaccgctagctgcctcccgccgtcgtcgtcattgcgtcgctggtgagccgtcctcctctcccgccggtatggtttgtcattgtgtgaggttcctagggtttaatctaacctaatccctcattgtctagcgtcgctgtcatctccgtgtgtgccgccggatcatcgttgccatctcctcctccccgatcatctaggtttggtgaggttcctaaccgtgatctcctagtttaggtttttaatttcctatttgcgtagtgggtctaatcctaattgtgccgccgccgctgctgcaccactgtcaagccgccgccgctgtgccgtgccaccgcagccgctagccgcagtcgcgccgccgctgtgctgtgctgccgcaaccactagccgcagccacccgctgccgagtgccaccaccgtgcgccgctgccgcccactgtcgtgccagccgctgagcgtcgccgctgtcccgcgctgccaccgctgccgccggttatcaccgtttgccatagtcgtatcgctgctagatcgtgacaccgccacttgtcgctcggtagccgagttgcctagccgcagtcgtcaacccgagtcgctaccggcctaccgtttgccgtaccgggtcgttgccgcaaaccgagttaagtctaccggtcttgccgcagccattcgctagtcgttaatcgttcgttcgcatgaagtatagtccaaagcctcgttcgttcggtcgtcccgagtcgttctttagttttagagtcgttctaagccatcagttccgttcgtcggttcagttgaccgtttgagtggtcccatgtcacggtgggttgactcattgagttgatatcccgtgaggcttgcttactggtgttgactcattgacttatttctcttaatgtgtaataatggactaaggtttttcggttaatagtaaatacacatctcatattctaaaattcatatctaaataatctgagctccgttttaatccattaaagttgcagtgaattcattaaaatatccaccacagacttatttgatgtattattgtatgctttgtttgtcgtttagattccgacagttccgacgctccagtttattttgaagtggttgctgcggttccgtcagctcaagagcaatgcaagtcatacatacaacattgatcatgttgaacctattttataaaatcccatgctttctattaaattgcattattttagaatgtcatgtgggatggatgcctatcgtactcagcctgttgatatcttatgccattgatagcttgggatataattgactagatgattggtttaggaatgcttagccatgcttagatcaattagttcataatgagattcactataattagtccttaactatatgatgatgtaccaccatggttaaggtttaattaaacaaaaatatgctttaatggtgggttgtgggtgtatggttttggaagtcgtgccatgacaattaaggattggttctcgggaatccctggaagatataaccgtacttatcacaggctagcgtgggctccaagctaaatctagagtataacttaacctagctgacataccatggcaagggtagaggcgatggtgaagttcagacctagctctggtctctgttgtttccgaatttacctaggcacgagaggggactgcccgacttggctaaaaaggagggggtgaaagctgaggtgggtatgttcggttagggagagttatatgaagggttttgtcacggtttctccctttgcagtatcgcggtagtcttcagcgcatggtaacatgtgtggaatcgtgtcttgtggataaaattgtacacctctgatcagagttaaaactattcgaatagtcgtgccggttattgggcggtcaaccagctcaccgtgattagtctcattcttaataatatgacttaatgaactggtgtagtttaggtggtttggttgggcctattgcaatgtggtttagcgttgggcagtgatattttaatattgcttaattatatattgttttactgtattcaaattatgatttataaatgctgcttttattacaaatatcttatggccattcctttgtgaatatcttgcatcataccttcccgttggtatgacttgttgagtacggtggttggtactcagtcttgctttatttttcctaatacagagacagagaatggttcacatggtgagttctatgaggattgagcttgttccggacattgaggatgcctgtggttttatggaggatgcaacgcttttggtcgtgaagattaagtctagattatttctttatttctgctgagtttgtaagcattatttactatttttgtaagatgtggatctgtttattaatttgtcgtttatgtactctggctggtcctggacagagattttaatacatattctgcttgaaattcggataatgaatttctgggcgtgacatccgctcgtgtgcctctcatctaacactcgatggaagtgttaacgcccaaatttgacacctaaacacgaaataggaaaacatggccagatttggaagtacccggtttccaccacgggaggccgatctgcccattgccttgaggctagtcagaccgcaggtatgtggtcggtctgaccagcggcatctggccaataagaccggctgagtcttactccgactagaatatcatcgggtcttggtttttcttgcttgggaaagtactttctaagttctaattggtctctaccttgattttaacatggaggaggtcttgtaggagacaagaccaacctctttataagggccaaggcccattcaattgagacaccaatctaattttaacacaattagccaattgaatcatttttcattatcacatctactttttacttagttctagtctagttttcatccatcttcatcggtttatgttgaaagccgtccgtccttgtcacgagagtgtgattacccgttcgtaggtttgttcaaaaaatattccgtttgcccatgagacgagtggttatccctatcccaactaagaagctccgctagctggtttaattttacaaaacccatcttgatttgatttggtttagttcgaggctgttgataactccgtaacaatgcaaagcattaggtgtcaacattaatgtgattgctcggcgtgacaaaaaaaaaagttgctaacagaaagcattattgccgattatatttgttacttcctccgtttcacaatgtaagaactcacgtatatttagatgttaatgaatcttaacatacatctaaatgaatggaggaaatactggaaagtcttacattgtgaaacggaggaagtacttgttttgcctaaaaaagatgtatcataggcgtatatatatgtttaaataaatcagctgaacatttgtcaaagcacgaatcacaggcatatacgaatggctgggctttcaaatgaatgagaggccacttacgtggatgcaagcactaggctgatagctgtgaggaaccaaaactcgttaatgggcaccgtggagacgaagccgccgaggaggaccaccgtcgaccacgtcagcgacaggtagcccacaccggtgacgagcttcccgatcactgcctgggttatcgcgacatcgttgatggtcgaatcagaccgctgatgactccatgtccgcggtacgctctgcatcgccgatcctcccagctcgctcctgcgattattcattccgccgcctgcaacaaattaagcagccagagaatcactgagaccaatgtgcatgccgaatggaatggaaccaagaggaaagacagattcaaaccaaggatatgatatgtacgacttcaaatgcttcacgaataatgcgcacaatagcttgttcggctccagatgcccgtaaggccgtaagtggggttacttgaaagggaaaatggtacgaatggttggcatgtcggggatattaatgctatcaccggcggacggcggtggcccaaacatcatatcgatgacactacgacaacgtagaggaagaaggaagaaaaagagttggaggctgcttttccttttgaaaaaatatatagtataatatattgtgctcagtaggccgacatgagttgcatgctgcaagcaagtaccttatgccatgcatggatccaatgcatgctttggtggtgatctgttcgattctaaacttgcttgcttagatttttttttgttagattctaaactttcgctttgctcctcgtatcggaagataatcaagtttccttctttatagccatccaacatgggcttgtccttggtgtcttcttttactgttggtcactaagctgtaaggttgtctttgggacatgggtttgggactttgggatatgatttcccatcccttaaagggtaagccatttattcttctcaccctatttcatactatgtctctattcatttccatttcccaatcccacctctcctaacccattttccaaacacaccctaaacacgttgacagcggatggacgcatgacatctaccgtaacagcaggtgctatcgacatgccctactatatgtaaaatcaaggagttgatttagattttgtgtgatgaaagcattggtggttttaatgtttcatgtgtgaaagattggtttcttgcgatgatatttcagagttatatagatgattgcttttgtgaagtgatgttgttgttgaccccgggtggtgccgccggtcagactggccagcctgacggcctaaccggcagattcctgttcattgtcggtttcaggttgtcttatcggttttggatgtttccttcagggatttgacttatagatggttcctatgcatatggataatattgttatactaatgtcagttaagttgggttcttggttgttgtatgtgcaggtgttgcttgaggccttgggagagtgttgtcggtgatagattagagttgacttgggagaagtagacgtctagagatcaagagatcatgcgggatgctaaaaggctggagaacaatgcacgtggtgatgaagaatccatatggtatataagagggattgtgtgtgtatagaaagaggagtcgaatttggaagggagtctaaatttgggaagattgatggagataagtaaagggataagttgtatacttgcaagagagggtttcccacgtggttgggagtcctaagttgtgttagattcgtgggctttgcacaacctacctcgtgtataaatagatagtgagggtgtagccttccagtatcggttttggagagacttgagttgagagaaagttaggatttcgagtttagttcgagattttagtgaggactactgttggtgcactttgtaaacactagttaatgcaataaagtcaagattcaatctacatctttgagtttatcatctaccagttttttctagtttccgacggtttaacagcaggcaaggtagcgatttgaccggcgagagtgcggcggtctgaccgcaggtgtgcgcacggtctgaccagtcatacaacgatgatctgatcggtgggtagtgggcagtatgactggcggtgacaggacttcgtcatctactccgtttgagataaatattttatttcgcaaaagattttgggtttttgtttccctaccattcaccccctcctcctctggtaggtttatttggtttttatcaatcctacactacaaatgtgatttctttgggtgggcaaaaccgatttgttgaggcgggttttaccgtccccctctgcaatgagccaacgactttagaaatcaatattttcaccggcggttcgacacctgcatttggaaattgatttttttttcacacagccctcttaataacaaaccgtatttaaaaatcgatttaaatttttaaatgtgattctttgaaaggaacacctaatagattgattttttttcaaacggcttggttaagagaaccgatgtgcaaagttctttttgccgaacaaat

SEQ ID NO: 45278 - DNA, 17616 bp, Oryza sativa
gaaggtgaagataaaaattaagtgtttagctaaaacgatgtgataataacgtgtgattaattgagctttaattattacaaacttgaaaaaggattaatctgatattttagaacaactttcatatagaaaattttcacacaaaatacaccgtttagcagtttaaaaagcgtatcattttaatccaaaaatttatcctgaaacgaacggggtcatgatttttaataaggccacacggttttcccaggcggttatgtaatgaggaattctatatatctatacaacttctcactaactgatacaataccgactctctcttttctgtgcagccacatcctatcttactataaaattgatatccactaacttttaaagctcaagatgcaattgtaccacatcatcatccattagcaattgttacctcgagtattttaaatgtcatgcaaacatgacatattatttacattttttttatttttagaacttaatatgcaagcaatgtcaaattattatatcaacatcattttcatattatttaaacatataaatctattatttctaaacatatataactactctctccgttcccataatatagcctatccaggcctagattactatattatgggacggatggagtaagccattgttaattattccagccatcagcctccgtccgatcttctttccaccatgcagctcaatcgtggcccagttttaatatctcggccgcaggcccatgttaccaatgcccaatacgtcctcactgttgaaatcctgcccataagcccaactctcctccgtccagtccatccaaagaaagggaagggaaccgcgtttcctcgccttcgtcctggttccggtgttgcacgccctgacgcgacgcggctctccttggcgcctcctctgcacagcgcgtcgcgtcgacctcttgtagtaccagttcggctcaggtgcagccgtgcagggcaccgcaccgcacgtagcaaggtaaccgcacgtaattatcatgtaacggaggtttaacgaagactaaacgtcaccagcagtggcggaggagtcggtatggcgaggtatggcgctcgccataccttgatctcccgcgggccgcactgggcaccggtgcggcggccgcgggaggcaggccgcagcccgcaggcggccagcgcaggctgagctgcacagcacggcaaaagggcagcagccagcaggcatccaggcagtgaggcaggcagaggagactatagtatactaatcaatctttgctatttactagtattttgcagtttctacatcactacatgtctatctatcctcactagttcgttcttacatgtgatgtattgttgacaactgcaatcttgaggtatttatgagtgcctcttctatttacactttttacaaatgggtgatgaattatgaacttatgactagtgcttattgccatgcttgagaattgagattgcgtcatataatttcgtgcattgggattgtttttttccctttcttcttgtcatgatctaattttcgtgctagttcatgggcacaccaccatacctagattttttgccgtcctccgccactggtcaccagtcatcccgttaacttcttttctcctgattcatcttccttttttcttatcctcttcttactccaatactcctgcctttctatgttgaactcactgaagatctataaacacacatactacctgttgtagatcaatactgtgttgaaaatatggtcataaattggtatttttaatctagaaaatttgagtaataatcatgacattcatataagaaagcgatcatggtgataaacatgaaaatgctaaagagagaaaagcttctaacaacatgttcagcaccaatagaagaattgagaaatacttggagaacgctccagtggatgacaaagcaattgtattgtctccattggtgttgtcgttctcagtgccgtctcttccagcaatgccactgtcgtttcctatgcttccaccaatagcaccagtaccagtgttcggcatgttgatgtagaggaagaagaggccgacgaagaggttgcaatgtagtcgaggaagtagaagcagatcgggaataggagcagtcatgcccagacactcctaaaaacttgatcgcccacctacccgtgcaggtatgcaagcggacggagttctggaggcacctgctcgtcatgagcaccaatacgtgcaggtgatcagaaccggggacgtggtggctacacatgtacagagaaggaagagttcgaggagaatcaagcaagagatgaactgagcagaatgggatgagcccttctatctgtcctggtgggcatttttatactgcgcaccaacgagtaacgttcaggagtaatctcaaaatcaatccgattcaattatatggttaatagcgaaatcaagtcgcttgttagtacagaattaatcagccgttgcaaaacgagagagcggccacgcaagccaagcctcgtcctcgccccggccgacccggatcggcacgcgcgtgcacgtgtagcagtcctaccaccacctcaattggtcaatatgggctctctaataactccgtatttaagttgagattttttcacttgaatttctaaggtggtattaatgctataacattaattgtgagccaatgaaatttactggaaataaattgggcttagcctatttattccaacaatccctactaaatttcagggctcacaggaaatgttctcagttctgcacttatttgttataccagtgtttcggtggagactgttaagttgaacttctacctagaaaaggagatacaccagaccgcaactgaacaatgggctataccttgaattattagtcttgtgtagtcaggctttactcaactccttaactgatactaggctaccatttgcgtcccctatgttcaaattccaagcctttctctggagatcacgcaaacatcatagactgtgactagcagtcgaacttatatagttgtgttgcttgtaagatgttttgtaggacaatatctctgcctaagaaaaccacacggatgacattaaggtatacaccatcctgccgtacagaaaaggatagaagtacatcatagagatggacccatttcagggtctctcctcgcagtcactcaatagtttgttttgtcatcctaattcacaggatatccgatcacataagataggttatcactattgtgtaactcaagtgggtcttaagtccatctccctcgatgtattatctatcacattacgtgatagtccctaaactggtctgccaatttttagctatctggacatagtctaacgctatcactcctgagtttttctgcttgctgacagatttcagtcttctttttaaatgcctaaatgacttcatattgtccttcgaactgttcaccttaataatcaatgtttgattatcacagtttatcaggatagctggtactggtttttcaaccaccggcaaatccatcaggagctcaagaaagccactcggcctcaatcgtggcggtgtctaatattgtgagttctgcttccattgttaacctcgttaagatggtctgcttgcaagacttacagaaaacaacgccaactccaagtgtgaacacatatccacttgtggtttttctcatcagcaccatatgtcaagtttgaatcacaataaccctctagtacttttgggtacctagtatagtgaattccatagcccactgtgcttttaagatagcgcattaccttttccagagtattgccagtgatcatctcccggatttgaaataaaaccggctcatcttgctcgtagcaaatgagatgtgaggcctcgttgcactagccaaatacattaatgaaccaatgatttgggagtatctgcaacattccggcacagggcttaataggattaatagaatactcatatcaacaagttgtaacttcttttccagaagccgattttcaaagaactccagggttaagcatgcttggcctgaagcaatttaggatgggtgactgaccgggaaattcttcccgagtgaggacaaagtgtgcagaaaagacatgtgttggtctgtgagggtgaccgggaaattcttcccgagtgaggacaaagtgtgcagaaaagacatgtgttggtctgtgagggcaatctatgacctatgaaagctgccagatgtaagcgggcccggcctaggagaggcgggacgttacagtatctcagttaatcccatgctattctttgtttttccttaatagtacactaatatcgtaaggagtatgagctggctaagactttctccacatagtgagattgcacaaattgcaatctcaccctcatcgcaacttgcagcctatttggttgcctgtaaatgtcttggagccaggacgagtagatgcaaaagtgccccctcagatatgctaagtaggaacgggcgaattgagcttcgttgcttgtcctggcccaacgcgtgcagcaacgctgcacccgcacgtgcacgtattgcagccgcgtgtgcaagcggtgcgaaggggtcactggtcaccaccttgcccctttctcatttctccccgaaaacgaaaaggctaggttttgttgctgctgcattgctcatcgccgggctcgacctcagctagattcgagaggaaggagatgggcgggaggaaggagaagactaggagaggattctagatttggaagctcacaatcgaccttgtctcgcgatcaccgatgtcttcccccatccattccttggtgtccgcgctattgccacataatccctttcgcatctgacacctccagcatttcccgtcagatctggttgccacgacggcgacggggcgagcacagcaacaaccatcgcgaccaccacgacggcggcgagcaacagcggcaatcatcgccaccacgacgatgacagggagcgacgtgtcggcgcgactagagagtagtggagcaagacgtgcagcgagcggcaggaagtgatggatgcggtgattacgacgatggtgagcaatcgggctcgccagagcaggctgccagtgggggtcatgctcggtggcaaggagtgcgacgggacgcgagagcgctttttcttttttttctaccgttctcattctctaagcccgtaattagtcactaatataaacctcgttcttttctccaacaaaaattggatactcgtggtacgtttttcaaactgctaaacggtgtgtttcgtgcaaaaactttctatatgaaagttgctctaaaaatatcaaattaatatatttttcaagtttgtaataattaaaactcaattaattatatgttaataccaccttgttttgtgtaaaacatttaatcttcatctttatcttcatcttcaggagaaaagaacaccacccgtggttcgccactacattagctcaattgatgaattgttttactaacaataagaagattgatatatgaaaagttaagttctggatcatcatacatgcgtatcatacaaccaaccaaacaaattctcctctgaaccgtatctctcgtgcagacaaccaaacaatatctcatacaagccaggctagactaatacaaacaaccaaacaattggatgtgtatccccttaactaggacgagctcaatctggatgagaaagatgagccagactaaacagatacaatcaaacacactcttaatatcgaacattcgatttgtagaagacaaatgaaggaaaagggaaaagaaggaacatatagttatagcaacctggtaaagcgtcaattcaagtcaactcgagtcaaagtgctcggctacagtattactggtaccactaaaacaaaccttttcagccacccaaaaccatctaaaaacaccatcaaaacacaccaacctcgcttccatcgcttttccgctcgtgtcgtgtgaagcggtgaactttagccgactcctgactagcgactaccctcccactctctcagctcgcttcccttcctcgcctcgccggccaagaaccaccgcaagattcgccatggccagatcgccggagccgccgcgctactacgccgccgcgggctaccaccgcccctcgcccttctcctccgtggcggcgtcctgcgtcgtggcggcgctgttcatcctgctcgccgcgggcggcgccgcggctgcgctgttcctgctctaccggccgcaggcgccggccatcgccgtgacggccgtgcagctcccctccttcgcctcccgcaacggcaccgtcgccttcacgttccagcagctcgcctccgtccgcaaccccaaccgctccccgctcgcgcactacgacagctcgctccgcgtcgcctacgccggcggcgaggtcggctcgatgtacatccccgccggccagatcgacggggggcgcacgcagtacatggccaccagcttcaccgtcccggccttcgccgtcacctcctccgccaccgccgccgcttcctcctccccggcgcagacaatcaccgtccccgcctccggcccctcaccggcggcggtgggcgcggtggcgctgcagcaagaacagccgccgccgcagcagcagcaggtggcggcgctgccggtgatggaggtggactcgctgctggtggtgaaagggaaggtgaccatcctccgggtgttcacccaccacgtcgtcgccgccaaggtgtgccgcatcggcgtctcgccggcggacggccgcgtgctcggattccggtgctgaccaagaccaggccaagatctgactctcctccatttgcccattttggggttaatcggtggtgtcccctgtcaatctcttcagtgaattcgtgtcaaatttgtaagataagttagtttgatttgtaacttagaattcttcttctttctgtgatgattttctgagtgtgtatttttctcttgaatcttctcatctttggtagatttctgcagccttcttgttgtaattttaatagattttctaggtgttttcagagtccaggccaaagaaagatttggttcttgagatgttcagttggacaatttgttttgctaagcaaccatagtgaggaaattaaagcttataattacaatgtattatcaaaattatgttttggacttgtaatcttatccattcttgcagaataattgtgacatttttgcatcggaatcagttccagttagatgcttatgactttggatgcaagttgaaatattctcagaaatgcaagttgaaaatgttattctcgcatattcgccagattgagctgatatttagtggacatgattggacatttaaccgtgtctcgcggcagtttgctgtaatttactttagtagcctgaattgtttggtgagcataattgttggatcttgagagatcagacaatgataggatacagacgaggggagtggttagtgcattgctggtcactcacttgggtgatcactacactcactatagtgtcaaccatggagcacgtgcgagtgcggccaatcgtttctcatcttcatttactctggtaataataatcctacccaatgatcaaacttgttgattaaatcatacggtgacaagaggtacgatatttggatggtaatatctcttatctaaaagattagggattttacccataaagcctcttgtatttttggatggagtagtagtaacattcatgctgcctttgcaatggagaatttttttttcttccttctcatgtgaaattatttcattttttttcttttgattttaccactagtagtgaacacgtagccatgttagcacaataccattcaaaaccagttaatttttgggctaggggaaaaagtattgtaaacacaggctaaataaatattatttggttttgaagttcagtattggttttcagatttttcacaaaagtacatagctgtaaaatgaaaattttcatcttttctcaatttactcaacttttaatatgtacatagtgctgttaatcccattttttttaataaatgactacttcgttatggtgccatagaccctatttagatagggagtctctatcatatcggatgtttggacattaattataaatattaaacgtagactattaataaaactcattctataacactgaactaattcgcgagacgaatctattgagcctaattaatccatgattagcctatgtgatgctagagtaaacatgcgctaattatgaattaattaggcttaaaaaatttatcacgcgaattagctctcatttatgtaattagttttataagtagtctatatttaatactctaaattcatccgatatgataggaacaaagtccctggatccaaacacaaccatagtcaaagagattcctcacatgtgagacatgtgagtcattttccacttggaagtgtcacaaatattggacagaccatttgaacgtcggcatactacggcattgcatacgctcaattactattattatatggggttgctcactttcatgcatgatttattcctactaaatttcagcaatgataaattttaccagtgtcaatatttaataatgttgagatatttaagttatgtttggcttgctacttttatcaattttctgcgagaaaggctatagaattatcaaactttagtagtggaggctaatacgaacaaagtttagattgttaataccttatcaaatatttagtaaagctaaaatttaatcgggtttattttggtgatgaaatgaaccgtccttatctagtccatactaggatggggtctcccccatcccattttaaatgtagttgtagatttcgtgttcaacatttgaccgtacatcttatttaaaatgtttttcaaaataaatcatacgtaaagtactatttatactttatcatctaataacaatgaaaaaactaattataaaataattggtgttactaaagctcatagctacactaaaatgagacggggagagtagtactccctccgtcccataatataagtgattttgagttttttcttgcactgtttgaccactcgttttatttaaaaaatttgtgtaaatataaaaaatgtaaagttgtgcttaaaatactttggataataaaataggtcaaaaaaataaataataattttaaaatttttgaataaggcgagtggtcaaacagtaaaaaagaaaactcaaaatactttatattatgggacggagggagtaattactagtataaggcacgagacattagagtccaagaggcttgcaatgttgaggcgaacgtgtgaggttccctggcactgatgagagcaaaacaacaaaaagccatccatccacctgcgcatgtctgctgcccaccgctaggcagtgggcactggcaaacgaaccttacaccgagctgtacctgtacggcttgtacgaatactgctagtattcgtgtgcgtgtaaccttttcttacaaggcaatactacgtacttgtacctactgtccgtagtggaggagtacctgttgtggttgtagctcttgtggtgatgtgccgacatgccgtccgaacctgtaactgcgttgtgtcaccgctgcagtcaacggcggagcagctcagtagaggacaatgactgcaactctgaactctgaagtgcctccagtgcatcgaatctttggctgcacagggcaagggtataaatttaaaattactatgtttggggatggagttagtacgaaaattcatgtaagacggtttttttaaaacataatataaaatatatatcgtttctatcttttggttagtaatagttacatataaactttaattttctaattactgtcaacgtcaaatttacgttaataaataattaaatttatagatatagtaaattcccgacagctgctttcatataagtaatattcatttctggccattttcatctctagcgtaaagcactatgttctactgcaggaatgcatctatccatagatcttggtgaagattgtgctgggtattgtatttggaacttactgtgcagtttctgtctgcacagtgttcaaaagccgggatcgtatcccatgaggccatgttcaatgcgtagcttgaactcgtatccttgctcatgccgttcatctcccgtccactagccgtgccactggagggaggtgcgatcctcacgaggggaacgggtgcctctacctcctccaatcctcttttcttgagccacgaatcgatgctaccgttgggcgatctcggtgccccgtcccccgcctcctccccctactttttcccttcttgcccctctcacctctgcatggtgaagcggagccaacggtgggcggagtcggagtaggccccgcgccctcgtcggagtggtggatggtgacgggcagcaggagagagagaggcgacgtcggctagatccgaccgctggcatgccagatccggctgccggcatgacagatctgggagagaggcagtgaagagaagcttcgacactgtcttccacccgctcctgcattctcgcgccgtcagtcacccgctactcgctgtcggccaccccacccctcgcgccgctcgccgtcgaccaacgcgtctgcgcgcggctctccgttggccaccacgcagagacgggcggcggcggaagcggaggagacgggcggccacgagaacggcagagacgcgcggcaacgagagagagggagagaggcggcgatgaaagagaaagagagacggtgacgaaaggaaaaaggcaaggaggtggagaaaacaaaagaagaaaaggctaaatagaaaaaggatagaagaggaaaataactctgtggctttgtgggctgagacacgtattgtgggatactagtaccctcagattttgtagaaccatttgagagtatcctttattgggggtagagtttcctatatgtggctttagacagtatagcctacgtaaggctactactacccgtgccttatattgtagatgccctgagttggaatggcggagagctacagtgccccatgtcattatctatttacagcagttgtatcaagtttggatgcacgagatcaatcgttacaacagcctcaaaaaattaatcaaacaatatttatcactgtacctatggcatagcatgtaactctcctcacatttcataagtgcgcctttgccattcttccctagaggcaaaaagaaatgcttattgctaaacttggtaataaggtgggcccaagaatcagtggtagtagctaatacatatgccacaatgtgtgaatgcaaaaggtgaacataaggtatgccccgcaatagaaaaaaagaccaatccctagcctcccacaccctgcacctacactattcactgtactaataatatagtttagtttcttattgctggtagtagccatactacctagtaattgctattgctagctttcacaatgtttgttcctaaatagtaaggttattttattgcttactaccagcctctatgccacattgtggttgctcttagcagaagatgcgaaccctcaaaagccaccacggattgggatcctctgtattagagtacaaaaggcacaggtagtaaattaaattatgagaaatctgcaccatcccttcacaatcctagggatatgatcaacctctacaatataaatgtgacagtacaagctgaaaagtgaagtattgatgctacagtacctggctgatctgaaccgtttgtttttagggttttaatctgagtgctcaattgctactccaatacactgtagcgccttgccgtagcagttcagctaccacggattgggacttcagaagtttagatacaggccacatggccatgctttgttcctaggagtattttagagttccagaagacaaaaattccttacataccaataaatgttattctacgtacatggttattttagaccaatcttgcaagataaacaccagagattatccagaacttcagtctccttgcaaaactgtcctgttttctacctcaagaaagcaagaatacgaggcaggatgtaaacagcataagaacagatggatgacagacgtttattggccaacttgtgggattttcttgaattcgatatacacaatattactttacagtaatgttttacacctctaaaatttgcttcttaacatacaacagcactggcacgatcactggactatcgaaaacaggacatggcaatggataaaaataacaagccagccaaatagcaacaaatcgtttcatctgtcgtacgctttgctcatcagctacaaaggttcggtatgcaggccccatccgggttcgtctgttctttccagatacggccggtcaccctcagcttcagctccttcctgtcaccgccggagaagaagagtgccatgttcctctggatgatgaggccgtcatggctgtcccgcaccttccggtggctgtcgcggatgctcctaggggtgccttcccacaccatcttcctgccattaccaccaacctctaggctgtaggtgtagttcctcgcttcattctcatcccccatgaaacggaggaaggccatataaactggtgccattccaagctggaacgcctcgaaatgcaggcagaaatactgcccgaaacaatggaacacctgattgagaggaaagatcataagaacagtgtttgtaaataggtatccaaaaatgaatactatgagctattatagtacttactgttagcatccaggtcgcattctcaacctcgcgtggattagatttgacatatctgtggttgaatgtgcagccactgtgcatatcaactttgtggtcgtccctcaaatgtgcaacaaggaaaggaatatcaccagccacagcacattcagaaccagcataagggcagttatatggcctaaagctgcactgtgcttcatgctttatcttgctgtagtatggaaaaatttctgggcaacctaaagaacaatacttgcaaggaagctcgagtgactctgctactttctccagtgccaagcacctaatatcaccgagctcttgtctgcaggtagggcaccggttgtggactctagccttgcatgttgaacataaagtgtgtccattttggcactgtaaaaaaataaaattagtgacaaccaagtaacaaaactatgccagtagtacatattagatgaggcccaatatttctagtgcaacataatcgttatcgatttttctgtaaaagatgcttcgacagcagcacaatagattggaacttgtcctttggaatgtagttttccaaaattcgatacataaaaagtacatataatttagaaaaagaaaagaaaagaaaggagtgtacgcagcaacaggatttaaacataaagaatggtgaattcatctctggtatgtgcctagcacagctattgtagaataaagatcatacaataccgtgtaagagaacaatatgtgactctgtgagtactaccatatcaatctattgtgaggaaagacaataatgatcatttgccagataaattgttgcatacatatataatcatttttataggttcgagggaactaataagactgtagctagcagatgtaaatatatgcaggtaaatgaggcaaataagctgagttgacacaactgtatatgcatatattggatgatgtgtaccattcgacttaatgtagtatttggatattcagactagagggctgttcagcatagcttgatggggctgtggctgcagctataccaacagtaactagtataccagcgctgtaccttagtgctatggctgttgcagtgcacctgcagggctgcagcagcatgggctaccaaataggccctagatgtttagtagatggctggttgatgtactgtccatcattataattttgcatgatcatagtcctaattctgatcatctctaagcatgaacaacataagaacaccatcaaaacacacgcaacccaaactagattagctatgctagtttttttctcacaatgaacagcccatattgaaaattgaaatgtaccttttacatcaggtgcataccctcaatcatagtttcttgctcatctattacttcagatgcaatgtatataagacaatgtatgtcaccaataatcattggggaacaaaataaaattatactaatattgattaacaatgtaccaaactagtaagggtggtgatatggcttgccctacgacaaggaccaagaaagggtgcacagcaatcacatgaaagaactccacgcagtaacggaagataagataaagattattacttattagtgctttagggattcttttcctattttgttggcttttatcgtgtagttgttggcacagacagatggtacattattgattgctattttgttaggtgactattttgttaggtgacaggtgcttacagaaaaatttgtggcattgaatacacaggagttatctactctactcttctccacccatgaatcagagccttatagagttttagttgtaggccatcatgtggggagagatccgtaccaactgacaaatagcaagcatcctaccttgctagtagttctcatgacacaaggattggccaatttggagtacctcctgaaaagaagattgaatcttgagatcagtggcgtcttgaatcatgagatggagcaaaaaaatgctccactaactggccaattttgacagttctccatgcagcatcatgtcagggcgtcataacaatggtgaggctgtaacaaccggaagagcttccttagtatttgcctcactgtcatccattatcacctgcctcactgtagaagatgattggtaccttctagggtatcatgccatcatcacagctctgccacaaccacgctatggtagcaagggtgcagttgcttcgctgtgtcaatttagagttcttaatgtctagacacttagaggtgttcccttgaactgccatcattccttgaaactttgtttttcctcttccaacaacagtacaggtttagtgcatggtgccatgcttccatcgcagccaccttagtcatagctcgaggacaaagagagggtgcgtttagcaaagcagcagtcacagcaactcagtaagattcccatgcggcagcagaagataaagatcactagtaggcattatggccttgtttagttccaaactttttattcaaacttccaacttttccatcacatcaaaactttcttacacacataaacttccaacttttccatcacatcattccaatttcaaccaaacttccaattttggcgtgaactaaacacaccctatgtaaatttgttggcttctcattctttagttgttgacacaatatcataaccactacaattttataggacgtttagtatttgcagatcaagccatgcagtgttttcaaatcaagcaaagaattaacagcctaagaggaatcctacagtatcccattgccccatatcctcaatccttggaccatacctcaccatgtccatgatacacaagattatgcttcaattagagccctccaaaacattcattggctacagagaaatatatagaaatgattcaggaggccagagccagcaaggactgaaggaagaaggccaggctcaagggagaaggccagtgaagatgcagtgaccgctatggctgattgatatgctccatccacatcagcaagaagagctcagatcaaatggaccatatagaaaagacatgatagattgaggaaccctaaaccaacttgtttcataaaacttagccattgagggagatgaacccagtgcactgtatccaaattacaatggaaattagctatgcgacttcactcccttgcgttactatcagtgctacacccactaggacaaactaggggaaaaagaatatagttactaatcaattacaaggacaagttcatcctaaagaagctagcagaacaaccaacctatcaagtcgataaaatgagtgccagactaaccataataacaattaatcaggtaaaataaattattagcgtcttccatgggatagttgtctaacttctaacagaccacaatcttgtgtagttatctttagaaatccagctcacctccatcaagatgaatgttctcccttgttaatgcagtctacactatcactaactaaggtatcgaggcatcaaatggaagaattttgtggcattaaatttgcagcaagactggttaatcacccatttgtgaagggagcatctcaacgaggtcccaataattagaagaatcaactattactaacaacaagacagaacattgacatcgataagctaacaagtatgcaaagggacaattctttcccagtattccaaggcatttggagcttgggtaaacaacaaatgcaataaattatcgacaaaagggtccaaattaaccagcacacaaggaatacgatggacattagcgcgcacgaattcagatccaaaacggaaattacgtttcatttaaaatatttctcaaataaaccacatcagcaaggatgtctcacaaaaaaagcccccaaatcgctgaggaaaatagagtcgacgaaaccgaatgggcctaattcaaatccccagcctaagattacccaaatcgcacaacccaatcatatagaggggataatttccccaattcgaactgcatcaaattggcgaacaacacgccaattaactcgaaacgacagcaagctaccgcaaagatcccgcgtttgcgaatcgaaacccacaaatccgcacccaactgaatcaagcgcaagcccatttcaattcaaatccaggcgcgctacagaacagaacgtccccccaaatcgaaggcgcggggagagagagaggggcgcaaacccacctggtggatgggcgggaacatggagttggtgcatacggggcactcgagcagctcgtgcacgctggtggcgggaggcccgccgccggggcccccaccttcggccaccgctccccccgccgcgggggccccggcggctccgccaccaccaaccccagcgacattcgccttggggaacgcgcgccccccggggccgaccccgacggcgacccccgcggggaggtgaggcgggagggcgtggtggtggtggtggtggtggtgcaccgagccgccgccgtcgacgtcgtccacgtccatggacgagtccgggagggagaggcactccacgctgtccatgtccatggccgccggccgccgccgccgccgcagcacggggggaggatgcgcgggtggtgacgtgtgggtgggatggatggctgggtcgacgacgacgacgcggtggtggtggctggacacgggggggacggggtgtcgtcctctcccacctccgtgctgtgcgtggaatcggtttgtcacggcgtttgttggtttggggtggggtggggtggggtgggaggcgtgcgtctgcaacgcggagagatagcgagggtggttttcgacggcggtacaccgtaacgtcagcatgcgttgccactataggctacataaacaaaggaaacgaaccggtaattttttttgtcccgtcacatcgaaacacacgtaaatatttttaaaaaatatataattcccaaaaataattacacagtttgcgtatgagttacgagacgaatcttttaatcctaattgtgttatgatctgacaatatggtgctacagtaaatatttactaattatggattaattaggat

SEQ ID NO: 45279 - DNA, 2455 bp, Oryza sativa
atccatcattagcaaatatttactgtagcaccacattgttaaatcatggatcaattagctttaaaagatttgtctcacaatttacacgcaatctgtgtaattagttattttttcgtttatatttaatactttatgcatgtgttaaacactcaatgtgacagggtgaaaaattttaccggggatctaaacaggcccttattctatactactccctctgtcccaaaatataagggattttgagtttttgtttgtaacgtttgaccattcgtcttattcaaaatttttttgcaaatataaaaaacgaaaagttgtacttaaagtactgtaggtaagtcacaaataacataaataataatttcaaaaatttttgaataagatgagtggtcaaacattgtaagcaaaaactcaaaatctcttatattatgggacagagggagtaggttgttatattatgagatgaagaaagtgacaaagcatatgtttatatggcagagagataaagaaaaattaggttgctataatacgaaggaagtaacaaactactccctccatctacttttgataatcaatttttgataggcatatttcaatccaacaacttatcatcttaatgactttctcggatttaatgcgtgactctccattcttccacacaagattggctatatgggcatcgagaaatgtaaaatattaatgaatcgtagtactccctccatctacttttgatagtcatattttatcttcgcacacagaccaaggataaataattctacttatgatccatttaaacctgctactggttattggtaaccgtcttcatggtaactgttttcagagggtgtaaggaacgtgccaaactcagagatgatgacccccagaaggccgctgaactagccgggccaacatacttggtaactgacgattgcccggaaaagtacgaacatgggaaagcactcttgccggattgggcactaaacaaaggaccatgggagatgagaaggttacataccttctacatgcatgctagcaaaaaaggcttcggccatataactgctcgatcaccggcagattgtttcagcgccgaaggttacgtatggctagatttctcagatctccacgccatatatcatcaggataagatgaacgtcaactatgttggtgtttggtgcatgtgagtagatgagttttaattaattatatgaaaagtatgtacaatacaaatccatgtgattgttactaacaagcttcttttgtaggatgcaatacatggatgctaagaagaaaaaagaacctatcggcttctccaactcggatctgtcaaacacagcataccgtgaggctagcaccagggtcagaccagctgaagggcaagactccaaaagagatagctgaatacaagaagggcttgcacaaggagaaattgattactgtctgttgacgaaaaaatcgaacacaccggcctgggagatctgcttaactccagtgcaggtccaaagattggtgagatgtgagtgtgccagtcagtttgatcttgcaactgacaagatatgcaaatagtagatcaaaacagccgatcggctgacaagccgatggagtagttccagccgatgccgataatagtcgatgccgataccagccgatagcgatagggtttaagcaatcggctatatgtccaatgtagataatgatataaaggcaatcagctgacgacgatgtaataaaataacaatataatccagtataaaccaatcagcaaataatgatatgataaataagcatcgatccgaaggtcaaagcacacatcggcaggaggtccgatgtcatgaaatccacaagattagattaaacagtgaagcctttgttgtcatcggctaaatccaacttatatgtatatgcaatccttatgagccgatgcaacgtccagataaatcaccggctaaaaccccgatgaaacccttattggcaatcaagaagcaggctagagattatggttctaagcacgacttagtagatcaaacttaactgatgcagcactaagtatgaaaagaaacataatatctagacaatcaagccgttgactgagttttcagggtggtagatgtctaagctagtctaatctagcaacgcgatttagccgataccggcagaaaccctaaaacgagaagtagccgatagagctaaattgatatgctaagactagattaacagagacatatgataaataggcaggcaagtatatcatccaaaccagagtaatccaagaggtcgaatgtactgatgcagccttgaacgacgccgacgtaaacgatacaattgcctgggccggcggagcattggacttaccccttcgccggagatcgaacaccgatgcagccccgtgtcaggtgccaagtcccgccggatgataaaataaagtagaaaaggtaaaaggtggcgatgcgccgaattgtattga

SEQ ID NO: 45280 - DNA, 2237 bp, Oryza sativa
gactcatttcacacataggataggataattgttcctaagatgtgcacgagatgcaaagatatgccatcagctcaattccacttattttcttcaggtaaatagttcagacctatcattacctggtgcaacgcatgggcattttgctagtgcttgataatcttccaatatatgtacataataatctacctgcaagaacttttattaaataatttaaaaataatttacgggcaaattattattaaaatttaaaattttctacctatcttcgcaggcggatgttttttttttgcaggcggccactttctattttcgtaggcggaccggactagccaacgtccgcctgcgaaaactatcttcgcagacggacggccgccccgcctgcgaagatcggcgatcttcacagtcgtttgcttacaggcggatggccgccccgcctgcgaagaccgttttcggccgcttgcgataatgtttttcctagtagtggaagaggatatggatcaatcaaattcattcaatccttgtaataccggggcaagagcaaaattgatgaatttgtctttttatgtggctaataatatgtgcgaaaaatcaaaaatggaaactagcatttcttcaagcctcactagtcgggttgcaactcatcaatttttctcatcacaagactcattatgacagagataataaatgaactttataatgtcactaatcatcaacaagcagttataagtagctgcttaaaaaactgaagctccagtataataaactaccgtatattgtcgtcgtgcatttgcgtgaatttaacctccttctataccgaatgtgtttacatgttattttttttataaacatacgttgaggttcaattgtattttctgaaagtagttcgtatgtaaacaaagatttcagctagtgcaatagatatggctagggtttgtgctcatcttatttgtcagagtttccctccccctattcgctcaaccctaaccgtctttttcgcttgtacttgagccaccgctttaccaccaaatcaccaatcatcatctacattgttgcatgaccttttatcttcctatatattatattctatccattctctattttagcaaattattttatgcacatacttggatatataggtgttcagattacctatttggcaggaaaccgaagtacaaaacaaatggaaaatactatgcatatgacttgaacgtcgtgtgttgcatcactagaaaacagttgaaaaacgctatgggctttcgctgggaaacgttagtcatacgagtatcgtacgtatagcagccctcaacacatagatttacatgatctataataaataaatgttatcatggaaataaatagtttacagtaattatgctaagcttgtgaaattaccctaagaacagaatttcataattttactactcctctattcccaaatattgttggtttacatttgttttaaactacgtatcatacccataactatataatataagctgttttcagatattgcttttattctttccactgttttcgtatattgaaatatatgcagattcaaatcaacgacagccctagagttgcagtttttcttctttctatttttcttttcatttgctctgtctctctcccacgtatgacggtacgagggaggagctggatgtacaactgcagaagacccaaaaaggaaaaaaaaaacagttttgctgtccttttaccgatctgatcctacggcttcctccttgctttttttcctccatctgatggtatatatgttttttttgctgatcaggtagtgttttggcattcaccattcacttatagagattattagctcattctttacatgaattttatttcagttctgttatctttattctgatagttgaggcagaacagccctgatggctctattttcaccaaaaatatttaagcttttgagtgcattgttccagcattttattctccatagccccctggcagagtagcatagccaattcaagctcgtattctgaaagtccaaaacaaacattttagatgttggtaaatagattttaggaaaaagtatgaattaccccctgaaccacaaaaccggacattcttcaccccaactatgcaaaccggacgcggtggttttggtctacgtggcgcacgtgtggcagtccggtcagcattctatttataaaaaaaatatgggacccacctatcatactcttcctctctctctcacgggtgcg

SEQ ID NO: 45281 - DNA, 18674 bp, Oryza sativa
ccacgtccacaccacggcgccgctccacgggaagcagccgtcgtcgtcgtcggcagcgccctagtagtacccaatcctcctctcccgccgccaccccttctcctcctcaccggaggagctcgccttggatccctcctcctcctcctcactgtcggtgccgtcagagtcggagtcatcgccagtggctcccacatctccaccagtagcgccgccatgctcggcccccgaaacctccccaccctggtctctagcatcgccgctgccgccgtctccatcgtcctcacctccgccaccaccgcccaccgctcgtccgcccccgcgcacacccaccgcccatgcgcccccgcgcacccctgccgcccgtccgctctcgcacaccgccgctcaccagcagccgagcctgccgccgctcgccgctagttgcaccggctgtcgctcaccaccagccgcgcccaccactcccgctcgcgccgctacccacttcctgcccctgcatcgccccatgagagagagagagagagtgaagagagagtggggaagaggggaagtggagttatgacatgtaggtcccacattttttaaaaattagaaaatgctgactagattgccacgtgtacgccacgtaggacaaaaccgctttgaattggatcgaggggggtaatttgtccggtattgaaagttcaggatgaacaatgtctggttttgtagttcaggggggtaattcggttgaccgtgatagttaggggggtaattcgtatcttttcctagattttatggtcacatataacttcacgggtgcatggatatcaacgtatcactttacctcagagcatttagaaatatcgaatcataaaaaatgtgtgcgtataattttataacggggcgacgggggtgagaatcgggatactgctcaactcggaggacatagcgccatgatggcgttgtagccctgcgctcgcactcaggcgatatggagagagacgaggcgcatcgttattttttccatgtgtttggtttagggatgaggtgggatgggttaggttcattcctctttttctgggatgggatgaacctagtctctgtttggttggagggatggagcgaaccctattttttgtttagtttgagggatacaatgggtcggaatgattctatcccttgtttggatgggggattgttggcggctgttaagtgccaaatatataccgccaacacctgcataatactcaaataatagaacatccgacatagtgatagggattatttctaacatattccacgagtgttggtgttttttcgatgcaggacataaacaccgaggttgggaggaaaatcagactaaaggtgaggaaggagtatatccatacaaggatgggatttgaactttatcaaaatagcagagaatcaactcaaaattcacagaaatagatagagcaagctcagagggagagatgggctaaaggccagaccaggaggccccagccagggttcggccgaaccaatacctccaccgttagatgtggggtttggcatggacgctcctgatcactccttgatggcggttggagggcacttcgagtatttccccttccacaaccgtcattaactgtcctataaatagacttcacttcttcactttcaagacacactcccaagcttgagctgaattataagaggctctattgtactatttgtatactacaattaggaagagcgtatagtagaagacgtcagagaaattccggagctgtcggtaatcctctcctatttattttgttctgtttattactctgatattaatagcattatcttcctgagtaatatagatttatcttgtgagaatcatctcttggctagttcctaatcagcatacgggattattgttcactataatcaactaaaatatagtgatttcttttgtgttttataaacactaaagtagataataattgtttagatgtggtgtttaggtaattattatccagtaattgttgcgtatcccatagtacatttgaggtgggtgtagaggtggtgatagccctcaagaacacttaagtcctctctatccgggtacatactagagcgacatctgagaacagtgggttgccaatgcctgaagtattgcgttaggattaaaattaagcttttcctatgtttctcagtagaaaattctctgtatcctttgcctatcttcgcttggtatccttggatgaaccggaggaagagctaatcacacacgttttcctagatttgatacccttggaatactccgtagggaaagtgctacatcggtatatccgtgcgcttgcggattttatctgtgatcgtaagaaataccaacagggataaaggtgggttgtctagatagagacacctcctggtgaggttacatctctcatactaggtgattccccgcgctttgctacggtaattactaagcaatttttaatatattttttcgacaatcaagctaggagtaaaaaagaaaaaaaaatgaaacgtcagaatttatcagtacttatcatgaactgatactcgtactttaatgtggaacatgttgataagtatgtgttaaatattataaaaatgatagatagactagttaaaatatcatagaaatgatgtgagaggtgatgattggatatgcttgcatattgatttgtttaattaaaaacaaatccaattttcatccttcaacaggaaaacctgatacaacaggtccctcaactgtgaaaccagtgcagatgaggtccctcggcggttttgacggtggttttggctgacgtggtgcctacgtggcaaatttgatttggtcttcatctgacgtggcgcttacgtggcaatttgatccagaaaaataataaacttcgtgggacccacatgtcagtctcacacataaattaataaaaaatggtggggcatatatgtcagtcaaacaaaaaaagtgggacccacaagtcagtggtcccacttcctctaccttatccttccaactcccaacctctatcttctcaccagcgctctatgctctccccacatcggcgagcgcgcatagaggacgaggcgggtaggccggcggggttgccggcgcttgggaggacaggagccccatcctcgctggtggtgtccgcgtgtctctacctatgcgactgccaccttgccgctgatgccacgtctttcctcctccagatctggtccgcctcacccgcgatgggcgaagatccggcagggtcccgccactagtagtgtgacgccgacgaagaccaaggttggctctcctcctccgctgccggccttggtgacgaccacttcgaccgcctacccaacccactcctactcgtcatcttatactttcttcccccagatcacacgcatcgtgctcggcggcatcgtcaaccccatccaggtgctcgcccaaatactttcgctgccaactccacctctatcctcgcggcatctgtaccctcttccccctcgtcatcgtcctgctccttctctttgccgcggcgacgggctctctcaccgccgtgtttcacctctccaaggccgacggagcgcacctgtcgggcacctcgccatccgtcaagccgataaagtaggccttgtccttgtcacccagccatggcggtcgaggagcatctcgaagatgaggtcggggaccgggagctcaccgtcgcgtaggtatggcaggaggaagagctccatgagcatctagtcgcccgcttcgaacatgaacctcggcgagaaccccctgcgacctcgccgccgcccgcttcctctcccatagcccgtaacccgccgcgcgccgctccttctccccatcacccatggtgcccgcctccgcctccgctgctagctaggaggcgtcctcctgcgagtccgccaccacagcgtcgtcgcgacggcattcacgccgcaccccgctccatcagtagccgcgccgcgaagaacggagaaggaagaagagcagcaacaaccgtaggggattgaggatgacatgtggggcccaccattttttattattttgtggcgaaactggcaagtgggttccacgggttttattattttctagatcgaattgatacgtaagcgccacgtcagatgaagaccgagtcaaattagccacgtaggcgccacgtcagctaaaactgctatctaaaccgctgagggagctagtctgcaccggttttaataattgagagactcgttgtatctggtttctggttgaagaacggaaatcggattagttgacaagtcaagggaccacagatgaacttattccttatttttatgttgccttccgaggccttttaatcttccgggtgtattgggcctaatagctggaattttaattctaaaaacaaaaatcacccaagcagccatttttgcgcgacagaaatgaattcgcgggcctatttcggcccgaaaaccacccatcaaagcttgcccttacggataaaaatgttttttttaaaacacagtacaaaacgcaggcgctcacaacgtacgcacactcacccctatgaacgcacacacgcacaccctaccctatgagcacctccgaaagactaggcctcgctgtcgacgggtacgtcgcctaccactgaaagaataattagccgtaaatgcgagcacccgtgtattttgaatggatataaacatgcacaactctcattaacattcaactaattaaactgccgacccagaactcttttaacgcggttaaaatatttttctagttaacaatcggttagggatgggtttcatctcttttacggataagatcgtattttagacacggtttttacagataatttcccgagaccacgcgctcccctcgccgctatatatattttgcgttagcccttcatctcctcctcctccctacctagatcaccgacggaggtagttgccgccgccgccgccgccgccaccgccggcgaggaagaaccaagatgtcggcgacggaagtgatggaggagtgcacggagacggcgagggagcggcgggaggaggagcggctgaggaatgtgaacctcgacgactggctccccatcacctcgtcccgcaccgccaagtggtactactccgcgttccacaacgtcaccgccatggtcggcgccggcgtcctcggcctccccttcgccatgtcccagctcggctggcccaccggcgtcgccgccatcgcctcctccttcgccatcacgctctacacgctgtggcagctggtggagctccacgagccggcgcccggcggcgggaagcggttcgaccggtaccacgagctcggccaggcggcgttcggccggcgcctcggcgtctgcctcatcgtgccgctccagctcatcgtccaggtcggcaccgacatcgtctacatggtcaccggcggccagacgctgaagaagttcgtcgagctcgcctgcgacggccgctgcgccgacatccgcctcacgttctacatcatgatgttcgcgtcggcgcagttcgtgctctcgcagtgccccaacttcaactccatctccgccgtctccgccgccgccgccgccatgtcgctctgctactccatgatcgcgttcttcgcctcggtcctcaaggcccacccggccgccgccgccgccgtggactacgggttcaaggcgacgacggcggcggggcgggtgttcggcgcgttcaacgcgctgggcgcggtgtcgttcgcgttcgcggggcacaacgtggtgctggagatccaggccaccatcccgtcgacgccggagcggccgtcgaagaggcccatgtggcggggcgtcgtcgtcgcctacgccgtcgtggcgctctgctacttcaccgtggcgttcggcggctaccacgcgttcggcaacgccgtggcgcccaacgtgctcatctcgctggagaagccgcggtggctggtggcggcggcgaacctgatggtggtcgtgcacgtcatcggcgcgtaccaggtgtacgccatgccggtgttcgacatgatcgagacggtgctcgccaagaagctccacctccgccccggcctgccgctccgcgtcaccgcccgctccgcctacgtcggtaagacttcaccttttggatctaagattttataagatggtatactctcttcgggctaataatacttatcattttggacaaaagtgaggtcaaacattaaaatctctagttataaataatttataaaatatttgtctttgaaatatggtgactacatgtatatgtatagattagttttaaaaaatacttcaataaaatcatttattaagatttatatacatattataataaaaataatgattaaagttgttttttttaagatcgtgcctttgtctaaacgacaagtattattaatccgaaggaagtacttatgttgtatgagtgtatcaaaattttcaagaatttttcataaccgtttagatagcttttacactctctggagcgatcaaaacaatttaatgtgttttgatctgtcaactttgtgcagcattgaccatgttcatcgggataaccttccccttcttcgacggcctcctcggcttcttcggaggtttcggattcgcgccaacaacttacttcgtaagatttatttatatatccgatcaccattaatctccattaattaatttttatgttcttggttaatttgtttgcttattattatttgttcatgttatttaattagatcccctgcatcatatggctcataatgcgcaagcccgccaagtacagcctctcatggttaatgaactgggtaagtttcagttttcattacgctcctgaaaataaacaatcaaatcgattcttttaatcatgttgttcttacttcttaccgttcaatttggccagtgtttcatcatcatcggaatgctgctcatgctggtttcacccatcggaggattacggcagatcatccttgacgctagcaaatacaagttttactcttagtccgatccggcctagaagatgatagagtaggattagttgtcaaaagagctagtagtagtagtttttaagatttctttagcaatgcacggtgcaagttatcagtgtctagaagaccaggcatcagagatgtaatagagtgcctgagtttatctctattattattataaaaatttaagatgtttttatcaaattttcgtccgtcacatgtagtcaaattcaacccgtatggccgtattcaaagagcatgcgatttataatccacatccgattccgtttcttcccaccggtgtttttggttgtttggcagcacgagaaccaggcagtaggctgcgtagcatgggccactgctgcaatctcccacccaacgttggagaaaattgcaatgttgagactgcaaacatgggggcttggctgttttaacatttcgagtggatgacaaatggacccatctgtgtgtatgaaatgtgggtctagtgtctgtggggagatagaaaaaagaagttgcaatatatattcctcgtatcatttattaatatatatttttatttttaactgttagtgtgttactataatgttatcgttaaattttgttagattattcgtcttatttaacaaattatatatattattatttattttgttatgtcttgttttatcattaaagaaactctaagtcgatatggcttacactaaattttaaataaaataaatgatcaaacattattttaaatgttaacgattgtaatatagtatatcttagaatgtgcacatcaaatgtgtatatgactcaatgtcaatatgatcctgcttggatgagtcttgctatcttttttaaaatttgaaaacaaacatataaacagttgtgtcccggaacgttgcagtagataatttttttcattgcagacaaggtaacttgttaatcaaaatcaagcagatataacaggagttggaacagatacgattggattgggcggatcaatgcatccaataaacagatacgatatgttagattcgaaattttgcatttaccatttgactttattttaaatataattaaaatgcgattaaaattgtatttagggtaaaaacaaaattagcacgttgtattttaaatttgtactccacaaatatgcgatatcattcataaattactcccctcaccttattattaacgtgttccctgtattaatgaatattatttttctttccttattatgaggtcgatcttacctctagcaaggtaatagcgtgctttgacagttggatcttggtctaatggacggctggaaaaaaaaaacttagaacactttagataagtcctaacagaacacatcatggtctgaatagtcaatattccaggatgaattgtcgtgctatccttttggatctgggaagaccacatttcagccataagagcatgacatcgaacagaaataaatagcatccagataaaagatgaattactgcaaaacgaattaatggtggtgtaacctgcaactgtgtaatggttctcttttttgtttagagtactgtaaaattaaccaactagctagaagagttgagagggaaaccttcgatcggaggaaaaacttctacgattgtgacatgagatgagactacgatccagtaacatgctagtgagcggaaggagaatgcaagcaatgtttaacttagctcggtgatataaactcaccgttttctaattggatagtaaaagtggaatcgctgtcaccatgaggagattgctgaagacgacctgaccatgttgaaaagtgggagagttatcggggagtgtgcttaattgagagtgtacatgtgcctggctgctcgtggtgacgcgcgcaagtgcaaaggagatgttgcaagacatactgatcatggttaaactgactgttgtagaattggataagatggcatgcaattttagatcatggttaaactgactgttgtagagttggagaagatggcatgcgattttaggtgtaggagtgggggaatgaccctgcgcatcagtgtagggctgtaaaaaagggtcgaggctcgcgagcatgtctcataaaccagggccgaatctgagcccgaacaaaaactcacgaactttaacaaattgagctcaagcttctatcgagcttgactgtgtgtatagtttatattatttgttgaacttattgatttaataaattaatagataaatatataaatatatatatatatatattagtatctattcacacaagcatgttttagcacaatatgattattttaacacttttttactcttttattagtttggttgactagaaaataattatactaatcaagaaattatcatcaaaatatatattatactacttatgaccgagctcggtagttgagctcaatctcaaacgagctcgaaccgagcttgtctaaaagctcgaaggtgtaataggtgttggaaatatggtcataaatcggcatattttaatccaaaatattgagacaataatcatggcataaacaatgtagagtgatctagtgacaacatgtaacataaccagtagcatactaaaagcatcattcgcatcatgaacatagcagtaacgcagtagcatgctaaaggcatcatgaatatcaggaacaggaacatagcagtaaagcgctaacaacaggaacaggagaaggatatacctcgagaatggccctccgctggattgtgaggcagaattgcctccgttagtgttgttgttcgcggcatcggctcctggcgcaccacctccggctcctggcgcaccacctccggctccagctccaggcgcgctgtcacgcccagaaattcactagtaatttccgaactttttttgtgcataaaatcctcgtccaggaatcagccgaggtacacaaactgacaatttaatatacaaatccatcataataataacgtcacatacttacaaaagaaaagaaaaacagcagcggaattaacggtctagcgatggcttctgctccactcccacaagcagctcaactggggtataagccaaacgtcttctccttctggatcctttatcttcaactgaggtttgattgattattgcaagaatgagcatatgacatactcaacaagccacacagccaatatgcaagtgcacaaggattccaaatgatggcataatataggctcatttgcgaaagtagcatttagcaaagagttaagagtagtaaaatagtagagtaattaatcagaaattttaatcaacactgaacagcacacccatgctgtacaggcccaaccatcctgaacaaccatacccggctgaacagatctaactccaaaccaggagctaagcaaattattaccagttataatcatcaataattattgtgagaggtgtgagactaatcacgaaaaacattgctcaactcgcccataaccgcgggcacgactattcgaatagttttactctggccagaggtgtaccactgtacccacaagacacgattccgcacatgtcgccatgccccgaaataccaccacggcattgcaaagggggaaatcgtgacaataccctttgcacaacacaactcaaaacagtgcaccgttcccggatcatagtcacccccttataaacaaggcttggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgccatgagcacgaccttcaaaaccatgtgctcacaacccaccattaatcatattttaattaccaattaattatcataacacgattaaccatcgtgagctaccattaaatataaccataaataataatgtagtatatatgattcatcccattagtgagctaatgtttctaagcattgctaagcaattatatatatataacatttagctgaaccaaaccaatacataaggttcaagctaatcaattttattacccaaggtatcaaggaatagggcattcaatgcaaattggccataacaaagaaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgatcacttccgacgcactcacgaaccttcgcaacgacggaaacgacaaactaacacgcaaaacgaagaaaaagactaataaaaaccaaataaacagtacataaaaagtaaacaaacacgtaggtcataattttagatgaattatgagacttgaacggcctcattctgacttcaaatgaatttattatgaattttacaagattaaatctaattaaagcccattaaaaaagaattaaataaatttaattcaatttatggacaattttaatatgtagatctttattttagaaaaatttagcaacttgaaccacctgaaacggatctacggttatttagttatgattttccgaagatttaatctattaaaagaaattggaaaaagaggagatgatgacgtcggcatgacgtcatccatagcggccggttagggtttgcgagctcgccggagctagggcgatcggccgggactttggaggacaccttcacgaagaggacgacgagacgaacccaacggtactcaccaacgcgacgaacggcgacggacgacggccggcgatgacgcaagaggcggcggcggctcggttgaacggcggcgacggctctacggtggccggcggcgaagaaggacgggcggccgggcttcctcactccacggcgcacctcttggcggcggcggcaagcggcggcgacggcagacgcggcggcgcggcgcgaccggaggatggccggcggcggcggcggcttgacacgcgcggcgcggcggctaggaggcacgggagaggacgggagagggggcaaacgaaagagggcgacgaggggatgctttatatagcattagattagagagattggactccaaacgagagaaatcgatccaagaaaatcaaaactcggttttggagataaactcgaaaacgagtttgattcgggcaagatacccaaccatttgctccaattcttgaggggaaagatagaggagaacgagaggataaaaacccctcaaacaatcggaagaaaaggggagagattggggaggaaacggcgcggcaaggcggcacggcgcacccggctcggctcggcttggccggcggctggaggaggaagatgggtccgacatgtgggtcccacatgtcggtgacccgaggaggagggggcgggcggcttggactgggccgacgggagagagagagtgttgggccgaattcggcccaacggcttagggaggggttctttttgaactttttcaaataaaacaatttgtgaaatgttgttgcaattattaaaaatacttcccttgctcaaataattcccagaaaattctagaaaatagaggagcaagcatagtatttaataaaattttatctagctcatttttatgttgagatttaacaaattaaaaaaaaaatagatcttctcttttaagcttttaaaaatcatttctaataattccttttaaacaacaatttataattttaggattgtaaacaagaaaatcacttaacaattataattagatcattatatgattaatttaatatttaaataattgctgaacttctctttgtatgattaaaattaataattgagctccgaaaaatccgaaaaaaattccagagagtataattaaccatggagaatttaataaaaattaaatccatccatgctttatatttaggaaattttatttcccacctttaacttcacttgttaattattgaacatttcatataaattctattagtaatttattaaataatttataaatcctaagacgaaaatcagggtgtgacacgcgccatctcctccagcagcagcggcgctggaggcagcttcggctccaggcgcagacatggtgggcgagcagtcatgcgggaagcactcccctaaaacctgatcacccgcctacccggtgcagatctcaggcgaaggtgtggttccggaggccctgctccttccgatctctcgtgtgcgcaagcgatcagaagcgaggaggcgagagtagcataggcgtggacgaggaggaactagcacccgggaaagaagcaagcgattcattctgatcggactcgcggcctccttatctatcaggagagaggcagtcggcagtcgtgggaacgtgggatcatggacgcgccgttgcggaggcagtcgtgggaatatgggttcgtggttgcaaaagagtagcgacgtgacgcccgcccgcccgccagccagccagccacgcccacgccctcgccctcggcctcggcccggccctgcgcgcgcgcgtgtggctttccgaccctcacctcaaccaatcaacagggagcctccaataactccctatttaggtgcctccaataactccctatttaggttgagatattcctcgcttaaatcctgaggtggtattattatccttaacacttattatgggcctttgagatttaataggataaattgggcctagcccaattctaacaatccccaccaaatttcaaggctcataagaaatgttctcaaggttgtgcctgtttgatataccagggttttggtggagactgttaagttgaacttccacctaggaaatgagctacatcagaccacaactgaataatggactatgccttgaattgtcagttttgtgtgatcaggtttcactcagacccttgactggcactgggctgccgttcgcatcccctctgtttggagcatataagtcaaactccaggcctttcatgagtatctagagatcgcccaaacctcatagactgtgactagcagtcgaactcatataggtgtgttcgttctgagatgttctgcaggtcaacatctctgcttggaaaagccactcgaatcacattaaggcatgagccatcctaccatgcaggaaagaagagaagtacatcatgaaaataagcccttttcaagggtctcttctctcagtcacacaatagtttgtttcgccatccaaattcacgggatctctgatcacaatggacaggtttccactattgtgcaaccttaggtgggtatcaagcccatttccctcaatgcattgtctatcacattacgtggtagccccttggtaaactgatctgccagatttctagccgtttggacatagtccaaagctatcactccggagtttttctgcttcctaacagatttcagtcttctcttgatatgcctagatgacttcatgttgtcctttgaactgttcactttaataatcactgtttgattatcacagttcattaggatagatggcacaggttattcaaccaccggcaaatccatcaggagttcacgaagccactcggcctcaactgtcgcagtatctagtgctgtaagttctgcttccattgttgacctcgttaagatggtctgcttgcaagacttccaggaaacagcgccacctccaagggtaaacacatatccacttgtggcttttatctcatcagcatcagatatccagtttgagtcactatacccttctagtacttttggataaccggtatagtgaattccatagctcatagtgccctttagatagcgcattactctttccagagcctgccaatgatcatctcccggatttgagacaaaccggctcagcttgcttacagcaaatgagatgtcaggccttgttgcactagccaagtatatcaatgaaccaatgatttgagagtatctcagttgatcccttgctattcttcggtttttccttaatagcacactgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatcctttatttcaaaactcttggacagatagtccttgacctcctcaatcacattgaggctggtctcaaagatcaatatgtcatcgacatataagcacaagatcactccttctcccccaccatagcgatagtacacacatttgtcagcttcattcacgacaaagcctgtagatgtaagcgtggtgtcaaacttctcatgccattgcttaggtgcttacttgaggccatataaggatttcaacagtttacacaccattccctcctgaccttctagtatctacccgtctggttgatccatatagatctcctcctctagctctccgtttaggaaagctgtcttaacgtccatctgatggacgagaagaccatgagaggctgccagagcaagtagtactcgaatcgtggtcaagcgagcaactggtgagtatgtgtcaaaaaaagtcctcgccttccttttgggtataacccttggccacaagccttgccttgtacttttcaattgtaccatcaggcctaagctttttcttgaaaacccatttgcatcctacgggcttgcacccatatggatgctcaacgacttcccaagtaccattagacataatcgagtccatctcactatgtactgcttccttccagtagtctcgaacacataactgatcaatgctccacggaacaggcaatccgaagcctcgaacttagcctcttcctcaggagaaagaggtggttcacttcgtttgccccatgaaatatagaagcattgcaacgctgtcaaccataatagtgcacgtgctttccatctcttatagttagaaccatcaaaagcatatggtttcagtgcagcagcaaagccaactaccgaaaatgacctatcaggttttttggattgttggaaatatggtcataaatcggcatattttaatccaaaatgttgagacaataatcatggcataaacagtgtagggtgatctagtaacaatatgtaacataaccagtagcatactaaaagcatcattcgcatcatgaacatagcagcaacacagtagcatgctaaaggcatcatgaatatcagtaacaggaacatagcagtaaagcgctaacaacaggaacaggagaaggatatacccgagaatggccctccgctagattgtgaggcagaattgcctccgttggtgttgttgttcacggcaccggctcctggcgcaccacctccggctccagctccaggcgcgccatctcctccagcagcagcggcgccggcggcagctccggctccaggcgcagacatggtgggcgagcagtcgtgcgggaagcactccctaaaaacctgatcacccgcctacccggtgcagatctcaggccaaggtgtggttccggaggccctgctccttccgatctctcgtgcgcgcaagcgatcagaagcgaggaggcgagagcagcacaggcgcagaggaggaggaactaacacccgggaaagaagcaagtgattcattctgatcggactcgcggcctccttatctatcaggagagaggcagtcggcagtcgtgggaacgtgggatcatggacgcgccgttacggaggcagtcgtgggaacgtgggttcgtggttgcaaaagagtagcgacgtgacgccagtcagccatgccctcgccctcgcccacgccctcggcccggcgcgcgcgcgcgtgtggctttccgacccccacctcaaccagtcaatagggagcctccaataactccctatttaggttgagatattcctcgcttaaatcctgaggtggtattattatccttaacacttattatgggcctttgagatttaatagaataaattgggcctagcccaattctaacaataggcttatcacgagcttggctggagctcgagcctgagcagatgagcttgctcgagctcggctcattgacaaccctacattagtgactaatccatcataatgaacgagagaggggagaggtcagtcacggtgacttaactactctgttgttccattgtttggcctcatcattgatgggattgtaacctgggctttttgtcaatgttctttatcagtcttatggatcacgtaccacataaggcatacatttggtaatttctacatatagggccggctgtgttcgttagtatggcttcccaacccacacagcacaagtggaaagtccattagcacataattaattaagtatttgctaattttttcttcaaaaatggatcgatatgattttttttaagcaactttcgtatggaaacttcttgcaaaaaacgcaccgtttagcagtttgaaaagcttgcgcgtggaaaatgagagcagggagttggtaaccaagagttgcgaacagagccgggctgagttttatctctactttcccaactcatctacctcgtttttcacgcacatgtttttcaaactgctaaatggtgtgtttttttttaaaaattttctatatgaaagttacttgaaaaaaaatcatattaatctatttattttaatttcttttagctaatacttaattaatcatgcactaaacgctgcattgttttgtgtgctagagagtaaggcaagtttccggagtccaatccaacaattatgataacttatatgcccgtagtctacttgaaatccttgagttgtacatggaaaagggtttgcctatctgtataaatacaaagcctccgaggagggaagggcatcgaatcataagccatagccacaagtcacattgaatactagctaggagaacatccaaagctagccacagactccaagtcactacataggttagttcttgacaaaagctagttggtaggctagattaactagcttgctcccctcttggtaattggtgtgacagatctcgttgctatacatataaagggttatggctattacccacctcgggagtccgaaccaatgtaaaaactactctagtcacgtgtataccctggtatcaatgtcccctttagctataaaatactattgtcgggtccaacccttcgacacttttcatttcttgaggaaatatgatctaattgatcagatggctgaaaaaataatgttgatattaactatataaaaagagggattgcttctagacgttcagtgtttttcttttattagaggaaagatcattatatttgtcggtgatatgggcctaggggttccaagctcaggagagaaaggctctccccgtgggacacgtgtcataaattccctgaagggatcatgtccttgcgtggggagcggccgttttcccccctcggcctcgggcctcccccggtcccgaggggacgagccaccccgaggccctcgctcgggcgccgcatggccaccagacgagggcaattgggtgggcgtgaacgccgcccacctaatcacatctatggttagtagggcagccgccccccattgtatttaatgcgatagagcggggcgtgggacgtgcgcctgtgaccggtctgtgaccggttgatggatggatggaacagcggcaggcgcacccacgcccgagctcgtgtcaggcggcgtgagggcaggtatgccctgttccatcatgaatgatgggacaccctgtatccctcatctagttagcagctggcttgaccgaatggaatgtg

SEQ ID NO: 45282 - DNA, 15306 bp, Oryza sativa
gttccatcatgaatgatgggacaccctgtatccctcatctagttagcagctggcttgaccgaatggaatgtgtctaggtcgccggcccggtgcatgcatgcccacgaagttgcctttcattcaatgccgaatgacgggagatgtccccggtgtcagctagagagacttgatgggaaccacacggcagctggcgtgcgggtcgcttccggaccagggcacaagacgcgtattaaatgtagacaatatttgctctctcccctagggaggtctaacggcatgtgtggtatccccttggaccataaaaggaggaccatacctagcaggagaggggttggatggctagatccatgagccaaagcttgtctaaccctagcttgtacaccagggattcaggggctttctaagctcaggaaaatcatcatgcacacaggagtagggtattacgcttcatagcggtccgaacctgtataatcatctttgtctcactttcgcaagtagccaagctcctctagagttaaccgcttccccggccgaactcacaaaggggggcctcacaatcccccgctggagggaatcactcttcgacaatattgataatgaccaagccttgtcgagaaagccgaaacaaagtttgaaagaaagggaaaacaaacacacacacttgacaatatcataatgtttgcacctctagattactagcacgccaatttttggcattcactaacaacaatgtggcacaaatttcactaacctgatagttttcttacctatatatagttgactaaacaaccagcaagatcatttctataacatcgatgccatcatattaatcttagtgatccagccacaatatgtttgagtgtaggggcaaaaagggatcacatatgaccattgttggaaaggaagaaaatataatgcttgtgtcatatgactatgttgtagaagacttctctgagagtgtttaccccttcctctggaggtaaatcgagctggtataccttgttttttttagcacaccctctactttgacttttgagtagccctatggtatcggattgcaatgtatgcatccccttctattacgggatgtgccatgccacatgccaccttcaagtgatggtttgtaggggcacatgccacatgtacagagttcgtatagtgatgtcatccacgacataatacaccatgtctgattcttgagtgatgtgtctaagtgtccggtcttcctataggtttgatttggcaacgtgatactttcacagtttgaggtttctgatcagagatcatcaccttgcaactgctacacccacacatctagttgttataaaccatgctcgtggtcgacctcaccatgaaggttttatccatgcaagtaatcgaagaaattcacaagaacaagaaagaacatgatccgaattgtaggtgaatgattagcactcaaagttggggtttcacaaatcggacttgttaacggagaaaccgtggcatatggcgatagactaatataagcaaaacccaactctaaacaatgatggctactgaatatatataagttgggatgttctagggttaacctaagggcgaacaccccttaggcctagcccacgatacaattacaaggcctaaggcccacaacagactcggatttgatgagatacatagctggtttggattattccaaacaactcataaggaattttgacatgagatcaaaaacatatgaaggtatactccaaaagctaacaaacacgcactcatgggatccgagagtccttctaggttagttctaggcctatttgaagttgatgcttttacgaggcccgaacatgaatctaaatcatttagaattttatctcttcgtttttttgacccaaaagtgacgtggtcgcatggaagtagactgaaggactttatatggttcccaatcaacttgatcatctgttgtctccttatgcttgcttgtctttgccttatccacgcaaagcaaacctttgttaaaatataaaacaagtaaatcttatatagaaatgttgcacctttgctttattgatgtgtaatatatgcatggttgtatccaagccaataatgtcctcatcattaagggacatcaattgacacaaagctgcttcgcctcctgcatgatgcatttatatgtggtgatttattagttgaattggtacagatgacttggcgggattattggtgccagcaatttcttaattcaggtgggtagaaacacctcatatgtgctggtcttaagtgaaccggcacatatgaggatttacctatggggtgttctgtagtattggatctgacaagtctatcaaattctttggtagaatgtttagtggatgatccgaatttatatactccatacaacatccgctgatgaatccaatagcccaacccatcagctaacctagactcgttgttaatatgttctcacatcacgtatcagtcgcatgtctgcctccacattccgattcaagcacatagtgggtgatgcatcgatgcttgttgcttcacatggtgtcggctcaccatatgccattgccccttcttttgttcaacatatatgccaccatatgttcaacatctataggccgtcacgacttgatgtgaggatgttgtattgttagctttgctaacttttgcattgttgagttgatgttatattgagtgcatatacaaataacatccaacaattttaataatgtttcgagcagagtcgactctgcaccatttttacatatgtaaacaattcactcaacatctgcacactatcaacactcgctcccacttgcatacttcatagaaaaagcgatggaaaaagtgtaagtgaggtgttgtgtaaacttgggctatttccagagaagtgtacatacattttctacaacattgatgacatcgtataaatataagtgttcctaccacaacatgtacaagtgaaccattttatacaaagcgagggaaaaaatgtaagtaggtgcatacgttggcttgttctatagaagagttgtgctaatgcggattttggaattgtgggtgttgcactatttatgttaaccttctctgaccatattcactagatcctgtatctcctgcagtcttatttcctctgtatttaagtaggataacatagttattcttttccaaaattatttataaccttgcaaatccttgtgcctactgaatatgtaccttgtgtattaaatgtatttaagtaggataacatagttattcttggactagtagcgatacttttgtttatacaaaaaaggaagtttctcacttagttagttgaatatttcctatggttttattggagatgctacaaattttttatcataatttgttaaatttcttaatattcatttgtttgggatgatgtgttgatttaactgtttatatgcttttctttgatgagaaagaatcaataaaaaatgcatctatatactatataaaatatgtatggaccttgttctttttaagtcctttataaaaacaatgttgatttattttactaaaggctctggacaaaatttcttcatgacaggtgtatgatggttgtcaaagctgggaaacatcttttattgttcaagcttattgttcaacagaccttgttaatgagtttagtcaaacactcataaaagcacatgagttcataaaaatgtcacaggttatgtgttcttctctacttttgattcttgtacaatgcaaaatgaaacaatattttcaaagttgattttgatgtccttttttttcaattttaggtccttgaaaacactccagacaatgaagcttattaccgccatagatcaaaaggttcgtggacactatcaacagcagataatggatggtgtgtatctgattgtactgctgaagcacttaaggtaaatgtatattagttgttacattatttttctttagaaatttgagaaactttatttcctaatgaaaaatagaatatataatggaagtaaaactctttgattttttggtaaaaaaatatagttgtgccattctaattgcttcggggaaatattgattttgttatcttatgcctctagaagtgttgtacagatcaaaacaccaccctacgttcaaatagttaggtggctttgttttgtgttaattggatgactgagcggtctaaacgagccagttactaagaccaggccttcatagatgggcgagataggttagcaaaacatatagatcactggtttacaaacaagcccttctagattaacccttttacacaaagaaaattttgtgcatttatgggcttgccgcattgatgggttgccttgcgcattaagcataagttagaagttgcggaattacatcctacttgatgtaaaggtccaattctgcataataattggaggcgatagaattgttgctactgcaatgtcaagtgaatatgttttaactatcatagatgagtttaaagaaaagggaacatctactacctccatccaaaaatatagcaacttctagctatgaactaggaacacagttgtccagactcatagctagaaatgcttttattttggaacagagggagtaggtgttacagtaatatctctgaaactatcaaaataccaataaatgtgaattaaagaaagagatacatataggcaaaactcatatgcatagtaaaatgttcatggtgttgaatatcgatgccttcaaatttatatattgaatatgttatcacattgtagcaaaaaagtctattggtgtacttgcacaactgcaatgatgatacattatatttgttgaattgctaaactgtacaaacttttacagttcatcatttgttgattccaatatatgtacatgttacattttttttcctgctaatgcttgcttttttattctttaggccttacttatgctatcaaagatctctccagatctcgcaggagatgccataaatggagaaaggttgtatgatgcagtggatggcatgctctctttcatggtataacttgtacttgaattgttcgccatgttcatatatctagttttctgaatttatcctcccatctttgtcattgtttcccaaattcggacgaataagggaataatttgagcaaagaatactttagggacaatcttgtgtgggccattttatatcatatatggacatttagatattttagtactagcatataagctcacctattccgacaacaactctaagactaaacatttcacaacacattaagtgtaagcgacgggctatgtgtatgtgggcctacagctacggaaagggttgagttgatgcagattttgaagcaatgtttttctcatgtgttattagtgtaaattttattacatggatgattgtggttatggaccttttgaccatgggtttgtggtgcggtctgggacaagaacatccacccttaattaatagagtaggtgaatgcaatacacttgctcattagtggaggtatttgtgcttcaccggcatataaacccatgtgttgtcaccacaccacatgcaagtatacacatatgtgagctagaacctaccaatttttttgggttattgcaaattttggaagctgggaagttaggaaagtcattcaaaatatgttcaaaatattgatgtgtaactttgaccctatggttgttagggcccagtctatacaatacatgagtcatattttcttgtacttgctttgctgaaacattcctttatgcggggccaatattactgggacaagtgtaaaaaaaattgctcatatcttccttcatgcatttcgtaaaacatgagaaaatatatcctatgccattgactatgtcatgttctattttataccatcaaattttccatatattatatgctatccccataagtgacaacgaaaaaagttgttattaatgcatcagaaaagaccatatcgcccttcgtttgcagtgttaatcctcgcaaatcaaatttcatcttaagaaatagttccaggagcgatggtggtacactagtttcattaatccataagaaaagacttggtatcattgagttcaactgtcctcatagtatcattctttccccatgtaaaatgatacttttatatttttgccacgatttttccaacactcactcaggtttaattaatcaggtctttcctctgggctaaatcaacccctttagtggacgctaaacggggatggtataaaatagaagttaagggaaaacttgatgctatgatgtagaaccgtaacaaagtcgatggtgtatgatagatttctctatcaacattattagggaaaaattggtgttgtttgcagcagcaacatgaatatgatgttgcttacttctgcatatcggtcatatattgttgtaacttgtcaagtaattttagcccgggtaactaaggttaataataatcttagctacaaaagtgtttctcaactttctcatctcgaatttatgatctttgagcaaagtttaagtggcaaacaggagtaccacaatcactcatgcaaatatttgttaggtttaaattattatgcattttggtttctttgctaatgattttctaaattttgtacatttctgtcctctactaaaacagtgcaattcaagtggataacatttcatgccattgttttgatccctattttgtttcattgaagaataaagatggcaccttttcaacatatgagtgcgagagaactacacattggttagaggtaagtactatatagtcctacttcggttttaggtaattaaagtgataaaccaagtgcatccatcatatttaaatcacgtaaaaatgctcatataagactaagaagaatgaaaacccataagcaaacataaaacttcagctccatattacaaatgaaattataaaaaaatgatagggtttagaggtacttcttttcatccattcaaatttatttttgaggtaaaatggtctaattacaacataatagtacttcctagaccatttatgaaaacaataacttagtttcactcactacaataatagcttagaagcaataaatgggtctagttgttgcaaatggtatactccataaaaaagcattaactctgtggatgcaaactcttcttttgtaagggcaaaatatattttcattataaggatttacattctattgctttgccacacatccacctcatctaaattactacctccatttcatattataagtcgctttgacctttttcctaggcaaactttgttaggtttgaccaaggttattatcaaaatatatccaatattaaatttaatgatacgtatttggtgtcacaaatgttgctaaaattttctataaacctggtcaaacccaaagcagttagactaggaaaaaggttacaacgacttaagtgttatatctattgagaattgtccaaatgttatatacttgttttactgatgttatacttaagtgtacactagtctattttttaagagagaaatgtaagaatgctcttgattttcttttcataggttctcaacccgtctaaaacttttctgaacattattgttgattatccgtaagtgtgctctcttgtttgaagaaaataccattggtttcacctcacaacatgtgtagagagctaactcaactgccttgaatgaattaatagatctgttgaatgcacatcatcggtacttcaagctctaatcatgtttagtgagtgctatccagtgtaccgcaaagaagagattggaaaatgtattaaaaatgcttccaagtttattgagaacaaacaaaggaaggatggatcatggtttgttgttcttatttgttgctacatattattatttttttatgtttacaatcaaccgtttgattactttttaactatgtcacaggtttggtacttggggtatatgtttcacttatggaacattctttgccataaaaggattagttgctgctggaagaacatatgaaaatagctcttccattaaaaaagcatgcaactttattttgtcaaaacaacttagtacaggtggatggggagagacatacctttcaagtgaaaccgaggtaattcttaccattcattttcacataattgacatagttacctcaaaagttgtgaccaaatatatttttgcaacacatatataatgtttagttccgcatttttccttacatttaacaaatatatccatcgaatctaaaacaactaagaaaatgaagcagacctatataaatttcatttagttaagtgctaggtctggcaacataaaaatatctaacaccccactcatcagcctgcatgcatatgtaattgtagcaaacaaatgtaacaagggtgtcacgcccggaatttctatccaaaattccaaacgcttacatgtgtgtgaaccctcgtccaggaatcagccgaggcacacaataacaaattgataatagagtacaaatattactctaatcaataggcgaataaaatgtcattacagaggtagatagttcctctcaatcaataaagatctaagcagcggaaaataagataaacggcgcagacggctccacttcacaggcagcttgaccaaggctacacctaatcctccacaccttcggcaacattgtagaactcttcctctgatgaatgattgcaaggtgagtatatgacatactcagcaagccacgcagcaaatatgcaagtgcacaggataacaaaggatggcatagtagggtttcatttgcaaaagcagcatttagcaaacatttgagaatttagtaaaacagttaagtaattaaacaatattaatccaacgctatacaacataccctgttgtataggcccaaccattttgaacaaccatcccggctgtacagttctatctccaaaccaggaatataccattccaaaccaggagctaatcaaattattaccaattatagcatcatttactatggtgagaagtgtgaaactaatcacgaaagacattgttagacccgcccataaccgcgggcacggctattcgaatagttttactctgatcagaggtgtaccactgtacccacaagacacaaccccacatcatgtcaccatgtgcctcaataccaccacggtacctcggaaaggagttgtgacaataccccttgcataacacaatccaccgcagcgcaccttcctggatcataatcacccccttatagacaaggcatggactccccagcgacccccgtgggcttatctccgccacttctcagtctggtgccccgcaatgaaccatgctatacaaaagataaagccgttgcccacgctggcttgtggttggcacggttaatgtttcacaaccgaaactcgtgaaccggtccttaattgtcatgagcacgaccatcaaaaccatgtgctcacaacccaccattaccaggttttagttggcacattaattaattaaccaatcacgattgaccatcatgaactatcatttagcagggctaagcaattatacctaatatctagctgaaccaatatatataaagctcaactagtcaagttttaataacccaaggtatcaaggaataaagtaatcaagaacaaaagggctataacaaagaataggttaattccacccaatgacattcgaaaaaataaatgcaatagttgaaaagaaacaatagctttaaataggatcaacatgctcaaagggttgtttgggatctgtgtgacttgccttgctggccttggaactcttcaaactcttctccggcgaaaacggactctccggaaacgacggaatctaagcagaaaagagcaaaaacaccaaaacagcacataaacaagcatgaacagtacatgtggatatttttaacatgtagatctcaattttagaaaaatttagagacttgaaccaactaaaacggagctaagatgaattagttatgaatttttgaagattaaatcggattaaaacacttatattgattttaattgaattatgacgcaataatgaattatttttgaaaaggaaaaagggaattattgcgtcagcggctagggtttcgcggtggaccgggcgcacggcggcggttcacgcgaacggacggccgaaatcgatccatccaaaacggacggccgagatcgatcgggtccacggcggctcacgacgaacgaccacgatgacgtcggcgatgacgtcacctaccggcggcggtggctcggcggttcgtacgcgcaagcccgccggtgaacggcggcgcttcggcacgaacggaggacaccaacgggtagcggacggcacggcgaactcaccggcgaccaaagcgacggcggaagatcaacggacggcgacggcgacgaagaaagaacggcggcggtcttcgggtcgatggcggcgacggtgctccggcggtctccggcggcggcgaaggggtggacgaggacggcgacaacttggcgatcacgacggtggccttcccgagggacgacgacgaccgagacggcggcggcgcacggctggagcgacggcggcgacggcggagctagggcacacggcgctagggcgtttccgacgacgagaggcgaaggcgagggtggcggcgggtagaggagacaccggggatccttttaaaggggctaggaggcaacggcgaaggcccacggcggccggcgacgagaaggaaagttcgggaaaaacgaatccgaaacaaactcgaatccacgaatttccaaacgattttagccggtgtttccaaaggagaaaaggtagaggagatcccgaagatcatttcccctctattgattcggccggagaaggaaaggatcggccgaattggaaagcggcggcggcggcacggcgctagggtttcggccggaggaagacgatgatcccgacaggtgggacccacctgtcagcgacagcgcgctcgcgcgggcggctgcggctgcggactgggccggctgggccgaggagagagagaggggttttgggccgactttcggcccaaagccaaaagagactttttaaaacctttttcaatttaaattatttcttaaatgcaattccatttattaaaaatacttcctcaactcaaataaatcccagaaaaatctaggaattatagaattaagcaaagtatttaatgaaattttatctggccccattttatattggaatttattaattaaaattagatcttctcttctaggcttttacaataaattctaaaaattcgatttaaacaacaatttatatattttgaattttcagggtgtgacaaagggccaaatggtcacattgattgagcaatataattgtctttgttctgtgccctggccatagctgttaactagttaaagtacaaaacctatgtatgtttgcaggtcttgagaaatgcacttgatttttttcgtcaatccctgtcacgcccgaaaattacctttcccgaatgctagtgtattaatccttgtcccagaaaaagccggggtataccgcaagaaacatgatagaaaagacacatctttaataattatcatgatagtatttacactattttaaacgcacattaagcctaacaacgaaagataaacaacagcggacaagcgggcctacgactccatattcacagacgctcaactagggtttgatcctatactccacctaacacttcttctgcaaagcttctttaactggagtgggaaagattaaacaagaaagagtacaactactatactcagcaagccacaccggaatatgcacataatacaagggggtactaggagtaatctattaggggttaagttttttgtaaaaccatctttcaaatagttaaagtataatgcacatttcaaagcacgatactaatctagtcaaaatattaatcaagccgcacacctgtaggaacttgccttaacccagcccatcaggtcatagttccaagcaatccagtttaacagagtaaaatatctaacctggatatattgctaagcttgctagtaatgggcacacggagagagggcagagaggataaggatgacggaagagaggagatcggcttggcgtataggtggctcggtgtttttttccacatatgtgttggtttaattaaaaaccgagacgaatggtaattttataggattcaacatgcttagattatgatatgactttccatgctcaacgatacggattgccaagacttctatgacggatttgaactgcacaacagaaacatttgaaactactgcacctacatgaacaagaaaacaagctacaactgaatataaagacaacatttaagttataacataaattgagcaacttaaacgggccaatttggagctcgtatggctgagaaactacaatccaaaattatatgcaattcaagtgaatatttctgaactacttaattatgattataccattaaattatgtccaatgcatcagcgctcgaggaaaggaaggatcaagcgaccagtagccaagtcccatgggtcaaatggctagttcatcatacacataaatattcactgagacggtccactaaaaaagcagagtgagacccatgtgtaagcctcagagaagagaccaacaagtggatcccatgggacaccaaacaagaggccacatgcacaaacacgcggctatgcgcaggagggatgcactgaccggtgccggtggcccatgacagaggtcaacgatgcacagaagcatggcaaaaggcgagggcaatgggagggagatattggaaaatagatcctcgccacgaaaatgaagatgaccgaatagtgaggaggggactggcggtgtggtcttgaaggcgatgaactcggggcagcgacgatgcttcagcttgacagcgatgatgtagcttcggtgatcttctcgcttgctaaagaggcagacagtggagggcttggcattgcagacttcatgacgacaatgacagacgaggacgtcaacagttggcgcttcgacaaagcgggagagatggtcatggaagcttcgagttgacgactcacgtcgctcctatgggcttcgggtcatgaggaggtcaggctgggaactagctcgacaaggagaaccgaacgcaacgacggtgtagcgagatgatgcatatagttgtagagttcattgacgagtacaacccagcataatcgaaatcgtttgtgtgcttcagaagagagtcggggaggtccaaagtgcaacaagggtgagattaccctgtcaaaagtgaaaacatcggttaaagggtggtacaaaatgaaacatcagtaataaaatgtggcccaaagtaaaatttactctaaatttccatatgtgctagttggtcctaaataatcggtgaatcaataatcaaccaaacctgatctaaacaaaaagtaacataatgcacacaatgccttgaaattgatgtattggtcattctctctcagtcatgcattcacagccatggatgtcctagtcaacacgactttgtatttgcatgcagacacacacaagtcacacaacataggtactagcatatgaacataagtcttgataatgttagattacattcttttattgaacaagtttatgttggggctagtagatctcatgttgtgaacactgcttgggcaatgttagctttaatatatgctggttaggtgtgttttgttcattattcattttagtaggtactaattgtctattatattatttattgtactacaatgttatttcataatgcctcaatgaaaatcaggttgaaagagatccatcgccactatatcatgcagcaaaagaattgattaatatgcaactagaaacgggcgagtttccacaacaagtgagtattcaattgattaaatgattttctattttctttagcacaaacatgttcagtatatggattttctatttcttgtaacacaaacatacatagtcaataatgaattaatatactaactgcacataaatattatttttggattgctcatcacttcattttatttggattgttgttttggtatccacaagaatgaaatgggaaaaaatagaatcatcaagttatgtagtttgtggcctggcatttatggcatgcatgaatactctaccatccactcttgatagataatagtagtctaatattccaactttaattacaggaacacgttggatgcttcaacagctccatttatttcaattacagcaattatcgcaatttattccccatttgggctcttggggagtttcgtcgtcgattggttctacgaaagaactgagcctcataaaatgacataattatttgatgccgaacaaaagtttgaactatttaaatatgcaaatgttttaagtgtaaaaatatcatatacaaaaaataaattgctatctgatgtagcaaaactactgtggagattatggataccccatacccacacggcatgtatatccgactaggtataagggtaccatatttacatagaatatctttaaaggacttgggataaattcgtaacttgtgtatcaaggaaatatccgagatcctagtcggttacaattgtattttatctttacttgcctattccgttaggaatatgggttgtatcttgtaatacggacacctccccatatataaggaggggtccgagtgcctcttggggtataacttttcctctagatcatacgatcaataacacactcggcggatcaatccccggacaggagtaggatattacttatcattgagagggcctgaacctctctgatcccaagattaccaccagccaagcctctctgcacggcacaagccaagccttagcgttgctgcctcgggatccaatcgcaggagcagggatcatgcaaaatgctctgttcactcgccagctaatgaacatagagatcgccgcgctgagcagcctcactctccgcgtcgccggcaacccatcgatcttcgtgatacactcaatcaacgccatgcagaaagaggccaccaaccacactgttcaccaaatcgacatcacgacgacgaagttggcgttgtagcttttacaagcgacctgcgtcgagtggattggctggctagcttcaagccgactggtatcgagaagtatgacggcaaaaccaatcccgagtcatggcttgtcatgcccagaaattcactcgtaatttctgaacttatcacgcccagaaatttactagtaattactaaacttttttgtgcgtaaaatcctcgtccaggaatcagccgaggtacacaaactgacaatttaatatacatattcatcaaaataactaaagcatctaatacttactgaaaaggtacttagtcctcacaacgaagaaaactgtagcggaaaaataaaatctaacaaag

SEQ ID NO: 45283 - DNA, 8586 bp, Oryza sativa
caataaaaaagtagaataatcatcaattctaatcaacactgaacagcacacccatactgctcaggcccaaccatcctgaacaaccatacccggctgtacagatctaactccaaaccaggagctaattattgtgagaggtgtgagactaatcacgaaaaacattgctcaacctgcctatgaccgtgggcacggctattcaaatagttttactctggccagaggtgtaccactgtacccacaagacacagccccaaaacatgtcaccatgctctcagtaccaccacggtacctcgaaacgggattgtgacagtacccctcgtacaacacaactcaccacagtgcgccattcctggatcataatcaccccctcaataaccagaggcatggactccccaacgacccccatggacttctcgccgcttctcagtctggcaccctgtaatgaaccatactatacgaaaggtaaagccattgcccacgctagcttgtggttggcacggttaatgtttctcaacagtaacattgcagtcatgagcacgtccatcaaaaccatgtgctcacaacccaccattaatcaaattttaattatcaattgattatcataacacgattaaccatcgtgagctaccattaaatataatcataagtaataatatagtatgattcatcttattaatgagctaatgtttctaagcatggctaagcaattatatatatatatatatatatatatatatatatatatatgatttagctgaaccaaaccaatatataaggttcaagctaatcaatttattacccgaggtatcaaggaatagggcattcaatgcaaattgaccataacaaaggaataggttcacaccacccggtgacattcgaaaataaatacacagttgaaataaatagagaatttgaatataggatcaacatgctcaaaggattgtgtttgggatctccttgcaataatcggtcttcaattagtcttctgaacaacttccgacgcactcacgatccttcgcaatgacagaaacgacaagctaacacgccaaaccgagaaaaagactaataaaaacaaaatatacagcacataaaaataaacaaacatggagatcatgattttagatgaattagagacttgaatggcctcatgtgaattagttatgaattttacaagattaaactgattttagccttatacagaaaaggattcacgatttattttagaaaagaaaagggctttatgacatcattgatgacgtcatcaccggcgggaggctcgggttccaacgtttgccggcaacctagggcacgacgtcgcgaaccgaaggcaccggaagaaagagcacgacgaggagaactcactgaggggcggcacgacgacgaccgacgacgggagacagccggcgacgaactccgaagggcggtgaggtactggtcgacgatgacagcggcgttccggcaatctttagcggaggaaaaccagtggacgggcttcaccttggctctgcgatgccgaagaaagcgacgacgacgtccagaaaccacggagtcgacggcgaggctcggccggaggtggagtagatcggattcacgccgtcgaggggcttccagcgggttacggcgaaaaggaactagtggccgggcttcttctcctccttgcgaacccggtggtgatgacggcgaccggaggcgacggctacaccggatgctagggacggctggagcggctgccggcggcggagagagaaggcggctgcggggagagacggctagggaacgggagctcgagctaggggttggaaacgaaagaggaggtcttgggggttctatttatagccaaagctggaggagatcggctcggacccgagaggatttggcggcggattggttaaggttcgccggttcggggataaggtttatccgaccgatttgaactcgaatcaaagggataaaatccgattccttagaagaaacggaagagaagaaaaagggaaacaaatcccctcaactaattctggaaaagatcgaaaggggaggccggatttggagggaaaagcggcggctgcacaggcacaggacggctgggtcgggctctgtctggagctggaagatgatactgtagcgcgggggaagcaaaacagattttttgctgggctaaaaacaaaagaagggagggataagaaatagacttccccggaagacaaagagacaggaagcaggcaaagaggaagaataggccgaggataaataaatagacttttccagtttcagcccaaaaaggaaaagggaatttaatttactttttcaaataaattaaccaccgaaatgatctttgaattgttaaaaatacttccatttcccgaataatttcaagaaaaatcatgaaaccaattggacactcaaaatacttaacaagattataatcagaccatttaatgactaatttaatatgtgaataattactgaaatgttctttgtatgattaaaattaagaattgagctccgaaaaatccgagaaaatttcagagagtataattaatcatggagaatttaataaaacataaatcctatatttagaaaattttatttcccacatttagcttcacttgtaaattaatgaacattcaatataaattctaataataatttattaaataatttataaatccttagacgaaaatcaggatgtgacacggcttaccgtctacggcctcgcaatccgcgcagcaggaggagacagtaaagctatggcaaattatttgccggcggcccttgctaactctgcccgatcctggctccatgggttaaccagtggtacaattggatcttgggcagagctccgtgagcacttcatcgccaattttcaaggcactttcgaacgtccgggcacctacttcaacctctacaatgcgatccagaagctcggtgaatcccttcgggactacatccggtttttttctgagcaacacaacaagatttcaaacatcaccgatgacgtcatcatagctacattcaccaagggtgtttgtcataagctcttggttggcaaatttggacgcaaacctcccaggacagttaagcaaatgtttgaaaaagccaacgagtatgccaagtctgatgatgccgtcaacgcctctaagcagtcgagcatcaattggaagtccaagaaagatacgccagccgtcagggggaatggaagtaacaacaataaggatctcaagcgtaagcttgaagaccttgtggcacttgcatcaccatcttcccgacagcgttcgcgtatcaacacttttgacaaggtcatgaacgcccaatgttcacatcatccaaattccaaccatgcagccaaagattgtttcatctacaagtagtttgtggagcaatacaccaagcaagcaaagaagccgacagatcgggagcaaagaacctcaaagaagaaggatgacgaagacgatggtccgactggttttcaagattctcgcaaagagctcaatcctatcttcggtgggccgcaagcttacgagtccaagcggaaacaaaagctgactgatagggagatcaacgtcgtccagcccgacacgccacaataccttcgctgatcagaaacaacaatcaagtttgaccgctcggatcatcctgaccgagtggtccacctggggcggtatcccctggtactagacctggtggttcgcaatgtcaagctccgacgatcactaatcgacggtggcagtgcactcaatatcctttttgacaaaactctggacgatatgtagatcccgcgcactaagctgaagccgagtagcgctcccttccatggaatcatcccagggctgtcttctactccactcggccagatcaccttgcctatcaccttcggcactcgggagaactttcgcacagagaatatttgctttgaggttgctgactttgaaacggcataccatgccatactcggacgcccggcgttagccaaattcatggcagtcccacattacacctacatgatgatgaagatgccacgacctcgaggagtcatatctttgcggagcgacatcaagcaagccgtcacctacgataaggaaagctgtgagatggcccagacccgtgagattgcacttgctcggaatgagatccgactggctgcatcaaccgcaaccgaaggagaagtgcttgtgaccaagtcaccgaagactggagaaggcgataccaagaccaagaaaattcccctagatccatctgatccatccaaaactgttgtaataggtgctgagttagattgtaaataggaaagcacgctcatcacctttcttcaagctaataaagatatttttgcatggaaaccatcggatatgcctggtattcctagagagatgattgagcactccttaaatgttaaagaagatgctagacctatcaaacaacgactccgccgtttcgcacaagacaggaaagacgcaatcaaggaagaattaaccaagctgttagcagcaggcttcattatggaagttttacatcccgactggctggcaaacccagttttggtttggaagaagacaggacaatggcgcatgtgtgttgactacatcgacctcaacaaatcgtgtcgtaaggatccctttgggttaccttgcattgaccaggtggttgattcaacagccggctgtaagctactcagctttttggattgctactcgggttatcaccagatcagtttgaaggaattcgactgcttgaagacctcgttcatcacaccatttggagcttactgctattcaccatgcctttcggattaaagaacgctggggcaacctatcaacgcatgattcagagatgtttttcaactcagattggtcgcaatgttgaagcctacgttgatgatgtagctgtcaaaaccatacaaaaagatgacctaatcgctgatctggaagaaacctttgctagcatctgcgcttttaggatgaagttgaatcccgaaaagtgcaccttcggagtatcgtcagggaagccgcttggctttatggtgtctcgtaggggcatacaagccaacccggaaaaaatcaatgacatcctcaacatgaaaccgcctagttcccagaaagatgtccagaagctgtctgggtgtatggcggcgctcgaccggtttatttcaagactcggcgagcgggggatgccatttttcaagctactcaagaagactgacaatttccagtggggacccgaagcccagcaagcttttggtgatttcaaaaaacttctcacaactccactagtcatggcatcaccacatccgcaagagctgctattattatatgtgtcggcaacatcgcaagttgtgagcacggtcttagttgtggaccgagaggaagacagccatgttcaaaaagttcaacagccaatctactttgttagcgaggtcttggccgactccaaaacaggatatcccttggtatagaagttgttatatggtgttttaattaccgtcaggaaattatcccattattttcagagtcacttggtcacggtggtcacatcgtttccactcagagacatacttcataatcgcgaggcaaacgggcgaatcacgaagtgggccctagagttgatgtctttggatttatccttcaagccacgcacttcaatcaagtcccaagccttagcagatttcgttgccgaatggactgagtgtcaagaagatacacttgtggagaagctggagtattggactatgcattttgacgggtcaaagaggctatcaggcactggagctggggttgtgttgatttccccgactggagagagattgagctatgtattatggatacacttttctgcgtcgcacaatgtggcagaatatgaagcacttctccatggactaaggattgttgtttctctagggattcggtgtctggtggttcctggcgattcccagttggtcctcaatcaagttatgaaagagtggtcctgcctagatgataatatggctgcatattgacaagaagtccataaattggaagacaaatttgatggtttagagttaactcatgtgcttcggcacgacaacgaagcggccgacagactagccaattttggttcaaagcgagaagcggctccttcagatgtttttgttgagcacctttatgagccaacagtaccaagaaaggatgtaatcgagaaggtagggacccaagaagtcagcgtgattgataccgattggagagaacccttcatcaaatttttgactaagcaagagcttcctcaagacaaagacaaagccgagcggatttgtcgacgtagcaggctttatgttatgattgagaccgagttatacaagaaaagtccgtcaggaattctgcaacgctgtttctctttagatgaaggaaggcaattgttacaggacatacattctggcatttgtggaaatcacgctgccgcacgaacaatcgttggcaaagcttacagatagggttttttctgccccaccgcagtatccgatgctgagaaggttgtgcgaacatgtgaaggttgtcaattctttgctagacaaattcatctaccagctcaaaagttgaaaactatccctctttcctgtccttttgcggtttgggggctcgatatggttggtcctttcaaaagggctaccggtggtttcactcatctttctgtatcagtggataaattttccaagtggatcgaagctaagccggttgttacaatcactgccgacaatgctcgagattttttcatcaacatagtgcatcggtttggggttcctaatcgtatcattacagataatggcacccaatttactggtggagtgtttaaagacttctgcgaagattttggtatcaagatttgttacacatctatagcacatcctatgagcaatggacaggttgaacacgccaatggtatggtacttcaaggcatcaaagcatgagtttttgactgactgcgtccctatgccagcaaatgggctgatcagctgccataagttctttggtctcttcgcactacacccagtcggcctatgggccaatcaccgtttttcttagtctatggtgcagaagcaatgttgccaagtgaggtggaatttgaatctctgtgatttcgtaatttcaaagaggagcgctacgaagacgaccgagtaaatgatctcaaccgactggaagaagcccgagaagcagcattaattcagtcggctcggtatttacaaggattgcggcgctatcacaatcgcaatgtcagatcacgcacatttttagtcggagatatggttttgaggaagattcaatctacgcgagataggcataagttatctccctcatgggaaggaccatttatcatctcccatctaaatccgaccttttctcttgtgttttcctaaaattagttgaggggaaatatttcctttatcttcctctctcgttttccctaagaatcggaacctaaatccttgtattttatccgaatcaaactcgttttcgagtttatctctccaaactaaccctcggattttccggttaaaatcctctcattttgagttcaatctctctcacccgtgcctatataaagcatcccttagtcgtcctcttccgtttgcctcaagttccaagctctaccgttgcccgtagcgccgtcgctgtcattgtcgtcgttccagccgcgccgggccgtggttgtggtcgccgtcgccgcttagcgtcgtcgccgttgggttcgcgcggaggaggagcacctcggccgcccctttgcagccgctgaagaccatcggagagccgtcgtcgctgtcaagtcaagtcgagccgccgttggagttcgtcgccggccttcgttcgtcgtcgtccgtcgttgtttttcgcaccggtgagttcacgtcgccgtcctcttcgcatgggtgtcctcggaagacccagccgagtcctctagctccggcgacctcatggttcagagccatggccggcgatgtgatgacgtcataaatccttttattagtttttctgtattagataaaatcttattaaacttcggaaattcataactaaatcatcgtaactcggattcaagtggttcaagttgctaaattcatctaaaatcgagatctacatgttaaaaatatccacatgtactgtttatgcttttttttgtactgttttgttgattttgttcatttcctttagtttccgacgttccggaggagagcgtttatgttgaggaaggttcagaagcgtttgaggaagctcaaggcaagtcacacagatcccaaacaaccctttgagcatgttgaacccgtttaaagctaatgttttatttcaacttatgcatttttttcgaatgtcatcgggtggtgagcctttcccaattaattatggccgaagatgactttattttcctatgggttataatttgatttgctagaaccttatatattggtttggttcagctaaatgctacatatgataagctcattaatgggatgaatcatatatactgcgttattatttatggttatatttaatggtagctcacgatggttaatcgtgttatgataattaattgataattaaaacttgattaatggtgggttgtgag

SEQ ID NO: 45284 - DNA, 4302 bp, Oryza sativa
tgataattaaattgactcctggtttggaatggtatattcctggtgtggaggtttgatttgtacaaccggggttggttgttcagatgaggttaggcctatgcaacacgggtgtgttgtatggtgtttatttaatattgcgtaattacttaactgttttactattctcttaaatgtttattaaatgttgtttaagcacataagctatattataccatcctttgttatcctgtgcacttgcatatttgctgtgtggcttgttgagtatgtcatatgctcattcttgcaatattcattcatcagaggaggagtatttcagtgaaggtgatgatctggaggattaggctttgtacgggtcaagttgcttgtggagtggagtcgccatagctgtttagtctttttttgtaaggaagctgtttagtcttttgtttttccgctgcgtagaattttattcttttgagaggaactatccacctctgtaataatttattattttgcgaatattaattagtagtttgatagtactctattatcaatttgttattgtgtgcctcagctgattcctggacgaggatttaacacacatgtaagcgtttggaattttggatagaaattccgggcgtgacattccatgaggtaataaattgttgtacataaatggtataattccaacataaacaactttataatattatttaatggcatgtcaatcaagacatttttctgtattgttaacaaatgttactcacctaagtgcacagtgagcccaaaactcctatcacaaaggtgctggtgaaggatagatgatcacaaaatggtgtcaaacgattccggtcacccaacttcaccaagacaagccaaatcgaggaggtgccctttcctagcccagccaacctagcccaatcctcaatcgactttggccacacgtggggagtattcgagaagcgataccgacttcaaggtgcgattggaaccgtctatgacaccaatcgacctaatgaagggatccaaccagtgccacatgctcagatgacctaacccaggtaggccagaccactaacctaggtcgaccgagaaatcgacttacccccaggctataaattacccctcccctccacattatttgcaaaacaccggtagctaaagatcaagctctagttagcaccatgttgtccaaatagagtagaaatgtaatactccaacccattttaagcctatagttataggtgtggtggtggttcaataccacctaggaagtttaggtgggtaaaggtttgcttataagcatttgtgctccaaccatggtacccctagtcaacctttttacacgaaacgaggacgaaattataagcagggtaccatatgagcgtggcccgctcaatgtgtagagcaaacaactgtagatgttggagatacggtgttacaggaaataggggagtggggagtttggatgagaacgctacggttgtcggacttcgccgactctctaatgcgaagaagttgggaaattttggcctcgtcaacattcggtggttgatctctggtttgtcagtagtcgaattttgatcggtcgatggtcgtcatccaatcaaaatgaccgtcttcatcttcctggttcgacaatgtgaatcttactgttttgcattacttatcaagtcatcttaatgattccatacttatcgattcttgcttcaatttagataaaggtcttactttatttatctttattgctttgctagtatgtgcacttgagcaaagtagtagcatgatacgttagcgtggggcttagctacaagtttatttgggaaggtagtctagatcaacgggggaccataggcgacaagttgtgacaaccctatccatcccttatagttagccaagttagactagatcccttcccaatcaatattccctcatgtctaggcataagtatcccaatggcatttacatccttatgtaacatatacaacactcaattacctctttggttgtgcatccttctaggtgtgcccgattgtgcacatactctttgattgtgcacgattgagcttgtttcggacgtcgaggattgcatgtggtttatggaggaagcttcactttggtcgtgaagattaagtctagtttattttgtttttccgctgcgtatgtgagtttctttttgttatttttgtaagacgtggatctgtctatcaaattgtcgtttatgtactctgactgatcctggacagagatttaatatagattctgcttgaaattcgggttagcgaatttctgggcgtgacaaacagcgtcatacatttttcgatggagggagtatcaatcaatattagtagccatcaggtttccaatcaactcaattgttgtttggtgacgcaaagtccgaaattagaccatactcaaatgcaaagtcaacttcctttaaggtaatttgtctaaattactagtactaaccgtgacatccaataatatatatgaaggaaaaactatggtggctattaattttaactacttataactcaagtaacatccatatcaccgtcggccagaattcttcatttcaaatagagtttgtgctgccaacagcacctcaaggtcaatatccctgatttccaactgtacaccctccataactacctccactccatgatgtggctccggcgcacctccctggacaccagtctccccggccatgacggccgctatctccagctcgacagcgctaaccacgtggctcctcctgtggcaaagcctccgtaaccgcatcatgcgatgaggactcaccctcatgttttttcttcctcttcttgggcgcaagcagtagtagctcctcgttggccttgaaggcggcgtcagcatgtggagcatcacctttgaagtagtgcaccataaccagcccgaggcggccgtcattgtggtcgtctttgccatggctcaacttctgagaacgaaacacccatagatcgatcatggcctcgttagcaatggcaacctttttcacctttttgatggccttcttaccctttttcttggcgtcttcttggagggtaagactgcaattcttcagaaatgtcttccatggacgacccatgagacgatacgagttattagctttaatgtacttcagcgtgaggatgtactcctcgccggtgcggtcgtaggcctgcacgaacagcccatcatcaccattgttaggctcattgttaggcttgttcgtgccattgtcattgtactctttatgctcatccttcttctctttagactcaccgttcttcttatttttaggcttgctggatttctttttgcgcttacttgtggcggctgacttctccgccagcgttaggatgctatcaaacggggataactcgccatccttcttgcgtgatatttgtaaacggttttggcttttcaaacggtcggaacgccacatcatcttgccgtagacgcgcaccggcggcgagacggcgccgaggccgttgaggaggctgcgcagccggtcgtggacgacggcaatgtcgtcaagcggcacgaccatgtcggaccctgccgaagacgtcgacgcgccgtctctgcctaggctggcccagaacttgccgtggccgcgccgcttggtgttcttgcaggttccgatcgctgtcgtcacgtgctgtcgtcggccacctcggatggcgtcacccatgagcttgtcggcggcgggcaggccgattggcatgccgccgccactggcggttgatgggctctcttcctcggcgaccatcttccccttgcgccgccgctctctatcgaattcctccttgcgccgctgctccttttcggcattgttggagtcgccgtcggccacgtcaacactgccgccaccgttgccgccgagcacgctacggtcagcggccgccgctaccgtcgtcgtctccctcgggcgaactcgcggcgttctatttctgtccgacgacgtggtcgacaccaccagagctccatctccatctccattgccagtactcccggatggcgtcaagaccaccacttggccctccgtgcgttccatcgactcctcacgccgcgacctctgccgcctcggaacctgcgcagcggcgaacatgcctgatgtatccatccgccggggtggcacgcacgatcgacacgaggatcgatcgatcgatcaatttcgaagagggcggtatgcatgggaggctcttcgtgtttgatatggattctactttgggaattcatacgaactctggcgcgtataccaaaccaaaccatcgcggtttcctcttccctacgagccggagactcctcctcgcacgcgaa

SEQ ID NO: 45285 - DNA, 7697 bp, Oryza sativa
  unsure (1)..(7697): unsure at all n locations
tttcctcttccctacgagccggagactcctcctcggacgcgaatacgcgatcaccttccctctcagcggtcggcggcggcggcgcggcgctcctcctccctaccctccctctcgcgtcgtgcgtcctgcagtcttcccaggcagtgtgatgcagatccgatcgcccattgatcggagaagccgatgtggcaccaagttgatcgaacacgctagctaggagatggatttgaacggaaggtattttcatcttcttcttcgatctgctgttgctttggagtggagatgtttcttttctgttcttgcacatttgttttgtcagaaagatgcattgaaggtgtttgtgtttatgcctgactactgtacttctgtcgtcccaaattaaattatttcatggattaataatgttcactttcatatttctagaggaattggaagcagatcttttttttttcttgtttgatcaacgttcccttcgaatcaattaattttctgatggtatacgtgctgatattcatgcattgtcgatgggtttaaccggtgtcattgtttgaattcagaattatctctctaattcattgcgtccaaatagacctattctaaagtttttcattgtgtctactgtattagaattttcagatatacaggagtacgtaaattacactgttcattgctgaaaatatcagaaatattgttgatatctaactgacttgccactaatgaggacacaatctttaagatgtaaagtacaccatctgtgtcaaaaccagtgccatgtaatttgaaggttgtggcagtccatgattaatgaaatcttgaagtacattgaaaagtttggagagtgcaattgtttctagaatcttgacaaatgatatgctccagaaatacagagatctggtgctagcagaataggtgaatttgcttggtttattagatttttctgttgctaatcacatacctgcttcatactgtgaggaataagaacgtttctgttactctatggaaaaatagtatgaattgtcttggggagtcaagtatagtggtgcatctaaaaaggatctctggaggaaggagcagccatatctaaagtatggtttgagagaatatataattgcacagattttgctaaaaggtgtgtttaattgaactgtatcgtgaaagggcatgtagcctagtggttgcagtgacctgagtagcaccctgagttcaaatctccataggagcgaatttcagattggattatttgagagctaagttccctattcgataggctaagttcctaatttaaaaaaactatatatatccggttggatatagaggccgggtaaaaatacccttctctaaaaaagataaaaaaaaattgaactgtatcagtgcatatatttcctaattgcggatattagttgtataaatatgcatataattcttgttataaatctacatgaaacactgtaataaaagattgaacaaaagtgcaaaacttaactttcttaattttgtcctgtcactcaacctggtattattcattgtatatttagagctgtattataagctccctgacaagccatatgttttttttcatccattgcatatttgcataacaaaattcgcatagctgttgatttgcaattgcactcagtgatggcaacttggtaggactcgactccatggatttactactctctatggatcaataatacagaacgaggttttcgtggacagagggatcacttgcactccaccacaccaataagtttttaactaacattttgctttttttatattttatttttttagagaatggtattttttacccggcctctacatccaactggatatatacggcttgctgcaagttagtcccttcaaaagaagtgcatgcttggttcatagacattaatcggcttatggaagtttaaaggtacattaagaatatgaagatgcattatttagtaggtagctatgagccatatatatattgctttgagttggctagaattagatgtcatttctatatatactgttaaggtcatcttatcggttttaacctgtggtttatatcttctaaaatcctgatcatgcccatattatatcctgtaattgaagcgttttcttcagatatatcacctgtctcaagaaacttcagttcaattatttgccttcgactttatctctctctataatatgtcatcgactttatcaaatttttatataatatgctattgggggtggatacttttcaaaaaacacctaaaatgcccttcgaacatataagggtcgacaattgattgacatactagaagtatcgaaaaatatgaaaatgttcacatagcattcgcacataatatagaagtctatgtatatttcaagattttcaatttgcaaaatgaaatttatgtttcatatgctaatagaatattcttgtattgatgctctttacgtaaatcatccttcatatgctacataaaattatttttctaatccagctatcttttgtgtatgtggttcctctttcacatgccacataaaaatagtttttcaaaagaaatcatgacagaaaatcttaaaatatatacacaaacttttatattgtgtaagaaagctaacaaaaacttttatacttttttgaaacttctaattagtcaatcaattgtgaaagagaatggcttgaaggaaattttaggcattttttgagaagtacccaccccagtggtatattctagaaaaaaattacaaagtcggtggcttattatagagggagacaaagtcgatggcaaattgttgaactagtataaaaaattaggggtatataatagattctctcatttttataatgatttataatttgaataattaaacaaaatattggtcattgtaggaaaattaagccaaaaattagcaccaagtatactatcattttgtatcaatacagtaatgaaggcactattcttcagtgtgaaatatttagaattacaggggtatcgtccattgtacttaaggcttacgaatttagttgtgctcagtaattgtgaaagtcccttgctatttttttccccttatttatgaataatgtcagttatactcattcaagaatgtatatatgacatgttaggcatgattttcttcccaaagatattattctttagagtatacaaaatcagttggatagtgaaaattttgatgctcttgccttagctgccctttttctctaggtgttgattactgaatttagaaatggcttagagttgacgctgtttgataacggctattttttttaatggtagaacactcatgttatgtgttgcgaaaacgattctagtcatgtagctgtatatgaagcttctaatgtacaattgttagcgacacggtggcaagtcccaacccagccgccaccctcccctcatccgcctcgccagcagccaccggcaaagctgggcagcagtgtggccttctagctcgctccaagacccggtggctggggcatcaacgggacacgggcggaggggccgcgatgtgtcgacgacgggttctgacgccgtttgggctggacacggccgatccggtgctgacggaggtagaattggccccctcgcgaccggatcgagagggagcacaccggccgcgccgcattcaggaccggcggaggaggtcatggtgtcggtggaggagatcatggcaccggcagaggagaccatggcgtgctcgcgcggaggaggcgcgggatggccaggttcggctcctccgagaaggacgaggtggtgaggaggccgtggaggtgcgggcagcctgggagaagcaggcggcacagctggtggcgacggtaggccggcatggcgcgagatgcgtggcggcagcaacgtgaggctggcgtggcgtgaaatgcgcggccggaggcagcgggaagtcagcgcggtgcgagttgcgcagccggcggcggaaggtccgtgcggcgcgaggatgcgcgtaggaggccggtctggcgtggaggcacagccgacgccggtgggaggccggcgcaagacagggaggctgacctagccaacgccacggaaggacgcaacgatggcagggaggccagagtggcgagtgtgccatagaggcatgcggtggctgtccggcgggagggcatcgggtcagcggtgtcctcacgctgatggcggatggtcggtagtggagcaatggagcaattagttgtggatagacagtgacaggcgacagccgcaaaacctagctcggtgttagttgttccaaaaaacaaaaataatacctatgaacttgaggagcaattgattatttcttagaggacgtaggataaatattgacaaaaaaaaatctcttgcccagagaaatatcaagatagaacccgtgcttacatcaaatccaatttaacttgaaaacctacctttgctcaaaatagcatatgaaatctaacaattaaactgaagtatatacacgtactaaaatcacgtgttagtttgaacatatactacaataacaagtaacagatgttcacatataacaaaccaatcaaatgaaatcgctacattttcatatgaattttaggtttacaatgaatctaccatagtccaagaatgagttagtacaacttaattatcacgaatcgagttctcatacttcacaaccatcgatcaaaacaatctggtgtgcacaacaatattgtcaggaataaatatatagtactaattaaaaatactcaaagtcagtgtaggactcgccggtgctcgagttggccgcgccgccaccatccgccgcggcgggggcggcggcggcggcggcgttctccggcggcttcttgtccttgggagtggtggcggacgcggcggcggcgtactgccggaagtcgaccggctccggcaccgacggcggcgtgaggctcctgacgagcgcccagttgacgccgtcgaagaaggggtgctgcttgatctcggtggcgcccctggtgaaggcgatccgcttgtggggctccttgacgagcaggccgcggatgaggtcacgcgcgacggcgctggcgccgccgtcggaggggaagcggagcggctgctcgatgacgttgcagagcgtggcgcggttgccggcgcccttgaacggggtggcgccgtggatgagctcgtagaggaagattcccagcgtccaccagtcgacggcgctgccgtggccctcgccgcggatgatctccggggccaggtactcgtgcgtgcccacgaacgacatggaccgcgcctccgtcggctccgcgttgaactccaccgccgccgcgccgttgagcagcaggcccatgtcgctcttggacgccttgcggctgcgccgcggcaggatgcgcgggaagaaggaggagggctggatgcagccctggttcgccggcatgctctcgccgccgtcgatggcgtctcctctgctgcctatgccgccgccgctgccggtggcgtggacggaggaggacttgacgagggtggggcagacggtgcagcggagggagaggtcgaagtcggagagcatgatgtggccgtcgtccctcaccaggacgttctccggcttgaggtccctgtacacgatccccagcatgtgcaggtactccagcgccagtagcacctctgccacgtaaaacctgacgacgcatcaaagttcaaattttcccacgtaagtttcatattttttttagatcaaattatcggacgcaagtttcaattttcagatcaaatctacaatagaatgatgatacatgaggtacaggcaatagatatattttgttgtcaatcgtgatacatgactatagataaatgtaccaaaatttatactagaaaatagtgtgcttcatggtacatcctcgagcgtaggaaaatcactcgttgatttttcaagcaactaataaggttagtattgtgcaaattccttctaaaattattctgcaaattttagcacctcctgccagggctggaaatttcccctacaatacaatattacttcggctgaaatttttaaacttttcaattttttcattaattttagtaatatttatttaaattcaactaaattttggaaatttcggtgacctccgatcaaaaggggttaaccgatggagtgaaccctgcctcctggtaccaaagttactgctgtctaaatttgttcaaacttgacggaggttaatttcctcaaactgctccaagctccgtggaaacaatttgttaaaattccgaagtggaacctgacctggcggcgggctcggagaagtgcttggagggctgcttctgccggagggaatggaggttgccgccggagcagtactccatgacgaggcagtagaacttgtcggtctcgaagtgggtgtagagcgtggggaggaaggggtggtcgaggaggcccaggatctcgcgctccgtctccgcgcgcgccatcttgttccggctcgcgatcgacgccttgtccatcaccttcatggcgaagaaggccgacgtgccgcggagctccaccaggtacacgctcccgatgtcgccgtaccccagccgcttcagcagccggaagtgcgccaggctcagcggcgccggcgcgtcgcgcgccgtcgccgcctggaccgcctcccaccggctgtccccgccggtgtgccgcttcacgttctgccccgacgccgacaccgacgccgtcgacgcnnnnnnnnnnnnnnnnnnnnnnnncgccgcggcgccggtgctgctgctctccaggctgttgctccgtgtgctgccgctgctgatgctgtccaggctgccgttgctgacggcctcgccacggtttgttcctgctgttgctgctgctgcggtcgtcgtcaccagcgccgccgtcgtctcgggcctctgcggcggcgggttcgccgtcttgtcggagtgatgattcggcttgttcttgggcttcgatttcttgtctggagatggtttggagggtgctgatcgaatgctgaattgatcatcttcttcaaagctggttcgattctgttctgtgctatttttatgagggctgaaatccatgccgtcctccatcgttgttagtttattgaaagcttgagtttctaggtaatctgaaacttcacagggcagaatgtcaaaatttgataggtaatttgagtgaaagtgtaaaaactggaaaatgaaaaaaaaattacaatgcaggtaaaactgaagaagaaaacgagtcttggagttttactctacttttggttggaattttagaagaagaatcgaagcttaatcttttgttcttctttccggatctgttaaacttagttttttttcccatgtaatggcaaaatcttacgtactcgtgactttgtttggctgtatataccccacaaaggtgcagaggccggatttaatctaatctattttttttaaaaaaaaggaaaaacttaaattaggagtagtcttagtataattttatcaccgggatgaaattgtctgagattaagaaagcttcatttatcaaaaagaaatgaaaaaaaatgttctgctactctcaggcctccttgacaagttgctagccacttgatgaacagtttaggttgattgtgcttattctttgtttattgaaatctaaaatgaatttgaaactgaacatttagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45286 - DNA, 1242 bp, Oryza sativa
  unsure (1)..(1242): unsure at all n locations
ttcatcagttgactatattggccgttaatttctatcataagttcatttttcttttgggatcaaagaaaatataaatttatgaagtatattgataaagtgtatactgatatgaattaggagccatactgctccaaccaccaaagtagacaagcagctctttttacgacatatgtggcaaaaagaatttatttcataatttaatttgacagttcgtgtataacaccattgttattcatgcttggcgccctttaggaaatgacacaggtagatggaagtgataatttctttttaagttttgaatcgatttatggtatagagttaacataatttgtttatggcgttgatcggtcaactaaattttagcggtacacatagatacgctggggaggagggaaggagggttggggaggagagggatgccaggaaggagggatagagtgtaggggagaagaggggtgctaatagaagagggctgccaagtagggaggagggacgacatggatgaggtccgtacgtcaacagggaagagagagccgcaggtggggatggagcgcgcatgcggcggggcaagcgatcggaatcagaaccgagaaccgagatggatagggagagttgggcggactaatattttgttggaagcagattttattttttaaataggcaaagattgatcctttaaaaaaacttgttttgaaaaaacatcatgataaaaactaattacagaaataggcatctgctttagcaccaacctcaatgacactgagctatagcctgggacgaacccaaggggtgccgggtatgcactacccaaaaattttgaaaaaaaaacactagggtgtggcgtggaatcatggcaaggatggtagcgagaaagcattaaaatagaatcccctcgatgaatagagcacaatggtgatcacagtttgtccggaggtcaaatcaggataagaagaaaggactgaaggaagaaccaagaagaagaatggctaggtagcttagggcatgatggctttcgttggatggtatcactaggagttcaccttactaattcattgtgcatccacgatgtcgtgcagctgtgcgcattaaaataaccgatcagatcaagagtggactgaaactcgatggtaataagaagatgaacctttagagactatacaactatcttaactgacaacgggggattcctnnnnnnnnnnnnnnnnnnnnnnnnnnnnnnnnnnnnnnnnnnnnnnnnnnnnn

SEQ ID NO: 45287 - DNA, 7252 bp, Oryza sativa
tgctgaaagtaaaatagaggaggacatgaagaagcaacatgctatgtttttgtcttctattactaaccatttgcaggaagtgcataatcatgaaaaggaggagagagacatgaaagagccgccagtcccattgatcacactcaaagtcgaggcacctccattatctgaagagggcatcaaaggtaaacttaatggtgctgaaattaataaaggtgagtgtgttgttaatgaattgaatttgtccacttttcatgctatagcagagcaaccattagtggaaccaactgctgagattcctttgtcacaaattgatttgtttgctgttccttgtgataaagaagagttatgcgataatgcttcacttatatccatgccacaacttgtgaatgaacatgctattcctactgttaattcatactgcactgattttaagcatgttgttcacattgctaatgaagtagaggagcgtgaattgagatcttctttaaatactttgggctatgttcagtttgatgatttttgtgagctcgataatttcaaggagaaattatttgctaagtctgatttgccatatccaaccaatgttatatttcacatctttggtgaatataatgatcttggaatatattttgtgcatagagtttacatctgctcggatttagaacctcctgtacatgtggataaaatatgcaagctagagaaaaatgttattgctaaccaaattgtctcgagtttgccttgttttgattggaagaaacaggttgttgtaaatggactacgcaaagagcaccatatggaaaaaccgaggacggttttccgtgaagaaggggaggatgatgtgaccatggctaccacggatgcaaccattgctcacatcatggatgaacaagaagatatcgagatcaagtactccaagtgctggaatccgattcggccacctactacaccgctgacttcaaacggccaccgaatctgcatacgacctccgttttcggcccgtgagtacttgatggaaagctctcggagccctctttctaacagatccagcctcttctctgaattctatctcgtgtggccagaatcacaggaacaaggtgttgcatcacctataatgggcctatgggcttgtaacttcatttgggaccccggcccaggtgaggcccatgtggggtgcgccccaagctggtggagcacgaccctaggcacccctaggtcgtcctcccacccctatatatagctagtctggcccaggtggggcccatgtggggtgcgccccaagctggtggagcacgaccctaggcacccctaggtcgtcctcccacccctatatatagctagttaccccttcagggtttctcgggttttgttagattaaagtttagccattgctacttgcttgcagcgcgcgtgtcggctagaccgtccgtctgcttgttcttcggaaccccaacttatcatttgtattaaattcctatttgcaatatcagattgctttttatcttgttcttgcttgtttcttcgatttgcttgcaggaatagggttgatctgcaccggcaagatcagcaacccacggagaggtgtatcgatcgctaaggcgcaacacaacgtctcgtacggttgtagtcggatcgtcaacgtttctcccaaatcgtagttatcacaactcaccgaaagatcgggccaacaacagccttgagtgtcgagaggaactcagggttcatcagtcactgtagctcgattgcgcccgaaaagcaaaaatgtttagggttcatcgtagaactcacactaagggtgtgtttggcatgcacacttttcaaactgctaaacggtatgtttttttttaaaaaaagtttctatataaaagttgctttaaaaatatcaaattaatctatttttgaaaaaaattagctaatacttaattaattgatcgctctgttttccatgcgggagagatcagttccctccaggaatctgaacacaggctaacggagactgggaagtttccgtgtgtttttttacacacgggagcttttttcaagtcttttagtactgtcatggattaattttacgagattttcagaggagtacagtttgttttcgtcatttcttttagaaaaaatatactagttctcgaaaatgccttatatatccaggtccatcacccaccaccgtgtgcatgtacttgccgtcacgttgtatttaagcacgattagtgacaatctacacaaactcgagcgtgacgggtcatgactatgccgtgtcgagcgacggccgacggtgataatcacgatgagcctacatacttagtatatgctacttatacatactctatacaggacactagtacgtacgttacatatttatatacataatacttctatgctatttatacatactctatacatagtaggatattgtcccaaatcctctatttatttagccattgattcaggggataggcgagccatcctttttgcgagtaatgcagaggagaacggtaaagccggtcacaatcttatccctgtttccatcgtacgtagagccacatccacagccacacggcccgcgtcggaacagggaatccccccggcgtgcagctcttcttttccccgagcaagtttaatagcaaagcccactactagcttcaaatcatttatagccaatgtaatatctaattcatacactagttacttactatactagtaatatctggtcttacctgtcatacacacattatgtcttttaaatccgtgttgtagctggctacagatctgtagcccgctgcttttctctctcttcctttatctctttaaaatatgtttatagctggcttatagcctgctatttgtacctgctctaaaaccgaatacatatttcctccctcccaaaatatagctatttttaaggttagtgtgggtattaagaaaaagtaggtgagaatgatcggactggatgaagtgtgtcattggttgaaaagagaaagtaggtgaataagaatgattgtgattggttaagaggaggtaagtagagaaatagcttcattttagaacattgtgctagaaatagttaaattttgagatggaggcagtatctatctatttattgcgtataaactaaataattagaaaaaaaataattaataagataaattaatttgtaatatattcatttacaagcattcaacttcaaattcaacttatatttttatataagttgtaaaaaataacaaattaactctaatcagtatacatatatttacaactaaatttattttttacaacttgcaaaagttaaatttaatctcaaatgcttctagtgtgatatatttcatattaatctatcttaacatttaccagttgatttgtgataaacggttagcaacaattatccaggtgattagaatccttctctcccctttgcagcactgttccccccactccccctttccttatcaggaagccacacgcactctccgtctccgtagactgcacgcttcgtcgtcacatttttcacggcctcctcaccgccctcccccctcgggccccacgtgtcagccgccccgtgcggattctttctttctcttctttttttaacctttttttttttctttttggtataaacaaggaccagtgtagttgcgcccaatcggaggggagagaagaggagacacacgcaccgcacggtggtggtggctctcggctcggccagatttgtttaattattcgccccgggtttaccgcggccgccaatcggaggcgccgcgcgcggccacatccctttctttctctttcctcgcctcgcctcgcctcgccattggcgagccgcggctatatactaggcgcaccccgccgctgcggcgcgcgtttctctctctccttgtctctctgtgctgttgttgttgcgggtgaatctgcttggatttcgtcggagttttctgtcgcggaggaggagggggtggtggttgatcggaggggaggggggagggagatggcgagggagaggagggagatacggaggatagagagcgcggcggcgcggcaggtgacgttctcgaagcggcggcgggggctgttcaagaaggcggaggagctggcggtgctgtgcgacgccgacgtcgcgctcgtcgtcttctcctccaccggcaagctctcccagttcgccagctccaagtaagcgcgttctctgatcccctctctctctctactgttgatgctgctactgctcacccgatgatctcaccctttttttagttttcgatccgctcgagatttttttggggggtttagatctagctacctgctgctgtgttcctctctcgtttgaaagggctccagatcctcccggtcgctagggcttcctccctcttctacagttttacttcttcggttttagggtttgtgtttggttgatgcgatgcttctcgcgaaacgccacttcgggatcgagccttcttttctacttccagaacaatcatccttgcggtttttggggctgattcctgggtcgattccggtggattctaccacccgggatggtcctccgaaaatggggaatttttctactgtagtttcaatcacaatctccacagctaagtacggggaaaattcgatcgcttgctttttgcagatgagagatatgcatatttctcgtgtattccatttgctttcatgtggagaggaacactctaaaatccggttaattttgcttacgtacgctgctcgataaaaaataaatcccaaaaccgatcggcgcggcgcgcggccttgggcgcctccgctaatcgcggcgccgccgtacctgtgattttatgtgtggtgtggcatggcatgccgtatgcatgagccgtcaaccaaccaaccaacgaaccagctgccgatcagttcatcctctcctactgcctctctctctctcgtggtctgcgcaggtggccggctggtactttgctgtagctatagctatatatgggatcactcttgtagcctttgggtatttgggcttgctagcttaccattattggtgttctccaagagagaaaaataaacatttcaagtaccaagagggtacgtggcctttgcatgttccatatataagtatgtcgtccaagaaaaaaaagggttaatttagtatagtaggactatacgcatataagcatgcccaaagagaagggggttaattaattaatataatgatgagtagtacggtactccattttaagagtgtgatcgatcttgatcagtttctttttggcagtcgaagctatttaagaatataattgcatcatttagggattgagcgcatgcatcagagaacataattgtatgcacgttttctgaagctcctttgtttaatttctgtgtgatttttttatgtgcctatatagttgactgcatatgggtgcttctttcccaaaaataatggaactgtgcgttcttcttttggaacgtactgtccttgggtgtaacttaatatttgatgcttgtaatttacaacttgatatatagttcatgataacttgtttcgttcttataattagaaccatgccatgaactttataatagaataatctcgtgtcatttatgtgttttgtgtaactaacaatgaaggtgagaagatcaaggtcgtagtacctcataaactttacactattcctccactattccttttttagggtcctcattttatatacttttttctacttatcatttggaacatctacacagttctacaatacacctaagacgctaagaccattatctttcacaatcttatgtcccaagccgctaagtataattgtttatctattatatgcccaatatcatgctctctagtttttcttccctacaatttgtcatctcgttatttctccatcaacgtacaactccattatgtacgaggaaaagatcattccgctatgatactatttgagtgaacaattatcagacaacaattaaataggagtaacatagcatttattgaggtgaagttaattttcagaagggcaaatgttaacgaagacctggtaattaaactggtcttttcgatctccatgcccaattgcactgatcgagaacgtaaagaccttggcatagttttttttatggcacctatatattcagtatgtatttcagtaggaattattgtacaagagggacaattcatatcatcaaaacctactggtggcatttctaattttcttactgactgaactttacacttttgtgcacatattactagattagtgccatagtttttgtaagttcaagtgcgtgctgctaaactgtatcctagttgagaacggtgggagttatattatataacttaatttttttctacaaaacgttgaacagaaatcactggacaaccttaagtcagataagaaactatgcacactgttataatttaagatcagtgattctgctgacattattactaagagcatatatgatgaagacatcaaaatgtactttaaacatgggcatgcgtattacgagtagcacataactctagcagaaatgtatgaattctacacaagctcagcatatccttggctggctggctacatcttcttggagaacatccaaagctatctttttccacccctttgaaaggatataaaatattgtgcaagtgttagtccaacgcagtttatattatgattacacaacaatcccaattcccagggtttcaaattgaagtttacttctagaattaggttccaaccattaagcaatacgtacgtagtatattctttatatatgcttatgtttttttcctgagaaaaatatgcattgtagtttagaccaatgggccagaattcatctgacaacaataaacaatatgtacttgagtggtgtctgactggtttccttcatgttaccctcttttgaatatgggattcctatagacaataacagaagaaacaaaaaaaatgcattatattagattaaattcagagtgctttagacaatcatatatagagtttaattttccattgatatatatgaacatgatatgatatgataattgaatatatatatatatatatatatatatatatatatatatatatatatatatatatatatatgatgctcgcagaatctcttaccaattttcagcgtaactagtaacaaataattaagatttattctcttattaaagaggctgtcttgaaggtgttagactatagatggttttgtatattagatatacattattattatatctccagagagcacacccctttgaagt

SEQ ID NO: 45288 - DNA, 12868 bp, Oryza sativa
  unsure (1)..(12868): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacacattcttggtctcctttcttacaaaaaaaaaaaaagcttacttgtgtcccccagaaaaacgtgagtacagccacttggtgcacaagaatttttccttttcttaaaaaaaactaggaatatagcccgcgcacatgcgcgggcatctttaatgtgtttgaaattttattacgaatgcttacgcgtagttggctttttttttattgaaataccctttgtactttcaaacttatttgggatttctattaatgttggttatgattttattctagttacgcttgcaacataaaaatttgttaactaaaattgtgtgaaagcatgccgttttgaatttataagaaaatattgtgtcatcaccatgaagtttctatgaaactatatattgtactatgggtatttctatactttaagtaataattgcttttatactatctatttctttttggattttaggataaagtaatttaagatttctattaaacatatagctaatagaactatgtcatataattaaagatagatttatacttcgtcgcataaatccgagaaagttaaattttgtttcaaaatataagggattttagagtagtattacttgtcctatccaaaaaactataatttataatttattgtttacccaatcttaccctaaccaccttcccaccctccacgtctcttttaattaataaggggtatcatggtctttttttttcttcctcattagctataaccctaaggcaaattttgttataggacactgcgatttcgtggttttagctgtaggataccgtccgaactcacttttagaggaagacactccataaacgtggtaatttaccaatgtacaccgcgccgattagaataataatttccggttgaagaggagagagaaatcacgtgaaatgtcaaaaatgcccttaggcccacatgtcagctctcctatctgtcctctctctatcccctccttccagcgtctgatgcgcggcgtcgggtagtcgtggtggcggagaacgatgctgactccgcgatggcgacggcggacactacgggctttcatgcttcctcctcctacaggacctcgagcgccgctaggatgtcgagcccgaccccgcccgcatcacggtggcgccacccgccgctgcgcggcgacgacgccgcgtgaagtgccgcgtggtcgaacgggcttgtcggcgacggaagatcgccgctgtcatactattgctgttgcggctaccacggcgagcagcgggcgacggagacgtcgagcttgccttctccaccatgggtgagacacgtagagagagaggaggagatcccattgaccggccgcttggtgaactccgcggcgttgaggatgatggtagggacggggtcggtggcagcggaggcgggaaggcgagggccggcggcagtaacggacggtggtcatggcatcccaccgccggatttccgccgcatcccggagttccgcagccagaactcacccgtgctgtctcgccatcgctgtcgctccgaccctcgcccccgtgtcgccgcaaccgctccactccgcgcatcagacgttggaatgaggggatagagagagagagagacatgagagaaatgagagctgacatgtgggctcaagacatttttgatattttacgtgatttctctcttctcttcaaccggaaattattattctaatcgacacggtgtccattggcaaattaccacgtttatagagtgtcttcctccaaaagtgagttcgggtggtgtcctaccgctaaaaccacgaaatcacagtgtcatgagcaaaatttgcctaaccctaaataccttaagatggttctttactacctgtgaaatacatcttgatgtttttttctaatttattaacacacttggatgattgttttttaatctaaatgcttatctataatgtagatagctacgaataacgtgaccacttgtataacgataaattacacgttgaatgttgtgccttcgtaaataaaattttcaataatttctcttattgattatatgctttaatatatcaataaatacgtaggttatatgctacatagattagtcatattttttaaattatatgtagggtgtgtattattgatgttttttaatttatgttttttcatattgcagtatacatatatattttttgatttaaagaaaagtcatgaggatgtagttttcaattattttgttccatgagattgtacacctaatttacttatttgtgtttatgaataacttattatattgccatgtggaaacataggaatgtctataggagttccacgtgactgtttgagagcgttttaggaagtttaatggacttttattgtataataatagatagatatatagatttttaagatttgtccgatttttaagagcgtcacgcgtgatggtgtaggagtgttttactttttgtatataatataatatatagattataatcaggttgttatctaatgtttgattttattctcatattaaattttgctaggtataaaattaaaaactaaaaagaatgagaagatatgagatggagggaggggtggacggacaaatgtacgtatgtacactacgtacatgagggggatcagaggatgcctgggagggtaggggtggatatttttaaatctaacagtgaaaaataatgggtctaccgtattaagtgaaaatcaagggtatgatgttttgctttttttttctcagaatttttttgatttctctaatttattagaacgccaagtggaggcttaggagcgtttgtaggaagttttatggacttttagtatataatagatgaagtactacgtaagagataaatgttgcgcaacaaactatagtgatctaatttatgtatatgatagaaacaaccataacatcacatgaatacactcgtaaatgtgtcttgtgtctcttaaagtttaaaagacgaagaccagcgatacatcatttgcctccctaaaaccctatttataaccggagatagtacaattacataggagggatgcaatttagctagccctaattagccaccccaagtacaagtgctcaccacctcctttctactccctccgtcctataatataagggattttaagtttttacttacaatgtttaatcactcgtcttattaaaaaaatttgtgcaaatataaaaaaaaagttgtacttaaagtactttagataataaagtaagtcagaaataaaataaataataattctaatttttttgaataagacaaatagttaaacaatacaagaaaaaattaaaatcccttatattatgggacggaggggagtactactatcaaacatgaccatgaccattactaatagtctagccctaaggccctgtgagtctgtgatgtgttgggcaccaccaaccattgccatgatttattcctcttctttctttctctaactttaattttatttattcttcttgtgaggcccaagcggccaagccgggagcccgggagtgtgcagcagtagactagttagtagctgttccacggtcccgaccgccgcacgcttagtttgaccggagccgtccacccgtgaatgtgatccatccggttccacggccaactttcccggtcaaacacgacgtgacgttccccgtaatcccccacacgatccacgggagaaacgcccaccaaacaaccacaaattcttccagaaaaaaaataaacgaggagcagtgacgttctcgcgaccatcatccgaacgtgccaagcatcttctctcaaacaaaatcgtgtcttaaaaagttaaattaaactacttttatactgagccgtttatttactgtgcgacaatgcgatattatattatcgtaatcctagtcgtgatcgcgatcctgacacgaacaaaaaaacgggccgtgtctaggattgtgacgctgacgacgttttgccaagggcgacaccagtaacagcactgtactagcagcggctatcagctcacatgggcatggccgctcgctccgttcaacgccggggaccgttcgtttcaactgcttctgccttgccgaccgccagtgacgaagcggaggtccgctgaaacaggttggcagttggtggcaactctgctgcagaattatttgcagcatgacaggtgaagttctaggcatctagctgcaagtcgtattccctttgtctaaaaaaaaaaatctagaacttaatatgacaacgaatctgaatagaattatatccagattcataatattacgatgtgatttttcatggaacagagggtgtatcacataaaagagcagttaatcatagctcgatatctgcagtactaggggtagttgctattggtgatcatcttgattaccacttcggagctttcgaggcttcaaacataggaggcatggtaaagatattctttttcctgtaaagttgatcgcaaaggtcgtcatttctacagtgtatccagtgtgaaagagcaaaagaaatgctgacgaatgtatagtactttacatgtttcacagataacagtttcaggaaagggaatttatccaattcaggatattgttggtaccagagatattgtacactacagacatgcttccctgatgcagaagacgctcttgaagacacccaacgctaataatctcgcaaatcttcttttacagaacaatccatccattagcatttcttatggggaggccccttagtacgatctgtatagtcccattaagggcttctccctatcctccattctttttcttgctgcttcacgcgctttaagggcggcttcctcctcctttgagatcactttgggcttgccgtcctctctttttctcttgttaacagcaatggcggatggagcaccctttacagttctcatcggattcagtggtttcttgacgaccaaacctggagcttggccccctttaattgtggggacagtcgcaactgaagcagttggttttgtttgtgaacttgaggattgcccagcattagcttgggaggtttttgcccatgcgtatgcctcttcctgagtgacccatttacctgctcattaagaaagcataaatattagtgagaaatagcagctccctcaaaggcatgacataaccacttaaagatccagatacacatgttaagagaagtacctaaaccgtcagaatagtagaaaccagaatttgagtcaaaatagagtccagtagatttgtcataatagtatcctgaatagagtcgaattcccatcctgcacaaacaggatgttatctaacagattgaacaaatattgttaaatagcgaaaattgtaatagtgctggcggacagaatgatcagcgcacatatgcaaacagtgcatcatggttcatgctactcagtgtgccagggaaaggtaggaactggtctgttcatctgttctcctgtctttaatgacatataatcatcagtaaagacttaagagtattaagcatactaaccagaataattctgctagggcacagttcatgaaaatctaacatcatttcattaacattaatgcaattgttagcaaaatttatcgtcaacatagtagcagagcaagtattactcacggctcaatttggtagtaaaagttttactcatgatgacatggacaaatctcaaacattcatttctacatcctatagtagtttccaggttacatattttcccatacatttgagccaagagaaagatatgtttgaaggacggatttaagataaaacaattttaggctttgaaaattgacagtagttagacatttctgctaaccaaggtattgtattacatgagctaggttggaatatatttcaagcatgtcaaaaactagaatcagcaggagaaaaaattaagaagataagactaatacaacaagttaatacaagctcaaaatagtgaacaaaaagagaaaacagaaatcatgaccaactaaaccctctcaagattggtgaattaacctaaccatcaactaaaaaaatcctacaaaagcataacagagaagtaggatgttcccaaaattcctaaaataaaaggaaaaaatatttttcactatcctaaacaaaggacgggaaggaagatagcaagcatatatcctctaaaaattagtcatccttcaaaacggctcttcctagggtgaggtattatctgtccccataaatagaaaattccaggagtaataaataggattaaagtattgatataattggaattgcagaaagaaatactccatactaatttactaaaaaaagaaagtacctcatccaaaggactcattttatattttaggattaaacaaaagggttcgcaaataaaagcgcttagggatagcttcatcagatatggaggcctattttttttttatacaaagcagagataactaatggcacaaaagaaaacaggctatgcagtggatcaggcattgaagaacactattgatagacaacggtgagccatacacaccatctccaggtgccgcagaagtgtcaccgtccacattcctttgactgttctctaaatctttttggtagctctttttagctttctgcagtgaacagtaagttacaaataacaaggcatggtagttcataaatcaaccaattgcaagataaattgaaacaacacagcaataagggaaaggataaattcaaaaagaaaaagcctacatggttttatcaatgcagaagtgtttacccttcacaagctctgtagtttgtgacataacaatatgtacattaggtgattaggataccaacatactggggaaaaaaacagcattacaaacttacagcttctatttgcttgagggcccgggctgcttgctgctgctccttttctttggcagcaccctccttttgcatggttgccaatcttttagtgacattgtccttgtggcgcttaccgatttcatgtgttctgatgcttagcgggttattagctatgtaaatcttacagaagtcacaccatttgtttccttggctcacccagtactggaaaaagataggggaaaaagttatttataacaaaaacacttgcaaagttggatgcttgtgatgacagtgtacaacaacttaaatgtcaaagaagatgatcgcagataactttcaaagggctaatagggaccctgtattcctaccagaaggaaactacagttgcttcttgtactgtcaccttttcagatagtgactaaataatctctttctcgcaatggtaaaaaatattgatgccaaaaagtcaattagcaggattggatgcttgcaacaacagagtttaagagcataacatagatcatatgaatgattggacacgaattttttcgaaaggaaaaaacaactaactattctcctataaacgaacacaataggcatttgtatcctgatttattcagaaagagaattgataatattgccatgatacatcacattgggactttcagtctctaatctccacttagcatttcaaattcaattacagttgaatacaaacaagtactaaaaaataccattaacctaccaaaagaatcaaagccctatttggttaactatctcaatctacaaaaacataagatgactgaagcacccatatgaagatggaatcactccagtccagaggcaaaatcttcctcagtccagcctcaccaagccgcatattctatctactctcccatagcatccgaacacacagggacatgcacaagcagcatacgaattacgaaactaaccctaattcatcgaaatccacgagaccaagtgactaacagaggcaaaatccctaaacatcagctaatcctgtataaactcgcactcggaagacgccgaccatcaccgagaaaccccccaaaggagaaaaaagcaccggggtttcgttcagatcgatgcgcgaatccccacagcgggcggcggagggcaacagggcaacgcgcgatgccggaaaattgcggaggaagaagggagagcgtacctccgtcatggcgggcaagggctccgctcagctgcgccgattgcgacagtgagcttcgcctccgctgccgggggaggggatcgccggagcggccaagcgagcgggggatttttggtcgcagtcggagacgggacgggggagagggtgctggggtgaggagtatttctcgggatgtgggcccgccggagagggggagaagcgcggattccagacgttcataattcaaattcatgccttgtttgaagtttaaacacgtgatttttcttccgagtaaatttcgaaaacaaaaagaaacacaacaactatttttttatcgaaactcaattttaatcgagcatttcggatagttgcaacaataacatatgatttattagaaagctgcaactttatatcctactccatccattttatatataagttattttgatttttttaattagtcaaacttttttaagtttgataaattttataacaccaattagttttattaaaactaatatttaatatattttgataataggtttgttttatgtaaaaaatattattttatttttctacaaatgtaatcaactaggaaaaaaaattcaaaatgtttcgatccacctatcatacatatatgaatactcatatatgaatactcatgttgttgtatattgggttcacgtgttacatacactaaaacgatataattttatagttttctaataaaatcattcactattattgtagctttgtagatagcaaaataataattttgaccaaataattacaatactatgaaatttatttttaaaaaaaaaaaatcggatttctgtccgcttcgtacacgaactgcattttggacaaaggcgatgatagtttagtagcaacagctaataagccttagattaataaacggagcaactaaaattgtttcaaataattagagtttggttaaaacttttatatctattctcggcaacttaaaagctaaggctagataatagaatacgatgaaagaactccaaaaccaagtatcaaaattaaaattttggctaaggcttatatttaagctaacatgcagacttcagtttaattagaaattttcctgcattccgaacttgtctcaagtccatcccaggctattatttctcaaaaaaaaaaaaaaaaaaaaaaaacccggccgaatgtttgtgttatagatgactcttgtctcagaagaaataatggtctattaaaataaagttaggtatggatgtgtctcctgttgcctaatatgggcgatttctggagtttccgaaactcaaatatgcgattccattgccccagactccaacattgattgattttaatgaacatttagtcggagtacatggacaattcaaacagatgcaaactgtaagaggtcatgttccacgaaatgtaagctactgctacactttcttcgagcgatcagtcaaagttttcgatcttgattggagttatatcatctgccaccttaaaattcccgactaatcgagcaaagaacaccatctgctgctccaaagtaaacttgatgttctcagcctgttcaaatggaagagcatactccatcacaaccttatcgcagggtttagggtgtaaagagacttgagactatagagagacaagtgatacagtttggtaccttgcggaaaccatgctgctctccttcgtattccaccaaggcaacaggcaaacctttctcttttaaggccttgtatattttgcgtgcctgatctggtgggactacctggaatgaaaatgaattgaagcagatgaaattgtttgcactttacagttgcaattatgcaccattaatttctcggttatcatgattatgagctcataggaaatgtttcacaaggaaatattgcaggaatgatgagaggcaattatgcatcagtaattcctcagttatcatgactatgcatgagaccaacatagaaacttccggtttatgaactcataggaaatgtttcacaaggaaatattgcaggaatgatgagaaaaaggctcaactacacaatatagaagtatttttttttaaaaaaaaaaatctttaactctaagttataagtacctagaaagtgacccttgcttctccaggtgagttatgaaaattaataaaaaaaaaaagcaaataacatgtgaacatgaaacttattacttgtcttagatctaatactcctgtaataaatctgtaagactaatgagtaccagaggatggtttaggaaaaaccattagttaactataggaggaactaaaatatgatgaattgatgatctgacagaagcggataatctaataaacagaaaataaaagctcgattcaagagtcccacattagcttgtctgctgttctgctagatattgatctctattcaagggtgcaagtgtaacagcggagcatacctcatacagtaaattttcaccgcatgtaacactttgacatgttatacaactatacactgacaaacatgacttgtctaaaatagttgatcctccgcaatcatcacataccttatcatccaagccttgaaacaaaataactggacatgtaaatttgtcaacaaagttgatcggtgatctctcatagtaagcattttcatttcctgaagagcaatgtagcaaaaggtgactattacattggacatacgggttggattgaatacttttaccaaagcagaaatagtgagactcttatggtcttacctacaagattgtcagtatagtgagactcgaatttgtgtgtctctgctctcaacaaagataagtcaccaatctgctcattaatatggtaataaaaatgacaagtcaacaatctgctcaatagttcttatgtctatgtagagacaaaaatgattgacgttacaaaggtggaccactctgtgaactgcactttaatctttttatcagttttccatatcaaattacctatcatacaaatgcaagtagtgatttaatacctcaatttcacgttataaatcaagtttgttaaattcttagttatatctgtgaaaaacagatcctacaacgttgtgcactgggctgaaaaatattcttgaatattcccatcttggatatggactaagaaaaggatcatatcgccaattattttctaaaagataatgcaattgatgtgtaaaaagtaactattacttaaaaacaatcacaagaaatctagaacctgcagcccccattgttctttgttatgtacatttataggaaagccaaaaaagcagaatcctagaaagatatataacttacaccatacaaagaagctccagccttgaatgtgtccctgaatgcgagtgaagctaacgtagtgtacccacctgctgatcgcccagtaatacaaaggcgtcgctcatctactttcccactctccacctaaaaaatgcattaaggtgttttgttagcattactataatgaaatgctattatataattacaaccattactactaggatgtaccaggactcttgcacagctgcaacaatcatcaacatcgacgataccccatttccccaatagcctctctcgatactccctcccaaaaccttcagttatattatactacagttaaattcagtgataaaactaaagatttaaataacctagagcctttattaaatcaactacgacatgaattagcagaaaaagaaaacaagctcccaacattgtacataaaggtgcaaccaaaagtccaaacagtggaagctaaaaggacaaaccagtgcttcccccatagttaacatcaagatatgcccatcctcgacttgtccaatactgaacactcaggtccagaattccacgtgtttctgctgttggtcctcctgaaagatgtggggaatatcaaatatgcgattgccatgattgtgatcatggaaaagaaggatgcaataacctaacgaaccaaattagacagaaaccacatagtaaaaattgtaaatacaaaacagaacacataacagttgggcctaaataactgaataattattttctgggatcaaactacaaagatattctgaggcatcacaaggcttcaataatttacttaccatgtgttttgacaagcaatggaggtttttcgtctggcaaaccttgaaaatttgggtttgaaggtgggtagaaatatgcataagctttctggccggtgctggatgttgaaaactcaacaaattctggtgcactgaagaaagaactatattgtacaacatctgatgaggatgaccaaattattgagaaactaactacttttgttctgtcctcatttaaagctacctgaaa

SEQ ID NO: 45289 - DNA, 752 bp, Oryza sativa
aaaagtgatgccgaatacgatgcttaccacattggataaatcagtgaagggggtgtcaagcaatgaaacagaacctatatcagagtccagaacaccaagatatgaccttccatgctgcctgtgtgacatataggtattgtgatggaatttttaatatattttcatcaacagaagtataacagtacaataaaaacctgtagctgaaaacaatgtgattgctttcaccaagaaaaccataagagctgataccaaaaacccacaatggccttgtgaactcagcatctagcgtgtaaactgaaataacctcgttggtgtgctcaacctgatgacaaacaagtgcattggcaatgtatgtcaaacaaaatccagatgatgaccaagaatgctgtatttgatcatgcaatgagccatgatcattgaagtcattacttacaagttccaactaaaaagtagagaagtcaaacaaaatcaggacaaaagatacttcaaatgttaaatgaagaagttcaaggattaagagaaaactaattacccatttatagatgttccaaaatccactccctctatcagttaggaaaaacaattcgcctgcaagttcatatgaattagacgaatctttggtagcagagttgcaagcaggatgattataatcatgataaatcaatagtcgcatcactgccaagcaaataaattgctattgctaaagttgcaaaggggttaatgggttatggaaccaacgaatttaatcactg

SEQ ID NO: 45290 - DNA, 11161 bp, Oryza sativa
tcactgccaagcaaataaattgctattgctaaagttgcaaaggggttaatgggttatggaaccaacgaatttaatcactgtgattgtgaagaaaaggctcgggaacaataataaatacaagtagctggccgagctaagaacaccttccataccaaagataacattttttgcttaaataagacaattgtacatcgtggatatgaactatgctagaccatctagttgaaaccactcaaggaaataatccacacagcaaatactgtaagactaacatgaacattttttttagagcaatactgacagaaatcatgatgtaacatctcggtagaatagtattgattccatcttctggcgttcagtattagagtcaattaaaaatgtgaatatgcatgcctaaagaaagagcaagatatggtaggtactgcttcacaatgttacatttgtataatcttctcatgcaaatatgtttgaattcctacaaacatacaggcataataaataaataaataaataaacaaacatattacaaacatataacggctttctcactcaagtaacaaataaatatgcaacatgtttcagataatcagacaaaattaacaagcaacatgacaccttttggagaccatttaggctcagttggggactccactaacattggattgctaccagcaacacagacccgtttggtcaagtctctacaaacaaagaatcatgggtgcttaatcataaaaagctaacagttgaaaaaaaaatcagaaacaggtcgaaaatggactagcataaggtagacagactgcaacactagagattacaacagaaaataaatccaaaagtttttagtattatgagatattcctctgtagtcagactaacttctttatatatatattccatgcattagagatagggttccttagggacactcaaagtttattaaagtgtaccatcaaatgattcctgtagaagggctagcatgtattatgaaccaagaaaaagataatggatccatctaaatttctgtcatcccgaatgtaacatttgttttgtttatattacctgattggaagaaaaaggcagcatgttctaatatgcatttctaaagataatgttgcttacccgctttcagagaagtagccaacccaaagttctgacttatcccagggcatatttggatgactccactctatccatgccatacgcttgttattatggtcaatacgaggaaaagcatagaagtcattgccactaatcagcacctttggttcttcaatacagaaaaaaaaagtaagaattcttacaaaaaaagcagatatgagaaaattacaagcaacacgcacacatagatttaactttgtgaaagttataaacatttcgtatagtcttaccctgaacaaccccattactcaagcttatagctgcgattgttgtggtgggattcaagctactctttcgacggtctatcaagaaatttgagcatgtcagaagttcagtatgcaactatagtttgtaataaaatcatatgccaattaaccttctatcacggtaacataacggctgaagtgaggatcaaagactccatcagcataactgacatcaggcccaccataatcgggtgtaagaggcacaggcacaccagctgacaagggaaaatcatcatgtgaaatatttcagcagaaaaaaatatcattatttaatatgcatattgatcatcaagcattaagtggttctaaatatttaacagctgaatagtgtgattagatttcctttttaatcctgtcaaacacaacctatcatttcactggctgtcatttcattataaacgcaagtcttttcgcttgttaagacatgctccaccaattctacttatttgaatgagcatgctatacagtaacctataaatgcatatacacaatgaaatatttttcaatgaagtactagacaaagaattaccataagtaaggaaagtaaaaacacatccttccaactaaattatatttctttattgacatgctaattcagttaggttcacctaactccttagtcctacaaccatagcaaatgactcacttttagtactttgcttgtacagacgttgatccttgtagtttgagaacacaacaacattatctttgactgaaaatgcaccacctccatattcttgagctagagtacgtgctgcaaattcttgaggtatgatatccacaggcttatcatcctccttgactataaccatacgcctgtgtccaatatggtggaagataaattaattccgagtgacacagcataacagggaactattaaaagttgaacatgacatggtacactaataacagacattaacaaacttaacacagttattgcaaccatcaattatttaattgcacactgctagaattcatggaattagcaattgccaggcagaaagaatttattatattacattaatcttctggcatcatgttgtctctagtgcagtaatgcacacacagcaaatgcatataaaatacattctgggtttctcaaatttgcatattcaatcaactctaattgtcaaagcccataagccaatcattcatttgaccatgtattctagtgcaaagctgtaacttgctttcatttatatgcagaaaaatcataccagtaatctgctgagaaactaaaattccaataattaaaaaaaaaaacatagtgaaacgaaatcacattattccttccagtttctatgatacaatctccacgcaaatatgtgccaacatgctactaaaacaattccagaatctagatacgcacacttactaagaaactagtaacaaacatcacaacagctcgagaccaacaatcacaatagctcgaggccaccaagacacaaaagagaatcagaatcttcatgtgccttaacgtataattaaggcaccatacaaactttcgtaaaaaaaagtgtagtagtagctgccaatgctattaccaaaatatttggaggaaaaaaattatttataactgttataagctcaggaacggcggttactggttaacttaccctttctcctcgggccggccctcgatccagaggaggcgcccgtcaccggcgagggcgatccctcccagccgcttgtcggcgccggagacaacatcggcggtgatgggcgacctccaggatccgtacggcgccgccacgggcttctcgccggtaccgccaccgtcggcggcggcagcggcgggggaggccgcggtggtggaggaggaggaggaggacatgcggggcgccgacgcgagcgggcggcggaggcggatgcggggcagcgcgcggaggaggtgggaggcggaggcggagaggcgtgcgggtgagatggaggcgagaagtgtcgccatttgtgaggactgctttttataagaggttttgtggggtttttgcggtttatagaacagtggaggatacgctccattgttccactctagcattcgcagcgagatccgctattgcgctttgttaaatttttttagttgttcatttttattgcgctttgttaaattttcttagttgttcatttttagtgcatttgatcaatgctactcaatttgtttctaaagaaatatatcaacacaatggatgcctcgctatcaacaatacatcacctatcatcgaaagaataatatattataaatataagcatctatgataagtctagagcttaatccgaatagataggttgcaccataaaaaactaccagctacgctcacttcgcaatgttactcaaccattactctgtttcgaatcatatcatcctacacagaagtacttgaaatatgcttcatgaaaacccttaaccccagccaaaatagcaaataggcgaaggcctctttcggaatgctgaaattttccccaattcctactagaattataccaaatttcgtaaaagtcatataaaattcctgcaaatgtgctacaatgtgaaaacgtgggagaaattctagctaacggaagcatttattccattatattgaccagagtcgtatgcaaagcttcaagagattatttcaaactacagctaggacagcgttgctccagagttccctcgagttgttcccagaagttgattaggtgacgaataacttcttaacgcttacaaggagggttcatcaaaattgtcgatcttgattggagtgatgccatcagccaccttgaagtgccccactaatctagcgaagaacaccatctgctgctccaaggtaaacttgatgttctcggcctgctccagaaatgcaagtcagatatgtgcctatgtaaaattgtctatttactggtctaaaagtttcatatactgaaaaataatatatacagttagccttcaatccttcatggtaaaaaaaaaaaaaacaattcggtaggaaatactcaacctgatacattactaactaatatataagtttggtgttgcaaagataaagacaagaggtactcgtcagaccttgcggaaaccatgttgttccccttcatactcgaccaaagcaacaggaaggcctttgtcctttatggccttatatatcgtcgttgcctgaactggtgacacaacctgaagatcatcaaagaggtgaaaagctggtaaggagaaacagaatgtgggaaatgcacccgctgctaagtcactcttagccgattttcgttccctctgttctgggttaacagattacatttgatttatcgataggtaactctatctgtaagtgcacttcctagccatatacatattgatcatgggacacgaggactaaagtgcatcagtgataattaaatacccttcatttttgtttatatgatgttattgctttttgtaactttgtactagtacagaccgattatattataatgatttggaagtttctttaaagacaaatcagccaaataggtttcatactgaataattatagatagctttgaatatactggtagtaaaaaattagaactcataactgcattcaaacaaaaatgacccgagggagaagttcagatcttatagctttaccgtgtcttccaatccttgaaacaatataattggacatgaaaatctatcaacgaagtttatcggtgatctctcaaagtaagcctttctattccctggaatattgaaggtatggcaagtaatgttgttaaccaaaccctgagcatatacatacgcctattttccagcatagatgagtgcaaaattccttaccaacaaggttgtcaatgtagtatgcctcaaacttgtgcatgcctgccctcaacgaagctaagtcagcaatctgctttggaccgaagcataacaccagatgcatcaaaatctcagcagatagatagtttcagcaaaagagagaatttatggaaatctgagacttgccccatataaagaagaaccagccttgaatatctgtctaaaagcaaggcaagctaaagttgtgaatccaccagcagattctcctgttacacaaagccgttgcgcatctactcttccagtttccaccttaataatcagaatgacactagcataaatgcttacaacctccacacgaaaatatgaaaaaggtctgtgtctgataagatataccaaaaatgtagcacaactgcagcaatcatttacatcaacgacgccccactgccctaaaagcctctcccgaaattttctcccatagcctttaagaccgtgaagaaatatcaagaaactagtccgtatcaaacaccaaaatctttgatgctaaacagatagtatatgtaaataagagcattgtaattcgtcagaaaaaataattcatacatcaaacatccaaataaaacaaatgcaagttctttatcagatatattagagtcaagaaagagctgaagacctgtgcttcccccatagttaacatcaacaaatgcccatcctcggcttgtccagtactgaacaccaagatccagaactccacgtgcttcatctgtaggtccacctaaagaattgcaacaatgtcaatacgagtttccatttcctttctttaaaaaaaagtacatttccttattttaatgttctgctttcccttagcaattcaaaaggcttgtcagtcaagtcagtcaggacttaggaccaatgagagctctgtgatcttttatcatcactacaaaacattcttcaaacaaaaacaactgaaataaaagagaaacaaagtgctgctctatatcactaacaaaattgaatgagaaaaaccaacatcatgtttcctaataacttctgctacaagtgtgaccagtaaagacaaaaagaataaaataggctattgaagtcaacgaaatatcatataactaattaccatgggttctgaccaataacggaggtttctcatctgacgacccttggaaaatatgattgtgcggggcatagaaataagcataagccttctggccggggactacagttggaaactccataaattcaggcaaactaaagtaggacgcatattgcataacatcctctgaagaggaccagactatagagaaattagttgctgtttttctcttttcatccagtgtcacctggtgcaaaaacagaggtcaaagggttgcactatattgaaggaattcagtttgaatagttggcatgtgacaaccaataaggtagtcgaatgaaccttagcaatcgacactggaagagtagcagatgcaccctcaacatagaagaacccatccccagaaacctagaaaatcaggaggatttgagttaaaagcatcagcattccaacaaatttaaggcactgacgagtgagatccaaatgttataaccagcaaactacaattagttctgaagttgactcatcgcatttcatacacatactatgttagttacagaagagaagggaatgtccagttctgaaaaagaccctgaatcatggtctagcactccagcacatgaccttccattctgcctggataagattcaaagttatgaattacacacagtaaaccaacacttgagtatgggaaaacatgaaaaaacctgtaacagcaaacgattttgttactcgtgtcatcttttccaaggaaaccataggagctgacaccaaaaatccacattggctttgagaattcagcatcaagtgaatacagttgcactatcaaattgctctcctcatcctgttgtaaatgaatagcacgtaaatgccaagtaagaggacaaatcgcactattttcagtatctttagcaacataattttagccatcatggttaggatggactcttttctttttgtttttagtgatgataaatgtttccctcattctaaaaaattagcagttagtggtaggatatcaacatgaatattacgctgccccatataatggagacgccaacataatatctcaataataaaatggtttatcacaagttcacaactcttcctactgaaagaagcatatcaaatataaacagaatataacttcttgtatgagaaattagactgggaagtaggcacaagtaataaagacagaacacattagcgctgagagggttgcagcggatataaggtccggtatgcaccacaccatacttcaatcaagtagtttgcaaaatcagatcaacgggcaactgaataaaaataattagttcagggaagatcatacccatttataaatattccaaaacccactctctcggtcagttatgaagaacagctcccctgaagaaaattgattgaattaagtgatattttggaaatatatttgcacctatcttttggagaaatgaaaacctacagaatgattctgacatgccaaagattcataatccatgcagagaagaatggtatagctacaaggatgaaagagcatgtcttgaacacataaaaaacttaaaataatataaactgggtatgaaaatgctaacaccttttgaagtccacttgggttcagtaggagattctactaacgttgggtcaccaccagcaatgcaaatcttgttgtgtacctctctgcatgttatgaatacgtaataaatatgtaggcttggaatatatcattcaacattcgcacgtcaacaagcaacccaaacatagtttattttaggaaaaaggatggaataatgaatatatcttattgaattgactatttgccgtgaactagagactacaagatcagtgtgttctcaaatatggactagtgcagtaatgctgaagattagtaatatgcacaactccatgttccttcacatgaatacaaagataaagatctaaaatatcattcagtattttcaaagcaaaaaaggtaatccagtagtagatagagtagtacctctttctttatgaaaactagttgagaacagaaagcatgcaagtaagaaattaccctttctcagagaaatatccaacccataattgcgctttatcccatgacatgtttgggttactccattcaatccatgccatacgccttttaattggatcaatgcgtggaaaagcataaaaatcgttgccactgaccagcacagttggttctgagcaaaaacaaaaaggttgagaagtttcaataaaaagttagtgtaacaggtatagttcaaaagaagcttaccattagcatctctgtcacttattgttacagcagcaattgttgtcacgggatttgagctatcctttcggtgatctgagtttaaattggaacttccttaaaaaggtaacaatggaaagcatacctactagaatgctaaatgtgaaataaaatactaataaccttccattatagtacataacgacagaagtgaggatcaaagacaccatccgcgtaacggagcactgatccagtgtaatctggggtcagaggttgtgctgagttatctgaaatcaacaaggaaaagatttttgaaatatattagttaccagatactctttgaaggagcactccatatggcgccttttttagcaatgatgactagtgacttaaagactaaaaagatacatcgaataaaccttttgaaaatcaaagcggcattactattcaaagaaaaaaaaataaagataggctagtttcttctcattttcttttctctaaagcatggagatctcaattatgtaaacaatttgcccatgcatttggtcatctgggtcccaatttccatgatgcatcccaaattaatggcagacgaaagcttaactacatttcaactaaattttcagcggtgcctcacgaattgcagacattagacctgctcaggttttccactcaatcgtaccatttctgatccattttcctcaaagctactacccctctgtctcaaaatatagcaacctagcgttggataggatataacatagtaaatctggacaaagccagtattaggttgatatattttgagacggaggtagtccatcataggctgcgtgggcaatgtaccaacctacaaggctacaactgagaaccggtgcagtccttgtgaaacagcagaagaacagcaactgcaccagacctggtccgttgacttccattcgaaggcctaagacttggtgcaatgcgagctcgagtagtcgagttcaccaactattatccacagtaaagagtacggtatgctgcaatggcgcggcttgttcggtgtacctccaatggtctgcttgtaaaggcgctggtcgctgtagttggagaagaccaccacatccccttgcaccgcgaacgccccgccgccgtactcctgcgccagggacctcaccgcgaacccctccggcgtcacatccacggcatcgccgcccggctccgccgcttccttcactaggaccgctcgtctgaagaagaagaaaaaatgcagcatcaggagagcaatctgaccacgcgagaagggggtggatggcgtcggcgcgcgtcgcgtaccctccctcctcggggcgcgtctcgacccagaggagtcggccgtcgccggcgacggcgagcccctcgacggtcctcccggcggcggagacggcggcggcgctgatcggcgactcccatgacccgtacggcgccaccaccgccttctcggccgcggcggaagcctgcgagtgcatcgcgacagggcgtgcgtgcgcgcgcgtggcggctgccgggagttgcggggtggaggagagcagaggtgaggtgagcggcgttgctgtcaagaccgcgggtaaactccactactcttctagtcttctgtacctcaccgccaccggctcatcggtccaactcgggtatcattaagaacttaagaatgaataggatactgataaatttctgtattactagaacagtacttcggtaacaacgactcctatcggatggcctaataagaaaaaaaaaggcaaattttgaattttcaaacttaattttgagattattttaagatattttcaacgtgatttctttttaagcattggcttttaagtcaccgagaacacgtatataaaagttttacctacaaatacaattttattcactaataagccgttttggcttattaaaaaaaaagcgaaacgatggaggccacgctaggcctcctcgattgggaatttgggatccagtgaagttagagaagctcggtggtacgactttgaggtattctcagccgtccgatcgacagcgaacggacaagactaatctctacagtgcaccataaacagtatattgacagtatacttacgccctctttatttaggcttataagccaacttataagttgaaaagtctaagccaaaacaaacaagcagcttttttatttggcttttttaagccataagccactataacactattaagccaaaagctaggttggagaagcttttttagcttatatgagatagatgtatgactccaccactaaacttaggacattaaatccattggcttataaatcatataagccaataagctgacttaaaagtctaggccgataagcctaagcctaaacaaagagggccttaacactttctacagtaaaaactgcatatcactgttcttaacgagaaagcggacaatatgccactctataggttgtgttaagataaaatgccactcaatacaatgcaccagataaaatgccacccaatacgttgcctaccggatgaaatgccactttaaagatttttgtgccaaaatgtccctgagagagaggaagaggggagcgctggggagggctggacggggaggggagaggggagctc

SEQ ID NO: 45291 - DNA, 23713 bp, Oryza sativa
ccccgccgttgccgcttcccggcgaacacgcaggtaagcgtgcacgctgccccgtcctccttccccgcaccgtcgcctcctcctccctctgccgcattgtcctcaccgccgctcgcccgccgccctatcctcctctcccgtcgtccctgccggccggcgccgccaccacccggtgaggcctccaatgccgcctgcccggccctccccggcgcttcgctctccttctctctctcttatatatatagggacattttgggcacaaaaatctccaaagtgtcatttcatctggtaggcaacatattgagtggtgttttatctagtgcattgtattaagtggcatttcatctgaacccaatctattaagtgtacattgtccgttttctcgttcttaactacggcactagactcattttactgtgcacctttgccgtttgctcctaaagtcagaggagccgaatccaggcctgctcagcacaactttgatttactagagtacctctattttttttttaactatggctatgcaaacgagacttaagctaagactttgcttgagagcccgttcagcttttataattctctcgtttatcatgagcacgtctttcaaactttctaatcgataaagattttgaaacgctagtacatttgaaactaaaacatttcaaataaaggatggacagaacgagaagaagattaattctaggatgggaagaccaaagaccaaaggcatgttctccatttcacaatgtaaaacttcgtagaattggccacattcatatactacctccatattttaatgtatgacaccgttgacttttttttaacgtttgaccgttcgtcttattcaaaagttttatataattatcatttattttattgtgacttgattcatcatcaaatgttttctaagcataacataaacattttcatattttcacaaaaaaattgaataaaacaaatggtcaaacattgctcaaaaagtcaacgtcgtcatacattaaaatacggagggagagtacatattaatgagctagaaagtcttgcaatttgaaacgcagggagtagcaaactttcgcataatagaagtgtccataaaacaaaatcattgttcatataactcgtgttttattccagtaaatatatacacgcatgatgcatgtcttgatgtcttctcacactaaacataaacaatagtacaagagtacataaatcacttaaagaaaatgtagcggtaaatagtgaaatcgatagcacgggtgcctgcattattgattattgatgccgatcgatttgaagagttgcatgactggttttaagcagaaggagcattagagtcatcgtcgtcgtcatggtgatgctcgtcaaggaaaggatagtcggtgtacccaaccacaggatcctgcgtgtagaaggtgttgcgatcgtagttattcatgggcgcatcgagctcgaacctcttgggcagatcaggattcgccaagaagagcctcccataggcgacgaggtcggcatagccatcggcaaccgccttgttcccttcttcccggtcgtaccctccggcggcgatgaacgtgccattgaactgcttcctgaagggcaagaggccgtgctgaatttgccggcggccgtcgacgatggccatgcgaggctccaccatgtggcagtagaggaaatcctcgtgcttgttcagctgctccaccatgtacgagccgagtgcctccgggtcggagtcgacgcagtccatgtagtccaggaacggcgacagcctgatgccgacgctgtgggcgccgatctcgccgacgacggcgtcgatcacctcgacggcgaagcggcaccggttctcgaggctgccgccgtactcgtcggtgcggtcgttggagctgtccttcatgaattgctcgaggaggtagccgttcgcgccgtggatctcaacaccgtcgaacccggcctcgactgcgttcctggcagcgagcctgaaatcgtcgacgatttgcgggatctcgtctgtccgaagccgtcgcggcttggagtacaccatcccatagccgtccggtgtgatcgccttgtcggtgcttgagatgggagccaatccgtcaggctggaaacctgtagcagagcatgcaggatgagaaacacacggcaaattcggatgtggattttcatccagcgacatccctcgttattcgcatgtcttctaaatagttatcaaatttttttaaaaaaattgacaacatagattaatacgaaatatatcactccacaaacatgcaaaaccaaattcaacttctataagttgcaacaaaaataacaaattaaactgaaaatagttaatgcacattcacaactatatttgttatttttgttacaacttgtagaagttgaccttaaacttgcatgtttgtggagtgatatatttcgtattaatctatgttgccaattttttttataattttttataactatttaggtgacatgcacgaaacgaggggatatcccctcgagggatgatttcactttcccggcaaattcatcaacaagaatgtacatatttcgtggtgcacgtaccgttgttggagactcttccgacgtgccagagctggcagatgaagagggcgcccttgcggtggacggcgtcgacgatgggcttccacgcctcgacgtgctcccgcgtccggacgccgggtgtctccgggtagccctgcgcggtggcggagacgccggtggcctccgtgatgaggaggccgccgcgggtggcgcgctgcgtgtagtacagcgccgcgtgcggctgcggcacgttgccgtaggatcggcaccgcgtcatcggcgcgagcagcacacggtgggagaggtcaagcttcgaccccgggcgcccagcctgcttgtacggtgtcagcagcgggatagcctgatgatcgtcgttcgccgccgcttgatgatgctgcaccatcttgtctcggttgattggtgattgctctgcttggatgatgtatgtatcaatcggcgatggaaaactaacaaatgcgatgcgatgatctagctaggctagctctttgctctgttcttgctaaacgctttggctgtgtgccgaatggggttggagtttggttgtatttataggtgtcggagtggaccctcgcgcgtggcgacggcggttttctccattgaccggcagagtacgctaatattttcgatctgcaaaatcgcgctgcgctgctggctccatatagatcgttgactcttcctccgtaccaaccatgccatatcgtgatttcgtcagccttgcgtcgtgaacttggtctgcgtaacaggcagcagccctgttgtctgcgtatcaggacatgtttcgtttgcatgacgagcatattacacatgtctgtggtcatggagatatatatggtcgatcatcagcatgaacaacagatgacgcaggtacaccatatacctatatttgtgctcggccaacttcatttcttaagcacctaagatgacattacaaatcaaaatttgcaccagagtaacaacacaagcaaacaaaaatcacaccataaagtcgtaaactaccaaactgctttgttcgttgattttggatgataaattagataattttgtgattactgatatatttgggttctaagtccataattgtgcaataacatagcttgaatctataaatttgtaatttcgggattgtagtttaaatgctaacgtcttataaaacataatttgaaagtgaataacttcagctatacaaattgtagggaataaaaatgtttgaccaactttttgaatctaaaattaaacatttgaactgaattgcagtgaaatttgatgaaaattcaaaggggaaattacaaaatcacatttttctctatttttctcccctaaaaaaaatgaaatgttatattttaaaaattaaccacaaccaaatttggaaatatttccatggaggggtagggggggttgaaattacctttaatattttgaaaattctaagtattttttatttcatttttttgatcaaatcatcatgtccactccgatttttagagtcaaaactgtttttaccttgagatctatatttttaaaatgtagaaacaagaggcaatatagttattccctccgtcccaaaatatagcaacttttggctatgaatctggacgcatagttgtccagatttatagctaaaaatacttatattttgggatggaggtagtatttgtgaaaaatctcgtggtcaattaacagattgagtataaaaaagaacaaaacaacttaagggtataaaggaaacatggctaaatttaggggtatgggaatgatggagcaaatactcaatgacacacaagaatttttttttatatgaggatcatcgcaatgatatctttactcctttataaacatcaaaacataagtctgcctcaccgccacaatcactaatatttgggcctcacaaagtgggccccacatagctagttcttatgaaaatcgatgacctctttctttcttatacccctccagttggatttttttactgtaccctcgggtaaatatggatcatccattcgttgcatccagcggatcatatccgccactactacactgagtattatggatagtattatttctccaagggtagatttggaaaattttgcatggtaaagaagtaatttcgcatgtgttaattaccggttaatttttttttctaatctactctattttttacgccatctcttggttttctcagactgtaggtgggcctgtcctagtgatgaacgtgcaagtgttcatacgggttttttgtttttttctgttgattttgttgcttctaatccggagagaaggacggttcgccgatccctaattgcatgaatgcaaacatggttggaatgcatcgctgctctttcttcaaattagtatatgcatatacacatgtgcccgtctaaattgatggaggattcctaaaaataaattgatcgagcattactcctgttcaagacgccagtgagaaggttaagacgccggtgagaagttatatgaaccggcgatgaagcagccggcgtcgcggcgaccttgccatgatccgtcgattaggataattgcagcgccaagattacgagcaatacccttctataattgaaattagagttgaaagtcaaaaataccctaagcatttttaaaagccctaaaatacccaaacaaatgaagggtcggatttagtttctactacactactaccaccggtagtaaaatgtactgtaaaaggccccctccagttttgtattctctctctctctctcccctttatcttccattctataatttggacctgataagcaaaaggaaaaagtacgaattacccccctaaacacgaaaaccaaatatttttcacctttaactatcgataccggatgaaactccccctcccccgagcagttttgcaagcggttttggtctacgtggcagtccagtcagcaattcatttttttaatcagcgggccccacctgtctgtctcccacactctcttttttccactcacctctctggctgtgttcggttcaaggggttcccaacccctttttctcgttttccgtgcacacgcttttcaaactgctaaacggtgcgttttttacaaaaagtttctatataaaagttacttaaaaagatcatattgatccatttttgaaaaaaaacaaatatttaattaattacgcgctaatggactgctccattttccatgccggagggtaacgttcccaacccaatgtaacgaacgtagcctctatctctctccaaaatccactctcttctccctccctcaccacgaggacggcgggcggagcttcgggtgacgggaggagggggcagcggagctcgaggcggtgggaggaggagtggtgggaggagcggacaacgaagggcggtgcttggggtagcggaggggcacccgcagctagcggtgctcagggagatgaagggggcgatggagcgagctgaggacgacggcgggccgagcttggggccaagggggcgacggagcttggggcggtgaaggggcgctcgtagccgccggcgcgcggctcgttgaggcagcggaggggatgcccgcagccagcggtgctcggggaggtggagggggcggcgaagtgatccaaggatggtggtgggagaagttcgggcggcgaaggaagcacccgcagccatcgccgcgcggctcgtcgaggcgacaaagggggcgtccgctgccgtcggcgctcgagccacaactgctggcatttgagagagagagagggtgggtgagaggggaagacatggagtggagagatatccgacaggtagggcccattgtttctttaataaaaaaattactgactagactgctacatagaccaaaaccgcttacaaagctggtcggggttttttttatatggtatcgatagttgaggggtgaaaaatatctggtttcgggtttagggggataattcgtactcacctgatagttggggagggattcgtactttttcctaagcaaaaatatatgatacaattgctggggcaagaagaaaacatagaagctctaaaaaatatacatatatgatggacaacattaataaaaccataaaaggcaatctgatgttaaatgataagaacttctcaaatgatttaatcatgagcatgtcttcttttcatctcgaccagagagcacatacaccctctaaaatatttcaacagaagcccataatatcatctataaagaggcccataattgtataatttttttgtgtgcatgtatgctaaagtgtcttaagggcttgcccaaaaataattcgtacgatcggcattgtcagtttaggttttagaggatggatttctagccattatcaaaaataaaagttaaggtatttaatttggaattgtgacaaaaaaaaatttgcacaagtgatggaaaccattgtttggaattaatttggatttatatgctaagtaaattcaaagagagaaaagttttttttaacaagataattcaaaagggacccatgctgggatgtaaaaaaaaggacagcacatcaacttataaaattacaaaagaacacatatatttctcatgtggtgtgaatacatctgcgtttattaatcccaatatatttggatgcataactaatcaaatatcaaaatgaattagttgcagacataaaccatcaaaaaagagagaagaaaatgacatcttgcacgcaggcatatactaacactgtttacatgaatcgtgcacattattattgtggatatatagaaccaacaactaaaatagcacaaaatctaagcatcagcaaccgagttgttctgatcctcatcgaggaaagggtagtccgtgtatccaacaattgggtcttgagtgtagaaggtgttgcgatcatacttgttcaatggcgcatcaagctcgaacctcttaggcaagtcagggttcgccaagaaaagccttccaaaggagacaagatcagtgtagccattttcgatcaccttgttgccttcctcccggtcatacccaccggcggcgatgaacgtgcccttgaaagctttcctgaatggcagcaggccgtgctgaatctgccggcggccgtcgacgatggccatgcgaggctccaccatgtggcagtagaggaaaccctcgtgcttgttgagctgctccaccatgtacgagccgagagcctccgggtcggagtcgacgcagtccatgaagtccaggaacggcgacagcctgatgccgacgcggtgggcgccgatctcgccgacgacggcgtcgatcacctcgacggcgaagcggcaccggttctcgaggctgccgccgtactcgtcggtgcggtcgttggagctgtccttcatgaactgctcgaggaggtagccgttggcgccgtggatctccacgccgtcgaacccggcctcgatggcgttccgcgcggcgagcctgaagtcgtcgacgatctgagggatctcgtcgacccgcagccggcgaggcttggagtacacgatccctgaaccgtccggtgtgatctgtatgtcggagcttgagatcggtgcctgcccatttggctggtagtctgttttgcaaagtaaattcaagagcagaattagaacactatcgactaatgatgatcgttactaaattacatggtaatgctaagaaattaatttatgaacacgaacataaaacattcatgcgcgtttgacgagtgtttaccgttggtggagactctcccgacgtgccagagctggcagatgaagagggcgcccttgcggtggacggcgtcgacgatgggcttccacgcctcgacgtgctcccgcgtccagacgccgggtgtctccgggtagccctgcgcggtgtcggagacgccggtggcctccgtgatgaggaggccgccgctggtggcgcgctgcgtgtagtacagcgccgcgtgcggctgcggcacgttgccgtaggatcggcaccgcgtcatcggcgagagcagcacacggtgggagagatcgatcttgccgccagcctgcttgtacggtgtcagcagcggcatcgcggcttggttgaccatctcgcctcggcctttctcaacgcttctgcctctctcttgcttgcttctgaactttgctctgcttgacttcttgatgaacgcttttggttgtgatgaactgcatttagtcgggagttctatttataggtgtccgtgcttgaagtgggaccggcggctcggcgcactttgtcattgaccaatcatgcaaccaatcatccatgtgcatgcagagtttcccattttcaatggttccctgcacgatatttctgaccccgttctcatgtcactttcttcgtctcacgtagcagccactgtctctctgacgaatggaaatacgtctattattactttatcgactattaccatatccagaggcgtttcttttttgttttcatataataacaaacaatacacgaggtgtggtttgaggagtctccagcagcatgaccaagcaatgacgcgagcataagaaaggtgcgtgagtgatcaacagctgatcatagagattctgattgtcaaacatcccccactgtggcggtttgtaatttatttgtatcaatcgtgcgccaagtgttttattgataaccattttaatttgctgcaaaagctacgggtatggattatgtatgcgctttggtcagtggggtgaatatcgcgcgcacacacgtaccagctgatcaactgaagtaatcagatcgatggtactcgtagtttactcgaatgactgatgctggttattaggaacttactccgtttcacaatgtaaatcattctaacattttttatatttatattgatggtaatgaatctagataatgaatctagacatatctatctagattcattaccatcaatataaatgtggaaatgctaaaataacttatattgtgaaacgaagaaagtatgaatttttctacataataaatatgatttccatcgtcagcctctcctattaatcacacatagaaaatgttctaattcaaatatgaaaaaaaaggttgggacaaacccctaatcctatatatctataaaattcatccccactaagatgtaattaatgctaattctctcttctctcatgaagccacatcatctcaattatttttagtctttggatggttcattaaagatgtaaattgcatctctcctcccaaaagacacaccatacaacaaaaatcatttataaccttagctaaaattgatgaagatacaaaaatacataaacacatgaaataaatggtttaataggtaagaaagaaaattttagaactcatatctactatattatcacaaaattctcccgtagcaacgcacggggtacccatctagtttactttaatttgtgaccagctaacttaaaaaaagatccctttgttacataatataaggatttgtagggttggacacggtattaaaaaagtggttataattgttatgattggttgaaaagtgatggtaggtgaggaaattgaatggtgggggattgtatttgattgaaaagaaaatgttggtggtgaagttattatattttgaaacaaactttaaaggccaggagttgttatattttagaacagattgagtatataagttatgttgcatcattctataggtgctagatcacctaaagtaaaataaataaccctcagctcgatactagcttcaaaataaataagattaccatagtttgtggtgttatgttttttctttgaaacagagagctattttcaagttactcttctagagcaatcttaacaaaccatttctctgttgcacattagaaatgttccctgctatctataattcgtaattggtagtattacgagagaaagttggacaacagttaatctcattttctttgtagaaggcaagcctgcttaattaagtgcttatccggatagcttaactaaatgtgggagctgacaaaacagtggagccaactttaacaaagggggcggatcacaggtcctcgaggaagcatcgtactcctcgtgttcagattcgttgtactatataacgttacatccacatcaaggctgatttttttggatggaaggagtagaagataggcatcataacttttttagaaggatattttacccggactctgtatccaaccggatatatgtatttttttaaaaaaattaggaactgagagagtagaagataggcagcgtaacttttctttttgagaagggcattttacccggcctctatatctaaccggatatatgtattttttttaaaaaaaatcaggaacttagcttatcgaacagaaaattagccatcaaataatttaatttaaaattcgctcctataaatatttgaactcaggaccttagatactactcagatcactgcaaccactagattacatgccctttcacggcagcataactacttaatatctccggggattaagaaaatcgatgtgcatgcagccctgcccagatatatgtggcgttgagcgctgctacgtcctgccattgccaacatcagcgaatacgttgggttcggcctacctgtgttgacgaacggtgtcgcctaatgcctcgtgctggctcactgtgcaattaagactttctcgcagtcaattatccaatccataatgcgattgtgacgatcgatctcgcagtgtacttttgtggtattaagttacatgcatcaattaattcaacacagaaactttagtagatgtgaaacaattttgctatatatttgtctataaattctcctccaaaaatttgacaaatgtaattatagtataatcacagtgtaattacactgtaacttctatgtaactttcaaaaatctctccgtaacatgttatttcggtaaaatggaggtcgtgggaacaaatcctttcacatatatgtgtgctatgatttttttttcttcctcgctagaacaaatcttataatagatctaacgattcaaaattacgtgaaagttacatgcaagttacagtgtaattacatgcaagttacagtgtaattacatacaagttacagtgtaattacattatgattgtactataattacatctgtcaaatttttaggagaaaatttgtcgacaaatgtataggtggtcccgatgtgaaaagatggctaattcactcactttatattccaattaacacactccttcatacatggtcccctaaaacctatagcatggaataaaagtgaactacaattttatttaattacgtgttagctagaatatatatgaactctaagatctctagctcaaatatcatattgagttatacgcaccgattattttaacttaaaagcttaatctaagtcgataacaaaagacaatacactcacttaatatactaacatgtaggctagaataaaagtcatgccgtccttaacctccgtaagttatggattctcatcacactcgtagccctttttttctactactctactctacatcgaagggtttaaaattgagaaactagccaccaagttaatcaagctatataattgagaaaccatttagtaaactggccaagctgaaaaggatcggaggtaattcaaacttttggcaaaacttatttaaattttgccagtttctgtcgtcaaaccaacggtaatcatggttatcgatgagatcattgggggagctgtatgcctggtgactaaatggtttttgcaaaccttgcaacacagtgccgtttactccaatattagttgctttcatactatatacctataaaattcgtaaagttcatccccactaaacgtagttaatataaattctctcttctatcatgaagtcacattatctcaattatttttaatctttggattattcatcaaaggtacaaattgcaccttttatccataaaagtcataccatacaacttaatcatttatggtctttggataattgatcaagatacaagatacaacatatataagcacatgaaagaaaaccgtatagtgagaaagaaaagaatacaactcatatatatttatttcattacaattctctgacaacaacctgtggggtatccatctagtaatactggacacttcacaacacggtgatgtacatacaaattttagttttgccctctttaatttttcctgctacatatttgcttgatatatcataaaatttagggaaaggtccaagtatctcctttttaaaatataagttttattttgtttggttaggataagatttcatttacgtgaacttatacaaagctttgaccaacactttactctattggatatagtttttatgacacaaaaatttaaatttattatatccgtattaaaaatatactcacttatgattattcttttccatgatataattgatattctatataggataattttttaaaggttatcctaatgaaataaaatatgttttaaattttaaaatagagggggtggtgtattagtgttggtgctctttgaagaatagtatacaactgttgatgcgggctagagaagaaaagaacatattttttaagcggtatggatataatagattaatctcgggcttatctgatttggtgtcctaccaaatcattggtagtgtctgttataaaaccagccccgaaatcgacatcggtagctaaacgcggaagaaaacgccataggagatccaaaacgatagcgacactgagacacgatatttggtaacggagttcagccgtagcctacatctccggggcattgattacgggcgctcctccccgatccagcatatacaacgtatcagagttacaacgactcacggccggtcgccgccggcagccgctccctcacgctatgctaagtcgccatgcggttacaacaggcacgcccctctatttatgagagatcctaggatagagtccgactcatactctagtcctaatacctattacaactccaagtcctaaactgtaaccgactacgtacacatattcgacacaaactctaacaaactccaccttggcaaatatgccacgccaatccgaatctgttacttgctcgaacctccgtgtaccaggacttgagttggttcttccgccgctcacgccgagtcgcccgacgagcctacgccaggctcaccgccttcaggatcgtgcacagcaacaccagcataaccattttccatgactccacctgcaacagcactcccttgtaacttgtacaaacatgagcttgtcctctcaccagtcataacagtcttgccatccttcatgatattcatggtcttcctatcagaatccacctgatacaaccaacccgtctcatgtaggcttccaagcgaaatcaaactcttccttagtcccagcacgtgtctcacatatgaaagtagcacctcatttccatcatacatcttgaatttgacatcgcccactccaacaacacgataactcgtgtcatcacctaagtaaacagcaccaaaatcaccagatttgtatgaagagaaccactcccgcttcgatgtcacatgataggaactagctgagtccaacatccacgcttctccagacttctcgttagacactgtgagaatctcatgactgctgctctctgaatcatcactatgggctactaaacttgcactcgcacttctcctcttcttcagtaatgggcaattcctccttatatgtccaaactcatgacacttatagcaaacatgatcatgctccttgctcttcgacacccccgcttcatgatcatgctttgccttgaccagcaaactctcagcctgagaagcctccattgcctcgtttttctttgatcttctcaagtctcgtgcaagcaacgacgaaattatctcctcagttttgacagtatccttgccgtacgtcagggtagtcaccacatgttcataagacggtggaagcgagcacagaagaattatggccttgtcttcatcatccagtttcacatctaacttacttagatccacaatcaactgattgaagacgtccacgtgcatcctaagatctgactcctcttgcatctgcaaaccatacagctgttgtttgagatacaatttactcgttagcgacttggacatatacaggtttgccaacttgtcccaaatttccttcggtgatttttcgtccatgacctggtacatgacagaatccgagagactcaagcgtattgttgcagctgcctgcgccttcatctcctctcacttgctagcatccatcttttctggcatcgtctcctcaagagccttggatatcccctgttgagccaatagattcttcagcctcatctgccagagaacgaaattcccggtgccatcgaacttcaccacctcaaatttggaaaccaccgtcgccgccatcgatgataatcaactcaacagatgttgccctattaaattgatctgccctgattaattgaccccaccgactaactcgaacagtaccagccggaccgaaccgtttttttttctctctccaaaaaaccggaacaggtgtcctttactcggtcaaagaatcagttgatgcggtcaaagggttacagatccaaatcgaatcccgtttcttgctccttctgcccgactcctctcggcccgattggcgccgccgcccagcgcctgccgtgcctctctccccactgaccagccgagcaccagagccgccgcaccccaccaccaaaccgcgccgccgtcgaaaatcgcctaggttcccgccgccaacgcccgtcctcgagtgcatgcctgcaggtcctgctgtcgacgcctctgaagacccccggtgatggacgacgctgccccgacgcaggagaggacgcctcctctgccgccggtgtccgccgccttctccaagagccggcaccgccgagcttccgccgcctgcacctgctgctcgccgaaaaccgtgcagcgccgccggagcccgacaccgcagaccacctccgcccacgaaatccaacaggtcagatctcgccttgctttggtagtttgcccgattgcttgttgttgcaatcccgtggtcctctgctgcttttatttggagaaattcgagtccaattcttaaccaaatcgaagaaactctttgttccccttccgtgtacgagttggtcaccggtttggctttttccatgcgtagccaggaaggactcgtaatccgagtctatccgctgtgcctgcaaaaacccgagtcggtctcctgcgtaaatccggcccaaaacagaaccatcttgctacctctggactccggtcacatgtagtctacggcttcgacatgcaaacgtgcacgccgccacctctgatgacctcctcagccaccacgcacccgtacgacctctagcgcagccaaccaacatcccgcccaacctcgccagcgaccaatatcgccggtcagttgcaaccaatgcctttgctgtactaacacgattgaataaagcattgacgatctgaattgaccacccctctgcctgattccatcgcttgtcgtatgtacgccttctctatagcatgtccatcacgcaattacctcatcaacaccttcaaaagctgcctctaggaaccacccgctccgacttccgattaaacaccatcaatctagtcgcgagccgaagccgacaagttgcatgccgtcttctcagccgcgaacgacccgagtgctatgtttagccgtctccctgtcgaacgcaactcatcgaaaggcccaggccaccccgcccagagtgatcgatccacccaccgagaacgccgatcgcctccagcttcaatcaacccgagcgtgcggccgcacgtctccctattgagagtagctcaccggaaagtccgagccacccgctcgaagtgtccgacccaccaattggatcaccaatcgcttctgccgccatcaaccagagcaccacgtctagtcatctccctgttgaaagcagccatcgaacggttcagaccgccgcctgaagtgttcgatccaccgatcaaattccgttgatcgccgccgtgctctaccttgcgcacatgtccctccctggacataaaccacgagcggcgcggtgtgaagcacctccatcgcgcctctaccatggacctcccgcaagctctgataccacttgttataaaaccagccccgaaatcgacatcggtagctaaacgcggaagaaaacgccataggagatccaaaatgatagcgacaccgagacatgatatttggtacatccttttttttgcggcatgctctctgatttacggattcgcagggggccgagggccaaccttagttgactgacaatgacaaaggcttgagaaacaaagtagtgcctttgaaatggaatcttaattaagtagtctatcagtggtgcgaagcagctttgccccggggagcgaaaggttataccttgccgtagcctacatctttggggcactgattacggacgctcctccccgatccagcatatacaacgtatcagagttacaacgactcacagccggtcgccgccggcagccgctccctcacgctatgctaagtcgccatgcggttacaacaggcacgcccctctatttatgagagatcctaggatagagtccgactcatactctagtcctaatacctattacaactccaagtcctaaactgtaaccgactacatacacatattcgacacaaactctaacagtgtcaaatcatgggtaaattttgacacttctaatggtttagtagagttgggttataggagttgcattacatttggtaaatttggcattaatctaaatatttataaggtattatttaaagtgccaattatttggttgggtaagttttggcatcaaaccacaacaggcttgacaacagcccatcatgcccatggttacatacctacgtaaacaaaattcacctcgaggtgcaaaaaattgatatacgcaaacataaaaaaaaaagggggatggatggaagtgagggtcacttatgagtgtatcacaaatatagtgcacattactaaaccgaacatttcaatttgacaatttaattgaggattaagcataagtagcagcgccctcgtctttctcatcaaggaaaggatagtccgtgtagccaacaacaggatcctgtatgtaaaaggtggacctattatacttgttcaatggtgcgttgatcgcgaacctcttgggcaagtccggattggccaagaagtgcctcccgtaggcgacgaggtcagcatatccatcggctatcaccttgtttccttcctcccgatcgtatcctccggcagcgatgaaagtgccattgaacagcttccggaatggcaggaggccatgggtgatcttcctgcgtccttccacgatggccattcttggctccaccatgtggcagtagagaaaccccgggtgcttgttgagctgctgcaccatgtacgagccgagagccaccgggtcggagtcgacgcagtccatatagtcgatgaacggtgacagcctgatccccacacggtgcgctccaacctcggcgacgatggcgtcgatcacctcgacaacgaagcggcaccggttctcgaggctgccaccgtactcgtcgctgcggtcgttggcgctgtccttcatgaactgctccaggaggtagccgtgcgcgccgtggatctccacgccgtcgaacccggcctcgatggcgttccgcgcggctcgcctgaagtcgtcgatgatctgagggatctcctccgtcctcagccgtcggggtttcgagtagacgatgcctgaatcgtccggtgtgatctgcctgtctgtgcttgagatgggcgcctgcccgtcaggttggtattctgttggtaattaattcatggtttgcaattcaatcagccaaagagaacaatttgcaagaaaccaaaaactcaacaaaaacctatgaatcaattgccagcagcttaactatgtgaaggagtacataccgttggtggagaccctgccgacgtgccagagctggcagatgaagagggcgcccttgcggtggacggcgtcgacgatgggcttccacgcctcgacctgctgctgcgtccagatgccgggggtgtccgggtagccctgcgcggtgtcggagacgccggtggcctccgtgacgaggaggccgccgctggtggcgcgctgcgtgtagtacagcaccgcgtgcggccgcggcacgttgccgtaggagcggttccgcgtgagcggcgcgagcaccacacggtgggagagctcgaaccgccccatcttgtacggcgtcagcagcgggatctccgccgccgccgccgcgtccttctccgcctcgcgcgccatctcaacgctagtgtggcctctgctactagctcactgtgctctgctctgctcctctattgtgttttgctccgagtccgatggtccaagggggttgatgatgctctttcatttatagcgtctgagtgggaccctggcggcttgacggaaatgtgcgcactgctattccatcggatctttcctgcgtcaccctctccgtcatcgtctggtcggtaggaaagtctctccttacctgggagagcgcactgattttcctcgtgtgggggaatgcgtggttctaattttctaaacattctttaatgcaacagccgtctggtgctgaactactgatgaccggtgtcaatcaacaagagtaagagatgcactgagctgttagttcttttttttttaacgtataggtttcttgcattatcggcttcaccttttcgcttatatttatatttattagtcaaaattaaaatttcaaccttaaatgtagagttgattttgagatttttttttgtcatcgcagtttattttttatcttttgcttgtttctcttagatcgttaagaacatgtatataaaatatatacaacactgcatctaatacaattttactagtagtagtaacccacgggctattattattgatagtataaataaaattttaattgtagcaggttatactaaagggaaattgctttgcgtacgataaaatttgtacgattttagtacgatcctaccatgcatgtcttttttttttattgggtggaaacatgttggaccccacatttgcatcacacacaagagactatgaagtatcgtagtctgatcgtatgaagttttatcgtacgtatagcaatgctcatactaaaggtagagtccacaccagttatgagttgctaattatgaatacgaatttttagaattaaatttcaagataggtacgtctttatatttattcaatttgaatttttgagttataaatattagaagaactaaaacttaagagttcatagtgataaacaattgaatgttttggttaacaggttctccatatatagaaatacaacctaagtaataaatgatcacatcctttgagttagaacactactacacgatagatttttgtggacactaccctcttttgtttccatgcggttcgtaagtggaaccgcacaaaaaaataggggaaccggggccgagctgtcgcccgcacgggaaaatcaattttctcgtgcggtcctcctaaatggaccgcacgggaaaatgagtcgattttccagtgcggatctattaagagagccgcacgcaaaaatagtattccttcttttccctcccacccacttcaaaatttcccctcatatatctcttttaatttctcctcacacccctcccctcttatctctcttctctctccccctctctctttcacgtctctcctcttgtctcctttcggcgcgcgggtgacggcgacggcggcgtgcggcgacagcgacagcggttcgcgtcggtgcgcagtgacagaggcggtgcggcggcggcctcagctccacacggcggcggtggaggcgcgggatccggcgggcggcggccatccccgctcggatccggcatgcggccggccttcccccgcgcgggatccgctcccctcccctccccttccttccctccctagatccggcggaggggaggggcgtccgcggcggtgcggccagaggggagggcggatccggtgggcggcggcgcggagtctagcgggaggagggtggcgcggaggccgccaccgatgacgatgaggtggaggaagcggcggccaggagcggcgccgcagctgcgcgccaacgagtaggcgcccatcgcggctgctggcggaggcagcgcggcggccgccgccgacgatgacgatgaggaggagatggctgggatctggcagccgggagtgtcgccgccctccccacgccaggatctaacggtggcggctgccctccgctcggatctggcggcggcggtggcagccggcgtggcggtggcggggagtagcggatctagggttaaggttcggtaatttgtgaattttattttttttggatttttatttttccgtgcgggcgacataagcaaccgcacggaaaaatccgattttctcgtgtggggcgccacccgcacgcaaaaatcacgattttcgcagacgaagtgttgcatgtgggccattcatccgcacgcgaaatttttcttgaccgcacggaaaaacccatcccgtagcaatggaagcttcttcacaatgtctagttagagagatttgtttcggttcaataaaaagtacatcaagctaccggtacctcacggtaccaaatcatttccgatcgttggatctaacaatgcccatcctgtctagctatatccaataatcgaaaacttggtaccatgagatactggtaccttaatatactttttgctgaaccggagcaaatctcctagttagaacatatatggatagattagtggtatgtcgaggacaggaaaatgacacatcttccgagacacccaagctactgaggtaaagattcacgcaccaacaaatttgacacacaaagtgccctgcgggaaccatttctcaagcaaaggtccgcaaggaatgggggaaacaggccaacaagacctcattaattaggataaggtggctcagggcgggggagaagtactgcatcagccaccaagacaagggtgatatgtgggtgtgatcttcaccccacgccagaatcgccgtaggcaacgacacggtgactccctcatcaaccacggtgtcatcaacctcgccggtgagccaggagaggctctcctgatagattgcgatatagactctcattgaagcgggggacgctactagacgatgtggtgggtggggcaggctagatccgacaaaggagagtagggttttgaaggcatggcgccaaggtggtagatatgaggagagaggaacaagatatggggccgacttgaaacgagggaggataggggagggcgggggaggtggatccatggaggtgatctcgatcaatagatttaatgtacacatttttaggtctctgatttgtcacatgatgatgatgatgatgatgatgatgattataatgggtaaaacaagtcaacgaaacatgtaacccatatatttggcagtatcaatacaataaatactcaacaaaagataaccttaattaaattacaaatatgcatgcacagaaatctactcatgcgtgtttcacaagtacacattattgatccataaaaaaaaactcggcgatttaggtgataatcaaacaattactgtagctgagtcctctttcttctcctcaaggaaagggtaatccgtgtagccaacgacgggatcatgtgtgtaaaatgtagatccatcatacttgtttaacggtgcattaagctcgaacctccttggcaagtcggggttggccaagaagagcctcccataggcgacgaggtcggcatagccatcatccaccaccttgttcccttcctcccggtcataccctccggaggcaatgaaagtgccattgaattgcttccgaaatggcaggaggccatggttgatcttcctccgtccttcgacggtggccatcctcggctccaccatgtggcagtagaggagctctgggtgcttgttgagttgccgcaccatgtatgagccgagagcttcggggttcgagtcgaagcagtccataaaatctatatatggcgacaatctgatcccaacacggtcagctcccacctcggcgacgacggcgtcgatcacctcgacggcgaagcggcaacggttctcgaggctgccaccgtactggtcggtccggccgttggcgctgtccttcatgaactgatcgatgaggtagccatgcgcgccgtggatctccacgccgtcgaaccccgcctcgatggcgttccgcgcagccaccctgaaatcgtcgacgacgtgagggatctcatccgtccgcagccgccggggcttggagtacaccgtgtgtgaatcgtccggtgtgatctgcttgtctgtgcttgagatcggcgcctgcccattcggctgttgatctgttggttcatgtcgcaattaatcgaatcaatcaacaaagcacaatttgcaaagaccttatattgatagatcaatcatcagcaatatagagtgagatttgctccggtcaaaaaaaaaaaaaaacctcgaggtaccggtacttcacaatactaaatcacctccgattgttggatctaattgagcatgatagatattgttagatccaacgatcaaaaaatgatttgatatcgtgaggtactgctaccttaagatattttttgttggactagagcaaatctcattttctctactacttaaaaaatctgtagtggtggtcttgatttctgacatagcagacgcatctaacaaacacgtctaatctcaaccatccgattttcatatccaatggcgtcaaatctcctcccatcgctcctctcctcatcacgcgccacgcccactcctttccccacgccgcgtccttcgccctcctccctgcgtcgcctcctcgtggtcttgaatccaacagatcagatcacaattcaatcttccgcacgcgccccacgcatcgtcgatcgcacgcggcgcgcacacacacccctttcccccgattttctctccctctcaacgccgtctcccatctctgtttccttcgcgtccgcctcctccgccccgcaccaaatcttcgcctcctcttctcccgcctcgccggcgcatggcggctgagggtgagggcaggctggcagctgatgaaggcacactacgacccaatctccggctcgtcgaccgcctccacgcacgccccgcccccgatctccgccgcctcttctcccgcctcgaccgccttcacgcgcgccg

SEQ ID NO: 45292 - DNA, 10328 bp, Oryza sativa
  unsure (1)..(10328): unsure at all n locations
gctggtttttcggtgtggatctcgcgatgccaaaaacgcccaaaatgctctggatttctctcggtttgtttcttcctgctgctctgtttttagtttttgctgtgtttccaaccgggttggtgcccgatagtacttataggtgtcggaatgggccatggtacgggcggcggcggcggccaagatggccaattatggcaagtgtacgcacgcaagttcgtcagctcttgactgcactggtgactggtcacgctttctgtttatgctgtcgtcaccctctctgtcatcgacttggtggtcagaaaaggtttctgtctgctcccgtcggaacagattcaggccttgtttaggccgtgtttagtagttttggcaaaaaaaaaattaacgtatacatacatatatatatatatatatatatatatatatatatatatatatttaaagtattaaacgtagactaataacgaaacaaattacagatttcgtctgtaaactgcaagataaatctattaattctaattaattcgtcattagtaaatatttattgtagaaccatattgtcaaatcatggtgtaattaggctcagaagattcgtctggcaatttacatgcaaactatgcaattatttttttttgtccatatttaatgctccatgcatgtgttcaaacatttgatgtgacggaaaagttggaagtttgaatggaactaaacacagccttaatttttttttccaaaaacgccacatcgaattttgatcacatgcatagagcattaaatatagatactacctccgtttcaggttataagactttctagcattgcccacatttatatagatgttaatgaatctacacacatatatgtctagattcattaacatatatatgaatgtgggcaatgatagaagtcttataatatgaaacggaggaagtagaaaaaaactaattgcacagtttgtatggaaatcgcgagacgaatcttttgagcctaattaatccatgattagccataaatgttacagtaacccacatgtgctaatgatggattaattacgcttaataaattcgtctcgcgattttcaggcgagttatgaaattagttttttcattcgtgttccaaaaccccttccgacatccggtcaaacatccgatttgacacctaaaaattttcttttcgcgaactaaacagggtctgagaaaataatagaaaaagaagcctctacgtttgctctcatagcctagaaaatcccacattaattggtgaaaaataataaaaaaattaaaaaacaatttgagacaatatcacattaacagcataaaaaaaaagaaaaacaaaaagaatcaatcggacaccctgcttacgtagtaaaatcaggactctttattcaatttggaaacactattttaatttagaaaacaacagtcatacatggtctatcaaagtgaaaccaatcagaaacagaaatagaataatgcatgtatttgtttcatattgtactcactgcattaatggcaaaaaaatacacagacttagcaaccaaagcaaaatacaaatacacaaaacaatcatagctggtacgcgggaaatcatctcgccaaaattagcttcgtcaacaaattagataatagaaaaacaaatcaccacgtttgctctcataacctaaaaattcacacattaattaaaaataaaaaacagagtcatatttttaaaatttatgttattcagataaaaaagtaaaacaaataaaaggtgagtccatataaaaaacaattttcaaaaatatgaaatttggattaaatgtataaaaaataaatattgaaataagagtaaatgtaaaaatataatttataaaaagaaaatctaaaatcggattaaattagaaaataattaatatcgataaaatactccatgtagaaatacagtttatgttgccatttttaatacattttataataaaatataaaaacatatatgctactataatgaaatataaaagaattttataataatactagccgcgcaatctgcgtgggcaaataattattggagtaagcaatgcatgggaacaaggaagatagactgatgttatagtacaactaaacccaccttctttacatcaacatgtgatgcacgtagatattgcgacatgaattacagcacagagacaaattcccccggcaaatagtcttagctggaaggaactggggcggcagtattgcagcttccatccgcgccgtgagaaacaagctgttgtataaactcgtcaatgtacctctcatggagttccttgtcagctacaagctcttgcagcctgatggcgtttgctacaaacaccctcctggtttcttcctcaaccatgacggcccggaccgcggcggcgacgccatggcggtcgaatgacccgtccatgtcatcccgcctcacctgcgatcctaccttgttaccctccatgagccgcgcgttcggcccttggtccccgaagatgggcaacatgatgagagggttcccaaacagaagcccctcgacgagcgagttgcgcccacagtgcgtcaagaaagcgcccaccgcggcgtgcgccagtatggtgatctgcgaaacccaccccatgcaaacatgtccatggctcttcgtcgtttcttggtaaccggaagaaagnacatctgagagatcgacgccatggggctttctcagcgcccacagaaatcgtgtcccggcgagctccagcccgagagccagctcgtgcacctgctccaatggtagaggcacctcgctccccagcgccacgtacaccaccgacttcgccggctgcacgtccagccaccgcatcgtcgagttgtccgtcatgccggcgcgacggcggcctccgtcgggcgacggtggcacgaggccgagggggatgagcggcttgttcttcaggcccgccgccacctgctggaaggcgtcgggctcccactccgggcagctccgcatggccgccagcgtgcacctctccatcgccaaggagcagcgcttcgcgacggacatgcccgacgcgccatggtcgacgaagaagcttgccttctgcgcccactcttaacatggcacgccctcccggcgttcttctaccacgccgagcacttggaagatggaagcgccggctggctccgacgaccgggtggcccatccggccatcatggaggcgctcgggagaagcatcgcgcatggcaccttgtgctggagggcgaccaggggtgcccagtggtggaacgtgtcggcgatgatccaatcaggcctctcgccggcggcgtcgcacgcggcgcccaggaactccgcgaacggcgcggcgagggcgtcgaaggccttccagaggagctcgaacttgccggagggaacgtcgttggtgcactcggtgccgtccgggaggcgcgcgaggttgcgtggcgtggagacgaaggacacgcggtggccacgcgacgccacgcgctccgcgagctcgaggtaagggagcaggtggccgaacgcgagccatgggaagatcacaaggtgcagcctcgacgaggatttggaccggccggtgtccatggcgatgttgccagatacagaggagctaaaccttaatctctcgctgtctcatgaataataaacaccggtagagataagaaatcagcaagaaaccatatgcattagctagttgttctttatataaccagtcttcaaataatgattgattttattggtgaaacaatggtcttacctatcgatcgattttttatgtgaaacaggactcaatagctagtggttcttaaatttttattattttctgtaggtacttgttgacagtgaaatttggtaagcccaaagtcatcatcggcttagagtcaatatcggcttcagagtcctgaaatcagccgatgggagtcgacaaatcgccaacaaccgtgttctcgatggaatcggatcaattaaagggaatttatccagaagagtccgagttcaagaagaatgcggcatggcagtttatctattaattaggaatagtttgttagtttcctttttatttttaggaaagtgtgtttagtgtcctataaggactttatgttttccttttatctttagtaaagtttctttcttgtcccataaggactagtatctacccatgggtataaatatgtacactcggggtcattgtaatctatctctacgatcaacacaattcggcgcatcgccaccctttttacttttacttttgtttctacgttccggtggaacttggcacccgacgcggggctgcatcggtgttcgatctccggctaaggggtaagtccaatgttccatcggcccaggcaattgtcttatctacatcggcgtcgttcaaggctgcatcagtacatttgacctcttggattgcactggtttggatgatatatttgcctacctacttatcatatgtctctgttaatctagtcgtagcatatcgatttagctctatcggctgtctctcgctttagagtttctgccggtatcggctaaatcgcgttgctagattagattagtttagacatctaccaccctgaaaactcagtcaacggcttgattgtctagatattatgtttcttttcatacttagtgctgcatcagttaagtttgatctactaagtcgtgcttagaaccataatccctagcctgcttcttgattgccaataagggtttcatcggggtttcagccggtgagttatctggacgttgcatcggcttgtaaggattgcatatacatacatattggatttagccgatgacaacaaaggtttcactgtttaatctaatcttgtagatttcatggcatcggaccgctagccgatgtgtgctttaaccttcggatcagtgcttgttctactatatcatattgttagccgattggtttctactggatattattgttatattttattaccatcagccgattgcctttatatcattatctacattggacatatagccgattgcttaaaccctatcgctatcggctggtaccggcatcggctattatcggctatcggctggaactgctccatcggcttgtcagccgatcggttgttttgatctactatttacatatcttgtcagtggcaggatcaaactgactggcatgcctgtatctcatcatatttggacctgcactggagctaagcagatctcctaggccgacgtgttcaattttttcgtcaacggtattgcaggtctcgatggttcttaattataatatatatatcgtatgcgtgcaacacatgttgtgaataataaataaataatctcaacccaataaagtctgtttctgccatttcactttcgatagattttaggtctatgtctttcatttttctttcgtaagatcttgcatcaaaatttgtgtttatttagatctaacatgtagttacactagttacagtaaacttactaggttacgttgcaccaaaattagattcttttttttacaactgttttgtttctatatttacgatttttggcatgtttgttcctttttatttcatttaaaacgggttgtatatattggatgaaaattatgtaagatttgaagctccaagtctatcaatctattgataggtagtaccataacagtttacttcggaagatcatcagtggacgacactttctactgatatgaattaagagccatagtgctccaaacaccaacaagtagtagacaagcagctcttttacaacatatgtgggaaaaagaatttatttcttaatttaatttgatagttcgtgtacaacaccattgttattcatgcttggcgcccaattcagggaatgacaaggataagatagaagtgataatttctttttaagttttgaatcgatttatggtatagagttgacacaatttgcttatggcgttaattggtctactaaattttagcggtacagatagatacactagcgaggagggaaggaggattggggaggagagggatgccaggaaggagggagagaggtaggggagaagaggagcactgagagaagagggctgccgagctgggaggagggccagcatgaacgaggggcgctaacatgaattttcttagtccgccactagctacaatatctcagcgccagtaagtttggcgttgagctcttattcaaggtggcgcaaatttgccaagatgtcgaagcgcagtaccactccactgacactgagctctctactgctaaaaacagtgtgcattccctcttttatagcaaagcaaggctagtgcagtggtggaggtcttcagtctcgagacgacggtttgattctgccatccttcatgcttgcttttttttttcccatttcactcaacactttttaatcagtagagtgcctagcgccaatgatattgatgctaaactctgatgatatggtatactcatgccactactagtagagagctcaacacaatggcattggcactaaactccgatgacatcacaaactcgtgccaccttggacaatgtgctcatcttcgatgacattgtaaacttgtgccaccttggacaagagctcagcactaggcattggtattgagatgttatacctcaacacagtggcgaatatagaatataaactatgaagatgcgggtgtaaaaatatagtatgactgaaacaacccagtgtgatcataggtgctccatgataggtgtgttgagctgcattagataatgcaataggattttgatagtattagcactataatgatcataggaaagggaatacatatttctcgaacaatattattacattagctcgttaatttcgaaccaccagctacaaactttcaagaaaaaaaatgtattcatgcttgtccgtatcacatgagaagcgttactccctccgtattttaatgtatgacgctgttaactttttaaccaacgtttgatcattcgttttattcaattttttttgcaaatatgaaaatagttatgtcatgcttaaagaatatttgatggtgaatcaagtcacaataaaataaatgataattatataaattttttgaataagacgaatggttaaacgttggataaaaagtcaacggcgtcatacattaaaatatggaggtagtacattattaatccaaataataggctaaaattggattatttaggtgccaattaagcataggtagttgttgactcctcatcaatctcctcaagaaaagggtaatctgtataaccaacaacgggatcctgtgtataaaaggtagacctgtcatacctgttcaatggtgcgtcaagctcaaacctcctcggcaagtcagggttagccaagaagagcctcccgtaggcgacgagatcggcatagccatcagccaccaccttgttcccttcctcccggtcatacccgccagcagcgatgaaagtgccattgaactgcttcctgaatggcaggagaccatgggtgatcttcctccgtccttcgacgatggccattcctggctccaccatgtggcagtagagaaagcctgggtgcttgttgagttgctgcaccatgtatgagccgagagctaccgggttggagtcgaagcagtccatgtagttgtcgaatggcgataatctgattccaacacggtgcgctcccacctcggcgacgacggcatcgatcacctcgacggcgaagcggcaccggttctcgaggttgccaccgtactcgtcggtgcggtcgttggcgctgtccttcatgaactggtcgaggaggtagccgtgcgcgccatggatctccacgccgtcgaaccccgactcgatggcgttccgcgcggctcgcctgaagtcgtcgacgatctgagggatctcgtctgtccggagccgccggggcttggagtacaccatgcctgaatcgtccggtgtgatctgcttatcggtgctcgagatcggcgcctgtccatttggctggaaatctgtcgatttcatttcgaaatttaattaatcaaccaacgagcacaatttgcaatgacctttgaaaaaaaatcaaccaaccaccagcaagtggacgaacctgtggtggagaccctgccgacgtgccatatctgtaggaagaagagggcgcccttgcggtggacggcgtcgacgatgggtttccacgcttcgatctgctgctgcgtgtagatgccgggggtgtccgggtagccctgcgcggtgggggagatgacagtggcctccgcgatgaggagtccgccgttggtggcgcgctgcgagtagtacaccgcggcgtgcggctgcggcacgtggccgtaggagcggcaccgcgtcagcggcgcgagcaccacccggtgggacagctccagctgccccatcttgtacggcgtcagcagcgggatcgcctctttcgcaggtgcgtgcaccatcttggcctggagtgcgcacgcgatttcgtcaggtatagactggtagccgcttttctgttcccaactgcttcagttagtgcaacaaaccaagaaaaagaaaatctaacaaatgtatgggcattcacctcacgagcgcacacgaggtaacgacggcctggattcctatccgtgcgtgaggttttgattgccacaggaaaacggcagcaacacttcaacaccggcggcgaagacgccatggatgtttggagggagagtagagaggaaggttggggaaagaagacgacagtgcgtgtggtttggggatggatgtgctggccctctctatcaccaacacaagatcctggtactagaaaagatgtactagttattggggcggagctagcaccaaaactaaggtggtgcactaccattgaaaacctataaaacttcaatcgaatactgtgcatttcagtgttttaaagtgagaaatcttggctttaggggagttcctgtgcatcagattagctgaacgtggctgactagtactataccaccaacacgcatgacggggacagcgcgtgtggtttggggatggatatactgccactctatccccaccagctattaggacaggtgtgggtccagttgacatgactatacttaggccgtgtttagtttcaaagttttcctttaaatttctaactttttcatcagatcaaaactttcctaaatacataaacttccaacttttccgtcacaccgtttcaatttcaaccaaactttcaattttggcgtgaactaaacacagtcttacaaaggttacaaaggccgtgtttatacctttgtcacatcgaagatacggacacatagaagtattaaacgtagtctaataacaaaaaaaaatacataatccgtctataaactgcagcaccatattgttaaatatatagcaattaggcttaaaagattcgtatcgcaatttacacgcaatctgtgtaattagtttttatttttatctatatttaatactttatacatgcattcaaacatttgatatgacagggtgaaaaaacttgccagaagatctaatcaggcctaaagaatacggaacacagaaaatgaatgaacggttgcaatagatatggactggtagatgtatgcacgaatctccaagttgagaaaattccatatgtacccttgaaacttcacccaatcccttctattctcctgagatttgtttattttctttcatatccctaagtttcaatttggatcccttctatacccctttcatcagttgactattatttgaccgttaaatttctatcataaagttcatttttctttttggtatcaagaaaatataaatttatgaagtatattgataaagtgtatactgatatgaattaggagccatactgctccaaacaccaaagtagacaagcagctctttttacgacatatgtggcaaaaagaatttatttcataatttaatttgacagttcgtgtataacaccattgttattcatgcttggcgccctttaggaaatgacacaggtagatggaagtgataatttctttttaagttttgaatcgatttatggtatagagttaacataatttgtttatggcgttgatcggtcaactaaattttagcggtacacatagatacgctggggagcagggaaggagggttggggagcacagggatgccaggaagcagggatagagtgtaggggagaagaggggtgctaatagaagagggctgccaagtagggaggagggacgacatgaatgaggtccgtacgtcaccagggaagagagacccgcaggtggggatggagcgcgcatacggcggggcaagcgatcggaatcagaaccgagaaccgagatggatagggagagttgggcggactaatattttgttggaagcannnnnnnnnnnnnnnnnnnnnnnnnnnnnnnnnnnnnnag

SEQ ID NO: 45293 - DNA, 16734 bp, Oryza sativa
cctaatagacacactcaacgtgaatttccttagtcctccactacctgcaatgtctcggcactagtaagtttggagttgagctcttattcaaggtggtacaaatttgccaggaaccaaagtaccactgccactgacattgacctctttattgctaaaaatagtgtgcattccctcttttacagcaaagcaaggctagtgcagtggtggaggtcttcagtcccaagtccatggtttgcttccgtgatccttcatacttgcttttttttttccatttcactcaacactttttaattagtagagtgctcagggccaatgatattgatgctaaactctgatgacatggtatactcgtgccaccactagtagatagctcaacacaatggcattggcactaaactccgatgacatgataaactcgtgccaccttggacaatgtgctcatcttcaatgacattgtaaacttgtgccgtcttagacaagagctcaaagctaagcattggtattgagatgttatagctcaacgcagtggcgaatctagcatataagttaagaagatgctggtgtaaaaatatagtatgactgaaacaacccggtgtgatcatgggtgctctgtgataggtgtgtcgagctacatactctaacacagtaggattagcactataatgatgataggaaaaggaatacatcgatttttttaaaagtaatatgattttaatggaaaatcgcaaaactatagatcagtttgatgaaatcgcaagtttagcaccctatcgaacaatcacggttcgataggggtacctatcgaacaactacaactacagttcgacaggtacatgtcgaactgttttagttcgacagggtagttcgtccaaaaacaaataaaaaagtacatgaacagtatcactacagtgctagacagggacatatcgaactgccaaagttcgagaggggttgcgtgaacagcgcgctatagtgatgctacagtgctcgcaggcacatatcgaactgcctaggttcgatagggtattgtgaacagcgtgctacagtgatttttccttttttaattttttttaatcacctgtcgaactgccgcaggtaccctatcgaattgtagttgttcgataggtatcctgtcgaaccacggttgttcgatagggtgctaaacttgcgatttcatctaaccgacctagacttttacgattttccattaaaatcgtattattttcaaaaaaaaaattcgaatacatctttctcgaacaatatcaatattacattagctcattaatctcgaatcaacagctacaaacttacaacaaaaaaatgtattcatgcttgtccgtatcacatgataagtgttacattattaatccaaataataggctaaaattggattatttaggtgacaattaagcataagtagttcttgactcctcatcaatctcctcaagaaaagggtaatctgtatagccaacaacgggatcctgtgtataaaaggtagacctgtcatacctgttcaatggtgcgtcaagctcaaacctcctcggcaagtcagggttagccaagaagagcctcccataggcgacgagatcggcatagccatcagccaccaccttgttcccttcctcccggtcatacccgccagcagcgatgaaagtgccattgaactgcttcctgaatggtaggaggccatgggcgatcttccttcgtccttcgattatggccattcttggctccaccatgtggcagtagagaaaccctgggtgcttgttgagttgctgcaccatgtatgagccgagagccaccgggtcggagtcgaagcagtccatgaagtcgacgaacggcgataatctgattccgacacggtgagctcccacctcggcgacgacggcgtcgatcacctcgacggcgaagcggcaccggttctcgaggctgccaccgtactcgtcggtgcggtcgttggcgctgtccttcatgaactgctccaggaggtagccgtgcgcgccatgaatctccacgccgtcgaaccccgcctcgatggcgttccgcgcggctcgcctgaagtcgtcgatgatctgagggatctcatccgtccggagccgccggggcttggagtacaccatgcctgaatcgtccggtgtgatctgcttgtcggtgcttgagatcggcgcctgtccattcggctggaaatctgtcgatttcatttggaaatttaatcaatcaaagagcacaatgacctttgattctttcgaatcaatcagtaaccaagtagtaacaactagcaagtaaataatctggcagatggacgaacctgtggtggaggccctgccgacgtgccatagctggcagaagaagagcgcgcccttgcggtggacggcgtcgacgatgggtttccacgcctcgatctgctgctgcgtccagatgccgggggtctccgggtagccctccccggtgggggagacccccgtggcctccgcgatgaggaggccgcccctggtcgcccgctgcgagtagtacaccgccgcgtgcggctgcggcacgttgccgtaggagcggcaccgcgtgagcggcgcgagcaccacacggtgggagagctccagctgccccatcttgtacggcgtcagcagcgggatcgccgccgcagctgccactttcgccggtgcgtgcaccatctttggcttaggagtagctttggttcttctcgatcgaaattgctctgcttctctctctgtttcttgctgctgctgctctgctctgctctgttctttgttgctctacttccatttttgttggtgcctgcctctacttataggtgttggtggtcgccgagacgccaagtgttcccaactgctgttgtcaccctctccgtcatcacaacttgtcgttagaaaaaaggtttccatttgttcccgtgggaacagattcattgcatgtggccgttttttagttcgcgtactcctgtggttctgatcaagacatcgaggtagcaggagtttggtgccgaggacggtgccaatcaacgcgatggtgtgtttggtgtgtacgtttgattctgaattcaaacatgaccctatttgtttatggttccgatttccattgcttgttctagtgcgtgtggattcccggagtgctttgagtaaataaacaacttgtttgtagttactctgtatactactactagtattttacgtttcaatactgacgcggttgacaatgccaggtatttataaaatttaaaacaaccaagttgagataagtaggagtatgattttaaaggaacactctatatctttcgaattgcatgttactgtagtattttgtggttaaatttatcatgtgcccgccaaggataaagtgaaatgtttagctcttaaaacataaagttcgaaatacgtaggattctcaaacactacaaacagaccaaacataaacagaataaggcgaattctggtaagtcaacaaaaggggattgttgcatcgaaagaaagcgacgcgaacgttgggccgcacgcgtgcttacgtcctgcgacgtcattgcaaacgacagcacgttagaaatcagtggctacgcgtttgatactaggccctatttaaatttcaactttttttttcttcaaactttcaacttttccgtcacatcgaactttcctacacgtacaaatgtcaaatttttttgttatatcgttccaatttcttcaaacttctaattttagcgtggaactaaacacagcctagacaccttgatactaagattaaaaatataattaaaaaaacttaaattctaagcatgaatctagatatccctagtatttttatttctttgagacggaggaagtaataacttttagaggaaggctgccgatggatgcagtgcggtctaaaacgcacgaaggctagccggcagggggcgatggtgcagtggacccacatgtcggcagaggttggactgtggtggagcatcggggcgagtggcgggtgaaaacccaacccggcctcagctgggccggcaatgatgacgctcaaagcgtcattcccctcctaagggcattgccgtgccgtctcatccctcatgtgtggatgccgggcaaaagcaaagtcttagttctctttgggaccttgacggacggcggcggcagtgttttccgttgcttctctccttagagatgtcgtttaggtatcccctagccaaaaccccaaaccaattggtgcaagctccctctagatttcatcctcttgtagcggcatcctagtctctacaagttggccacgttggagggcctaggggggagaggtgttctattattctctctcaccctctctcccttactcctaaagacttggatagataagggctttgtgttgattgtaagggttgggttttgggtgatctcggccgtgtttctttgttgacctagcggtagccggtcacgcttagcgacgaccggtccaatgctagccttctccttgttctatgtgttggcactgtcgatgtatgggtgtgatggtatactttttttttctttttcctggttacgaccttctaggtttgtaatcttataatttttcttctgctctatcaatataacttcgcaccgtcttatgtgagtcgttccagaaaaaaaaaacttttagggcccctttgaaacgcataggaaaaacacaggaatagaaaaaacgtaggaattgaagtggcatgttttcctaatcctacaggaatggaaaacacaggatgaagagggtccctttgatagcaccataggaaacaaacaaagcaaaagatagtttccaagaggttgaatctcttgcttattttcctatgaaattgagctataggaatgcaatcctaagaaaaatttcatatactttcctatgaatcaaagggtttgataggaaaaaatccttaggaaattaaatcctccaaaattcctatgcaaatcctccaattcaaaggggcccttagaggaaaatcgaatacctgtacatagctaccaggtacatcattgacagcaattgacgacaattgtcatcaatcccaggctagcaataatcttcagttcttgcagcctgctagatcatgcagctgctctgaccaggctgcttatggcgcaccgccgcgttcaccttgatccggtgcatctccacatgatcccacctctgcaacgaggcgtacatgttggacaggccataggcagcgccgtcgtccaggtccagctccgatatccggtccgccacccactcgcccaccctgacgccgtcctcctccgacgccgacgacaagcggcgggcgtgaagcaggagacacccgagaatcttggcgttcggcctgacgggcatcgcccgcacgacgcgcacggcgtcgccgaggagtccggcgcggcagaggaggtcgaccatgcagccgtagtgctcctcccggggctcgacgccatggaccggcaccatctcggcgaagaacctccggccctccgctaccaggccggagtggctgcacgccgacaggagcgccacgaacgtcaccccgtcgggccggatgatcccgcggcacgttcgactcctcccgaccatgtcgtggaacgccctgacggcgtcctcgccgcggccgttcatgcctagccccgcgatcaccgtgttccagcagaagaggttggggccgtcgggcatggtggcgaagacgtcgagcgcgcggtccacgctcccgcacttgaagtacatgtcgatgagggcgttgcttagcacggcgtcgatccttgtcccgagctgacggatgtagtgatggactcgcgggccaaaggcaaagtcccctgcctgcgtgcacgcggcaccacggtggctatggtgaccgtggtgggcatcatgagcgtctgttgctgcactgtctgcgcatcaaccggcggaacatggcgatggcggtagcggggtcacctcggcgcaaatacccggccatcatcgtgttccatgtgacaacgtccggcgacggggaagaggagaaagagcagcccatacaatcgaaaagctcctgcgcagcgtccattctcccggccttgcagtacccatcgatcatcgtgttccacgacacgacattgctcgccgtcgccccgaggctcgcctcgaacacctccctggcggagccgaggtcgccggccttgcagtaacacgtaaccatggtgttccacgaggcgggggtcctgtccggcatccgctcgaacagctcccgtgcgtcggccatcctccgggacgcgacgagcgcggccagcatggcgttgaacgcgaccgcatccctgcgaggcatttcgtcgaacagcctccgggcgggatccaggaggccgcgcctggcgtagcgggtgagcagtgcggtggccagcaccgcatcgccggcgaggcccagcttgcaggcgaggcagtggagggcctgctcctcgcggcggccgggggcatccgccaccgcgcggatgagggccgcgcgggcgttcgggagcacccgaagctgcatcagatcagataggcggcgcctgtgaacaactcgttgctcctccgaacggctgctcctcggcgccccgagcgctgatggtggtggccttcctcccaacgtggtctccgtccatgggggtgggtgctcgtgtggccgtgcctcaccggctcacccgtagagctcggctttagcagcagacaatgccgcggggtgggctcgtcggggtggagctccaccgccggccgccgggtgcccgggtgtagggagaggaatgagatcccctcctcaggtcaggtgactttacagcatatggttcatgtaaagatggctactatacgtcagtgactcaaagttatcatgtgacttaatatactttaattttgtgctgtcggtataattcacgtatcagtgcgacagctacaaattacataaagttactgcacaaagttaagggacttgtttctgagaaggggatataagaagatttttcttttgggcacatagaagatttggaggtgaagaaagtggaaatgggaagggttaattggaccataccattataaataaatttgctcttttttaaaatatcattagtcccttcgtttcaggttataagactttctagcattacccatattcatatagatgttagtaaatctaggcatacatatatatctagatttattaacatatatatgaatgtggcaatgctagaaagtcttgtaatatgaaacggaggaagtactgtttatctaaccgatatcatatcatcatctacatcggcatccacatccaccaaatagctataccaatatccttggacggattcaaagtgaagcggattacataatatcatatccgttttcatctctgaagcgattggttgaaacgatacaggtagtaaattttatttttacttttaaatataagtaacataattgtattaatccaatacaacacgcaatgtcatacaacaatttgttattccccatcgtttcaaaagaaaaccaacccttttggcctctcaccaaaagcaaaaccaagttattcccttcatctcacaatattactacctaatatataattggatattttctagtacaatgatatattaggtggcaaaattttaaaacagaacagtatactacttataactgtcgtagtggtcgccgttgccatcgcgaccgaacgcgatttgaatcagttggagagcaggaggcggcgcacgtccccgttcgggggtttggccagctggcggcagcaacagatggggtaatattgtcccggcttgcagtacgtggtatacgggtacacgtagcccctcttctggcagtactccgggcatgtcaccgaatcacatggcacgatcgcatggcaccaatcatctgtgcacaaatattcgattaagggtcagaacgtttggttgaaaaaaccgataataaatatacaaagaaaaaaaattcgataaattttgataggaatacaaacacaaaacacagtaagatttaaacagaaatataagtacaagataaaaaaaatacataaataatcttttgaatataatagaccaccagaaagacgagggaatcagaaaaaagaaacagaatcaaagatatgtcccaacaagttgaagttcttgctaattttccactaaaattcttatagaattatctattttataggaattttaaagaagtagatagattcaatccttttcaaaggtctttctaagaattttttatacaattgaaatcatccaagtttcctttttttttttgacaatcaaagggaggctcaatgtatgaattaaattttggaagatattgtgtgtcagaatcatttatatagcatgaaacaccatattttgttatacttttcagatgacaccaaaaatatatggctcatataacacaaaacaccgggttaaaaaaatatttcacaattatttgccaatgcaattcttcacatgataaataacagtatttatatgtatactgtgtccaaagttcttcaaatttgactgtctatatataaaaaataacatctatttatgaacggatggagaattgagttatacgtattgatacttttgtaaattaagatggcagaaactcttttataattaccttgtgcagcacatgaatagaccatggccatgagtaaaagagacgccaaaaacatgaccctgttagtgtccttgatgttgagaaacgccatgatagacagatatggccaggatattggaaattcaaaaaggctggctgaatctctcttgtgttctaagcttttcacttgctcttctattgcaatttggaattgctgctacattgctcagcagagcagtttatatagagaggaaaaggccatcaacaatagaattaaattcgatctatcctaatctttgcttttattgacctcttaaacctatatttgaatggcattaatttgttgctaattaacaaatcaatattttggcttcttgggccgaccattgcattcctaggcctgcaagcttgtaatgggcctacacaaagaggacctggaaccatctgttggaataagttcactcagtgaccctcaaaagtgatcgaaatctaatccgtgaccctaaactacaaaacgggatatctcgacccccaaactcttaaaaccggtgcaatttgactcccttggtggttttggagggcggttttgctgacgtggcgcttacgtggcggtattgaccgggtctcctttacacgtggcgtttagatggcgtttaggtggcatttagaattaaaaatatctgtgggacccatttatcattgacatgcaaaagaattgcaccggttttaagagtttgggggtcgagatatctggttttgtagtttagggtcatggattatatttcgatcacttttgagttttgagggtcactaagtgaacttattccccatctgtttgacaagttaggtaatgtttggtttgagggatatcctaaatagaagatggcaattcagtacatactttcctctttttttaatatagcgcagtaggagcctctcctgctgtttaatcgtcaaaaaaaaaatagaagatggcaattcagtttttttagtgtgtttggttggtgagtgacgccatgatggcctacaaagggaatatcccataaagatgttggatgagcgtattcggccaaattggtcggacgaggatatccaccttgttaatcttaatcttgatcattagtaattgattagcaataattaatgcattgtattgttaattagtaattaactttgtcgaaattagggttaattagaccgaattagtctattttgtttttaattagtatagattatgactatattagtgataattattatatttttagtattaattaatatatcattgttttccttctactccttctcattcatccctttccttgtccttcattcaaccaagcaagaaattgaataaccatatctcactcaaccaaaaaacaaaacagaaccaccgtatcattactttgccatgcaccaaacgcacattaagtgctaatttggaacaaacaatatttgaaggatttgattcccatggaaatttttcggtaatcatgaaatattatctttcccatttccttgcaaaaagaatatatatgatcactataatcgagcacagtacagatctgacatcacattacagtttttttattatttcgtgctgtttcagaaaaagaaactatagtcgagtatattgttgtaacagatctatcgcgccgcgccgttgtctcttcatcgtcggacacgtacgatgaaataatcttgagaatcatttggagagcaggaggcggcgcacgtccccgttgctctgcttgtggcagcaacagctggacacagactcacctggcttgcagtacgcccgcgcgttcttcccgcatagctgcgggcacgttatgttgttgcatggctcagtcggctcacagtagtcctctgcatgaactgatacacatattcaattaaaacttgttgaaaccaatatgtatgtttaaaaagctttttgctccaagatttatatgttcttttcctactgaaaacaagtgtacaaagcccaaccaattgatgagtgagtgttattaccatcattagaaagtattaagttactgtccatatgcatatctttatcattactttcctactatacagatatataaactgctaacaatggttaaaactgtttttcttaaaatatgttaatgtaattgattttcacgacaaaccataatactatcgaatatgtatttgtacacaatggtttagagcttgacccgatttttttatatataataattaataaccccgtaattaaatatctggtaattgcgtgcaagtaattagcaaagtaggatggacgttgtttttgttagcgtccagatgtggacgctattctctagagcgtgtaggtctgaacgctattctctagatcgtgcaggtctgaacgttattgtgaacagcgtccaccatacgggtgcagtcgaaccgtgccaaaccggcccaaacatatccacctaaaaccaatcggcgccgaaataactgccgttctctagcgaccgcatcctggcctcctcggcaatccctcatcgccaccggcgggcagcaaaggcggcgcagtattcgtcaccaatcgcacgcgactagctgacaacacgccttgccacgaaagactccatcagcatcgcctttgcttgtgcggctgaccagctgtgccgccggcagctagcacacactagagattcatcacgcgagtacgtattcaatttcatctccattgatcatattgttgaacatatatttgcattaaatttcttccaatcacaagttttccctcgtacgtgcttgacttttcgcagcctacggagatcggcctctccatgtggatgaggtagtggaatcatttgttttctttcaaattgtctcattaccctattgggataatggaactccactacccagccttcatctttgcaattgaaagaaatccaatattttctagagctgattggtaaagtgggtggtaaggaattccatggtgatgatgccatatattcatggaaccactaggctgtatgcatgaaaacatagaacaattacttaaggagattaacatgaatagatgagaaaaaaaacagatttcaacaggtacggcaaactgaaaaaatacccagattttcttcaatggtagatatttagtgctggccatgaggcaccatagtaaatcatgaactgatcacgctatcagcatttttttataagctgtaatcaatgtgaattgctgagaatttatattaccaatgcaaagatatggtgaatgtaaaaatgtaatgagcaattcagtattttggaaacaactcccatgacaaatctaatataactaattatgtatttctttaatccacattatcacaacaatcaagcatactaacaagatggacatatataggatggtataatcacacatgtattacggaaagaactgactatgcatgcaaacaaacggcacttacactacacgtggaggcgtacggcggaggagaccacctgggaacgggatgtgtgggcaagtggcagtgccggcgaaccaccacaagcgtctgaggcaggcggcgttggtggacgggcgggcgtcgccctcgcgcgtggaggagagcagcggcagcggagctgccgagaacgagggctgcgacggccggcaccttcgtgcgattggacgcgcagcggtggcggatggatgggcgacgttgttccgcgcatggaggactttccaggcagtggcgtcgccaagaacggttcctcttcccgtttttcttttttttttccctttttcattttgcttatgttcgtactgggaccgccggaccgacctaggcgaccggtcatatgctggacgtagttagccagagcgtccagctctggacgattttacaaacagcgtccacatctggacgctttattcttcagcgtccatcctattattaaaaatcccaactttgatttaccagatatttaattatggggttattaattattatattaaaaaattcgggagcttgactacatgcattctacaataacatctattctcagaaagaaagagtagcccttgtgtatatgcttttataaagatgataataaaatgcttataattaccttgtgcacaacacaaataaatcatagccacgactacaaaaatggccaacaacatagccctttttacacccttgacacttagaaactccatgatcgagatatgtggctagggatattggaaattaaaaaggctagcaagctatagctattccttaactgattctactctctttgctcttatactgcgatggaactgttgttgcagtggtaaacagtgtagcttatatatagagagagagaggggaagcggccgtcagtaatcaaaccaaatcaaatctatgagatctcttcaaaaatacaatccatgcaaatcttgctttttattgacctctcaaaaaaaatctcacatttgaatgccattaatttgatactaataaaaaaagattctagtctcttgggccaattccaaaataaaacaatttctacctatgaatctgaaaaagctgttcaaattcatacgtaaaaatagtttcattttgttcatattcgtatttagaaataactttatttaggatccatttgcgtttacttggcacttttaaccaaaatttaaataaaatattgccaaattcattaaaaataattaaaatttgaaaatttcggccaaaataatatcatttcggggagtctgatagaacgaaaatttcctgcgtgcaactgacttcttacttttcagtgtttatggggttttgctgcccagtgggcatggtagaggcgtagagctagactgctagagcatagagcatagagttaatctccaattgtggctagagaaggagtattttgatatgtggatcatagctaaagaaagtgcgttgaaggatacccgtgacagtgagacaaagcgactgcatatatacaaaaatcaacacacgccacgaacatgcgcagtacaattaatccctcgatcgtttatttcaaccgaatgacccatacaaatacaccacacgcaacgcaacacaattagacatatagtatatattgcaattaataacttacaatattatcaaagcacaatgatgttctgatatcgaaccagaactcccagaaggtggcatgcagaagaagaagaagatcgacgtaggctagcagccgcaccatggccggcggcgaccaacccaacatctcggtggcggcggccggcggccggcggcggagaggggtgggcgggggccgggtcagtcgtcgcggcaggcggagctcttgggcttgacgatgaacttcatctggcccatggtgcagtggatgccgccgcgctcgccgcagacgaagtagtggggcttgcgcttccggaggacgaactcgtagcccgacccggcgccctgcatcacgttggccaccagcttcgccgccttgaggttgcacgactggtagtccgccgcgttccgcatcatgtacacgctgtgcgcgtgcgtcgtcgcgttcggcgggtcgtacatgaacactgccagtgccaccccccataccattgttcatatatatatacttattaatttcaccaacatttttttttaaaaaaaatattagactcaatcaaggttcaccgtgttactccatccctccgttccaaaatattagcatttataagttgtttagcaatagaaaatagccaaatatactaaggttaagggagaaaaaagttcttttcagtcatctctggttaaattcggaattccttatatttttccccatatatctgattggttaaaatttgtatggatttttatgtattcggatcagtgttatagaaatggtcataatacggtgtaaattttaaatcctagaaatacttatattttaaaacagagcgagtaaatatcattgtataataataattcaaacatgtaaaagcattatttacggcatacatactagttgtgatggagtgtgagatgcaggggcggagctagtatatattaggggagtgcccaggaacccggttaagaaaattttttagctatacctcatctatttttatcatgtatgcaccccctcaatacaaacttaggcacccacataagcttaaactcgatctaaagtagagtaaattaagcaactagcaccacccttcatttcgctctagctccgtccctggtgagatgttacgtaccaaggctgtcgttttggaagaaggggcccttcttgatgacccagtcggtgtagttgtaaccccacgtccaccgcgccgcgtcgccgacaacgaaccgctcggcgcgcgccgccgccggcaccagcaccagcatcgccaacaccgctgccaccaccagcgttgcactgctaatcctcccctccatcgatcccaacgaaatcctcactctaattaaccaacaaattctcttcagtctccggcaaagctagcttagctaattaattaactggatgaatggatggagatgcttgtgatgagcaatgacatggcgatcgagatcgagcatgctggtataaataggatagccaagctgcaggtagctttggggacgtaatgatgtcgcaaagttgacccacacccagtttaaacctgggcgaaacatcgggaaatttaaattaaagaaaattcgtgtgaaactgatgtgccatgccgtggattctgcatcacacgatttggttgggacgtaattttcaggtaaagcagcactcgatatggagctcgcgttctggattggtcatcgatcaagtgccccattagcgagcgtgcttagtggcctcgtaaaaatttggagacacgggggttggtgagcaaactgaccatttcactggtctaatctctagttgcttccattttgcagtggtgttcagccattagctaggagcttagctagccatgattttttttttattcccctctcgagttcctttcgttgattagccaatagccaccatgtcagcatgattactgtagaggattagggcggtgataggagatgattaattaagcaggcgtgtgtgattaaacgacagtgtatgtatatacgcctgcttcatgatcacgtcatgctgatatggactacgggagtcgacaggagtggattagtggatgttgcgtcgagtaagcatcacttcgattattacactggtcgatcgatcgtgaattactccacggttctccgaccaccgtcaaacgccggagctgtattaaccggcaaccacacgtaatttaaggtcagcttgtggtcaagtctggcctaattttgtcggaaaatcgcttagcttagaatacttaaatatgcctagcttctcctgtgcatttagctttgggatgcagacacagatttcgcctgtaatgcgtgcacgccgctgcaacataaaatcgaccgaaattcaacggaagatcttgcttgcagatggctactagtataactgtttgcgcacatgcacagatgcagccgatccatcgatcccggtagtagtatatgcgtaacagcgtgtatgcgtcatcgataccaaagggtagcagagcatcatgagcagaggcctctgtattcgagtgttgtggcatgtgaaggttcagacttctactgtgctgtattatacaatgctactgttcataggtgcccactgaggcactgaccaagtgaccagtagtccagtacgtagcttggaagacaagattaaaagatgagcggcttaatgatcacgaactcatggtgtacattaattcgaccggccggccattgcgaaagctgtggcagagagtatacgcaaaccacaaggctggggctgggcattttctttgcttgagtggatcatgtccttatggaggatgattgggatgcaatgagtgtttgggcagttggatttaacaaattgagtgtatatgacttaaacagagttaagtcaaattgatgtcctaataatcgaatgtacctccacaccaatactaccatgaatgaaattttatagaaatttgaactaaatatgtgaaacaagctcatgtcttccaaaggaagactacaaagcggaagttgccgaaatagaacagacacgtgaactttccaccggaaccgctattctcttaccggcgcgtgacgctcacgccaccaaggcactcacgggggaaggctaaaacaaagggctgcagga

SEQ ID NO: 45294 - DNA, 12097 bp, Oryza sativa
ccgtttcgaaacaagcggacgtggcagacaaaaggcaaggcacccaaagaatatcagaaaagcaggtgagaaaagccacgcacaaaaggtgtcaattgtcaggttgagcacacaacagtccaagacgaaaggaaatgtccattggcatgccttgcagcaaagtctgaaaagtggaaaccgtgctgttcagttcaatgtctcggctttaacagcgttgatacgcacaattacttttgtagtaatgcaaaagaaaaacaaaggctatcctctcccccactattttttttccttgtatctagatagggagtcagcgtcttttgcgttagctgcgcagactcccttgttataccctgcaaaaagaaagcatatcatttaatcagtatatattaacaaaattaaagagtgtaaatggtgtcgtatcgtataatttggacctcttcacggttccagtatgtatcccagatcaagctaccaaaagttctgccggggaaaggaaactagggatcacttgctctcctacaggagaacgaaacagccattagtacctttgcttgataagtgctgaaagcctggataagaaattaaggggggaagaaaggataaggattggcatttgagaattacttcattgtctttgtctgattttccagaaggttggaacatccttgcaaatgccttccgctcctgattccttctgtcggcaatctgtaatcatttgcatatagttggtaacgacgcgcatttatcaagattctaggttcacaagaattacagactgaccttcttctttgcagcagctagctctcgtttaattcctcctaaggattataaaagattattaaatacgcggttgcaacattacagaagtgttgccagtgaatatgaaaaataagagataccatcacttggctccaactccaatgcatgcttgaagctctccactgccgcatcaatgtcattgagtgcaatgtgtgcctgcaaatggcatttatgccatatgagttgcgcagaaaccagatggtaataataatacgatatgagtagcacattgcattgattaaaatgtcaatagtttcaccttgagctaggtttaacaaatactttcacctcacaccagggtaaagcaaattaagattcactttgcaccaacccaagcacctctcatctactaggtttgcaatctgacaagcatctcactagcatcagcatgcccatatggacaactcacctatagctgggccatacttatcaagatgtgaacagagtcaattttcaagtggttgggctggtgcaaaatgaaacatatttcgctccacctggtgcgaagtgaaatatttgttcaccctagtgcaaattgaaactaataatgagtgccagtgcacaatgcaatttactcataagatcaatatctaaaaataagcaaatgaactgatagtcccaaacaaatggtaatagcaatatgatggtttagtggttcgattaacaaagctcacaagcacgcagacaaataaatcatagttcagagaaaaaaagcatcagcaaatagtgaaaccattactgcaggtcaataccaacctgtccttgtcgaaaaaatgccttagcattgccctcactttcacgcagtgcaaaatcagcatccaacagagcacccttcaaatctcccaacttcaatttgcatgcctgaacaagatttgaagggcaatgtaggtgaacaacagagcacgaatttgaagtttgtgtacggagtgagtagcaagcaggaacagaaagacactgctcctgcagggtaggtaaggattttgcagcgatgaacacaaagatttaagtttagatgagaatacaatagtactctaaaatcatattagaactaatgataaaggaattaaaagaaaatttattcctctgctttgcagttagttgtgtataggtattcaaagatgaactcaggaaaacaacctagagcaaagcaacggacaatcagatcatgagaaaaaggtaattggatatacacgagccatgtacattctacctaacttgcgccatgcccatgcactatttattctacaaactctgttccaaaaaatataagtatttctgagtgttttttaaatgtatctggacatcctttcgtccacgtacactttgggaaacacgcagaatattttagaacagagggagtaaatgttttgcaagttgctataatcccataaccatgtgcggaagcagtgtggcagaggtaactcatgataatataaaatgacaataacagtttcctttaagacaaaacgttcatccacaaataagttactggaatagataatgcaacttacagagctatttgtgagtataatcgatttggtcttccgcagtgctgagctcttctctgcataagtgttatgtgacgtgtttatgatcagtatgcatcatgtgacagaaacaacaaacattgaacagttgtagtgagacagtataattgccttcatctatatcttctttctcccagcaaacgtccaagtaacgcagtgctttcctgtactttctcagagctgccttgtaatcctgtttctgtaaagaccagaagtactaacttcagcttcagggaaacagataatgaaatattaaattgtgccaaagtaattaactagaattgttcaactgatacaagcaggtatttcattaaaacagcagtagtttggctactaaaccattcaaaaatcaacagcagaaggcttaagaaacatgaatctgtaaatactagaactatcgaagctggtatcgaacaagtaaggactaccatgcactaacttaagctaaaacctaaacatttaatcatgattaggatttgctgtcgtcacctgactttgctgatttggttttatttagtaaatgatgcaatattaatctaacagataaaaatacttgaaaattagcttgaagaggaaattaccttgaaattattattcccaaaagccttagcagactcaacagcatccatccaccatgaaacctccataggcttctcatcaagatcattgggccaatcaggatacgtatcaccatcattgaagaagttcacaactccatcatcagcaccttccggaagttccccacaatcgacaatttcaacatcagaagtcgggcggtcagcctctccaacaggagcatgctcaacagagcgaaccacccccattcccttaattactctaccaaaaactacatgtttcccatctaaatgaggtgtccgagttgtagtgatgaaaaactgagatccatttgtgttgggaccagaattagccattgatagcattcctttcctctcatgcttcaaaacaaaattctcatcctcaaacttcaacccataaattgactcccctcctgttccatcaccagcagttatatctccaccttgtaccataaagcctttgataacgcgatggaagcaagatccctacaagaacaacaattaccggacatggtctcagagattacggtgaagatgtgacaacagttttcagtgaagtatatgcagttgtatcaggacaaagtttctcatcatcatttttaaatcccaagttaacagagagtggaactgtcctcttttggtgttaaaagcaaaaggaataaaaagagcacagcaaactagaaaagaaaccatccactcaatcatatagaaaatattactgtagtagatgcatccattagctccatgaacagaagttaaaatgaggtacaaaatgccaagcagctattcaaacaagaaccatgtcagcatgttatgtgctcctcctgtaaccactaaaacttgtactagactaaatgtcaaactaatgaaaatatacagtaaaatggctagcaaagaatcttggtacagtactggtgactgtctctgattctattctaaaaggctacgaggcctttctatgcgtacggaatattacttaacgatacgcatacaaaaccctcttcatgtctacctaataacaaaacatccatgcatgtggctgggccacctgtcaatatgtaaaacaatgaggccttgtatgtgctccattaaaaaaggagcgcctatatacagattgcacaaggctaatcgctaacctgcacatggaatattttgagagtaaagtgccacagaaattggtaccccatatccaatttctggactagtctactgcaaaagaattggggttactcgtgtgcaaaagaacgttcatgtgatcaagtcacaagcccttgtcccaacatattgtataagtctaatatgtactactgccttagtttacttctaattgtcacagttcattacactatgcaaattttgaccattaataactttttcagtaattctgttttaatagacttcacaccgttcgatttgacaagcagtttgaatgaatatatttgtgtccttagatttttcaccgagcgtaggttaatgatgctatttaaatatttcctccttacaagtttattggaaagaaaaatagaggtgaaagtttggcaaaagccaatggagcgagtacatcactgtctactcttatacatggacttaaccatactgtaatagcagataacgaatctgccaaattttaacaggaaaactgtgactgttccacaggcatatgacaaaccacaaaagttagcacaggtggtacttgataggctaatatctgcaaggtgcagataaaaggaagccaaaatggagggggcccgttttaacagtcagaacatgctgtaccagcagtaccagtgcatagagttcatttcatatcaaaggacaatgatttgacaccacagcacaaatattagccggaaaataaatcgacagattccaaatgggccgcataagtaagaacatatccatacgacaaaagaagaccatacaatggcaggatgcagctgcccataaacacgctaaatgatcattaggaaagcaaatcggtggcacaaaggccggccgaacctttttaatctctaaactagaactgatttgcagtagtgtaaactaacccaaatgtttcagaatgcatgtttatgaaatccgcatcaaaatcctaacaaagtaacaatcaccaatcgcccaaattaaaaaagaaaaataaaacagttctctgtctctgatcagacgcctaaaaatttattgggagcggtgggcagtcaatcgcaccaagacacaagacatgtgctaaacataacagaatcgaatcattcattgcgcgcagtactaccgcccaaatccagagcctaagacgctcctccacccaacgaaaccaattcgagtccccactccccaacaccctaaacctccaccacggcagaaagccccgaaagggactacccggacgccacaagcatctcggcctcggcgatggctccaaatcggcggttccgtactcaccttgtagtgtaggtgcttcccggtgacggcgccgacgcccttctccccggtgcagagcgcgcggaagttctccgccgtccgcggcaccaccgacgcgtagagctctataacgatcctcccctcaatctcgccgccgatgctgacgtccatgaagcacctcgggttcttcacctccacctccgccgccgccgcggaggcgacagctgctgactccgcgccctcgccgccgccctccattgcgatctcgggcctcctcggggtcggggctaggctaaaccctagaaactagtggagcttcacgaggcgaggcggcgcggtggtggtggtgtccgtcggttacctcgggggccaaacggcgaaggctgcgttgtgggtgggtgccatctggggttttgtggggaaattgggtttataggggagggccgtcggtgagagagagtgtagtatattgtggatttgtggttttaccgacatgtgggcctcctctttaggagtagtactcccggtatatgattcggaattcagaaataaaattcagcaagataagaaaattaatactatataaaaatctactcctatatccaccgggcaatgaaacagacgatataaaatattggaatatgcaaaagtcttataccattaacctgaaatggtagtggatttaacccttatgtaacctacttaatgtttacagagagcgtagacatcgaatgctttttttttctccatcttatgaataagacatggagataatgtacatgtttagatgtaacaagtgactagttgtctacttgtcttttatttttttcagccaagctatcatgacttgtaaaatgacttcatcttccttattttcggtcaaactatcttaaattttaaaataacattaagataacttttcaaggaaagaattaaaccatatagatacctatcggtcttcattacgagggatggtgtatcatctcatatataactcttcgtagagataattttagctatacgaagatttcgaggtctcaaaagaacgttatctcacatcatcttagagagcctaattatacataggcaacatcttttcatgtatttatatagttatcaatatataataaattcaaccttaaagataaatcttagtacacacttgtacactcctacgcgcttcaataggtatcatgagatccatgcatgtagagctcttaccgtttctcgaaactactaattttaatgattatggacgaatgcattagaaaattctttgagcaggtacaatagcagactatgagccaattataaacatattttaaagagataaaagaagagagaagagcagcgggctacagatctgtagccagctgcagcacggactccaagatacaatatgtgtatgacatgtgggaccatatattaatagtgtattaagtaacaattgtataaactggctagtaaattagctatagatgatttggtgctaatagttgtctatactattaaacttgctcttacataatcataaacactatactaaagtaatatcatctaaaaggaaaagttaattgaaacactacaaacataaaagactttcaaatactcccatctcactcatatattattagtatgaagaatacaacgataaaaggtagtggcaattatgatggtttcgctatccaccatcaatgtatgtctattcttttatatgaatttctaaaacctacaccacatctgttcttaaaaaaaatcaacttccaaatatgaacatatatattcatgacctctgcccatatttccacgcattcatgactcatcacagttcacaccggtccatgaaccgtccgtcgtcgtgctatatgcacaacggcgccccacactccttccaccatcttcaacctacccaccccgcctgggccccaccaccccctcgttcgttccataaccatctacagttagtactactgttactacaccctgccctctgactgcgggccccacaaaccatcaaaccccctcctggtccccacgcttccgcctccggctatctcggtcctcggcgcgtgtcaactgccaccgccactatgccggcaactgtaaacaaggcgggggaggggaccggggccgggcccaccaaccccgatcggacggcgtgattcggccttgggcccttggcctcacctttttttccgccgctgctcgttttgctggcccatccggtgacgtccggtcgctgtccggtcacctggcgacggagggcgagcggcgcggggccggccctccgccgcgccgtcgccggcgatggccacgacgcgcgtgacggcgatcacagcggcagggactccattgattgaccacacgctattctggggcgtggttcagttcagtatgaccgtgaaacagtcagtggagcgaatcgtgaatgcatgtctctcctgtgaccatgagcgattggccggcaagcacggctgcacggggcggatcagcatgggagcagtggggtctcgagcctctactacttgcgtgaaggctacttgagaccccacgaaaaccctactaattattttttttttgccatatgcaaatggtaggggactgtaactctatctagtttgctcagatcccactgctattttttttatggatccgccactgccggcaagtacgtcggcaagtacgtgatgagtcctggataggggtgaaaacggccaaccaacgttcatttccaactttttaccaactgatctatatggaaatggtaatcgactgaaactaaaatggaaatggtaaaagaatatgaaaatggacacgaaaatagttttgctgttataccgatagggatgtaagcggggcgggtaagcgggctttttttatcccgcttatcccacttctagtttattttttcttctaaattttatactaccatgcgtaaaatagactagcaagcatatttttatgcgaatagcgggactacccacttgcatctctatataccgatcgtttccgtatttaccatatttttgtgaaacttaccgttttctataatatggtaattaccgtatgtttccgtatttaccgtattcttgtgaaaattaccgttttctataatatggtaattaccgtatttctaaatatgcctctacttgacccacagtttagagattgattgactctttaatcaaatctctaacttgagtgcatggctaaaatggagttaatttatatatatagtataagcttgaatttatttatacatataacatacttatgtaaagttaaaatagagtatatatgtttttatagtttaatgttttcgtatctgttactggtttctaatctgtactgacatgtttccgtccgtattgctccgtttctgatttttcgatatttctgatatcattttcgttttcgattttactgtttttgatttcgttttcagaaaaatatggttatggaaatggtggtgtctgttttgccgttgtttcggaccgttttgatccccactcccggatatgctgctgcctacaccatcaattattgggggtggtttggattcggttcgtctggattgtatgagattcagtcaaatgggacagccgagcacaatcatggcggatgcatattcagcttttgcagcctggggatgcgatgctggaggagagtactctacctctaccagagtcgtcgcacaaggggagcgtccggatcactggatggatgatggattggatctactggtgtagtactactgtaccagtgctttttctctcccaggtgtacaacgtagtacgaacggattatgctgacgtagtacggttccgtgcgtagaaaacggtgtacgtgtacagtgcactgcccatgtgaggatcgagaggggggtgacgagggacgaggagcagttcggctgacgcaaccgcccaaccgcaccgcatcaccgcggctgattaatttgcctcgttcgcccggggcaaatcaaccgtgcgtgcctgcagcccagcacgtcgcgcgcgcgcgcgccatcgatcgatcgctgctgccgtggcccgtgctacggtgcgggtgcgtccgtttccagcagcccgcggggaaggggggacatggagatgcgtcggcacgggacaccgccacggctgcgcgtacgggcgtgtcacggcgtgcgcgcctctccggtttttacggggaggtgaggtagggggggggggggggcgcgatgcggtccgagcacgggacaccggtgccacggcgtcgcgagcgtggcttggctggcacgagcttggtatggattagtctaatcaatgtactcacatgtgattaggtttttttgacggaaggaatatatccatgttcaaaatgttataaattagcaccgcctccccctacttccctaacctcttccttaaggatccgctttctctctatcagcaccaccgtcgcctcatcttttctctctatggatgtggagggattagaaattgagaagtttcttgaggggtgaataagatatttcgcaaatgagagaatccaacggcttgaaacgtctggagtagaaatcggatggctcataattttttttgatgacgtggcaaattaccatttcgagaatgattagctcttccactattttagatatgaaaaagtacgaattacccctgttcccaaactattgtggtcgtctgaattaccccctgaaccccaaaaccgaatattcttcacctccaactatgcaaaccggacgaattacccccctcgacccaatctgcagtggttttagtctacgtggcatacacgtggcatcctgttaacgaccaaatttggtaatatcagtatcggagataaagatgggatcgaagcggaatcgaagatgaggattgttgcggaaacagagtaaggatcggctggagtccggatcggctacgactgggatcggctaagtctgagttggactggttaagtgatacagccgattccgacaatacgacctgtgtgcgacattaggatcgagttgatgtgcttcaagatgattgccacacatggataaagtcctgggaaggcaattgtatctattaattaggatattttatgtaaattccttagagataaatatgggcaaaagtctgccgcaaagacttatggtatcttagagtttgttagagataagagtcgtgtccaatatggacatatcttgtaattctcgggtataaatagaccccgagccctatgtaatgattaacacacacgttcaatacaatttcggcgcatcgccaccctttttgctttagttttatttcgacgagttattgctttcgggttgagctgcatcggtttcgatcttcaacaagaggtaaaacttgttatggcggcttgtgttctcgcgattagtgcttccatctttatgatactctaatcttgtttatgtaatccgtcaagttatcatatatcttgcataatccttgacaatatcgtcatctaacctacaatcggctaacatctgttaccagaaggcagccgattaggttaaataacgacgttggcttagattatctgagatatccaccactctatgaaacatccagcggcttgattgtctagatattgttcttcttttcatacttaatgctgtatcagttgagtttgacctattaagtcgtgcttagaatttcaatctctagcctgcctactggttgccgattagggtagtatcggagtttcagccgatcgtatctgatctaattgcttttatcttacgtgctcaattaacatgttagatctgccctttatatcaagatcttgttgcatttaagtatattaggtttctgcttagtatattctatttgctttaatatcttaatataaagtagtatcggagtattagccgatacatgctagatctatctgatcggctatgctatgaacatatatataatctcattattaatatatatttcgatctaagtgatttatactgtctcggtaaggtgaccgatctatcccaatcacttgattcaagtatatatcgatataaggattatatatcgttgatatctacagccgatcgagtagatttagttctaatttgttcacttaataattgccgatcgatttacatatgacatcggctcaaagataaataatatgtcatcggcatttagccgatcggctatcatttatggatttaatcacggtttctttgtctttgtttcttgttgattgcaggatcaaatcaactagcacgctcatatatccgatggcgagttttggacctacactggagttaagcagatctcccaggtctcgtgttttctatcaacacatcccagtcagcgttttttaataaaaatggtgggacccacatgtcatactcttccactttcccccctctctcactcttcctctcttctctctctcactcttcgtctgtctctctcacggatcggtggcggcgggagacacggaggggcgggcggcgtcgcggcgacgaccgagcggaggcggttgcggcggcggctgccggcgctgctgggtgagtggcggcgggcgcggctggacgagcggaggcggcggcggcgacgggctcggctgaacgagcggcggcggacgcggctggacgagcggaggcggcggcggcggcggcgggctcggctgaacgagcggcggcgggctcgactgtgcgcaacgccgcctcgcgccccgccgtgcccatggtgcccgtggcgc

SEQ ID NO: 45295 - DNA, 8781 bp, Oryza sativa
  unsure (1)..(8781): unsure at all n locations
gagattgagaggaagagggagagagagagagagattgagaggaaagtgggcaatagagagagagagattgagaggaaagtggggaagagagagagagagattgagaggaaagtggggaagagagagaggtgggagagtatgacaggtgggtcccgccattttttaattaaaaaaacgctgactgggatgccacgtgtatgccacgtagaccaaaaccaccgtggattgggtcgagatggggtaattcgtccagtttacatagttgggggtgaagaatatccgattttgtggttcatgggataattcggacgacgttatagttcaggggtaattcgtactttttcttttcagatattgtgggatggaagaagtatgaatttgttatagtagctcgtggaccacaagttgcagtaggacatacgaaaatgttggtccagccgagcaggagactcattcgagaggaaatcgacattggcctagtacaccataaacgggctattttggctgttgctcgaagaggcacacacatgctctgaccgatgttaaaatgaccccaacagatagttttgtagagcccaatagctagttttattgcggaataagttcacctgccatcccttaactttacatcgagtttgtttgacatcccttatcctcaataacagaaatcttcgtccctaaactatacaaaaccgtgcattttaagtcccatagcagtatagatgcccggtttcgctaatgtggcaccctacaattttctcttttcttttattcttttcttcggctgccgacgacagagggtgagaggcgacggcgaatccctcgccttcctccgtcgccgcttcgacaccaagtggctccttagccggcgtcgactggctgcttcctcgcccgcgatgataaccccgttgccatcaccttctgccgcgcccggctccgcaaggatccctaccgccggccggagagcggaggggagacgcggccgactgctgttgctgctgacgtcccatcgtcgcccaactccagcagcgcccgagggcgggggcagctggatccgcccgccggccggagagcggaggggagacgcggccgactgctattgctgctgacgtcccatcgccgcccaactccagcagcgcccgagggcgggggcagctggatccgcccgccggcttctacctctctcacctctgcctcttcctggctgagccgtccccactgttttcctccctctgggtgtccgcctcctcctcgctgctactccatctccccctgctcggagggatgaccggcccgacgaccctcgtggcgcctctgcccccaacatcgccgccgtcggtgcagccacttgcccagcctacgcactacaacttcctcaactccaagctgtctgttctgatgctgtcgccactactgttgggcgcgaccgtgggaagccaccatatctggcagcaggtcatcgccctggaccacggccaccagcgacgtggcgttccccagcagctacttcatcatctctaccatcctgcccgtggcgtcggtcgccgcgcgtgtcaccaccgcgttggagtagctgtataggaggcccctcaactccacggcatcttctttcttctctcttcttcacaagattgagagggaggggggaggtggccgacaggagtgtgtgagcgcggggcagcggcaggcggagcgggcacgatgccgccgagagcttctttccgcgctggtgccaccgcctagcttcttcccgcgagctcgcccgctgctgccgccggccacctctcccacatctgccgccacccgaaaagagaaggagagaagagaagagaaaaagaaaagtaagaagagaggtggggcccacatgattttctctcacttacatgtgggccccatattttttttttgctgactaggatgccacgtcagcgaaaccaggcatatatactgctatgggacctaaaatacatggttttacattgtttaggggtgaagatttctggtattgcagataagggatgtcaaacaaactcggtgtaagttgagggatggcagttgaacttattccttttactgctacaaaagatccagcctgctagttctacttcaaagagttcaaagaaaactgtctattttctcccccaactatagaccaagtctgacctctgtccctcatacacaaagctagatacatcatacaagcatccctcaattatatcactatagtcgagcaaggtaaaaaagttggttggacgatggttttgtcctacataacacagtgacttagtcagaaaaaaaaagtcatatggccctctttcaatgatccattagttatcgttctatcttctgtctccctcttttccctctttctacgagaagcctcaagcttgagcgtagagggagcgtggcatcagcggttggcgaggccatccgcggaaaggcacggtggacggtgagctccgtctaacttgagctccagttctgcccatgtagaagcagtggtggccaagcgagccccgttaagcttgagctcacccacctcacctgtccgcgagaagaggaacatcggtgatgatatctggctaaccccctcaagctccggtgaaagtgcgtagggagagggggggtggggaagatgtggtggaattagaggagctgtggtggaaagatggtgagctcggatctctaaaagatattcagatgaaagtatcagggcgtgtctagttcgcgaaaagaaaatttttagatgtcacatcggatgtttgactagatgtcggaaggggttttcggatacgaatgaaaaaactaatttcataactcgcctagaaaccgcgagacgaatcttttcagtctaattaagccgtcattagcacatgtgggttactgtagcacttatggctaatcacggactaattaggctcaaaagacatgtgggttacttcacacttattgcaattagttttttatttatatttaatgctctatgcatgtgtccaaaaactttgagaattaaagtaggccttagattttagattgctttttttaattgaagatgaaagtgtgaagctatagttaaaactttcgtgtgatttgagttgacagttttcaaacgaaagtgtactaaatgaggaaaaaaaacgtatgctacagtgcacccctgcacataaacggcatctgtacaagttcataaagacaatcaatacactataataaaatacaacacaattattttaactttattttccgttaaggtgtcgtggtgtagttggttatcacgtcagtctaacacactgaaggtctccggttcgagtccgggcgacgccagattatcgttttttttaatctccacatgtttaataccatgaattttctctcttattcccaaactatttaacgcaagaaaccatgaaaatgttctctcccaaacttaggggtggattactatttaatgcaagaaaccatgaaaaatttctctccccaaatagggttggataatttagccaactcggttcatttgtgcttgttatcttaataagctttttcagtgtaaccataagttaccacgctcaatcgttttatttgaattttttttataattagtaattttattattattatatgataaaatatgaatattactttatacataacttatgttttaagttttttttgaaattttttcaaataagtcgaacgatcaaagttatgcacgaaaaattatggctggatttaaaataggatggaggaagtaataattagttgcaaatacgaatacagtgctaattctaatatttgaactcgggtgaacatgcccaagctcagttcggagaaaccatgaaatttctcttttattcccaaaatattaatgcaagaaaccatgaaatgtttctctcccaaaatatttagggtcccccaaaacaatactatatgctaaccatcatttgagtaaattttcttcgttctcatttttctttttgccactttatctggtttgatatttctatttgatggttgaccgtggaccttacatcagggatctgggaggtgagacgacaatgacatactccactaattaataaaatatttaatgcaagaaaccacaattttttctctcacaccacttatagggattagtatataaaaaaaaccatttagggatttgcttaacaatcagttaagtacgttgtaaaccaacatacctattaacgaatcactagatctgttccctgttcctcacagcagtagaggcgtgagatgatgtggaacacccgcgcatatccctttgcccttaaaaacattgcagaagtagacaataaacatatatatatatggtgaatgctctctcttcattatagatctgattagtagtacaaccaaccttaaatgtcacgtccttgtatatataggggttttaggaggagatagatgttatctctactctactctagttcggattggtcaaaaaaaggatcttatctccccgggagataatattccgtaacaaagtaaacaattttttttcaatcgaattttcagccatttgatctgctaatttgagatctgcggtagatggcgggcctggcataagtggttgcaacgtggtgttggttttgttatcagaaacagcccagcccatggtcaaggcgaggcaaaggtgatgtttccattgcgggggctacgcgtttggtgaggtaggcacgagatgctgcagggtggctgcgatgaaggtttcgtttgattagctcactgaaccatatagctaatttattacttcttttatttcataatgtaagtcattctagcatttctcatattcatattaatgttaataaatctagatagatatattaattatcatcaatatgaatgtgagaaatgctacaatgacttacatcgtaaaatgggggagtatatgttggttttaaaataaactaatagctgacagtgaactctactgttaaacttgctctaagtttggtaaggcgcctcactactttgttttaccggcgaggaaggcacgcagccggtgagccatcttaatgttcaaccaggtgtcaacgacatctagcatggagggtgtcacctgccaatgtggttgtgcaatttgaaacaccaatgcagggttggggggcttgggggccttgggggtaattcggccggatcttcatcctgcataggacgtcatattatatactgcaaggatcatttatccaaaacaaattctcaacagactatcgttgtgttgttgcttagatcacttctttttattttttatcgttgtgttgttgtttagatcactttttttttctcgaacaatatagaagaactacgtgaaaaaatgctactccctccattaattcccctcgatagaaggcgtaatcactcgttatgcaaagaccaatgaaccgagtaatacccgttgcttcgatcgttcgaacgcgtgctgcttcaattgtttcgcagacatcaatggccatgcccatgcagcccacgcttggatccaacacacttcaacactgtgagagagaggtgagagaggtagtgtagctaagataggggttaatacagtcccatggtcgtggatagagtcgagtgctatgctcgctattaggttttggttttgggtggttcggcagtagcttctttgttggtctagcagtggtcggtccggtgctaatcttctcctgggtgttgtataagcactgttggcgcgtggtgcgtggtgatactgatttttttctttcatggttactgtcttctaggttactagctttatagttttctcatgctatattcaatgaatcatcataccatctggtgttggtcattcaaaagaaaacgagagggatccatagccgatgcttttaaactagccaaacaaaagaatcaatagctgttattctacatgcacataaaacacgcgagagccaagtagttgccgtcgtgtatttggacattttgacaaaatgcagttacgccttctattgagaaatggagggagtacccaacacatacaacggaagacatttttacatgacaagaaaaactgcaaccatgaccggccggagcaccctcacagcatctctctttaatatgatcaaggcaaatgatttttgtcgattcaaagaaaggcaaacgacttttatctacgaaaatattcaatgcaagaaaccatgattattttctctcccaaaacatttaatatgagaaagcattccgttaatgttttatatattgtaaacgcaaccgaacgttacttaaaaaaaccactaacatcgaattaatttcaatttagggattcaagcatatgtcatcatataaagtactccctccatcccaaaatataacaactttcccttaagatttgtcctaaaatataacaacttcttcaccaacaattctctcgccaactaatcacaaccctccaccattcacttttcccacctatctccactactcatcctatcacaaccctccaccactcacttctacctactttcttaataactgtgtccaactttaaaactttttatattctaggatggagggagtaaatcagtatatccataaactcgcaacgttaaatgaaattactcgtcagcgaaaaaagtactaagttattatgatgagaatgactagcttaataattgtgccaataataagtctcagccgaggtcacaagtttccatacagttcccatacaggtacgtacataacttgcacgaattaagcgaacgatacatacgtacatgtcgcatttaaattaagtgcgacgaaggtagtatggtacactagtacaagttgagaaaaaaagatccaagcaaccggaccannnnnnnnnnnnnnnnnnnnnnnnnnnnnnnnnncatcgatctcctttttaacataggataggattattgcagccttgttggtaatctcatagcatgacatcttcttgatcttcttaagatgcatttaacttccaacttcatccactcatgcacacagacaaataattcatggtggtcgtcatcccatttctcagctctctagctggtccttttatttcaaggcaacctgaagatatcaatttttttaagagagaatggattaaaccggtctttacatccaaacacagccatccaatatttgcgcttatgttgaacagcacaagaaataagttacatgaggaaaataaattcgcttggtaacttaacacccttgaaggagaacacaacacattcagagtacatagttctgatcgatctcaggtttaggggggcacgaatcaagtaataaaaagggcattatttcaatcaataattcatagttcttaagttgattttctttgtcgtttatcccttagtgcagttttcatttggatttagtgtgaaaatggataccatctgcagggaaagcttacctgccgggaccaactagctagtaaaagatcaaatccttaagtatattaaaaactaattgagttctgggaaaagatcatgatatcgtattcaatcgtctagaaagaatttaaatttcgttttatcatgttccaacagaacgagcagaattattaaaattgtcccatctgagaaaatttaaattagctacaaagaagcgacaagggttccagcggaaactcaccctagtttcagggatatatcagaaccatcatcattatcctgcgagcttcccgaatttaatgcagtcatcacagattcagatgattgtccatcttcagtaagaacattttcagtatcaggaaccgccaagccagcagtaggcacctgaggcatctgcatacaagcaaatgcacagaatataaatgcatattccgccgtgcctgatatggagaaaccaaagggtcctcgaatttgcattttattttgtaaaactatgcaaatatttcgaacgcatatacacagtatgtattaattacttggtctctgaggcgcatattctcttctgccagctgaatgccctacaagaacaaataaattgtatcataagatttgtgaaattatacctgattcattttcaaaccaaccaaatcaattttacgttttgtgctgataaatacaaaatattatatccagacataaatgttttacgttcatacaaaattttatcaaaattttgtaattccgacaatcagttttgtattagaataaatttatgaaatctaaaaggttatttttaaaggtaaatccatatatatcatttcttttgtttttaaactaaacatttgagaatctcaaattattgatggtcaactttttaaaagattgactgaatcttatcctaaacattaaatatttaagagcaaagggagtaaaattctattctaaatgtaatccttagttgcattgttggatatcggtgaaaatatcaatttctaaataaataatactcctcataagcctcacgagaaagtttactgtatctgaaaatctatgcataaataaacaggaagctgctgaatgataacatttccatccaatatatgtcgagaaaacatttcatgcctgaaaaattgtgcaataagttcacaacaaaaattgactctcgtacagagatcctatcgaacctcagcatttcattgacagtctattattgatttattgccatcgtataccgtctgcaagcaacattccaatatagtacatgcacatgtttcactcgtcaatataatttttgctatatataataatttttgctatatataaagttccggcactgaatagtgaatattagtaccctttagctagttctcgacttctagtcaccactacagaatgg

SEQ ID NO: 45296 - DNA, 3221 bp, Oryza sativa
  unsure (1)..(3221): unsure at all n locations
cgttttgatgatttattggttcaaccagttaaaccactggtttgaagcggatcaatgcaatttaaatagataggttattctttcaaaacacaaggtgcatcgtagcatgctggtcgtttggtttgcttctatgcatgtgatcgtgggatcgaatcccacatgcgtactttttcccacattttccctctccaacagcctccaggacgcatgtgaccttgcacaaggcaatccttggtggttcaattccagttcaatagcaatttttctacaaaaacgggtgacccaaccggtttctaccgggtcaattgcgcaaacggtcttttagctggaccaaactggcggaggctctagttctagttttttcggtccaaccaccggtctagtccagttccaataactatggattcagccacctgagggaagatgatgatggtgacatcgacaagcagccgtgcaccacgatgacaggaatagtacagtgacaagaagctgcgcgcgggacggggatagtagaacaataagagccatggcacggaaatgatggcggcgtggcgacaagcacaacctttttggatttttttggccaaatttccctatcatagtcatggcaattttggccttttttgtgcagaattttcctatctgtgatgggtcacaacttgtagaccgttacatatgatttcatcattaacgggggtgtcattctcaccactgaccaatagttaaatgtcgggttgctcacccaacccgccgttgatagtctttctgaaccatcagagatgacccgttctctagcagtgtgtcctccctagaaatactccaaaaagcatatcatattgacatcttcagaattagtatattgttgtatgtcatattgtaaacttccactaatttagcgccattttatacaagtttcttgcaactggctacactgcatagtttttgccgtacactcactactacaaaaccattaattgaggacaccctcatgtgctggtcatctaaaaccagcacatgaggtatatatttcctatcctcccaaaacccgcacatggattaaatattgaaaaccagcacctatcaccccttataggtgccagattattaaagaaaatcaatcgatacataaaatatatgtaccgaattttttaataaaccaaaacttataatgtggatataattgctagttttaacaaaaacacagcactgttaaggatgcagccgagccaacaaaatgtgggactgtgggagcccacctcgatttattaggtacctctcgatcttatctccctgactccatccccaacacaccatcctttcttcatgatctttatctccctagccttctctcttctcgaatgacacgccggtcccctcggccgtctgcctcctctcccctagcctatgggcagcacggccacctcctctcccccaagccgacaagcgacggggctgccttctctctccccaactcgtgagtagtggggccgccctctcccatagcctttgagcggcgcagctggctcctctctacttagccaacgagcggcgtggccacgtgtcctctcccccaagccggcgagcaatggccttgaggtccttgttgacctctaccagatctgatcatccgcgaacaccaaccgtgcctcatggagttcctcgctagtcaccacgcctccatctcctgatcctactgttcgctgctcgggagcagccaaatccagccacctcctctctgccaagccggcgagcagtagaactagagatccccgggggacaaatctggcttgtatggtggtgggcgagcaagcagatttcaccttcacccatggtgagcagcaacggggatggcgaccttctctccagtgaacctcctcaattattgttgttgattctgtgagtttgtatgttaatgatttctaatgtcaatcgagctcagagacgaccttgttcttggatgttattatgtgtgtctgttcttggatgtcaatcaaaccttgggggctatggggaacgctcaaagcatcggctttggttcgagctgatgcatcaagccagttttagtttttnttattcgtgacacctcaaaggtaccggttcctatactagcacttttgattctccccatcagtgcctctaatagggtgccagttgaaaaatccaacacctatgggggttctcaactggcacatattatgggttctgtactagtgtcttgttgtattaataatcatctttatcaccaatatatctataacagtacaacaatgacaataaaacatctacaaaacctattttcactcggttaaatttatacaactgacggtaattaagttgtgactaactttttttttcctctaggatctagcttattagctgcttacagggacacagaattttgagaacccatagagaattactagctatgattcaaaatacccttaactagactaacatgtttggcagacaatagtgaaatcaatgtaattaaggacattattacgaggttaacaaaagtaactagtggaatctaatcattttgtttacctttcgttggagctcactgatttcttgcatgaattgctggtcctgcataagcatatattgattagttgtctgaaaaacttgatattgtgcctgccaattcatacgaagctgaaaagggaacaccatcggatgacacccaacctttgtacagagcacccgctgcagtcctgcctcgaggttcttttccatctgctgcagctcttccacactcaatccctcaagctcctcacctctcatctgtctataaatgtggaattgtgacattatcaacttataatacgggctatttctgttgcaaacaattttgtgatatatcgaaataataaaatcaatatggatcagaacataattaacctaagttgaagacttgcttctgccagttgttcattcaaactgctacacttgctgtgctctaactgaagaagaaggtgaatatatgcataactgttagtatatgtacgaagcaatataattaagaagaaggctagttacaaagacaatttctatgagattcttgcatttatattcctaggttagaggacatataaatgtgtggagttagtactttatgtcacttttctttgcagatccaggatattaaatagtgtctcacatttacattaattacatggtcttattttcattaagagcaggtacaatagcaggctattagc

SEQ ID NO: 45297 - DNA, 11219 bp, Oryza sativa
  unsure (1)..(11219): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtagtagttctcttctcaatcaagttgaatttaaactactccaacaaaaaatgcaattttgggaaccactagtctatcatatcacgaagaggtgacctaagaagaaaccaatgccaacaaaatgtaactttgataaccactagtctattagatcaagaaaggatggtttaagacaaagctttactctgccttccaaattatgcattgtccctgacttagaaatgagcagtggattaatttgtgcaaacttttttatgagtctatcttttgagctgtcatcttagtaagctgcaaataattatgcagtgtaattttatttatttgaaaaaaagaataaatctgatcatgtctgtttctgttttgtcctctgttgtagtgccaataatatatcaggttcatcgggcgcgcgatggaacaagctttgccaccagaaaagtggaggcaaagcaaaagggccttgtcattttcaccttgattgcttcattccaggtgtttatccttctggtacccagttttgtgaacaatgtacagcctcaggaaaattttggcatattagtattgatcaagcatttgattctctcgatggcttccattttgggcctgtttggttctcttccattgctagccttgccaattttttggcaatggcaagatttggcaagccaaaaaaattggtggaggtggctgttttgagtgataccaaaatttttagactaggctagtgcttaagttaaccaaaccaaaaaaaattggcaatgacaaatttgtggcttcattcctacaaaccaaatgagcgacatttttgtagcagtgcattatttggtaaggttgggtttggcaaagaagcaaacaagctcaactccctcccatcataaatatttggtgtttaggacaagaattattaaaacttttgaaacttcgaccatgaatagcttctcaaatgcttagtttaaaaacaaaaaatgggtatagacagatttatttttaaaaataatatcttaatatcatgaacttactagatttggtaagcctattctaatataaaactgatagttaaagttttaaatgtttgacaatcttgtcctaaacgtcaaatatttatgaccatagggagtaaaattttaactacacttttaacaatatattacagtaaaggtagtggtcaaaactgtgttgtggagaccacatcattgtttataaactttttttgtgactagagggaccagtagaatgttctttttgcaatattcaatattcatactgaacgctgtcaacgataacgaactgtttgaactcttgttaaatcctgaggaaatgtgtattttcatgtttatactactttatacattaagccaaaaggttcgtgagactaaatctgccagcagaagaatagatggtatctaacttctgcatgatcaattatgttgcagaaagacgaattagggtttgagcatcaagctgcaatcatgcctgatgttcctcctccagaagaggtaattttttttcctttcctgtaatgtatatgggaaagaagaattgataattaataggtaatcaaatgcagctcctgaatctggaagagatacgggaaagaagacttactgatcctcgcttcccaatgtaattttcatgacttccaaccatatatttgatgatgatagtttcctagctaatgcagttctcagatgattcatctttaatcttcagaataaacttcttttatgttattgagaaagcattatatttgtcaccatttatttctcggacactatatttgtcaccattactcagatgaatctagcatctggtattacataaattagaaattatctggtagtatttctcacgtttagtaaatcaagcattctatcttcttaagcttcaattataactgtatttggttcgtgccacagtcgcatgccacctggcaaagtcttgactgttagtcatctgcaggcaatataggaactcagctgccaagaaaaagttcgtaccttggcccatagaaatgaggttttgtgaagattcagcatctcaacataaaccaaggtatgtacacactgtgttttctttcagtgcagcctgctcataccttctctcctcccctagttggtgataactgataagtttaccacgaaattcttgtgtactttcatattcacgattctaaattccactgtgaaaacatccaattttaattccattgtgcaagaatttatcgcatttcctgctacattgcaatttaatacattgttctgattcattagtgcatctattccattatctaaaaaaatgtatccaatttctttcagcttaaattattggtttagagccagaggaaaactttctgatgatccagcactgcataggtttgccatctaatcactataccgtgtttcttgtattatagatgattgggcacgacattaaaccatggtattacaggtgtgttgtagcatatgcttcggatctactatattctggtgtcagcctaaatcctcatagggagaagggtctgaagacatactcactcagtcttgatcactcgtatgtttcagcaaaccgcacccagtactgcgattttaattaatacaactcgctagtaaaccgtttgtttgttactgttctgcaggatttggttccacaagcctgtgaaagctgatgattggcttttatatgtggtaagccattgatttttacctctcaaatgatacacaaaactaaatttctgcttgaggttcttatggcaacaccttcccttaataaacacagatcgacagcccatctgcacacggtgggcggggttttgttacagggcgaatgttcaaccgacaaggagaggtatatgccttcgttgtttcaaagcttagttcagttctgcattgcttctgtgatggaaatgtttatcaacttactatgatgtcttcgcaactgctttagctcgtcatgtcgttgacccaagaggcgctgattaggagggcgaagacgccaggacaaccgtcacaaaccccaaggccaaagctttgagaggtgcagaagagcagtattatcgtttcatttttggcactttcacagttattttccttttcaatggaagtctataacacgtagacgtgaagccgaagtatagcatactgcatatatgtagcaagaaaaaacgatggtaaaactggttctgtaattcacgaacagcttactgacataccacgtatgtattggatcgggaaaaataagcgaagaacttggtatcgctttttttttatctcaataaagccttcaattatttcaatttaagccttcatggagcataaatggttggataagtacacatctgataagaagtttgtctaagcacacatctgaatagttgatatgaaaagcacgggtaaaatttgtctgtgacgctcaggagatttactaatattccagttacaagcagctcctcgtgaaggattctcgcaatatttgaagtgtcaaaacaaacagtatgtcatcatcatgtagacacacgacattttacatccagaatcaatctagccgtggatgtccagtacttaagatagtgaaagcaaatcacacaaaaaaaaatcctacaaattcaacgttgtagtattccacacaatcacaatggtcggttgggattttgtcaacagccttacaagcaagagtggtgacaaacagctacatgttgctttctgattaaatacaagtagaaaacatattacaagccacgcctaactaaagctgtcttgttagtagaaactcccactacaaacttctgttgaatcccttttcaaactacatgctgctgaatcagcctattccaacatcaaaatgctacaaatggtatactgctgaatcaacacaaagacttaccatcaaaatgctacagatggtatgcataatgaatcatacaagaacatgttaccatcagtccatcactaccgtttagttttgaaaacgggatggatattcacattcaaatgctcaagcttctcgatctttgcgatagattcaccgattctcttcaacaccatgggcatagccccaatattcgcctcacttttggccttgacgatccttagtttttccttcttctcttggtcaactttcgcaactggtgttccagcaatatgctgcgatgcagttgtaacttctgcaatgtacataatgttgtcagcatctgacactggaattaccaagagaaattgccatctatatcttctacgttaatttgctcttttaattttttttacttattgatggcaatggcaattaaactgggacaatgcaaacttgagagtcatttttcacatacttagattaggttgcagtagagaacaggaacaggaaaagcctcacttttctatgtctaacacttcaacaacatactttcatggtttacagttagtgactggtgcaaataattatcatcaacaaacaggtttgatgccgaaatcatcgagcttgctaggtaactgaacaggaatctaccgatacgggaagggaaggtacattttcaatgcatactgtcaaccagggggtagggaccaaattcaccgattatcacaaccaaagaaaaccaaatgtcaaatcgcagtttagatccgataagtcgtcctctcttctttccaaatcaactgagccctaactaactggtggtaagtaacactagcattgctcgtatatacgataaaccccaagacctactatactaatcacgcccaaattatacgaacaccaacaaggggacgaacaaatcgaaaaccctagtacgccggaagcgcgcataccgaggaggcgggggcggagggcggtgaggcgggaggcggcggcgttgaggaggcgggcggcgtcttcgcggcggtgctggaggaggcggcggcccagacggtccacctcccgctccagctcctccatgtcctcctcctcagccgcctcgtcctcccgggccggggcggcggcagcggccgcggggaccttgcgcttccggtggctgctctgggctccagttcggcttggggtgagcgaggcgcccgccatgggggggagcttggagcacgtgaagccgcggcgagcggagaccagagagagatgctcgagcggaaggagcggagcggagcggagaggcggattcaatttgggaggggggagagatgggactttggatgagtgggacccacaaggccacaacggggaagaattcgattttgaaagtcttcgagaaaacacagttcctgcccctggacacgcatgtcagtactagtgccgatcaaccgcaataatactgtggccctgtttagttctaaatttttttttccaaactttcaattttccatcacatcaaacgtttcatacacacataatttttctatcacatcgtaccaatttcaaacaaactttcaaacttcagtgtgaactaaacaagttaaattttcttttagacgatggcgctcggcccagcttttcataaaaagcatacgaggttcatacagcaaaatgaagaaaaacaaaaactgggtaagccagttcgagagaagagcaaatgctgctggcacagccagacaagccagagagattgcatctgaatgcactaagagaaagagaaactagattaagcctgaaccgcgccttccactgtcctggaacttgccgcatccccttggacctcgagtgaatgctggcacgcagtaatgtttgaaccgtatccagctccccaatcagcttctgttgcgccaaatttctccactgcatcaaaaacgacatcaccttatgaggtaattgcatcacgtcttttagcaatttatcttcgaaaacccaatcattacgaacaagccaaatagcccaaaaacaggccgcaaataggcaaagaatagccctcctgttgctcacaattttccatttaaaatcatttactacccgaaaaattatttgaattttttgtattttaaaattcaaattttatatagtttaatcaaacccggatggagatatgaccaaaataaaattggtagatctcaatgagttctacaactttgtttttgacagttttttcatatgagtttatttagtatcataaaattcaattcaaaatttatttttgcctataaggctaatttgcctcctcaatgagttctaatacttgctaaatatatatttgatccaattaactcggttttgctagtgaaatatgtgaatggatgtgaaatatgtaatcaaaatagatgttatgtgaatgtggttgtgttaaatatattgatggttgtgtatgtgcatggatgtttaacttctttggaagtcaatccccaaagaactttgaggttaagcgtacttagggtggagcaattttaggatgggtacctgaccgggtgcacatgagtgaggacaaaatgtgtccaaaaaacaaaatttatttttttttattatactcatccgtgacgggctatagtttaggcccgattgagatgagagccatccgtgacgggctatagtttaggcccgttagagatgagagttatccgtgacgagctatagtgttggccagattaagatatgtgtcatccgtgacagccggatgcccgattgatatattttcttacatcagtgacttttgcttgggccgctatccgatagagatgaggcttagacccgttacagatgaccgaatctgttctagtgagggtctatggagcagcgagttgtgaaattcagaatacaagattgaatgctccttgaaatgtggagatcaaacggaatttcttatagtttagtttagtttctctaaaattcttttaaattcctccgttcacctgaatcttcagtcatatcgaccgttatataaccagcaaacgcaagtagcaacagaatactcctatcaatttgctgtgttcaccgaatactcctaacaacgcaagtagcaacagaatactactagtgttgcaagttttaagcaccacttattcggtggcctttatggtgctgatatttctccgggttgcgtgttgacgtgagtcagatataactggaaccatgattttttgcgagaatattccttcctaaaaggaagcctggaatttgcagcaaaccctctcccccaacaatttggcatatcctttcccatctcttttcatcacccttttttcttaacagaaacagccaccaaagaatcatagtactattctgtgcaactagtatatgattgatcgagacgcaagaacaaattccacattagcagtaggcataagtctttgtttatgtgtatgtagtgtggtgaagaaatagacggtgcgatcaagccgcatttgtgatcaggtatgcacaatttgcgtaaagcgagatggaagtttcagcagcgtgtgttcagtctatttggaaacgtagatgaagaacagaagaagggtcagtactcaataagtcactattcagtactcagtactcaacacaccgcttatgactcggtactcaataagtcactgagtatttggaatggtgaaatttgatagaactttgttcggattgccaaaattcgtttgctggacagaggggatcatttcagtgaaaatcattgcaagtctgcacaaaacgctgaaaacatatagagtagatcgcgattagctagcctatgcgaagattatttcagtgaaaagattttccttttccttcatcgaaactgatactagactatatcaaaataatctacttactccctccgtcctaaaataagtgcagccatggttttccacgtctaactttaacaactcgtcttatttgaaaaatttttgaaaaaaatttaaaacataattcacgagtaaagtagtattcatgttttatcatcttataactacaaaattgctaattataaaaaaatttcgaataagacggatgatcaaagttgggcgctgaaactcatggctgcacttattttgggacggagtaatacaagttacaagccatgatccgttcatctgaattctgacatgtatgtacattcatctgaaaaaacatgcggagtacgtaatgacagtttaccactgggcgaacaaagctacagctatggcaaaaacaaaccatgtaagtaagattaaataccacatgccacgactcgtcatgccgaggccgccgccggcgctgcgggcgggagcctcggcgagccggcgctgcgcggtggcgcgaacctggcggtgaccgtgaagtccggctcgaggcagccgtcgtcgaagttctgcgcgtagctgagcgggtcgtagttgagccccccggcgccgaggatggagcggccgccgccgcctccgccgtgccgccgcctccgccgcgccacgctgagctgacgcagcctgtgccacagcgccgcgagcccgagccggccccagcacgacgacgccatcgccggcgctcccccgccgcgcgccgtcgtcgtccgtcgcccgtacgacgacgcgtccacgtccgcctccccgtggtcccctccctcctccgccatcgtcgccggcagcctccccggcgatgcccacatggcagacaggaggcacgcgacgcgagagcgcgagaggtttgtgcgtgatgcgtgtgctggctttggtttttctctcgggtagatgaggcgcgtggagggagaggtggcgagccgttggatgcgagagggggacggcggagatggggacgtgggggaggtggtcccctttgccccgcgggcaaatgtggcacgtcgcatcgtgccaggcgggatctcggctgacgtgggcgtcgcttgctcgcatggcgacggttgggcacatcattttcaggttctcggtacaagcaacgtgttgctcgttgccgtgttcaatcgtatggttttctcttctttttttttttcagggcaatcgtatggttttcgatccaacaatcaaaattataaatactgaccacggtaacactacgtgtatagaataaaaagaaaggttcagatagatgaggatgaaaaagataaaagtgcaaggcaagaaatttctgtttaagtaactaactgaacgggatcatcttattacaaatataattcttttatataaaatttaaatgatagaaatacaattattacggaatagaatgtagtagttttcttaaaaagaaaattcaattaatatccagtaaccagtttgatctgctactccctccgtcccaaaaaataagacatatccatccaaaattacttatattttggggcggagacatcataagatttgttctatggattgttaggctgtgttcctctctacactttcatatcctctacttcctcgtttttcatccacacgttacccatacggctaaacggtatgttttgtcaaaaacattctataagaaagttgctttaaaaaattatattaatccatttttcccacttatttagctaacactccctccgtcccgctcattaaggcgcacacattttaaaattcaactctttaaatatttaaccaataaatattttattataaattaaattttatgtaatgaaaataatatcattggattatcatttacattcacttttactatatgattaagattttgttatgaaattggcagcttgctcgttcgttaaaaaatatgattttgttactacaaacattatagtatatgagaaatttaaagttaaatatgaattttaaaaaatgtgccaagtctgaccgcgtcttagtgaagtacttaattaatcgtggactaaacccacgagatctgctgtgagaccaggaacaacatgctaagctcaatggaactcctggtcacagaacatagatagatgatccccatgaccttgcatgccatttctatattaagcatcttatcgtttgaccacacaacatatacgaccatttttagaccgcgagaagaagcgtccaatatgtaacgttagttatcttggacatctccctcctagacctcatttcgtttagctgccgcactcaatggacaatcgtaaccatgggcggtgctcgttgccgcggctcgccgttggcgccgccgtcctcctcctcgccgtctccctagcggccacgccggcggcgagccatgccgggcacgatgacaccggcttgcacagcaactacctcgtcatcgtgcgcaagccgtacgcgtacgacacgaacctgtacaagaacgtgtcgagctggcacgcgtcgctggtggcgtcggtgtgcgacatggcgaaggaggcgctggagagggacccctcctccgtgtcccggctcatctactcctaccgcaacgtcgtcaatggcttcgccgcccgcctgacgccggaggaggtggaggagatgtccaagaacgactggttcatccgcgccgacccggagaagacgtaccagctccagaccacccacacgccgcagctgctcggcctcatgggcggcgcccgccgcggcggcgtgtggaacaccagcaacatgggcgagggcatcatcatcgggatcctcgacgacggcatctacgccgggcacccgtcgttcgacggggcgggcatgaagccgccgccggccaagtggagcggccggtgcgacttcaacaagacggtgtgcaacaacaagctcatcggagcgcgctcctacttcgagtcggcgaagtggaagtggaaagggctgcgcgacccggtcctgccgatcaacgaggggcagcacgggacgcacacgtccagcacggcggccggctcgttcgtgcccggcgccaacgtctccggctacgcggtcggcacggcgggcggcatggccccccgcgcgcacatcgccttctaccaggtgtgctacgtggagaagggctgcgaccgcgacgacatactggcggcggtggacgacgccctcgaggacggcgtcgacatcctgtcgctgtcgctcggcgacgagcaggccggcgacttctccgacgacccggtctcgctcggaggctacagcgctgccatgcatggcgtgctggtcagcgcggccggcggcaacaccggcccgggaccgagcaccgtcgtcaacgaggcgccgtgggttatcaccgtgggggcaggcaccaccgaccggcggttcgtcgccaccgtgaagcttggaagcggggttagcctcgacggcgagtcgctcagcgagccc

SEQ ID NO: 45298 - DNA, 4288 bp, Oryza sativa
ggccgcgcccttctcgtcgcgggggccgaacaggcggagcagggggatcctcaagcccgacatcataggccccggagtgaacatcctcgccggcgtccccaagatcgaggacttggcgctcggggccgaggaagtgatgcccaagtttgacatcaagtccggcacctccatggccgcgccgcacatcagcggggtcgccgcgctgatcaagaacgcgcacccgacgtggtcgccggccgccatcaagtcggccatgatgacgacggccgattacaccgacaacctccggaagccgataaccgacgtggacggcgcgccggcgacctactacgccatcggcgccggctacgtgaacgcgcggaaagccatcgacccggggctcgtgtacaacctgtcgtcgctggactacatcccctacctctgcgggctcgggtacaaggaccagaaggtgaactcgatcatccacccggggccggcggtggagtgcgccaagatgcccaaggtcgatcagaaggatctcaactacccgtccatcacggccgtcctggacatggagccgtacgaggtgagcatcaaccggtcggcgacgaacgtcggggcggccacctcgacgtacgccgtggaggtggacgtgccggcgacgctggcggtggaggtgaacccggcgaagctggagttcagggcgctgaacgaggtgctgaactacacggtcaccgtcaagacggcctccggcaaggcgccggccagcacgatcgaggggcagctgaagtgggtgtcggggaaaaagtacgtggtgcgcagcccgatcctcgtctgtgccggcaccggcggcaagagcgccgcctccatgggggctgcaccggcgtagagcactggtcgagcggagcctaagagatagcagcttgatgatgattactagattgccacgcgtgttaacgtttgatggtgctttactcttcgctcggtaggtttaggctcatgtatgtggaggctagcgaattaatcctttcctccgcggaagtggggtgacgggtttttcttgctgtttttaccactagtgcacgcggctgatcttgaccattcattgattttgtactccaggggacgagatgtgatttcatccccggccccttaatcatgatatatgttcatttattctttttttcctgtttctcaaatagatgcagacgtgacactcctctcaaatagatgctggtgtgttatatatgctatatatgctgtgattatattttaaagttgatgtgaaaatttaaaacatataatcattattgtagtttattttgccaattgaattacgaatagagaaaatatattatccaactttcattatttctcctattgtttatatttttcataatattactgtttgcaacatcacgaatgccaagtggagcttaataaggatcttgagttgaagcagtttgccaagacaccaaaatactaaaataaagctgttggaccaaatgaggttccaggatccatcccaaatgccaaacggaccggagcctaataagtactccctccattccataatataaggcacaactatttttattacatgtttcataatagacatacatgcaaacatgcaattaactatgatatcttctacattaaattattacttttttaaatcatccactctcaagttatctaatcatattggatgcatgcattaatatttattaggatgatccaagctacaatatgataataattatttcttggtctttgggttaagggtggttgtcccttatattttggaatggagggagtatcttgagctgaagcaatttgccaagacaccaacatgtggaagggcgggctagctccgcatctattttaagtttgaacctgggaagaaaagattagagctagtcttctagtttttcttttcggttgttctttttcatgtttctcaattatgagttttagaatgtatgcactcgtgtaaactttgattgtgtatatccactttggatatagaggccgaattttatccattatctaaaaaaaaagacaccaacatgttaaaaactatatattgaaccaaatgagattaccaaaatccaccgctaatgccaaacggagcctaataaggatttcttgagttgacatgttttttttttacttttttttaaaaaaaatctttttccgtccccattcttgatcttgagtaaaactcaataaatgaaaatcatgaacacctcgtaagtttatattgtttgttctttctttgtagtttgtacagaaaatactactcttgtatcttatcctgccaattcttttcataatttttcagggctatttggaatgtagctgagaagtaaagtcacattttaataaaaaagataccaaattataaccgctcatattaaaaggagacccgtgtggggatgaaccttaatagtatagtatagtacttaactatatttattaatttcgatttcggaattactatacggctataccaacaaaacaaactaagaatccaaagatgactacaatttggtatttcaacaccagaactgtaagtttaaaatttcaacaataagtactgtaagtaagaaggatcccaattgaccgagaaatcacaatgcgcgtaacgcgtgataatacctctgtctcataataagtgcagcaatgagtttttgcgtccaaatttgatcgtccgtcttatttaaaatttttttataattagcatttttattgttatgagatgataaaacatgaataagactttacttgtgacttatgtttttaaatttttttaaaattttttaaaataagacgaacggttaaagttggacgtggaaaaccatggctatacttattttaggacggatgaagtattaccgtctctgaatctctgatatatgatcaggcgaaggtgacagagaccgggctccgtacggtgtgcgtctccgaaacccaccgcactgcgccctgcaccacccttgcgccgccctgccccggccacacgaccaccgtgaaatccttctcctggttcactccggtgaaccgcaatgtcctcgggaacacgcggacggtcacggttgtgtccagcatgtcgaccgccgcgtagtactccgatggcacctccccgacgttcttcgccgtgcgcctcacgagcaccggctccgacgagttccacgcccgcgggaacctgaccgagatcgacgggtagttcagctggtgctccgggatcgccgcgacggcggagcagttcaccggccggcgcgcgatcaccgagacctcctggctcgtgtacaggccgcagaggtagccgacgtagtcgcaaggagcaatgtcgtagaccaggccagggtcggcggccctctccgggttgacgtgaccggcgccggtggcgaagaagttggccggcgctcgctgctcgtcgagtatctggttcccggagcggtcggtgatgtcggcggtggtcatgatggccgacttgatcgccgccggcgaccagtgcgggtgcctgctcttgatgaacgccgcgacgccgctgaggtgcggcgtcgacatggatgtcccggagatgatgttgaaggtcggtccagggaaaacctgcgccgacgatggcccaacctggaacggccatgcggcgagcacgttcacgccggggcccgtgatgtcgggcttcaggataccggggttctgaacgctaggcccacgggaggagaagaaagccatcgccggagcaggcgtcgtgccgagtaccgtgcccctggggaggatctgcgccaccgggttcgccgtgctgttgatgtacgccttgatggctaagccggcgacgtagtcaacatgcgacgccgggaggacgtgcgcctcggccaacgtagtgtagccttcggggaagtgattgggaagtatcatgccggcgccgccggcgctctgcaccaccgcgcctttgatgatcctcgtgatgttaggaccaccaccgactcgcagacgacgatcttgcccctgacgtcgaagccgtcgagcgagccgttgccgcagaactcggcggacggcttcccgctcgcgccggcgtagaccagtgggtagaaggtgctcggcgagtcgttcggctggtacagcgactcgccgtcgaagtagagcccgttccctaagcgcaccgtcgtgcgtatcgaccggtccatggtgctcgcggcgacggtgagcatccacggcgcgtcgttgatcacggagctcacgtttgggccagcgttgccggcagccatgctgacaaacacgcccttctccatggctccgaacg

SEQ ID NO: 45299 - DNA, 29374 bp, Oryza sativa
ctgaaggaggggtggtccgggaacacgccggtgtcgatcacgccgacgatgacgccagcgccagctcccgagccgcgtgggacgacgacgaccaccgcttcccctgcggcggcggcggagcactcagcccgaggaactgcggcgtgtgcgtcgtctgcagcgtgtgcgtctggtccggcaccgcgctcacgaacccgggcatggcggacacggcgtcgagctcctgccgcgtcagcctggccgcgaacccgctcgcgacgtggtggtacgcgtggaccagccggccgtcctccggcaggaacgtcttgtaccactccttccggtcatcggcggtggcggccacgtggctttcctgcggctgcacgtgcacgatgaacgtgccgatctcatcgccggtcgcttcaacggcgatcgcgaggacgaaaacgaacggaagaaaggagagcaaggagagcttgaagccatccatggcgggtttcgttctgatacgacttctgagctctgcagcatttgcacaaattggcggccattttataaagctaagcgctttgtcagattaagctggccggcttttgcctggtcttcaggccgtgacaatatgcgaggattggaggcttggagctacggtaaaattggcaatttgaagaccgggttaatgaacaaaaacggagcgaaacagacacatatggctgcttgggaattgccgcactgtgatgggatcttgctgcaggaacggagcggcagccgcccgtgcgtgaatatgcgatgtttgcctcatagtacttaaaaaaacaacatagtattggatgtgatattttctaatacaacgaatctggatagactagaaaatatcatctctaatacgttgtactagaaaatatcacctccaatacgttgtactaaaaaaaaatatcgcctccaatacgttgttgcctttttttttttttaagaacggagggaatgctacatagccaaatggcattgtgtacgtcgtcttcgtttggatcacataactcatttttctgtctgttgaaaggtgacccaatttgtcgatcatcttagcaagtcggagcttagatctaaccgccgaaatcaaccttcgtatagaaacaaggttcgtttatccccagtttttttttctttcaaaggtcgcctaattctctgatcctaactagttatagtgggcctttttgtgcagcccaatactggcgattccgcgagcctagcctatcaaggcccatgtaaaagcatttggtatcggtccagatcacacgtcgcaacagccgctcccccggccgcttgccccgacagaaaacgaacatttacgctgcggcgagccggcgaccatggcgatttggttggattgtgtcgggcgcgctgtgttccgatccaaagcgaagtgggttggcagcagggtttataatatcgtgaggtcatcgtgattatcacgtacgctaacatttttaatttttaaaatcataatataccttgtagttatcacgttaactgtcaaactgtgagatggtggtaatctcacctcaaacattttggtaagttggtcaggtatgcatgtagctagcttctgtccggccagaggaacggaaaggattatgccacgcctttcgatcgtcacccgtgaagaacacgagggcgtctccagcgcctggacgtggacaacaatgaacacgacgacgatcgagtcgatcgacgagctcaccttccctgggcgcggcctcggcggcaacgatcgcgaggctgagtagtgtttgttgcatcattgcatggatgggtttgctcgaggttataatctgagttgatcgatcagttggttatcaatttcagctttttggaaagccatgctcaaatctcaatggagacgaagaattaagagagaggaaaaaaggctgtgtttaaatttaaagtttagatccaaacttcagttattttctatcacattaacatgtcatacacacataacttttcagtcacatcatctccaatttcaacaaaaatctaaactttgcgctgaactaaacagccaaaagccaaagtaagatatctgcacctgctgggctgcatgtaggcccgctacaccttttgcttttctgcacagaacatggcctggagcctgtagggaggcccagcgctgcagcgctcggcctggacacgatttgacgtgcacaaagatgcttggcgctggcgctagtttgttttgactttggaccagctctttgggcttggggagtttcttttagctttttttttttaccaagagaagctgtatttatataatccaaaatatactgaaactagtagttgagtttctcgacttcttcaaattttcctcgaattttttattatactaattttattatactgaaactagaagtcggctaccaatcaattgtttatgagaatcttaagctcgctcaaatactagcggaattgccctcgaaaccaacttcgctatgtaatactcactttgctcccaaatataaatatctctaggatttaaattatatatcataatataagcatattcctctggttttcatgatttacattatttcgatgattctaaagctaattactacatgtctaaaaaggaaatcgaagcaattcaaaatgaacaactaaagtgattaaaaaggaatattttaacctaatgttagtatttgttaaatatagcaatttataaaaagaaaggatgtacagtagtacatatttttgttttaccattgttattataacactatgcttacttttgaaaggaaacacagctatacaatactaatttatttaggattgagtttaatttgttgtgccacgcaagtttaattaagttgcgctttgtctaactatgttgaattgccttttgtgttgaatggacgaagttgtataaattgtggaaattattcaaaggttcaaacaaataaattaaatattataaagatgaaaaatagatttaaacaattttctaagaaatcatactagaaagtttttctttttttaaaaaaaaaggcccatttaaaagctcgagaaatatacacaaatatccatcattccaccttttttttagaaattaccggaggggagagcttttccacctgaaattttcattgatatgagggagtttgaatacaaagttcgagcaaactacagcgtcatgccattaaatattttgagaacagacagggcgagagagagagaaagagagtttgtttacaggcagagacaacaatctggtctgaccgccaaatacgttctgcacagatagttgcttcatcgatgcagctcggagcatgcgctggaggcaaggttgttcatttttttaaaccactttgtatcgataattcctaaggcatcagaagcacgggaggaagaaaaggttgtttttaaaaatattttcccggaaggtccattaataaaattatttattatatactaaaaatccattaaactttctaaaaacgctctcaagccgacacgtggctcttctataaacactgctttgatatctaatcatcgattttactttaaatttggtggacccacaattttctaccgttggatttgctaaccaaaagaaaaggcccacatgactgtccatatacgtacggtgctacgtatgctcccctcctcaataatgaaaatatattttgtgataactaatatttatccacgtacgttattagattatttaccacaaaatttataattcaagatccaaactaactatatttaataagtagaaaaataaaacacatttataaggaaaatcatatagatattttaatgatctatttaacaacacatatctttgattggatattttatatttatagtataggtctaatttaactacgtatatttgcataaatttgtaaagtaatatattttatatttaaattgtaggaaatcctatcaattttctttgcaacattagtacgtacatatgatttttggctttattttttctatcgtataattacatacaaatggtcttttttttcttacggcaaacagtaggtaagcttagtccattaaacatactctattttcatttaatttgggggaaccattattaccattagatttttatattttgtaaaaaaaatactaaatcagtttatctcttaaataatcccacattaccccgtgttctcgtgtgcctgtacggacgtactgtgtcccagtgtacctgtagtacgtacttaagtacgtccgtacatacatatcccctatgtctttttctttttttccctccttatacttacattagatgaaaaactaaaaagtccatgttaactactccataaaaaatatatgttttaatatgtaagaatatatgttattttaagttttattctaaatagcgcatatcatggaaacatccataaaaatattaataaattaaaaatgaagatcatataattgtatatcacttacaaacaaagttagattggacttatattttaaaaataaaaacaacttaaattgtgagtagcattctaaaaatttactcactccctactacataatagatatttctaaatgacattacaaatttatcatgaatgtatttttatatattatatgtttctttagtcatgtatttttagaaaattaatgatcatatattttttttgacaccatgtggatgtccttttatctcttaggcttcattcgttctagctcattggatgagcttacctcggacacgcgaaacaaagcatatcatcagtgtaagactaattaagtattaaatattataaactcgaatatggatttatttgatattttagaatactttgcacaatagtttaggaaacatgctcaccataaatgagggagtagccaatctgataaatactttagaactcaatcttaaatttattactaaatatatagtatataaaatatcatgtcaatcaggaatagtcaaatatatcaatcgtatatccctactaatccctatgtatataagtttcatataaaaactactatccaccaatcgtcaagttacattatgaggcatccgtacatagcgcgccaattattagatggcatttaatggtcacgtgcattatcaagtaccgataaaggacaaaagtgggcaaacatcaacgaatgataggcaagtattgataccaaccataaaagattttaacatttagaaataaatagatgtccgcactcgcattttcctacaaacttcctatgataaacttcctataaacgctctcaagctgtgatgtagtactcctacaaacgctcctaaaccgtcacgtggcgttataataaatcccagaaattcaaagaaaaaaatctaaccgttgtttttatttattctggtagacccattgtttccgtccattagatctatcttagaaaagtaccattaaatttatctttaaaagtctcaacatctagatgcacataggtacggtatgtacgtactcacgcaggccccacgtccctctcttttgtttagttttctttgtgaaatccgaaaacaatacaccattaaaaaaaatctgaattcagctcaaagctatatttgggatttacaattaaaattcaaagctcctttgaattatatgaaaaacaaacaacagtgtgcgattaggattcctattgattgcatgactatactatccttaatttggtttgcacgaataggtcatagtaattttgaaggaaaatttcctatcctaccgttaccaagcaaataaacataggaaagtttaagtccatcaaacatcttacgaacactcctaaactattgttaggcatcctagaaatgctcctaaccattacatgacactataatgaattagagaaaatcataaaataaggaaatactcacaacatgtgacaagttataatgcacacatttagaaataaatataatggtatgatgctggactccgttgtcatatagaatataattacgattttaatgttttactgcctaaatatgttaagagaaaatagaaataagatacatgcgcatgttttttttccttcgcatgggatcaagacaatcaagctgctaaatgcaaaggttgtttggttaattgcattttatttatgctctgataggtgatgatttgatctatatgggtttaacaaattttgaaattcctcttatttctgtactccatccaaaattcgtttattctctattttacacatgtatttctaacctatttatgtaccttttatattttcctataattttttaaatcatgtgttataaaggaatcttcgaaatctttcaccaagggaaaatcataatattcaaaatcctaataacaaaaaattatgatggcttaaataaaatgtccgcgtaactgcgcgggctacttttctagtttttttaaaaggtctaaattatataaaaaatttggatgaaagggttgttggcggcggaatatggcccaggtctcgaacatcccaaattgttgaactgagattgctgcccagaaattgcgagcgaaggggtaggaccgtaggggagacagtggtggctaccagtttcttcattgagtccgcagtgaagagacaattgtttttgcatggagattttttttttgttggccatggaccattccacctatttgttacagtaagaacctgtttatatgggactaaaacttttaagtccctatcacatcggatgtttggacactaattataaatattaaacgtagactattaataaaacccatccataatcttggactaattcgcgagacgaatctattgagcctaattaatcaatgattagcctatgtgatcctacagtaaacattctctaattatagattaattaggcttaaaaaatttgtctcgcaaattagttttcatttatgtaattagttttgtaagtagtctatatttgatactctaaattagtgtataaatatggagactaaagttaagtccctggattcaaacaccacctaagttatgttggaaagtaggagattcataagaatcaatctttttaaagagaaaggtaggagctttgtcgatcaagaaataaacaaaaacaataaatttgatttccacgataattaggaagaggttatttagaccctctttgtttgggcttaggtttattggtttagatttttaagttagcttattggcttatatgatttataagctggtagatttaatgttctaagtttaatggtagagtcatgcatctatttcacataagccaaaaaagcttctccaacctagtttttggtttaatagtgttagagtggcttatggcttaaaaaaagccaaatgaaaaagccgcttgtttgtttaggtttagacattttgacttataagttagcttataagactaaacaaagagggtcttagaattccctgatgcttggtctaaactttttcgatctctcattttttttcgagtacaaatgcgatgcatgttgagttatggatccaaattcatttacacttaataaagactagcttctgccatagtggagcggaggcccgtcgccggtaggattgggtatgaatcatcatcccttttagagttccaccatatatatacatcttgtaaaccatcgtgcggcgttgtaaccttaccctgatatagtgaagatattttgctggctagcgcctgtggttttttctctcctgctttgagagagttttccacgttaaatctcgtgtctttttgtgattgatctattatttattattttttatcgtttgtttgcctatagtttccgaacaatgcacacacactaaacttacgctcatacacatgtgggcgccctatcatacgtctatgccttttcgatctgaactctactttaagtttagcaaggcttgtactaacgaataacaagaaaacatgaatacctccccagaatactaataataagattgagaactaatcatggaatccacgctccacgcagtcatacccatggtgcatggtatctttcatcctgtcatctcatctcagctatgtaattacatacaaatatgattgtgtgtgtgcacttcacagggcagatcgagacccaaatattttagatagaaatctcaaccacattaccacacatgtgacatcaggatttctcctgacatggatagacagtacattattgttattgttatttattttataatgaaaacttagatctaagtctgattatatgtgtcggcatgcttgcaaattaaattaaaccttgccacgactactataattaagcaagataaatgtcgaacttcacacatgtagccttttgtgtattacaaatggatcgactaacgtgactgtatccacttacccaactacttattctagatttaatgatataatttgtgtggtttaatttgcaagtaagtttgtcttttttaaattaagttagtgagtttttttttgaacactcaatattgtttaggtgaaaaggctaaagtaaagctctgcccaggaatcattataaagtacatcaaaggatgatgtttttgatttttcatcggatcatttccatgcctgatcagtaggaattttaagttgtaaacatatattacaagtaaacaattcaatcctgcctaatcaagtttatctacaacctactactaggttccacaaacagacagcacaattcagagagaaagccagccaaagttgagcacacatttcattccatttcattagcacacacacacgcatgtcattagcagctaacgaccataggcacgtggcgctatatcgtaggctcatcatgcgccatacagcccaatcaagagttggcataagcgtgcttacgataatcctaaactatcctaacctcctcgagctaattaagctcaccagccgagcacaccccaagcagaccaagctaaaaaaaaaaaactctgctttattcgtcctctcctctgcatgaactctccccactactcccctgttacagcttgtgacaaccaagaaataccctgcctgcttcgctgtaacacttgtactcctgaattacgcagagatctcctgagttatctgcaagagagagtgcagtaacaggaaagaaggttttcaatggagacggagatgcaaaagtggcagtaaaatggagactttgcgagggcaattcgatcgggcaactcacctcctcggggcaagcaactgccggtgtcatgatcggaaaggcaccggagccggagacggaagggggggggggggggggccttcacctcgcctttgccgtccgtaatgtcgccattattctgaccggcatgctcgccactttgtgtcagataaaggaggaggcccgcttgtgagtgacatgacatccgtgctatctaatccttgcccccgcgcggccacatggctgtgtttagtttagctgcgagacgaacgcgtgctgctgctcaaagcgccaggattagtgttgagtccccatgctttgttcagccattggtgagccggcaggcataattagcttagtgacaagtaccgtactactaagagcagtacaatagcagactatgagcccgctaataaacatacttaaaaaagataaaagagaaaagagaaaagtaacgagctttaaatttatagccagctatagcacaagctccaaaatatatacgtgtataatatgtgggaccaaacaattatatagtatatgtttataggtaatcgtatgaattggctatttaatcgattatagataatttgaagccaataattgattataatattaaacttgctctaagtagctgcgctggttaagggagacaaatggtggcgtcgattttgtcattagtgtgtgcttgcagcgtcattagtaggagtatgatcatctgtcggcagagctctgtaaaaattctgctgcttcagtgcttctggtattagcgtcagggagtgcagtgatctgcactgcagtgcacatttcttttcggtgtttacgcattttcgaagggaatttacgcgcgaagaggagggggggggggggggggggcatcgtggaaagcgagggggaggaatcgcactcttttcttggcataaagcgcgcccgacccgtttacctcatcgccgtcatcgtggggcctcaccacgccacgccacgccacgccacggcacgacgtagtacgcttctccccttgccggccacttcttccgcagtcgacagccgctgactctccactgcacccagcgcagcagcgcactcgcttgcctgcggcctctgcctcgccaccgcgagcgcactcggtgtgccgatcggtcgatgcgaggatggacacgccgtcgacgacgtgcgacgagagctcggaggtcgacgcgcgcgacgactacggggacatcgacgacgtggagcggcggcgcggccgccaccggcgggaggcctcgtcggacgtgtcgtccgagtgcagcggcgagcccgggagcccgtacggttcgccgtacccgcggtggcccgtgtgcagcatagcgaaggcgccgccgccgccgctgctgcagaagctcggcgcggcgcggcgcggcgcgggccgtgaccgcaaggccggcgacggcggtacgtcctcctaccacccgcattgaggctggcaaagatctctgctgctttcttggcttggatattctccctaatgcgctatagatgggttgaattggcagagttgcagctgatcaaggagaggttctcgaagcttctgctcggcgaggacatgtccgggagcggcaagggggtctccaccgccgtcgccatctccaatgccatcaccaacctctatggtcggtacgcgtaatctcgttttcagagatgaaatcttcagcggcagctaggaacagagtagaacacgagcgtgctcaatgtcaatctgttgcttcctctgttcgcagcgaccgtgttcggcggctgccaccggctggagcccctgctggcggagaagaggtcgatgtggcggcgggagatggactgcctcctctcggtgtgcgactacatcgtcgagctcttcccttccaaggagatcatgcccgacggcaccgtgcgggaggtgagaatttgcaggtgttcgtccatgttcttcaaggcaaaagctctcttgcgcgtcactaatccatggacgcattcccgcctctttcgtctcaggtgatggcgaccaggccgaggtccgacatctacgtcaacctccccgccctcgagaagctcgacgacatgcttctcgtaagacccgattctgctcgcgctatgttcatctccatgactccatggattggcttcttgttcatcgtgaaattgctttgcttgttgccgtgcaggagattctggacagcttccagaagactgaattctggtacgtgaacgacaagggtcagaaggatagctgcgccgccgccgccgcggcgccgtgccgtccggtgagccaccgcgacggtgacaagtggtggctgcccgtgccgtgcgtcaccaagcccgggctgacggagtcggcgcggagagacctgcggcagaagcacgactgtgcgagccagatccacaaggcggccatggccatcaacaatggcgttcttgcggagattcgcatccctgagctgtacaagcaaacgcttcccaaggtacagcaacatcaaaaatctctctctctctctctctctctccccccttctctttctcgatacaagagcttcaaatcttccaattcgaggatttctcccaagaatctgaattctgatcctgtgcagtgcgggcgggcgagcgtgggcgacctgatctaccggcacatgtcgttcccgggcaagttctcgccggagtacctcctggaccggctggagatctcgtcggagcacgacgccctcgaggcggccgaccgcgtcgaggcggcgatgcacgtgtggcggcggaaggcgagccaggggcactccaggtcgccgtggagcgccgtcaaggagctcatggagtccgacaagaacgtgatgctggcgagccgcgccggcgacgtcctgctctgcctcaagcagcgcttccccggcctctcccagaccaccctggacgccagcaagatccagtacaacaaggtaaccacaccaacccatcaccagcaacgacgtgtcgcgacatcatcgccatggacgaacactaacacgaagctgctgctgctgctgttctccgtgcaggacgttgggcaagccatcctggagggctactccagggtgctggagagcctggcttacaacatagtgacgtgtatagacgacgttcttttcgccgatgagtctgcaaggaagatctgatgatcatcatcatttgttcatcctgccttgccttggtccgggatatcaaaatataagggtccatggccaaatcccacaatatgtacattatgccaatactagaatgtagccatgtaggactaatggaagatactagcacaaggaaagcacagtactctattggcctagctaagctagcaagtagtagcaagcaatgtttgggtgtttcatactttcattgcgagggtcccttcaattgtctgccatgagtgtgatcacaattggtacttaccaactgtgatgacagctgagatgattcaccagagtatatgcaagcaatgcttaaaatggagcagcactatggtgtatctgataaacaagggaaattgttttactttcatgaggaaaaaaaaaactataattaggcagtacatatacaactgaacttattcttcctactttcacacctgtacagagaacagaaatgatagaagaagcattaataagaagaaaaattcctagtgttaggagccacatatagtcaagatttatagtatgatgcaaacagtcaggcaagcctaactctactgcgctgtatacactctgtttaaatctgtcacactcactttttcaaagctttttgtactatggtttttggtgaataaaatcctgccgaagtgccgaactataaactctatcagtttccatcggatggcaacaaaacaatcttaaagccacaagtcaaacaccatttcctccagtaaatcatcaagcaaagtatcccacacctctatagcaacttcttcagtatcaacccgaaggtccatccatgatccactctccaggtctttcagcaccacccgatctaatgtacttggaacctcatcactgacaagagaatcgatgcaattatccacctcttgaatgagccctgttcctaccggagctggcctcacactgtgtttcagataagctacccaagggtcacaaccaaaaaagttatccctgatcttgcaaagagcttcttccacacaatcaaagagaaacaccgcatcgtctgtcaggcagtacaaagttcctacttcagccaatacagatgtgtcaagcagtgatccgtccacataccatatctctgaactttcctcagacaagaagtctgaagcctcaagcacaacctttatgaaggaaagccttgcctgtttatcatccaaaatagcttcttgtggtgtgttttgcaaagttggggttcccgagggagtgtcatcctctttaaacagaatccttgtgcttggcatggacaattcatctgcataaagcacaataaaattgtgctactttaccatggatttttcaagaaaatacaaaagggtacttccactatcttaaaaaagggaaattcaaaaggggaagttcttattttgaattcaataccttgcgttcgagttttgtggctggggctgataccatctcccaggaaagaatctagaacagattgagggctcagtctctcctctttgtcatctgcattctccggggagcaagaaaatgtcaagatggatggcttggttaatccaacaactgccgatggactatgattgaattgctcgttaactttttctggagtgtgcagggatacttctggtaatgcattcatggtttgtgactcttctgcgaagcacttcaacacgggggagtaaaagaaaagttagacgcaaaattaattactaacttaactttttgtacaatttgcaaaaacatatggcttacttggtcggtatttatttgttccaagctttcagttgaagtttcgatctgaatagagacttggggggtatctgttgcatcattcatgctgtcaatccctgcaaacatttggtgtatatattagatgaaaacaaggaagtagaaaactaaaaagataaacaggaggacaacaatataccttcactagttaactcctgcgagatagtgccctctttgactggatgactggcatggtctgtcttaaattcatccagctgtgtgttagccgatgtgctggtgtccaatggtattagctccccaaacttcattggtgggtcagaatttgatgaaatatcctcttgttcagtcgtcagtaatgctgatgaagcagtcgaatcctctgacagtttaacatcctcttgaggacaatcagtttgagaaaacgtatcattctccgaatatgaaagtaatttcccaaagggttctgatttgtgtacgatctgagaagtgtcattcttttgattgtctagcctctcgattagatgcttcttagctttttcgtagaagaaagagctagcacaatgagtggcatcattccccatgccacttccactatcttcagggattgttttcttgtcaactattgagggtttctcagccttttcacattcagaagagtccatacttgtcgacatactctcgagaatgaactgttgtgttgaatcatctttctggaaagtactactcatgacatcctttcgattgttactaatggcaagccttagcctccttttaagctctctaagtgagaaatggcgagcatatttgtcactttgttcctgaccttgcaaatcagcacgagtttgtactggtgacgacattgcactacttgaaatcagactagtctgacttcttccaggacttggcttcaatattactattctgctaacgccacgaggactatcattcagttttggtggtctcctcatgactagcttatcctccttcaagaaaaaattatgtgttttttgcacgctgtatttcgaaacctcagactgctctagactgttaatggtaactttcgactttgtttgtttgtcatcttctgccagttctaacatgggatttcctagtgccgtgtacaggttctgcaggcattgcaacatcctagagcttgggtctttcagaagcatcagaaagaactcttcgtttgcgctcagcaattgtaatgcatcaagaaattcattgggcctagcttcgtagctgctgcttgtgtatttcccgtttgcagattgatgggttattactgcttcagccacagcttcaagtgctttctctatactacaggagatttgtttaggatgagtactagcatcagtattgtgctctttgtcaatcaaactggaagagtgatctgatacttccgaagtgataatatcgcgactgccattatgatttctgtataattccatgagacttgtagccaagtctaggtcaacatcagatccttcctgcaggttcacagacttcaaatcatcagaacgtatcccaaatatgttcctttgtgtttccttcaagatctgcgttccactggccatctcttcttccatcagtgctttaatacttggcctgctggcatgaattgttttaaccccatagtctttgtcctcctgacaagcaaataaatttggttttctatattcagatgttatcttcaaatgcctacaaatatttctggatacaaatacttatgcatatttaatcctccataaaactaatacgacaaatattttttatttgtaaccttttctgtgagaattctaattaatatatttggcaatagaaactatttcatctgtaatataataaaagctaataaagctgtttgcaattgctaaaacaaagtgaatatgttactatatgtttcaatcggtggcactcgagtctcatagaaaatacagttgttttcaaatccagccatgagattctgtaggtaattcagctaatcacacttaaatattcgtaaaaatgtcttgaaaagctttgtacatatactaaagcttttcatatcaatgctttaacagtactatttactccagttgccagcagaagcatctgttattagtacatcaacattacaagtattcaagaatgttgatgacaatcaacattttgcccataggaatcaagcaattgtaacactgtacacttgtagaacaagtaacataatgatgaaaaacaaattgtccaacaagtaaaaagcaacagtaagttaaatttgggaactaaacttcagtctttgtttcctttctaatcagttttgctagcgcaaacgcatgttttttgtctctgtgaaacagacatgtgactttgaactttcagatacaaaaaacagatgaaataggtatatatggatgacttacatcagaaaagatgattccatggaaatcttcagaacctttcaggtcacttctgactgcatgaagcacagaatttatcataagcaatatcattacactgcagcttacatcattctttttgttcagatgacattgcattccacttaaattcctcacctgaactcctcctaatcgtcccatctgaaataagttttggactgcgacggaagtcaaacatgtggatgaggcccgacatacagcccatatggaccttctcagatttgcaccgctgtttgtaactcttctttgccatgatagaggagaacattgtcagacagattcgtttaatcaccaggcaagtttacaacctgaatatcaaaacatagaaaaccatgttagaattggtaaacagtacaaattagacatgcaaatggcgaaagagcttccaccctatcaactactcatagttggtcatgatctcttaccaacttctgaatggttgcagaatctacttacataactaatacagttgtccaagactaattgtaaaaccaaagtaaaaaaaaaaagagaggtaaaatttgaaagaaagaagagacagaaaccacattggaccccacaaatgcaaacatgtaaagttcaccgcattacggcattacatctaattgctttctaacgagaaacatgctataagaatttaatgaaacctaattaaattagagagacaaaaacttcttgtggccatacaaagaggcaaaaatgccaaatgacgaaactctgaagatttgaaagttatttcctctcttttccttgtcaagaaaggaacagttgtcctgtcggtgaacccagaatcctaggattaagaatagttccacttccccatatgcaaagaacggctacaaatgtccaaattgcattgtatagtatctgcaggcgctggctaatgcctaaaacagctcagtaatccctattggagtatgtcaaccacagtataacacaatcacccagatgaacaaaaggttgatattgggtaatgcttatgttaccttagttcgaagaacccagaccagatgaatacaggaaaaagcaaggtggcgcctgacaactgttcctacacaatgacctgctaaatcatctgaacagccatgtctgccccttttctttgacccttgagccgtgaacccaagtacccaacaatggtactagcttcttcaatctccagacaatcaaaacccaatctttgaatctcgagcaatcgcgaaccaagagaagataagcagaaacagatgagaaatgatccgatagccccaacagaaacccttgtatctgccgtgcttcctcggtttcctcaagatgccccggactcggaattcacgtcaaaattgagaaacttgacaggaaggaatatatctcatcaagacctgaacacgcaaaaggaaagaagattgcggaactgcatcatcagaccgaccctctgcttcctttatccccctccgtcttcagccaaacatgcagacctcgccgtgaagtttcaatctttccagcctcgggcgattcagaatctcacaggcaagaaaggtccctgttgcggaacaatctcagaacccaaatgcgaaaaaaaaaagaaagagagacaatctttcccccttcgatcctctgcttcctctgagcaaaccctcgaaacacgcaggaacaggcacccgaacagaattttttttccgcctccaaaaaaaccaccaaaagaaacagcgaataaatggatacacactgcaaaagaactgcccctttttcacagaacaatgaacaggctgttggaattctagttgccttttctgatctttttcttcacttcgtttccttccaaaaacaggagcatgcgtcgaggccggagaggaggattcttgggcgaggccgcgtgggaatgggatgcctctgtggccgcgccaagccgccaaccactgctcctgctaccaccatctcctcatcatatgctccgattatctctcttccttcctctccaggaaggagaaggtaggattcggagggtggtttgctttgtacttttcaggtttttttcgcagattaatggaggggggcattgccgcattggactttgatatctgtctctatcttggcatctccctctttttctacgtcagagaagcttgatcaagctcaacacgtagtggatgggaaaggaaaaaagaaaagaaaagaaaagaataaggatttgatttttcgccggagaaaaaaataataaaagaatttgattcttgtctctatcttaggctctccgtcttgtaccagtagaataaagaacacatggcatacaagggtagttttgaaagtagaattatattttttattagtctatatttaatagataattgatctcatccaataagggctaaaatttactaccatatctgaaatattcattgtgatgtgggatcgaattataccggtagattgataaggtgtagtacaaattattgggaatagtacaattgtgtttttaaactagagacgttgcatggcaaaaaataattctatcttagcttttgcgtgggaaattcaactaattttctcttaagatgaatgttaggaggcatgcacgggccagcaaaatctaatcgtaggtataaaatggacgcttgtgattgacgaacggcaaactttactcttatgcccaaaggcaagggttcgaaaccagcatgcacattaaaaatgttacacttatgacacaccaataatttgcatgtacttagaatttgtaggaggtgtccaataactcacacaaactatttcatgattttttttcaaccatttttcgtcataaacgtgacctctgattatggatgctcaataactaataacacatattttaattcctgaacgcacatttcttgcgattggtttgacgcaatggcagggccagagtaaaattgtggcgtcggctaaccccacatgtttttgcaagatacaccttgaccatgtgaaaactagcaaaaaaagtacataaaacaatgaaattttgtatggattgatcccacatggttacatatttatgtattttgatcccaccgggttgagaacctgtctctgccattggtttgacgtatgcatgacataactaagtatcataaattttttttcaaatcagtgagggaaaaatattgaaatgcgaagagataaatcattagcaaaaaatttcaagtgagcaatactactttgcttgtatatttttttagatagtttctttaggtttccaatcgaatgatgtttatttccttctcttgcgccacagtaactgagctactaatatttactgatattagtttgcagaaagcaaactatatttatttcataagtaaagttcacataattcgaaactatcacaaaaccaggacttaaatcaatgtactagttccaaagtaacacgcttccattacaaatccaatatgtgtgctgtggtttttatatagcaaatatgctcatgttaaacttataccgctatgccctttcatggtagtatctttattatggtggaaattttaaattgggaacctatatatgacgaacgaataatttctaaatatgtctaacttaggcatcgtgtagatgcttgaaataggtaatgtaactgcatttcgccctcattgcacagtgtgttctgttctttttagaagcacacgctttcaacagttgaagtatcacgagatgtccttctatgggtatcatatatggctacacctgattgcaatgaacacttttagaatagataaatattctattccctgttccatatcttgttatcctttcgagattatatcaactttaattgttgcccggtttgaaatggtgcgtacatgtacgtggattaacaacatttgaagcctgccgacaggaaggcagcgttggaagtcattgattttttttttttaaaaaaagaagaaaattagaagtttgaaacgagtggccactagaaatatttttccggcattactgcacaacagcaacagccgtcatatccaattctttaatttcaaggattgtgacaaaccaactaatagaagattcgccggaaatcggttggattaggatgaataacaaacgactaaacatttccatggcatgtctcagagacaacatcgctcaattattgggtctcttccaactacagtagcgtccattttttttcggtttgttcagctgtctacccaaacgaaaacaaacaatggtcctcgtattacacacacaattgcaaaaccgatacatgtacgtgtaaatctgaaaggaacatacatttagctcggtgacagagacgggaagaaaaatgtaccagattcaggttataagactttttagcattatccacattcatatagatatgtctagattcattaacatctatatgaatatggacaatgttagaaagtcttataatatgaaacggaggaagtagcgaggagatcagagagccgtccgatcagccatctgatgagagcaggatgtactggttcagggcgacgttctctggactgccagtagccgtcgttttcgtgtgtgcactcgtgtcggctggtggttttcgcgtctctcgcgtgccgccatggacgcttcaacctccccggccagtgtcaacccccaacaccaccacccctcacccacacacaaaaccggttgactaccagtgaaattcgatcaaattctgtcagaaatgtaagaattttctttcaaacttgactgagaaaccgagttgtttgttgcttgtgttcctaagccgtgaagttcggtcggttttgtataccatgcccgccttgaattattcgtcttctaaattcattgacaaatttcgtcagagatcgacgcctggtgcaatattttgttccgtgtggttgcatccaactagaataattacaacgtactatattagttggtgcatacatatcatttttctttcaaagtacacacatgctatatagtgatgacagtatatgacaccgcggtgtgattgttcagtatgttctgaatttctgttcaggggcttttgtcaggcgtaagccggaataaaataggaacgagcagcggaatcagcaagtgcgtgatggatgatgcatatcatacacagcagcttacatcaggtcaggaatttcctccgtggaatgcatgcgtggcgtggcgcatagacaaatacgccggcttcgtggccaccggtcactgtacgttcgcgtgccgttccgctgttgcatgcagaagcagacgaacccacgcgaaggaaacgaagccttccgtgccggagtgcgagcgtgcgacggcgacggccgcggccggtgtctctccggtagacgatcggttcacatcgcggctcccaaccacgccgatgcaacagcacacgaaatgcgatcgtgatgtcgtgtcgttgttattcaatccatccatcactcgactcaacaacccggaattgcataaaatttccttctcgtatcattatgctttcgtgcgacgtttcttcctcctccacgaacgcatgcttgatcggtgagaacacaaggctaatttgtttttataataaatttcattccggtatttactttacaaccggttgttacatgatgaacatataaccgcaaattacaaaactacagcatgattaaaaaaaatactaaggctatgttcgcatgagctcgatgggaacttttccctccgcacgaaaaacggagcggtccattagcgcatgattaattatgtattagctaatttttaaaaaaaaatagattaatttaattttttaagcaactctcgtatagaaatttttttaaaaaaacacatcgtttaacagtttgaaaaggatgcgcgcagaaaacgaggaagatgggttgggagaagaggttgcaaatacatcctaggctaacttgtttgcaaactctgacctgtttatttctgaaaattcatgtatttgggtaagtgaaccctctggctttatcataagtatatatgttgataaacgatataatcatatcaatagaactagccgaacggtattccctaaaaaatattcttacctatttattacaaagaataatctaaaagtggctttgtgatgttgccccttgcccgtgagccaatgtttacgctacaaggtcacgcacctatctgggtaggaaatttcccctccgttaatctgtactttggaaatgaacatctcaccagccggccattaccaaggacaagattgtcaccatctgtatttccgtgcttaagagtggaactggttgttagggtgttagcgttgcaggcttggctgacttgcagtatgtaagtccaaaccgaccccatgcaactgccaatctcctttcacaagtcaagagcacgcagcaggtgagctaattttgtcttatggcatgatgtatccttgcgaacggttcggcagtggttatctagagctgcagtgagtacatataaattaattctttccagctttttttcatgtcttgctcatgatgagatagtaactctcaaactaaactaaccaaaagggcaaggaatcaggggggaaatagactggtattgtagggttttctttttcagagtaacagtgcatggcatgctgttgcaaaatgtgcaagtgagctgtagtcattaaattcattatcggcaacttggcaagcatggtttcatgcctgccgtgatgccacctgacaaaatataatcaagcaatgttccatacgcacacacctaattgtccaataaatagtgccaataattttgtcctgaatacacatgagacaagctgacgacaaagttatgggccgaattgatgcacggaatatggcctcggataagcaaggagcacttatttacactggaagtatggtcagtaagaaaggtaatagagtcagaagaaacagttcatgcttctctatctctgggccccagattatttgtatactgtgtgtacctgcatatgcacaagaggtgattctctattctatactgcctgaaatgagaaaattcggtgaatttctttattgctgcttcaaacaagaaagcactatttgacaggaagaaccttaagaccgtccataacgaccaggctactaattcagttgcacagtccatcccatactgtcctccacgaggcctttctggatagccgtaagtgctgaatagagttgctgagacacagttctgaacttctggttcccatactccactctgtaatggatagcggatgcatgagaactgattttttttttaatatagagtaacaattatttaatagaacggaggagccctttctcaatgctgcatttgttcgtatttgcagaatttgtatgacatggatcactgataaagaaaaataggagaataatttggtggatacatatgctaagtttttccatttagtgaaactggtatactaacacagtccccatgaaatatgctaccggttactttactctttttttttccttttatgagacgacattgtactctgttgatagtactacaggtgtacattttcactgtatggaatgtctactagcttcacaagctcttatgattaattcaacatctcaaagattccagctagaatatcttcaaaggctgaggttgtgaattactgaagtacttaccttctcccctggtacactatgcaaccaacagaggatagtaccacagaagttccagtacagaaaacttcatcagcgtcaagcaactcatctattgtaataagacactcttcaacctgaaaaaaaatatatcagcgaacaagattgggttcatatctcatattgttgacaccagtttccatgcttgagtttcaataaaattcaggaccctcgagatctcaaaaaatttcaggaccttctgagatctcatcaagatctttcaaaacacatttgaattctgaacgaagtttcaaaaatttcaaacaagtctgaatattttggccaatatggaaagaaaaggtggtgtgcagaatgttccaacttccaagatacaaatattctgaaccatggttacagaggcagtgttagcagaggatgggcattcatgtttaggttacctgaaatccaaggctacgggcgtattcaattatacttcttcttgtgatgccaggaagaactgttcccgttaatagtggagtagaaataatgttgtcctgccagcaaaaaggcaatgctacattgtttagctctcagaacaaaatatagtaatataaaaattatctgacaatgtagcatctgataatttggaggattctgaacttaacacatcattccttgctactcctaacaagtttgaagataagctaatgccatgtctatcaaatgataatttatgtgccataaaattattcagcccgttcaacgaaatccaaaaagtatgctgacaagttacaacatcattgcaagagacatcattgagctatacttggaactgctttacactggtattttcctagatagacttgcaaaggaagtcaatttgaacaaatccagtacatatgtacacataccttcaccatgaatatattacaggacgaaagttcctcaacaaactttttatgcactggatccaagtaaagaacatcagaatgacctctctccttagctctttctttagcataaacggcctgtatacagatgtcaaatgaaaatgaagaacaagaatttgatttcagacataaaaatatacattggcagccaaactcaaattgggagaaccatgcccgtagagtaaagatatggaatagtgtactgtgtcctctatgaggaatcagatgataaagtagagactcagcttgtagaaaagaaaaggtaattactgaagcataatttccgatagtctttatatcaccagttccacctggtgccgcacactgatattcttcctcggttaacaagctgattggagataagccatcctgaatgtaaacaagacagtaatcttgcaactataaccagataaaatgaatatgcaggaaagttaagtcaacgctgccaaccttaaaatagtgcccaactgggcaagcaaagacaacaaatgtgtactctggggctggtgcaacaccgaggatagccccacttccaatcagcagcggtctgatatataaagaacctttgccagtagggggtacctgcaacggagcgcatagctcatgagaaagatgtgcgcaccacggcgcctatcactgttgaagaaacaaaatgtccttacccagcgcttgtttgctaaaattgttagctttatagcttctaggaactgctctacacttggtgcaggcatacataaccggtctgcgcctactctcatccgtaaagcattttcatcaggacgaaatagaaggactgatccatcctcttttctatgtgctcgcagaccttcaagtaaaccctatagaaattttacaagtgcattagagcttttcaaacaaaatggagcagaataaatggacaaggctcatttagtacagctctgctcaacaatcagatagtgattcttcaaggtagaattaagagctcaactaacctgaccataattcaacactccagctgctgggttcagttctattggcccatatggcaccaattcacccttggtgaacaccccttcctcggaacatctcatcacatacataaagtcagtcggcacgggttgaaacccaagagtttcccagttaaagtcgaccagttcagcagttcctgtgctgaagcatgaagctcacaatgaacagataatccaacaaaaacaggcactgcccgtaatgtgatgatgggtcaggcaaaggacaacaagttcagaaactgtttgctacaattgtttagccgttatgattcctctttttccgcccacatgtcaatgggacacccgaatgctaatcggagcgcacctgaatagatggactgtcaaatcctaaatgttccatcaagctaatagtggactggattcaacagcctcttttcgttaacccgcatataagtctcgcctaatcttgtcttgagtagcaggacaagcacagtgtgaatcaatatccttctacaggatttgaaacctttttcctgttctaaccactaagactgtaacagtacagcgaaaaaaaaaaggtaaaccgtgatagaactcagtttgtcatgcttactaatatgctgcggtcaccagagttgaccaccggctcctcctggcgacagcccctcctctgcagacggcgactgcgccgcaaaccgccgccgatcgcttcagaatctgcaggcagcgtcaaccattagcaccgtatcgaacacaccgtgcccttccactcccgctgactgtagcccctagcatcatccaccgatcaatctcgcgctctcgcggaagaggtgctcacggggtgagagggcgcgcgatgacggcgcgtcggggacggcgacgcgccgccgcgtccgggaccgggggcggccacacccacacgcgggaggagctccattcgcggtcagccgcctgccgccgccgccgccgcccttgcgcgccgccgagggtcgaggtggttgggtggtcgcgcgccgaggggaccggagacgagacggcggcgcgcgcgcgtggttggtggctgagggctgagctggtggggaggaggaacgccggcggggcgaccgaccgagccggcggcttgggttgccattggctccgggaggtggagacgcggggcccacccctctctcggggggtgcgtgggcccaggctgtcggtgggagaaatccggccttaaaacatgcggcggcggcgacggcgaccgttgtttctgagtctctgacctggacgtgccgtggaccgcatacgtcgcaggtttccacgatgggataagggctcggggggtcggtggggcccatctgtcagggtaaacttaggctgggctttttatttgttttctaggccgtgtgcgaggagccgaggaggccaggcgactcatcagacttctattcttcaatgggccacctgagtcgagatcatcggtccattacacgataaattaaggaataagttcattttatgttctttatcttgtgctagtttaaaattcgtccctaaatcacaatacatgtaacgtataccttgatttacaaaaccggtaataccgaaatcccaacacagtatagtgcccagtaaccagggtgatactcttttgggccaaaaggcttttggaagattgacttgaaggcttctttactactccagtacgtaggagaagatttactattcatactgaaatgtacggagtactacatttgaagcaaatgatattaaagcttatacgggaaaaaaacacctccttataccgtactccctcccgtttcacaatgtaagtcttacatttacattgtgaaacggaggaagtaccttataaatgacaatacagtcattatatataaattgtaaaacaagagagtagaaatatatatatatatatatatatatatatatatatatatatatatatatatatatatatatatgcaaaatagagcattctaaaacacagaaaaataacaaagataaatacactacagaaaacacacaagaatctgagaagagataaagtttcaaaactaaagttcccatgagagaaaatctatttcctctgttttatattataagacttctagcattgtccacattcatatagaggcaatgctagaaagtctataacctgaaacggaggtagtacataataaaaagaagtatcgtagatataatgttgcactggagcatgagcattcatgtctgcatgcagcaaagctggaaatatagaaggtctgtaggtagatatgtaattcagcttatcttattaagtttgatttgttgacaaatcaggaagtcagtaaccaataagggaagcaactacaaccaataattcacaaaataggactgcaagtatgcaactaccagaactccgacctcttttttcactatcttccagtagctgttaatcactttagatagtgccgtctcactctctttcagctgctaagaaaaggaagagtttgaaactacaatgaagagtttgaaactacaattacgagactacccgaactccaatctaaacctactgtactgactcaaaccggctccacaagcagcagttacagacatcataaacttccaaaactcagaagaaatgcaccggtattatgggacaacctatcagcaactggcaaagagatgcactagtccacatgataagttttgcgctgacaaatcgaagatggataaaaactgaggagaaaaaaatgattgatttattatagcagtgtggttaattaggaatgctggtttcatggtttggtattgcggcatgaaatgaaagtctgaaattagtgtcctatgagcaagggcacaatgagctaggtgaggatggtgcgattaatttcctcatcatttcatcacttctgctactgcacgaaaggatatttcattaattgttctagagaaagaaaggacatttcgggcctgttcactttgatgaaaaaaaaccttaccaaattttagcattgccaaaattttgacaactatgccaaaattttggcagaatttcttatatagttaccaaaatttggcagcaaactaaatatagccacttttttggcaactttaccaaaatttggtaatgttgaaaatgacgtcgaagtgaacagccccttcaccacgtacagatcttgacagaattttactcctagagatctggactgattagtggttttgcgcatagcaaaatgtgtgctacttggacaactggtgcacctccggacaggataatatggtaaacagatcgcttctcttatgtatttggttatctgagtttcttaagagatgaaaatttggaaggcaaagataaaatcccaatttgcacgcacaaaaaaagaaaccctagctacatacaaacataaagctaataaaattagcaattccggtaaaattaacaccataacctccgatt

SEQ ID NO: 45300 - DNA, 6326 bp, Oryza sativa
atgatagagacatggttcaatgtatgcctttaccatgtttcaaaaaattcacacaactaactacacatactctatctcctcttcacctatccatacatgcatgcattcagtgactttcaaaataatttttctcataaactacttatctaatatacgatccgattatactgttgtatttgttggaattaaatctttataacagaatatcatatgattatattctgatgaaaaaaaaccatatatttcagtttgtcagcactcaatgtttcatacgcgataacaatatgtttcaacgtgtgtcttcactgtgtttcagaaaaaatatttcagtgactgattttttttcaccgtatatatatctcaatgttttaccggtggtcaactaaaacatttaccgtttgattttttaacaaacaaccgggcacccgattgggagtttcttccttagagaaggaagtgtcttgcgtaactaataggtcccacgtttcggagaagcgcaacacgtggaaccaacagaaaaaaagccacgcttctcgtacggtaccatgcgaactggcgacgcatgtccagctgccacccgcgcgagccacgtctatcatgatttttgttagaccgagcctacgcctatcacgacgagttcaagccgccggcccgcagcttgaagtctaaccgtccccagccgcacgagaagccgtggtgcggccctgccgaaatttttttccggaaccaacgcctacggaaaaggctatacgtactaactttttcttactaaattcttactaacactgatgtgtcatgctatgagtgtacctagaatttttgtaacttccatctacttaaatcaaacggttgagatgattgttagtaaaagtttagtaagaaaaatttagtacgtgtagcattgctattttttaaactgtcatttatactaatggaaatggagggctctgccctttgaaaaaaaaagaaaaaaaaagaaaagtggtccccatctgttagggtaaatttgggcttgtcttcatattttatgtgggccgtcagttaggaagcgaggaggcccattacgcaaagctctctcttatgggcctaagcgattttagaagattggtttgaagtgagcgcaacgcttcttgtccttaccttttgttttccagagtagcagcctcagagtctcaacggcgggctttccatcgccatcagcccatcactcaattcagctcgattgccatttgtcaagctgatcaaagtactacgtaccgtatgagctttttccacgtcggcgaagtatagaaacctcaggacgagttaatactgtagccatcatcagcagtgctattcattttctttattgcgtacagtactatggagcacgagggctgtgacagcgcctggctaatcctcatcctcccagtctctcaaatcctgcgtgttcctcatgggattcggttctgggatatcgcagcctttgccatcgccagtatcacatggcaaagctggaaaataggagtattttaactcggtacgacgctgtcgctgagaagagagacgacgcaccggaccgaaggttcgggaggcgaaaacgtgaggaatcggccggtttttccctgcacgccatcacgagcggcgacacagtgagcccggccggcgagcgtggtggccactgcagctcagctcggcagtgcgtgcggccgctcgtcgccatccgcgcgcgtgtgcagatactgaggaaaacggtgcgatttgcggcctccgtgcctcagttttttaccaaccttttttgtcgaatcttgcagtgaatccacctccaactatgtgagccatggcaacttggcaagagcaaagcaaagccagcacagcagttgcacgtactacctgaatggcctgggttcgccgcgagctgagccgatgggcggttgcgatggagcgggagacgcagcgacgtgccgctcgtgtgcgacagctggcagccgggggcacgactggtgagttgtcctcctcctcacatgcatcatggcccctaccatccggatgagaacgacacatatgatacggctactcactgatcccccgtcagcttgtcactggacaggctgcgccgcttgctatctgcagcctcgttacgccagactactaccagtaccagattgttgtgaactgcggcagtgtaccacaataacgggttcttttttcctcatttctgtttggtgttcatggaaaattaatcaaccaagattgtaagaaattgcgacaagtatctcgagcagcaaagagctaggttgaattctggaaaactacccaggatggtctggaccatagcaaaacattccactcactcattaaaccctcttgcctgcatgtcgctctccatatcccaaataattaagccacaaccagtggtcgttgagtgatgctcattaggccttccgatagatttgtttacgattatctctctgcttaatccctccagttcctctctggatagccaatcatcaggccacaaaatacatcatccaactaaatgatgacattgataattaggctcataaaaaaaataatcagaggctagctggtgcatgcaccggaaacccaaccaaccccccaacaccacaatttcagcttcgcttacgtagtcgatcggcgccgtcccctaggggttggccggttgctactacgtactacggcctacgggagcgacggagttgtggaatttggagaggtgaagagagcgacgggaagagacgtttttttgtggtggaggtgggttggccggtggcgcgagatgtggtgagatacgaccaggttgggagaccgttggcgtgaaatgataggccatgcataccgcgcgcctgcacaagcggacaattgctaaatatgatactcactccattctaaaatataacaattttagctcttaagatttatcctaaaatataacaatttctccacgaaaattttcttttcgaccaatcacaactctccatcattcacttttcccatctacctccactactcaaccaatcacaaccctccaccattcacttttaactactttcttaataaccgtgtccagcggtaaaaatgcttatattttgggacggatggagtaattatttgatagcaaatgaatcaattataactgttataagattttaaaattgatttcaaataattcctaaaaatataaaaattcatatataaaaagcttttgcaaaaatatatgggcttgatcggtagtgttgtagccgatccacgctaatcaggtgatttgccgcggttagggtcatatgctttgattttttacagagaagggtattttttacccggcttctatatccaaccggatatatgtatttttttttaaaaaaaaaatagaaacttacctatcaaacatggaattagcactcaaataacccaatctaaaattcactcctataaagatttgaactcagaactttcggatgctactcaggtcactgtaaccattaggctatgtgtcctttcactagtcatatgttctgatggttgttgtagcaaagacctaattccttagtcctaaaatattgcaagtttagaaatataatcattcatcagttcattcctgtcacaccccgaactagtaccgaccggaactagcccgtgacgctccaaattaacctgttaatcgataccagtcccaggaaacagtgctggtatcacagggagacagaatatcacagcaacagaagtctctttattatagagtagaagtacagtcatgttgggctgcggacagaccccgagctcacaactgcattacaaaaggaaagcggaagccaggacttggaccaatcatcacaggcgcgacttgggatctaggccgaaaccctaaaactcatcgtagccagcttgctcctggaagaactcctcatcagcaggatccgcttcatcttcttcagcaactgggggggaagttatttatatagagcaagggtgagtacgggagtactcagcaagccaggggaaataaggtgtttattgcaggcttcaagggaaggctgttgttttagcaattgattttatttgaacccttttctgaaaacaactaagtgagtgcttctcaaacgacacggatgaaacagtgcgtctcgtccggtcggagtatgtgcaatgtatcagtctttagaattgaaacaaggttggcacccggccaacagctttttcaaccggccacccgggccaacaactttccaaacggccacccgggccaacaacttttcaaacggccacccgggccaacaacttttcaaatggccacccgggcctagctgatcccatcagctgcatatttttcaaacaccgaaccccttttcacacagcaatttcacaagcagtagtcaaaccaaactacgctaggaatcacctcacatccgcccatgaccgtgggcacggctgttcgaacagtttgttaacctctgcagagggggtacactttacccacatgacattactaacccggatcatccagcccgtggggatcagccacgtcgggagacctccaagctttcatgacaaggcatttcgaaagccgacacagatttaccatatgccgacgagaggggtcccagaccaacaacaggttaggtcccagaccatactgtgccaggaagcccaggggtcctccccgacaccaccccggcgaatccacatgtctctcggcatcaaggctcccctgataagctagttactcagccaggggtgtcccattccacccatgtggtcgtacttgtcttatgtttggataaaattccaatgaaacggtccttaggtgcaagagtgggaaaccgtacacctggtacgttccccggtccgcggttttggaaattcatttagttcacaagcaccgacccaggtgtcgggtttttccaagtcttttgtaaaactccagttttacccaagttgttactcagattttaagtttgaaggcgaccgtcgattctcgcacagagtgcacgattatcgaagcgcaactgggtggttacaaggggacatagtatggcaattaacaatggaaggttcaaatgcaacaagtctagtaggtccgccaatctgccttgcagatgggacaaaagattaagtgcgatcctatcaatgcataatattttgcaagcaacataattaaatttcaaatataggctcaagatgttcaagggtggcttgccttgctcgagatctggagcttgatcctcgaaatcctcgcactgcgggtcttcgggctctgaaactaaacgcgaaacggaacaactcaacaaacgacgaaaataaagccctattaatgacctctaagcgtgccattagatagatctcgagatttagggaattttggaagttgaacggagtcaaacggatttacggttgagaagatattgaatttctacgattattgaatttttgatctaaaggaaaaggacttaattaaattctttttggaaaagaaaaagaaaagaaggaagggagggaaaatagacgtttctcggacggctaaggcgcggcccaagaggaatggagcggtccggccgagctaaatgggccggccggcccaaggcggcccaaactcgcgcgcgcgcgggagggaggagagagagagccggtggaccgggttcaccacgcgcggtcccgggtgggacccgcttgtcagcggcttggctcaccgtgcggagggagcatgcggcgcacgcgcgcgggcgggggagggacgcggtgcacgcgcgcggtttgcggtggacgcgggtgcggcgggcccacgcgcagcctctcggctcgcggtggaacgcgcgcacggggaggggctgaccggggtcggttcgacccggtctggctgagctgtcgccgacgtggcgcctacgtggctgccacgcgggccggcgggaggtagacggcgacccggccgcgaatggacggcgggcggcggcggcgagcggcggagcgaaccacggcgatacgggcaacagcgagcacaccgggcggttgcacgtgacaaggggaggcgagccaacggctcggattcaccggagtttgctcgacggcagcgggttgcggcggcggcaaccggtggcgggagaagagggaaacggcgacgaggtcacgagaggtcgattcccggcggtgagagcatctacgcggcttcgggaactcgacgctagcgtcggattgggcggaattacgccgagcgaggccggcgacgagcgggtgctaccgagctcgggcggcgacggcggcgagcacacggcgagcgacggcaacggttggggcggcgccggctaactacggggagtctactcaagctacta

SEQ ID NO: 45301 - DNA, 9725 bp, Oryza sativa
gggattcgatttggaaggaatggcattcggaaatgaactcgacgatagatcggagatttagatcttgagatggcacggacactagacaacaatcaaagaaaccaatttcgcaattagggtttttaagagataattttcccgctaggcgccacgacggaacgggcgctacaattccttaatcagaaaacaacactgccgcatatagttacttggtttactcgttgttaaaatgatgaaaggaggaggaaaacaaatgaagggaagacagaagaggagaaaaagaaagtcaccagaattctctcttccgtcagtctcagcgcggtcgatcgtccggagatgcgacggcgttttcacgatgtaacctgcctaatttctcgagaaccttcgctcaatcattcaccgggactacgtcgatgagtcgatcgactctgcacgcctatctcgggccttacagattgcaccgtgtgcatacgatcgcctgtacatatagtgggggcctgattaggatgctggaggagatatatgcactgcagttttgaacagttgcacagggccttcaaatttgagaagactcttcagcaaatcaagcggttctaccgtgcaccgtgctcttttgacagggagctccaggcgatattttctttttcagaagtactaagatctattatactgactctagtacaaagtgttcgtactacactagtactactgccaattgtcttgcacaaatggtccattgcagctcactctgccatgctacgtacggaatagtaacatgttattcacgcacttttcacatgtatggcacgtacaatgtgtcaaatttcaggtacagataacttactgagaaatttgtatatacctgttatatgaactcatctatatcacatttgttaggaaaccctcataatcttagtcaccttttttttttacaaaacctactatacaccttcccaacgtgagcgccgcaaacatcaacaccatcgctgccaccgcctccttacccctagtgtgtcgccacacggtctcacctgctggttggaagacaccaatggcattggcaaggcccctcggctggtttcctccctatctccactctctgactctgccctcccctgccctatgttccttctcaagccggcggcaataaggtgcccctgctccaccatcttccatgtctctagtggctatctgtcgttggatccgtcaccccccgattgccgcctcctaaccagtgggtttgttttgcccctgtcagtcatcctccgtcacacacggttatctctctaagctttgggaaaacccttcctcttcctcctcctcctaccccctcccatcccaaaaataacctagaaccctaactgatggggggacgttgctgccttgctagagctagaggagaagaaagccgacacaaatcttggcatggaccctatggtctgaaattcgacgaaaatctttccaaatttctgccatatgaaggttagcgattccgtaaaaattatgaatgagcctgtacaatttacctaaatggatggtccggatttggaacttatctacccttaaggatggtcaaaattctcatggttacacgaagaatgtcaaatacactcacacatctcgctaaggaaaaacagaacagccaatcagagcataaatttcaaacttttcttgaaaactcaagcaatttttcactgatattggacaattttttttatcaaccataatcactagtgtcacaaacaccttgaaattcaaatacattcaaaacttttgtccaaaagcacatccgaccgggggacctcaagatagaaccgaaatttcaaattttcaaccgaaatttatgaactagatgagagtgatgcgtaagggggaccatcagggagcaaacaaccgtgaccgaattgcataggagttatggctgatcacttgagaaattaaccatccattcccggtttccctccaatattgcacccatccatcatccaccagggatgataccgttgccgttgctctaaaaaacgttaaaacagcggcaggcaacacgacagcacatcgcatcgtacgtacgtcgttcgtcccgctctcctccgtcgtcctccctgcccaccgtcccccacacccactccccgccgtcacgtccttccagaaccacctccacgactcttccaatcccccgctataagacgcttctccactcaccactgcaaccctcacccagccagctcgagcgagcgaagccagcagcagaagcagtagagagaaagtagagagatggaggggaaggaggaggatgtccggctgggagccaacaagttctcggagaggcagccgatcggcacggcggcgcagggctccgacgacaaggactacaaggagccgccgccggcgccgctgttcgagccaggggagctcaagtcgtggtccttctaccgcgcagggatcgccgagttcatggccaccttcctcttcctttacatcaccgtcctcaccgtcatgggggtcaacaactccacctccaagtgcgccaccgtcggcatccagggcatcgcctggtccttcggcggcatgatcttcgccctcgtctactgcaccgccggcatctccggcggccacatcaacccggccgtcaccttcggcctcttcctcgccaggaagctgtccctcaccagggccctcttctacatggtgatgcagtgcctcggcgccatctgtggcgccggcgtcgtcaagggcttccagaagggcctgtacgagaccaccggcggcggcgccaacgtcgtcgcgcccggctacaccaagggcgacggcctcggcgccgagatcgtcggcaccttcatcctcgtctacaccgtcttctccgccaccgacgccaagaggaacgccagggactcccacgttccggttagtataccaactactactgcagtaaagattcagagatggaagtatttttactgttttctgagtgattgatttttgttttaatttgcgcgatcttccacagatccttgccccactgccaatcgggtttgcggtgttcttggttcacctggccaccatccccatcaccggcaccggcatcaacccagcgaggagccttggcgctgccatcatctacaacagggaccatgcctgggatgaccatgtgagtttaaattcactgaaaccaacccctttctccctccttacatgtagaaatatatatatatatatatatatatatatatatatatatatatatatatatatatttgacagttcgatttgcatcatctgttaatgcgcagtaacttaaaattgatgcacaaaggtattctaggaatatataggatagctggttgtagtaaaagaagaaccttgtatctgataactgatgccatatccccatgttgaaattatatgtgatattacttaactgctagcaataattcagtagctctgtagctgtagctgacttctataggtgcaagcatggtgaggtagcatttgttgcttatttaattatagataggcttagcttaacaccctcatctgaagggaaatgttgagggactagtttcagtgtagcaggcaactgctaccatctctgacaatgactcaattggctattactgtatgataagtctacatcattagtgaggacatgattgagcaatggcacttaattacaagcactaactcccgctgcaatttgctggttctgcagtggatcttctgggttggccccttcattggcgctgcccttgctgccatctaccaccaggtggtcatcagggcaattccattcaagagcaggtcgtaacctgcatcagctattatcactgtcaagatgccaatccagagcaagctgtttctgatgggcgcggctgtttcccgctgcctgctttgttagtaattattgtggagtcgacgttcctcttcaagtttgttgtactactgtttttatctgaacacagacttgtaatttcagtactcagttgtgtatccctcttttactatgtgcaaattaagctatcctcctcctattggagttcggttcagctgccatctttctgcaattgccaacacggctatccacaaaaccttaacatcaaaagggataaggcatagtgggtgtcgagaagaataatcattgggttccaaattgagacgaaacctctctttctgagctatctgtcacacttgcatcatcgagatcgtgatgctattcagcctactccaatctgccagcacacctgggctgtggttggcagcttgtggatggagtaacatctcggcgaattgaggttggtggtgacggccgagaggacaatgatgtgagtcattgcccgttggcaattggggttggggctgtgtgtgtgggcgctctggtcctaaacgcaacactacaaaaacttacaccgtggcacatgccgtgctgattgtttggttcttgcaaacagcctagctgcggaagatctctccccctttttaccttcccctttgtttacattttggttcatgtttgcggccactgcacggtggcttggtacgatgaacccccccgtgtgcccacagacagaccgcactgatttggccggaacctgaagaggaggtattgcgttgtttgcaaggtttcgctggctggacctctgtcttctggggaccgctccaatgccagcaaacggctcagtgaagaggaccagatcaccgatccaacataaattgcaagagataccgcctcgtctctgtgcatgtgggcttcacggatcatcaattcaccatgacctgatgatgataagcagctgctacattgttagctgcacggttcaagcttgtaagaactaagcatacaagtctcagtaacaactgcaagaaagtctacacattaattaggtaatggttatagtcttatagatagctcacggtgcagatctgaagaacatgtacatgcgggagaagctagtttaaccaaggatctgattctttgtataaatttccagagtaactggtacagtgaataagttggctcattggctgagttctgctacaaaatactttcagtatgcagtttgacttgcagcagtagtttcaacctcaggtgagatattgtgtgagagaggatactgaatggctggactgtttctcctgtgcaaaatcttggctcttagttgaggttcctctgtacaatggcatcaggacgccaagaagaaaatagaaaattaagttacatataaaggcaagaggagtatacatgcggcgaactactacttcggaggtccttcaatctgtagggtaccaatatacagtcttgtcatttgacagatgttagtacgccaattgtagtatgcttccgggagttctgcctaacaggaatggacgatatctgctatttacattgaacaaaattagtaagagctattggtcaagacaaacttcagtgtcctgaaaataaatataacgactgaagcaaaaggttcaaatgtggattctgaactctcaaagtgcctgattcacctgagattctataagctgctaacaggtgaagtgcttcagaactacaccgaacaaagattatacacagcaaggcagcaagataatagacagcaaggcagcaagccccatgccagcaattaggaaaaaaatgtcactagccagtagtgctaccatctgagctgggatcagagtttttcttttcttttcttttggccacgttgagtttacaagctcaggaaacaacattgtgagccatgttgctttgacgtttaaagggagtgaatctagcaactagaatgccaataaaccagttcttaatctaatagtaagtgactaaagctgcaaatgatgtaggacagtcttgacttaacgtataatagaaagttatgaattgtgacaagtgaccatgcatacctttgccaacttgaattgtgttgatgacaacaaagattccatccattgccaactttagcttctacagacattagtgattttcttttcctcatactatgatacacttcaagccatcggatggctaaaaagcagccaaaccaccagttacctttcgaagctccaaaaaatgccatctgaatactgattcttgatattagttaccatgcttgagtccaaggtgtggagatccagacgtcaagtctaatgaaggatttagtttcacatgatccacaaaggcatgatgtgtgaaacgttcagatggtgacagcttatcacgcaaatcaaaaacatttccaagtctctttccaaactgagggcttagaatgtcagcttcagataccaccctctcctgaagcccctgagagacttgatgcactcgaataaattgcccaagatcaggatctgtaggccggctggcaaagagatcatccgggcttcttgatgggattgcaaatccctcgttgctgtaggttgattgcttcagatggttaaaaggaatagcaccattaccaccagacagaggcgtggaggtgcctgaagtagttctggggcttgaaataggagaaggtgacattctgccattggaatgttgtggggaccttgattttagcaaaggacttccacatggagaaactggacaagatatattgcttcgtatacggatatcactgtaaagttatttaaggattagaggctgcacatatatagggaagttcaccgcaaatcattttccaggtaagactgagtttcactgaagagaacacaagttactaccatatggctagtggtgagatactcattcatactagtgctaggatactcattcaacttagattagccatttttttaacagataatactttgtacttgctttattgcacacattgtttggacttaggactaatactattaataaacacaaattgggaaatgatgtacctgtgttttgaagaaaattttgcacctcttctctggtaaattgtctgaccctccaatcccaatgaggaaatatttcttgtatgcgcagccatctgaaaactcaaataataccaagcaaagtgaacaggccatgaattatccatgtaaccatgttatgtcagttatggcagtattcaagtggtaccttggcgctcgatctacaagatataacagccaaatgttccaatggttcagaaagaacagatttctctagtgatactgctttttgaacaaatgggtgctgcaaaagctccattgcagtgggacgttgagaaggatcacgttgcaggcactttctgatgaagtccttgcctggctctgaaaggtgatctggtattggtggaagttccttgctatttccgatcttgaacattgcagcaatctgcaggaaagaaaagaggggaaatgttcatgccaaagttgcttcggtgaaacttccaagtctcattacgagtcaaaagaaggaagtctttacatttcaagcacctttcataaaattgcatgcaagtaaatgatctttcaacattctacatcagacagtgataaattcttaaagaattcatgaaaagaacatttccatatcccattcactcatggcgaaaatcaccataattaggttatctatattatagaacaaataaactgtgcctcagaagtataatactaaccccttcatactggctccatggcggtttcgatgtagccatctccaggacagtgcatcccaaactccatatgtcaacagctaggttgcacccatttgagttttttataacctgcgtatgtgttgcatagtatgtgatgtacagaaatggcaataagatatgcatgaaacaaaaaattaacaagtaaagattttcagtgatacctctggagccatccaatatggactacccttaaaggagaaaggacactgctgcccattgatctgcataaagacacatttaatacgtattaatgagtaaaatacttccacattatacaaaaggcattttgtaacttatcaggagtgagggggctagcaaggtttcaagcacccttaacagcagtactcaatcaatgcattaaccagtgacaggagctacaagatcaagttgatatagatactgctatatattttttgaagagctcgatataattcaaacagttgtgactatgatatgaggcatagatgcagaaatggaatgacacggaaaataaagttcaattgacaaaagtcattttcaaaaaattaaagtgggcagaaaaacttacatgttttgccattccaaaatctgcaagcttaacacgaccactaggatctactagtatatttgcacctttaatatccctgcaaaattgtgatgaacaggacttataattacaccataattccaccgatacaaacaaaccaaagaaaagagagaaaaccaaagaaattgctacctatggactgtattcttcgcatgcaaataagccaaccctgaaagtatctgctgtgtgtagctgcgtattgcttgttcaccaagctgtccatactcttgtagaagtttatggatagatccaccagatacatactccaagtatatataaagcttatcatcaacctgtattggggcacaaataataagtgaagccaaaaaagaaaatcaaaagtggtacataaataactcattaatgaaatcctagatgctatcatgcaacttcttgttacccttggtaaagggaggaaaaaaataattatataatgaccaaacaggaaacaataattgagttaatggttccaagcaaaggaaaacctagcctatgtaaacagactgaaggcagcatttataccgtttctgatccatagtattgtacgatatttggatgctgtaggcggctcaatagtgatatttcctgagaaacaaaaaaagaaaaacagggaatcatatattgaacaggaaaagacataatctgaacttcttttgcaactgtaggttaaagcacaatcaacagactatacctgccccaactgctttgcactttcctttgatttaggatcatccaagaatagggtaacttctttcatcgcacacatttcaccactatcactgatataaatggtaaaaccacattaggaggacaaatcattgtggggacaccgaagttacatggccccaatcccctcccccagaatagagaacagtaagatagccaaaatagagctatattccgagttacatggtgtcttagctaagatcttacaaaaattccaagatgcttagtatattcatagtacgtcatatgattttttaaaaaaaaatgaaatttcaaagttaggaatattcttacctgttaaagccaacatatacatgaccaaatgttccacggccaattagcttccccttcttccatcgtgacccaggacttggtggattctcagttctaccagggctgcgaggtactgaaataggactagttggagtggagttatttggatgaaatgaactgtgagagatgctcagtggtggtaggggaagtttgtgagtttgcttcttcttcccatcatcatgacggtttgttggagattcaggggccatccctccagaccttggatgcaatggtgaaacacttccactatgcaccctcgaactagggccaggacttgtcattcttggacttggaattggtgaacactctgggctacttctgctgggctgccaaaagagctgggctagcatatcaccacccacagaattatgcccagatgtttgccctgaacctggactggaacattgaccagatccaacaaaagttacatctgtgtgaggtttcactgcccaaaaggccgaagt

SEQ ID NO: 45302 - DNA, 9965 bp, Oryza sativa
atcatttccaacaggactctgaagctgagaatccccatgatcatcactatcagaacagttactagagggagaagcaaccactatttctgaaacaacctcactatttccatgcctcctcggaggccggttgggtttagggagtggtagaagcagtggtggcttgccacgtttttccaatatgggctttgattcagtgatatcagaaacagtccgagtcactggaggacgtactccaggaatagggaggggatgggcatgtggtctatcagctgaaaagctttggcagcgagaaacttcttttgacggtgaagtaggacgtgacactgtggtagatcggcagcttttttcaacagatgaatcattgccacgtctacaactccgtttcgacttcgtgcttcccttttgatcatttggacttatcaaccgatgaaatgtatcgatgaggttttcttttgtggttttcttagcatcttttgagaaagacttcccccaccatggtggcatattgaatatgaaataatttgtggtatgtctaattggctaggtactaatcacggtgttattcaagctgataattaccatattctgccaatcagattaacatgtgtagcgcacgattttcttaacaacccatatagaacccccagcttccgcaatgcactggcaatggagctagaagcagacaaattgatgaccacaaggtggtgtcaggcaccttctttacccccaaaaggctgaaatacatatggtaacagacattttagcatttactattaatgaaaaaattgcaggataaaaacaatgggttattccatttatgtttttcctaggtaattagtgtgattcaacaccagaaacagactgcccatagcattatgagtgttttatgattattctttcaactcaatctttaatcagtaaaagcaaccattgcaaactcaatgcaaaatgaactacaattataagaagaatcttttttattgcttaaccacaccaatcgcttatttaagccagtcataaattagataaagaaattatctccactgccatcaatcatccatgggagtgcaatatatcaagtatgttttggttgaatggcataacactgtgctagaaataaataatgtttcaaacttcactcaaggagttgtcaaggtcacagttttcagtaaaacacaacggcataatcggtggtgcctcctagaacttcaaatgtatcaccaatagtgatagcctgcgtgcatggttcagtcgctcattcacatgggaaggatcacatgcatattgtacaaggcaacatatacacctaaacctaaagtaggttctgttttttttttcttgaatacacaagagagttgcatatcatttcattaagagagaagaggaaacacgggatgggagctgaaacgcccccactcaccacaaacacatacaacgcttacatttaaatgacaccttacccaaccggggttagcgacctaagaaactcactgagtttagaggttccagccatgtaccaaagaccacactcatttgccaccgattggatgatagccaaagtaggttctgtttggaattacacattacattctataaagccccccagtatactgcataacctaaagtttcgtggcgatacatacaaaatacaccactcgtgatagagcaccaggtttctgggtgtaaggtgaacttttgcagctgaattacaatcaacgaaacccagtgttctgtttggccatgtgtactattgagctttgatgctgagagaattccatgcttacctgaaccccagttgattgcactacagtctaacgaactaacagcgacttaaggcctgatagttaacatccgcagaagaatcggcacccgtccacaagtcaaaccacagcagtcgcaatcgtaaactcccagcaattccatcgcacgagagctaagtccaagctaactctagtaccctcgagacgaacctacataagcgcagccagttaccacctctcgggagcaatcgattttgccctccaaccgcgcgctcagatctcagcacaaatccacacgcctcagatccacggcgagcaccccctttcacccacgaaatttaccatcccagcttcccagcccagcgcgagcagcagcgtccacaaccagaacccaccccccaaaaaacgaagcgagcagagcggaatggcaggaggaggaaggaggcgagcataccttaccggcgcgccaccacggcgaggcgagctcgccggcgggggggagatccgacaggcggagggaaagccggaggggaatctggaggcggtggtggtggtgatggtgcgggcaaaaggagaggaggagctcgcggaaagtgggggaatcggaaaggggaggggggagaggagggtagcaacggaaaaaggcccaggccgacgaggtgaggagaggaggaggcggttttgttcgaggagagtggtgttggcttgtgctgctcgctcggagaggagaaaggagggggaggcgacggtggaggtggaggtggaggtgggatcgggtgcggcacgggattccctgtggccggtctcccgccgtccgctaggacgatgtggtggggcgcagaagatcccgctggcgctttggggatttattctcctgtcgcctttaaaatttgtttttcgaaagctttttgcggatttatttcggcgcatcggggtagcaacggttctttttttccccctgtgttctgtgttcccaggcgtgctaccgcagtaccgagtacgcttcgagcctcgatatggaggggatgtatataaggcgccgttgctacggactacggtagcttcatcgagacggtccgtttctggatctaatggttccttgacctcgtctattttgatcgtatagaatttgatattttttttatacagagggaatacacatgtacggcgatcgctaatcggcgcgcgcgccggcggcgcgtgtttcaggcccatggggcccagcaccgggcgcgcgcccctccttcgacgttttttttccgtttttatgtagcgatttttttcgttttcttttccacttttttctgattatttttttaatctttagcatgatttgagtttgaaagttttaaaattttgagttgaaaatttttaaatctgaacttgaaagttttcaaatctcgatttgaatttttaaaaaattttcaaatctggacttgaaagtttttaaatctagacttgaaagtttttgaatctcgagttgaaagttttcaaatctgaaattgaaagttttcaaattttttaaatctggacttgaaagtttttgaatctcgagttgaaagttttcaaatctgaaattgaaagttttcaaatctcgagttgaaagttttcgaatctgagttgaaagttttcaaaatttgactttaaagtttaaaactaaaatcgaaaattttcaaatctaacttaaaaaaatttcaatctgttagtaaaaaattctcccaaaaaatctccaaaatcttttctaattactatcattagtgttaagtgtattaactgatagaggtagttaagtatactaactagaagtgttaatagagtaggttaataggcgaggagtgctcgctagccgcgcgcacgcgttagctaggaggcccccacatgtacaatgccatcagcatgcctatcgttactattatttgtgtatgagaaatgtttctaatatttttgtgttttaatacctttgttctaaatagacctttcacaattgtacgacggcaaacattttagattaactttttaacaaaatgtcaaagagcaattatgatgaactcctctataaatttttttgttggatctataaaatctaaaaaaaataaaaagagttgaatttaattggtgattcggtgtacaattaaaccgagtatagacgaaactagtagttggattatggatagtcatgcaaaagagtataactgattcaccggttttaaaatatcaacacgtggtagcataaccatgtaaggttatagctacatggtgcaataaaattggttcattgatttacggtgtgtttagttcacgctaaaattggaagtttggttgaaattggaacgatgtgacggaaaagttaaaagtttgtgtgtgtaggaaagttttgatgcgatggaaaaattgatagtttgaagaaaaagtttggaactaaactcagccttagagaacctaagtcagcaaagttcaagtcgccaagtgatggatcaaaataatcataacatctacaaaacttgcgccatggtatttgatgttctactccattgattatttaatgatggagatcacaaaacttacgcttatcttcttctcacttagtaactccagcgtagagcactagagccttagatgatcacgttgtgttttaggcaatcgtgttacactacaccatctatctctcacacatctacattctatcattgtagcgttgccatatacttagggtttgttcgttttagggaaaaaaacagaggatttgaattcctagggattaattcatgtgagtgtcgttcggtttatagcattaaagtataggaaaaccaaagaaaaatttacttttctacaagttgtatagaggaaacatggaaatttttccatacactcaaacttcttataaaaattcctatggattgatgtgcgcaaacatttatattctttcacttttcatgttccttcaaaccgaataagtcctcagcattgagaatgtaatattactaatggagaacttttgaagtactacactttcactcgctacacaaaagaaaagggatgtcatttcatcattcatcgatttaaaaaagacgcgaatattagagaatgatataatatcaaataattagaagggatgaggtttttaacccagatcatctagccaccatcttttggagctagttggaaaacactagacgtttcctccatcgttcgtcgatctcgccgtgatattttggctaaagataatggtttcattcaatacactaattaactactcctgtgtatttgcatgtactccgcgcgacagcaacgtcaggcgtacacatccaaatacccaatgaaagatggggaacggcactacggcagagaaggatatttttaaggtacccttagagtaatactggccgtccactcttatcgatctaatggacctgatcttcttctactgtcagtagtagtatgtgcagtagaaaccacgtggagggcaaaaccgtaaagaaaaaaacacagtaatattacgctttatcggtgattagatggaatgggctcgaaatgtgcggtgagaaggcggcggcggcgaaggcaggatgtgatgagatcggcatctatgtcgccgtatggtggccgtcgctcttccggccttcctctactgccatatacagatttaattttgatgcttgcactcgctggttcagcgcattgtggctgtgtcgcgcaagcccagccagacgaggtcagaagctgcccggccaggagccgttttaatccgcacaagctaactcgattgtaattagattcacatgccgttaatgaagacttaatcttgattcatgagtgatggagttctattacggagtaccagttaattcgtccgattttgctagatatttgtcatcaaatttctccccctaatatttgtcagatgtaattacagtacaatcgtagtgtaattacactgtaacttgcatgtaattacactgtaactataatgtaacttgtatgtaactttcaagaatctctcggtaacatgttatttcagtaaaatagaggtcgtgggaacaaattctttcatatatgtgtgtgatgtgatttttttcttcctccatagaacaaatcttgtaatagatctaacgattcaaaattacgtgaaacttacatataagttacactgtagttacatacaagttacagtgtaattacatacaagttacattgtaattacactacgattatactataattacatctgttatatttttagtagaaaatttgtcgacaaatgtataggtggtcccaattcgtctccgcgatggccaaaaattatcagacggcagctggaccagtcttcgatgcggcagtaattcgccggcagagcacacacaagaaatgtggccagcataatcggcgatgccgacgccgtccaacgggtcgcacaaatgggaggttgacccttccgggtttctcggcggctacaccggcgatataactttctctaatagataaatggtcagaaatacccttacaatttacaggataaagtaaaaattatcgtataaatcaacggtcagttttgatttatactaccctactgccatcgctagtaaaaggtactgtaaaatgacccgcagagaaagagctgtcaagcgacatcgccatcagcagatttcatgatcagccagtttattcattgaaacttggcaagttggtattgcaggtagctcaccagtgaagacggtgcagacagcagcagcattgaaacgccgattgcaaaaatgattagatcgacgaaatgccaaatgcatcgaagaaagtcctgagcgatctttagggtgtgtttaacgtcaaaattaaaagttgggttgaaattgaaacgatgcgacggaaaagttaaaagtttgtgtgtaggaaagttttgatgtgatggaaaagttgaaagtttagagaaaaaatttagagtgtttacatggaaagcgactgctgtactgctcatgttcatcgacatggtcgatcgatcgagacttccatcgagagagaggaagctagaaccgtgaacacccactacatgcatgcaatgaagtgtttgacgagtagctatcaacaattaaaatgcccaaaattaagagagattaaccaattgatcgacatgtttcagctctctgaacaagcaaccatccaacaacaattggcggcacattaacacaaaccgcccagacgaatttggacttgccagtttgggttacacacaggagattaattattaattattgctccttaattttggtggctgcacaaccaaaatcatagtactacatgatctaagaatcttaggtttggagttttctttagacatttcctctatcgactggtaatgaactgtaaaagcaagtgatttaaatgacctcaccaaccatacaaaccctttagtaattactatcttggactctcatctatctacatatttttttgccatttccaattgacttcgtccaacgcccgggatcttctaagcgcaggccgcggtggcgcgcgccgcggcggcgtactccccggcgccgcggagctcgtcgacgatcggggcgaggtcgcgcgggcgcacctccatccggagcccgtgcttcatgaacagcgtgagcgacatcttctgctcgacgcggtggcccggcgccacggccaggcggtggcggaggagcacgctgccggcgatgttcctcatctgcaggtacgcgaggtccttcccgaggcaaatgcgtggcccggcgttgaacgccacgaacctgaacgagtcgtgcggctcgaacttcgtgccgtcggccgacagccaccgctccggccggaactccaggcagtcgtcgccccacaccgtcttcatgcgccccgcggagtagatggagtacgtgaccgacgaccccgccggcacgaacgtgccgtcggggaggacgtcgtcggcgacgacgtgcttggagtcctccggcacggaggggtacaggcggagggtctccgagagcgccgctttgaggtagacgagctggtcgagctcctcgaagttgagcggcgcggcgagccacaatgccgggtcgtcggcgccgcgcgacgcggccaggacggtgcagagctcgcggacgatcttgcgctcgacggcggggtgggtggagaccagccagaagaaccaggagagcgccaccgaggaggtgtcgcggccggcgaggatgaagttgagcgccacgtgctgcagcgactcgtcggagtaggtccccttccgcatgaagcgcgacaggaggtcgtcgtgcggcgtggccgacgacgcgtcgcccttgccgttgccggcggcgagctcgagcttgcgcgccttgatgaccgccgagaggtagcggtcgacgtgctggacgctgcgcgcaagcgtggtctccatgccgagccccatccacttcttgaaccgccacacgcactccgggaagatgaagcggttgagagtggcctcggtggcgcggtcgaacgccgaggcgaagtcgttctccggcaggccgcgggcgagcgtctcggggtccttgccgaacgcgaggccgcagatgttgtcgaaggtgaggcggaggaggaggtcctggaggtcgacggtggcgccgccgccaccgccaccggccgcggcggcgtcggacaggatgggcagcaggcggctgtggatggaccgcgacacccaccgcgacatggcggtgcgcagcgtgcgcgtggtgaactccagcgccgccgtcttccgctgcgccacccacgtctccccgtcggagttgaagatgccgtcgccgaggaggtccccgaacacgccgtgccagaaggggcccttggggtagttgtcgaaccgggacttgaggacgtgctccaggttcctcgggtcgcacgtcaccgtgaccagcccgccgcggcgcgccagcccgggcacggcgaagatgcacgtctggtaggtgccccgcgtgcggcggaggttggcggcgatccactcgtgcatgtcctccgcgtgccgcaccagccccggcaggctccccaccaccggccacaccctcggcccgctcagcccgcgcgacatcctccagaaccacgccatgtacgcggccacggccgccacgaccaccgcccacgtccccgcctccatcaccaccaccaccaccaagctaggctatggcgatcgatctataataagtgagctcacatgcatgggccggggcaagcagcgatagatagctagcagcaaggacgagagagtgtgtgtgtgtgtgactgtgtgagtcgccagtggccagctagcgcccctgacctgagatcgagagagagaagcgagacgatatataggagtagaacctgcccgagaagcaatgcgatggatggcaattaatatacagaagggaaaaatatatatatacagagttgccaggatgccactctactccagctgcaagtgcatgctcggtacagtatatatcgagcgtccgggcggaccataaatcgccggcaggggccgttgggtggccgtcgatcgatcgaaggcgcggcgcggccagtgcgcgcgcgtcgcttgcctgcctgccggtcgctgcggctctcacctacgccattcaatgcatcggcgggcggcacaccgaattgaagccgtgatttcaatggcgcgcgtacggccgccggttgtttgctagtagctcgacgcattttaaccgcgccaagttttaaaaggatcagccagtagatcgacctgttttacgacgctttccactgcgatttggtgatagtaatatgctctgaggtgccagtatcatgcagatgacggcagggccggatgcgagtagatggccggggggagtgaaactggccaactgaccaacggtttctcggactgtctgggctagttttgggactttgggggtgtgaggtggttttgacgaaggcaaaggatagggatatcatggtcgcctttggagcgtcagcaagcggaggcgtgtgatcgtgtcaagcaccagctagcacccgggttgacgatggtttggaggggttgggtcaccgaacgaccaacgtcccaacctttcacaaaagcgtatagctcccagatcgtacagaatgtcgcgtagtttgtgtgattgtgtcatttctagtactaataaactactccttccgtccctaaatataaaattttgatgtaccacatctaatcaaaatcccttatatttgtttggcaacgtgagagaa

SEQ ID NO: 45303 - DNA, 2861 bp, Oryza sativa
ttatagtatggatgaacatttgttgaagtccaggaatttattttgattgaaatttttggattcttcttttgcaggctgttatcaactatgggccctcatggtatgtaacctatctctcgccatgtgtcacttcatagtttacgatccagcagatgtgaagattatatattacgaagtgcaaataacggttcatcaatctctggattatttggtaacttcatactagtattcatatttgctgatgtgactatttgagttcaattgagtaatcagcagctgttaggagttagcggttgtcatttgagtatgtatgcacaagtatgagtatttaaacctgtaatattgattatcctgatggactattggacatttagctgcctaaggagttaggactgactagatttatgttatgcattggtttgacctcaatatgaccacctaacagctatagaaaatcggtcatcatttgctgtatattaacatgtgtaaagtcaaatttgtttagcccaggatttttttcctagcaatcctgtattggttaacaacatataggatactgtatctctttaactctgtgaattactcattccctccgtttatgcaggtgccgtgtttgcagtcagattcttccacccttctgcaggttcagcaatgaattcaagaatcttaccttcatttatgctgatattgacgaatgcccagaaacaacacaaaacatccgatacaccccaaccttccatttctaccgggatggagagaaggtcgatgagatgcttggtacaggagaagagaggctgcatgaccggttatggttgcattcttgatagggatttgccgggctgttggtctcatgcacaatattttctctctctcttttatcctactttcgtgctttgttgtcaacctctgagccaattcaaggtttatgttggtgtttgtaatgttgatcatggtcatctttagtgacatacaccattatatatcagaattggtgtaccggtttttctctcatgcttatgtcaaaactgagaaagaataccgtcgacattacgatgcaaacatttttagtatcgtccagtttgtacgatggtgctgctgcagatttctgctaatcatgtgtcgtggaaatggactggccacttattatgtcaacagtaacgcatctgtgagtacctgagcagagttccatcgcttatactcctgcccggagctaagaatagaagacaattagacaaacacctcacttttctttctttttttttgaaacgaaggtgcaaatatgtttcattcaatcaccaaatcatttacatcagcttaactactcctactacaatttgtgaatccggtaatcttcactataagattcttcagtaataagtaaatagtttgactgccgatacaagcaggttttgctaccttcgcatacccttcagatgcaggtgccatataaatctgggaaatctcaaaaatctaactagtaccgttgtatcatctaacaatcaccaaaaatgtgatatcagaatgttctgggacaaagccagcgctcagtagaagcttcatgcgaacaaacagcatgattaccaggtagaaacacgattgacaggataaagaaaaatcatgcggtcaagcttctaaatcaaagtatcagtaactctagatcataatgcagctaattcaggaactcaagatttagatttagggattccaatttttaattttgagggcctagttttagttctactgctgttccgctctgccttaatggatgcaatcacagcatcagcccccggaccaagacctttcctgccaactaatttcacaccaagcttttcacagaggtaatgcagcctcatttcatcacctcctctaacctctcttagctccatagcctgctgtcgtgatagtaatgtgtagacataaagttgttgttgctggttgaaatgtgattggagttgctgaaacaacaatttatttgagtggtgctggtccgcctttcccccttcagttgcacctttctttctagggccacctagttccaccttcagaatggctggggactttggatcagaagcttgtccaccaaaaatgacagagaagctgccaaattccaaatctggttgcctaaacaagtccatgagtagagcagcacaggcctgtgtatttgttgatggacctttttcaactttgctctttgctgctcgggcattggcatggagagtgtatttgcagcctcccgcagaccactgatgaaagcaccatgcattgttgctggataacgtctcgtggtggcctctccagcgaaaaacaaccgcccatctccaacactttcagctagtatgtcatagtcatctccagatgctccaacagcaacatgagaatacgaacctagactgaaggagtctgtgccccatctagtacaaacactctgcagaggatctgggacctcaataccttgaggttcatagatacctgagatacacaacattcaccttttagacaaaaaaccaaggttttaagcagtcgaacctattgtaacaacatactacatacatgtctacatatatttcagtgcagttgcagaggtatgaggttaatggaacaaagagtctgttgcaacttgcaaagagtcacttgggtgaggcatattgaagtaccaccttatgcatatagtcatatagtgatctaaaatacgatgatagattttacatcgctagatgaccatttacataaggtagtaaaaaattctgatggtagcgtattaaaaaaaaactgatgataggagataaaggtcttacctctcagtatcttgagaacagaactgacagcatcagtagggggtgtggtttcaaagttgtgggcag

SEQ ID NO: 45304 - DNA, 18174 bp, Oryza sativa
  unsure (1)..(18174): unsure at all n locations
ggggggtgtagggaggtggttggtcagacatggtcgccggcggcggaggcaaagccggcgcgcctgctcgataaatctggtgggggtttagatggggatgggaacggtgcgagtcggagccatctatctggtcgggtgcgcggcgcggctgtgcgggacctagcgggaggtggaagacggtcgggggctccagggtccgtttcgctgtactggtttccgtcttctgagatagaatacgtaattccacgctgtacatcatcaagccttgtcagatggacaggctttgatcccagataaaccttaaaataatttcttcaaactattgggatgacataatgaatgcttttcacccgctgagcttgaaagtaagtttggatgatgctactcgcttgtttacccccgataaccttgagcatgtttcttaaaccgctaaatgatttgttttttaaatgttttttatatataagtttttttttaaaaaacaaacaaatacattttcaagtttatataataattaatactcaattgattatgtacaattaatactcaattgattatgtactaatagtgacttcattttgttttaaatgccactaaaaatctaagccaaacttcacttaacattactctactccctccggttttattttaattgacgctttggacaatgacacgctctacaagatatacctttgaccttatttttctattataatatatacaatacatgtttacttttattatagtgttttgaaagacaaatctatatatatttttctagtttctttaaattaaatatttttaaaattattgatggtcaaagttataaaagtttaacctcaaccttgtccaaaacatcaattaatatagaaccagatggagtatgtgcattgggattggggtgcaaaagtgattcccaaatccatgatataattaataggaatgtttgcttcaactaaactattcttgccgcatgtatataatgctatcacttctggattggaagtactacagaagtttcttgcagcaccattcagtgatttcctctgaatggccaagtataaaaatatgcatgatttgcaggaagtagagtttttaccttttagttgaggattcttcaacaatcaaaactgactggtaagtgataacatatatacactaatacacatggttcattgttgaatgcccttggcttcttgaatccagttgatgaagaattacaacaacaaatcaacatgcatgtattcttacattctgaatcgatttcttcaatatgctcatgaagtaataccactttacataactgtactaccccactacaatactacattgtggcaatactcttgttgccaaaagaatggtctgtcctcaacattattacttcactactattaacaaccgatggtttctcatgattctctaagctatatgtgactgaaaatgaatccgtgaaaacaccgaaaaatgagataagtggatctgctcttgcaccgtcaatagatagcttcagaaattgaccttcgacaactggaaattgaaacagcctcttgtaaccaattgttgtgccttcaacaattgtttgccacaattcatccaccaagatttccacacggaacttgattacacgttgtcccatctggataggctcctgaagctggatcacattgaatgaagcagattgtccgagatcaaagagcatttcccaggagctctgcccttcctctggagcccagtaagagtatatgctttcctgaagaacattggagggtgcaaactgctgattgccaaggccaccgcgcacggtgcttgctgtgacagtggcatttgcagcaaaattctgagagaaaattgtctgccgaatctcagtaaattcctgaaggacttgcatatcttcagtagaaattaagccagacgaatttggggggacattcaatatgagtaggcagtttctaccaactgatttgtagtatatgtcaagcagagttgtggcattttttggtttctctgaggcatgccaaaaccaaccaggcctgatagaaacatcacattctgcaggaacccagtcttgcccaaaaggatcaccacagcgtgaatatctgataatgaagttagcatcttagtaaatagactgttgaattctgaaatgtaggatgcttgtcaataacaagcaaatctctacctcatcaaaagtttatcaaatccaaaatagtccaggctgtagaattttcatatgagatgtaaattccaaaataaagatgaagcacaaaatatatctcatactagaaaaatgtaagtccatcactgctataattagttaatgagccaagggcaccattctaatttctgtactgcacaaggattcattgaactctgtggacattcttgtggctaattccattctctaagggaatgtaacatctaaagtctaaaccacataccactgaaactattgattgcactgtaaattttccttattgatgaggctacacaagaaattaatttttacaggctttgcaatagtagtctcttactcatgctgtcgctgtcacgcatgcacactaaaataatgctgaatagtagcactctaatcaaataatttcaacagcctattgtcatgagtaatcttccttaacttcaaagagaagaaaaccacattgtttgagtgttacaattagttactcatttgagaggtcatcattaggtacttttgcaaggacatcagtaattgcttaaactttaaacttatcacggcagacagttggaaggaatgcttggagttttggtcctatgcatgatacaattttatcttcccacaagtaaaaagttgtcttgttcccaaaaaatatttgcattacataattgaaatttccattgatgtgatttgggagaacaatttagataactagaaaagccttttaagaagttaggtactctgcagacctattagagttacttaattccaattctagcatttttatccaggggactagggatatgattgattaggatcttaatagaagtaaacagcactctgttttttccccagctcaataatactgttacttactcaggaatgatgtgcccaatcgtcaccgtgctcttattgaaaggagaccagcaagtataacctgcgacccctgcctcatctcctacccatcttgtatctggtccagcatctgagaagatgacaaccctttgctggagctgatggataagtgcaaaccaggcatcaaacatgtaatccatgtccttgccctctccctttgcaccatcaagccaaacttcctccacatctccatacctgcacttgtatagtcagaatctttacacaggagaaatcgtgtacagtaatcaaatcgagtgtatgtagtttactcgaagtccaaagcaaaacaataaatgcgtagggattaaacattccattttcatagataattgcgtagtgattaaacattccatcatcatagataattggaataagggtagtgactcatgaaaaaagtgtagcgactttgattaaacaacacaaattaagcactgactactgcgccccgagaaaaagttcccaaaaaaaaaacccactaataaacataactacttttgatcaccaatttctgaaaaggatcatgcagaaatgcaatgttagtttatgttcccacaagcgcacagccacatctggatcgaagctctcctcagcctgaacccaaaattcagtagtcgacctgcaagatccccattgacgaatacaacaataatctcgcaattcgaacgcaatcgctgacatacctggtgagcaattccgtcatctggcccaagtagtgctcgttgtacgcgacggtgtcgccgtacaccggctcgtgccggtcccacggcgagaggtacagccccagcccgataccttcggcgcgcgcggcggcggcgagctcgccgacgacgtcgccggcgccgcccttccacggcgaggcggccaccgagtagttcgtcagggccgagggccagaggcagaagccgtcgtggtgcttggccgtgagcacgacgcgcccgaaccctcccgccgccgccgcgcgcgcccactggcccgcgtcgagcgcggagggcgcgaacacggccgggtcggcgcggccggagccccactcggaatccgtgaaggtgttggggccgaagtggaggaagagggccatctcggagagctgccactggagctgcgcgtaggaggggacggggaggaccggcagaggcggcggcgtcggggccgcggagccggtgacgccatgggcgcggaggagggggaggccgacaagcaacccaagaagaagaagaagaatggtcgccattgtcactcggtgatccctcgatgagggtgttcagttcacctcagcgtggcgtagagttgactgctctatagtttctgttgttgccaacggctgattattgaagaattaagaacaccgtcaagaaatgattagctataagcaagaaaaaatcaggggaaatcttgtaaataatctgaaaacatggacacgagtaggggaatgaataattgtgtgtgatgtctagccggatttttaatgatgtgaagttaagaaagaaaaagaaaaagaaaaagaagaaaataatgcaatgggttaattaacagatgatctaatagatcacatacagtatatcactgcatataataccatccataacactaaatcattaattatttactattattacggataaatcgttatatcagctacatgtacattatattgatatgatgtggaacgattatataaaccataacccattgaaccattgttcaagtcaacttatgaaagaacatggagtacaaatagattagagaataatgctatatttttatattgtgggaaaaagaacaaatatattagagaacgttgctacagagtatttgttaatcgggttgttcactgcataacttaatattttcttcgagtaaaaatgttgctacagggtgataaatgatttaacttattctaggataacaattatggacaaaaattatattctattatcttaaaaaaattatggagagaaatttcaaatgatgtcgtcgttgacatatgaatcccatgcgatttacacattatatataaaactagaatattaattatacaaatctatctgaaataattatgttgattatctatatgccacaatttagtattaccgattactaatcgccttgcataccaaattgttcttggaaagtccaattatctgttacaaatatatgcataaacggaaatatatgttcactttccgtggggcacacagacgaacacatcgcgggggattaaccaggccactcgttcgctcgctcccaggagctcctccactcctcgattcccgaatcttcccgccgaaggaatgtgctggtgtgcgcctatcgccaccgcgcccgtcgccggcggccggttccctccgccctctctccgctgccgccgtcgtcgagggagatcggtccgcgcggacgcctccccggagcccgtcgacacgcagcggaagaaggtcgccgtcgccggggccggctgggcaggcctcgccgccgcgcatcacctcgtcaaacaggtctgctctcgctgctccgtggcgccggattgctcctgctgcattcgcgttctcgattcgtagcgggcaccgcgctcgttcgcattatccgctcgtgtgggcgcactcgcggcggcggaattttctcccaaaatttgtttccttcgccgtctcttttgaaacagcagtgacaaatacgcatctgccagtacgtggagcagagaagttttggtgggttttgttcttcatcactgtactttccattgatcagggatacgaggtcacgcttctgggggccgagagcggcccaaccgaggagattggtctcagaggtaaaattttcttcagctttcagtttacaactgttaaaacttggtgtgccagttctgattcagtaatccttgaatcgtggcattgcacatagggttttggtacccataccgtaacattttctcgttggtggatgagctcgggatctcgcctttcacagggtggactaaagctgcatactactcttcacaagggcttgcagtacctctctctctatgttttacttgcgaaatcgttttttcttcagcttgaatgccctcaaaattgtgatgtgcatggatttacctagtttgattacgaaacaaactagtatttttctctgtatattttagtagctttctgataagattgtaaaatctgaattacagaaggaataattttcttctaccatgtgcatattgaatttagccttatatttttgtggtaggtttattttgttagttttcttttctttcaaaattcctcataactatttggataacatgcacaaaattagaggatagcatgccatgttgtaacaatccatccccatgtatcatgttgtttcacgccgaactttgctctgaatttaaatgatctgagggacattattcttcctttaactctgatagcattgcattgttctgaccacttgcaggtggaatttcccatttttcatgaccagccccgattaccagctccctttggaatgttaacatatccagaagtatgatttattccgtctggatgtgttcgctgctacctatctctccagtcccaaccaccccatattctcatactatcctaatttttctttgttacagttcccaagtcttcctttaattgataggttgacatcgattcctgtcatggctgcaggtatgcacgtccatctgtccaggttctgtctttaaatgctaatggcctcagttctaaccacttatttgttgctttgatctagtcattgacttcaacaacacagacactgcttggatgaaatatgatgcaagtgaggaaatttagtacatattgcacaatttataagagttgacagctatagttatagtagatcatttcttcctcatgtcttattgtcatatttcctgcagtgagtgcaagagatctgtttaagatgttcggttgctctcaaaaactctacaaggaaatttttcaaccagcaattcaggccgccctgtttgctccaggtgagcaatgcagtgcagctgcaacactggggatgttgtattactatatgctctctcatcaggttctctgttctgtcttgcccttactttttaccccttttctttcttcttatcttcattcaaatttacgttgatcaacaaagctctttccaatgatttctcagaaattcccaaatttacaggaaaactctgattttttgttgtgccgtggggaagtggaagacataattttctctccttggttgaaatcactggaactgcaaggcttaaaattccatggaaacagagtgccaacaagtttggccataaataaggacactgcatgtatctctggaattgtctgtggagaggaggtacatgaggcagatgcatttgttttggctaatggactctcttcgctacaatatatcatcaagaacaggtatatacaagttacagaggtagtcactgcaagaatcttgggcctgtttcaccactaattactctcagtaacttggaagctaagattgctatagaaatacgtactgcttgaggaacagcacttttcttcacttgaaacatgtcttattttcatatatttgagtgcttctctgactattgaatttcttctatggagtagtccgtttctacagtctcggcaagaatttgttaatcttcttcatctgtccacgattgatgtggtctctataaagttatggtttgataagaaggtaatcgcaagtgacaaaatatacttcatttgccaagaagtaatacacattgttctcacatattttgtttttggtgatatgaaatgccagatcacaattccaaaggttgccaatgtttgttctggttttgatgatccatctaggtggacattctttgaccttacttcaatatatgatgattatgctgacaaatcaacaacaattgtggaggctgaatttgtatgtttcaactttaaatcaactaccccataacaaattaaagcacttccttccaggaggtatcttactgttatcaatctcttgttgcagtacaatgctagccatttgctgccactgaatgatgagcagatcgtttctgaggcttcatcacaccttatcaaatgcatacaggattttgaggaggctaccgtgatccaacaattggtcagaagatctcctaaatctacaatgcacttccttccaggtaaagtcaaactttaaccttattgcagtacaagtgcctacaggaatattgctcttgatgctctttcttcgtgggaacgacccgtgatgacaagacttacacccgtgctagctcgttaaactgcatcatgcttgataaaaataatcaagcattggttgtaaaatgattatgtgatagggttccataatcagaacatacacttgtgatctctttcagtgcacagttgtacactagcatctttagtatttataaaataacgctctaatttaccttacactgtctttcttgcctcttcgaaatacctactgtgatgcatatgccataaaaattacattacatgcaggttcttacaagtacacagtgcgaggatcaactaccttaccaaatttgtttattgctggtgattggatagtgaaccgacatgggtccttttcaaaggtgaccgagtaatatgtcacacaatgctttggagtcattacaaatttattcatgaatttagaacttttatgtaggaaaaggcatatgtgactggactcgaagctgctaatagggtggtggactattttggtgatggcgactttgcgaaaataattgcagttgaagaagacgagcctcatatagagacagcacggaatctcaatagaagagccaacgaattaaagactcagattcctttctcggagttctttctctaatcacataactgggagcttttcagtatgaccatgagatttatgctctacaactcattcagaaaaaaggtcaagccagttctcacttccctttttccccttataggtcaaaccagtttttcgtacataaaaaaaaaaggtcaagtcagcttttagtatgatcatgagatttatatttcttttactgttgtgcatattgacctgacagacctttgtcattgacgcttcaactgaattaagttagcaataattaaaaaagtagaaaagaaggtatatccagtcttctggagttgcggtaggtaaatttcttgattctatatatgtttttatttgcatactggttatcaacaaatacacatactagatcaaaccacaacagccaaagcaactgcttttggggttaacttttttgcgtttcatctgcttgcagcatatactcgaacatgtctatacaaatttattcacaaagagaccagagagtttcctcaggtttgtattcctttcctcatcatttccacaaactcttcatagtcaattctcccgtcctgtgaattcgatggaggaaataattaaatccatgggaatgaccctaattagtgaaaataaaatactttaggtatgctttaccttgtctttgtcaacttcatccagtacttgtttaatgtttgcttcatcacccattccgtactctgccatggcttgttccagttcatctcttgttatgtacctggaattgtttttcatggtctcttgttaatatatactgattttttaacaaacgagtttatagcaagaaaaatatgatgcaaggaaagcatgtgttagacatcgttacacaatgaacatgattgttgcgcagaacaagttccagtgttggtcaatttagagctctttattcatggtgctgaacgagataaaaggatgtgcattggctaacaaaatttattttacccgctgttatctttgtcaaaatgttgaaatgcacgaagtaaatcctcctccttttccagtttatgcttatttatcatagctgtgaggaactccgagtaatcaatgctgccactcttgtctacgtcaacctgtaccacagtatcactagtaaaatccttttgtaaactaaacctgcagcgaagagttagcaaaagcaaatgatcttactgcttccataagcttctgaacctcggcttcactaattcttgatcctagctttgtcagaccaaccttcagttcttcaaccgtgattgtgccacttctgtctgtatccatgttattgaacatctgtttcaagcccttgatttcctctggtgataggttctctgcaattaccttgagatgaaaggaggcagcgtgtcaatttgattttagccaaagcatagtagttatccctgttaaggaggattctcaccttaagagctaattgctttaacttgttcattgccttgaattgcttcattcttgataggactgcgctatcgataggtctgtcagatgcaccgccttctttgagccatcgatgttctgcagcatggagacatccatttaaagagttggctacactgtatgtatatatacagttgcagataaattttacattcataaccgcagattagaatagcgaaacacaattcaggtgtgctacctaaggcctgcgatgcagtaatcctcttctggggatctctatgtaacatttgtctgataagatcctttgcactttcagatatcgaaggccacgggctggtactgaaatcaacttggttgaccagtatagcatcgaatatgcctttctctgtctctgcgcagatattcaaatttgacaattatctccacgatatacttgatagaatgtagcaaaattagccaaagagtaaatatgtactatggatatttacctgcccagaatgggggcgtcccgcatagaaggatatacaatatcaccccagcgctccagatgtcggcttctttcccataatttcgttgtaacacttctggcgccacataataagcacttccgacaatgtccttgtacactttacctgcatttgttgttttgttgttggggaaattttaccttagcttgtacatatcttgttatggcgagctaaggtacgtgcattatctctcgcaagatctttcaacatgcatgatcgatgcatttctgcatctgctttgatattgtacgtttctactctttagacccgtgcatttctaacagccaaattaactcatggtgttgataaaggggggaaaagaaagaaagaaagaggtagtgtagcttatgtgtgatatcgcgaccctgaccttcttcgatgaagacggagagtccgaagtcgatggccttgagcggcgcgtcgtcgtcggcgctggcgagcaggaagttctccggcttgaggtcgcggtgtatgacccccatgaagtggcagacgtgaacgacggtgaggatgtcccggcacacggcagcggcctgccgctcggagtagctccccttggccgtgatgcggtcgaacagctcgccgccggagcagaactccatgacgaggtgcacgtggtcgttgtcctcgtacgcgcccctgaactccgcgatgttgggctgcccgctgaggtgctgcaggatggtgatctcccggcgcacgtcgtccacgtcggtgcgccgcaccagcttccgcttcgacaccgacttgcacgcgtaccggttccccgtcgcgcgctccgtgcacaggtacgtcgtcccgaactgcccgctccccagcttccggtccagctggtacagcgaccgcacgctcaccatcgccctctgcagcacggggcccatctccccgccgccgccggacgccctccgggacagcgcccccgccgccgaagacgagcccgtcggcggccggtgcggcggggccccgtgcctcgggaagctcggccgccgccacgtccccggctcatcgccgccacgcgccttgctgcgctccgcggtcgacgccggccgccgcatcgtgcccgacgtgatgggtatctcgtacgtcttggtgaagcagttgcccattgcaaagcctcctcgtttcctttccttctcctggggtggcgccgagacgaagcgagggtggaatggtgagttgggtttgggagaacgaggagccgaggttttgaagggtttctctttctctgcgcgggcggtgggcggcgggagcggagttgcttgacgtgatgccctaccccttcgtttcgctgtttgcttttggtccgggctttgagctttatgccttgtttggttatctccggagggaaaggaagattcaaagaaagcctcgggatcacgctatctcaccttatgcaggcagtacaatatacttgcggcggtgcgacagccgattttattcggctttggaggtgtagaaacacatagcactacgtgcttttattgatctagcaatagccattttacttgagggatatgctgtactagctttcggtaacatcgtcagaatcaggcgcaggcagcactaacaaagtacgccccttttcagaacggaatcaacagtgggccggagtaatgtgacgagccaagccggcccagaagatattccggcttacaaaactcagagcggaatcaactatgggctggaggtaatgacctggtaagtctatcttgactcaaaaagacgttttattaacatggtggcatgtgctttcacggcttctggcctcagcaagcggtgacgcgcgctctggcaatcgctaacacccggagccgcctcgcccgccgcccgccggtggcgccccgcgtcgatcggctaggggcgaggggctcagctgatgtctacgctacgcgagagagcgggcggatgccacctcttccactactaatctctttcagcggcgcgtggcctgagcagggagagtagcagacgcagcagcgccaacctgccccgtgacgggcaccgcgcaccatttcggaccgatatgccgtgacgggacgccgcattgcgcttctgataaagcatccggagagtcaaactcgattcggaagttcagtgtacttcgtcgcccacacggatgggttgggggcatgaatccgaagtgagatcatttccatgggaaaagaggccaaaaagataaactaaggaaatagtccattcatgtgtttctctccaatatacgtcataaaacctttttttcttctctttacggatatcaatatacaaaagttcctttgaaggctagcatatgtgtggtgtttgcagtccaaggtaagaaagtacagtaataagtacccttggtgaccgaccggtacagttcttcagttatcaattcttctcagattaaacagctgtggttgtatataacaagtaaactggttttcagaattgcagcactagagtggtgtgaaggcctgaatgggttcatcatgattcttgatgcaaactcagtctaggtctttctttgtccttaattaatatatatttgtgaagacctaacttcgagtccagaaaacaaaaggagcttttcgttgtttcttttgaagcctagtaacaaaaacgaaggaacactgtgttaaaccaaaactaaaaaggaagaatatgtgaaccttttgtatgccggtaaggccgtatggaatttcaactgcactcgttttcaaattaatagatgtggttgactaagtagaaaaaagaaatactagtatgctgatgcaagctagtgtgatccaggggttcgttttgtttcttgacacacgcttgagtcttattctttattaccccaaagcaccttcctaatcctacctattactttggttaactttagaagacactgactctaccaactaacatgtaagcaaacactagttgcataaccgttggttgagaagagtagacgagaagggacccagtctagtagtattcctctagaagattaggttgctgtagccatgactgtgagttgtgactaggttttttcagtgggcaaggcaacaccctacacatgaagccttgaagagttggtgtatatatatcagatgaccctgttgagcctgaacttacaatttagaaagaacaaggaagacagcaggtgacacctttgcggacacaccaaaactgccggccatagcccatattcccacaagaagatggcgatcccggtttacagcatcacaagggcagagatcgaggagttctggaggagaaaggagatggaagaagaggagcagcgcctcaccgccgagaaggaagctgcaagaatcaaagccaagacacttatggtcagttcttcttcttattgatcaatcgtaatttgttgtattaccaatcactatctcgtcctctgatctcctttaccagctcaggttcagtatggttcttagtcaaaaaaaagttcagtatggtatttagcatagcagataaatcgacgcatgtaaggcaataaaaatctgcgatgcagatacaggccaaattatcctaccatgaatttggagttcaaaaatactgtgacttgtggtgtctgaattgtttgaaaagcagattgaagattatgcgatcttcgagcaaatgataagggagattcttgaggagggtatcaaaggtgacagcgcaagggcggagagagacatcaccacgaacggcgccgctgccaccaagagcactgagggaaggattggcatcaaagattggtaaccgttctttctgcaaatttcctagagttatgctatccgttctttctgcaaatttcctgaagttgatatagcagagtgcgtccctttctaaatagtgcgtttccacatcctctttggaagttggataatggtccaatgtggaaaacaatctgtatcccactttccatccatttccacggttggatttcctgttacaattctatagtggaatttatagtcaagaagaattatatggatgtgagaattaagaacctaacaagctcaacgtgtagttagtcaaaataagaagcaacgcgttaagatttttttgtaacagttctaaggatcaagacggctattttcgtgtgcatgtgcaatcgcttaaaattctggtgcaattacgaccttagcatcctatcagaagtaatcttaattacttagtcttcaaaaaagaattaattaaatagctgtggatatgactgaccaccatcttgcctccctgggtgcaggtggagaaaaagcacttatgcttatctgaatgaaccagcaatgacatccacggatgagaacggcagaaggaagcacgccatcaaatacatcccacaggagagatgcatgaacttcttctcatcgattccaagtcaacataatactactacttttgcaatcttctaaatgggcaagccaatgataagctgaggcatattggcaaattagaaaatatgcaagtggtatatgcatcagcaatgctatgggtggaataaactacattgtttttaagtgtataagtatgtccaaactgaatggtactttaaagttaatcattttgtaaccttgttgccttgcgtggtatagaaagcaggccattttaacttattattcattgtaaaaaaaacaattttagttggtgcttgcaatgatatatcagaagctattgccaacacttctgtgatggtatcacgaatgttattcggcattatactgttcagcacacgtaacaatcttcttgcatatacactcttatctgtttgaattgattaaccttgcaacatcttatgtatacatcagttgtgcactgtatcttcaaatgtacaaaatatggccttcttgaacattgtttttattttttaaaaaaggctagttcctcttagagtaagtttaatagtatagcccactactagctccaaatcatctatagccaattcatacaatagttgcttactatactattaatactcggtcccacctgtcattgacatattacgacttagagtccgtgctgcagctggctacagatctgtagcctgctgctcttctctatcttccttttatctctttaaaatatgtttatagttggcatatagcctgctattgtacatgctcttaagtattactctatcttttttccccttcctgtacttgcttgaagtgtccagaggcaaccaagttctgtgaatacgagggatcaaacaaacaagaaacaggtaaaagaaaacaagtgtaagaaaacgaccttacaactaaaaactgatgttacatatctttgtcctcacttttgctaagataaagaaacagttctacctggaaactatccaagggataaaaaacaagttttctacacaagagtcatcgctagcatacaacaaaaagagtgtcgcctttgttattttgcagcgtactcggatgctgacatgttgttggctaagaaagtgcatagataacttcattagttccactaaattagattaccttggtggatgcttgagcaggtaggtagatagcagcaatcaaaggtgtctgctctgctctcctctgcttggcagaatttcattctgaattttcgctctgaagttagcagtgaccaaagcggagtagagggagctccacttcattttttttaacagatcaatattacaatttgaccaaactgaacctgtttgcccaaattggcctgttgcccgagcgtttctctcgaggaataagttcactttgggtccctctatttgtcgcccagtccgattttcatcccttgaccacgaaaccggatgcgacccgtcctccaacttacgaaaaccgggcaaacaaggtccctcggcggttttggctgacatggcgcctacgtggctaatttgactcagtcttcatctgacgtggcacttacgtggcaattcgatccggaaaaataataaagcccatgggacccacatgtcattttcacatataaaataataaaaaaaaatagtgggacccatgtgggccccacatgtcatactcatcccccctcatcttcttcctccctctccctctcccctctctccagcctccaggcgccacggctcacgaggtcacggggaggtccggtggtggcagctggcgacgcgacagccgccgccgccggcgagctccacctctcggcgcaaccgtgcagccgcgtgcgtttctgatcccgcgcgcgcgtggctgtctgacggcgtgggtggcacagatggattcatggatctatccgtagcgcccccctcccccccctcccgcgcgatgcgacggccaacgacgtcgctctgatgccggcgagagagagagagtacatcttcaactgccagcattaatttgcatcgagagagaaaattagcagtagcatcaaataatatcatttcagtttcatcgcaattaagctagctagccatgtgaggagtcagttcgatgcctcgatcgatcgtcggcgtcgaagaggggtcaagaactcaagattaggcgatcgattccatctgacacatcggctgaatcatacgagctaccgtcaattgagtactcgtactaacgtacgcgtgtaaatgctactgactgcatgagagaaactgtacaagtcctgtgcttacacaatgtactacggcctagccatgatctatatgatgcagcacaataccttttaattaattagtcgatcgacaagcgatccatgcatgcatgggagtaatttacaggcttcgagttcatacactgttgcattgcaacttgcgaaaaacacagtgctacactgagaatcaatgatggccatccgcagctaagtgatgatctgtgagcaattagcaattaccagttactgacgagaggtgagtaggtaaaggcattactagcaagaactgcatcggaacaaagttcattccggtggtcaaaactcaaaaccccagcgagctgaggcatgagagcgacgtcgccagccgtcgccgcctcgccgtcgtgtcgcggcggggggggggggggggagtncncacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 45305 - DNA, 15370 bp, Oryza sativa
gggattagatccatgaatccattcgtgccgcccacgctgtcagacagccacgcgcgggcggggtcaaaaacgcgcgcagatgcacggctgcgccgagaggaggagctcgccgccggcggcggctgttgcgtcgccggccaccaccgtcggacctccccgtgacccagtgagctgtggcgcctggaggctggagagaggaggggaaagagatggagagaggggagatggaaagggaggaggaaaaagatgaggggggatgacatgtggggcccacgtgggtcccactttttaaatactatttatgtgtgaaaatgacatgtgggtcccacgggctttattattattttttgatcgaattgccacgtaagcgccacgtcagataaagaccgagtcaaattagccacgtaggcgccacgtcagccaaaaccactatcaaaaccgccgagggacctcgtttgcccggttttggtaagttaggggacgggtcgtatctggttttgcggttaaggagcaaaattcggactgagcgacaaatagaggaacccaaagtgaacttattccttttctcaatcatgtactgggcctgctaaccactgtagctacatgggccaaaagagcagcaaaagcaactcgcatccataacaatcaatggatcgtggtctttttttatagctcacatcgtttgtaactttgtatcacttgttggaccggagcaaattctttttttataaaagagattttttagggtctaataggatggtgcggtaccgaatatggacaattgaatctccaatggattaaaaatggtggtactgtgaggtaccatcgaggtcaacgggtcgtaccacggttgaacaagtaagtgcaaagggcatcaacgtaattttgcatgggagtatagactggatcaacttgagtgcggcaactgcaaaaatctgaaacctaagtcgtcacttttgaccgtgcttgccctcttgtcaccgccgcaatccttaggtttagggcaccgccaccaccctttctgtactcctcacaagagtccttttcaccacaacaatattcgatgctgcagagctcatcgcatgtatcttcgtgatatcatcgcatttgtggcgctcctcggcggcgctcttctcgctacaacggtcatcgatgccacgaatctcactgcctgtctcttcaacggcgagcccgttggcacagtggaccattgcagaggaggtggggagatgtttcctttccagacatggcactggtgaagcccttgctacccctacgtcagcgaagtctttggagaacgataatggggttgacgactgtcgatgctacccatcctgtccatcacaaatggacggttagattcgatttggtacctcaaggtaccacttgttggacctatagatgatcataaggcctaaggccccacggcccgggccaagcacggcatggcatgactggtgttgggcccgtgtcggccagccgacagttggcccgtgcttgggccgatgcctttgcacggtgggccggctcggcacggaacgatcaaagaaaaatagttgaagcatccaaaatagacttaaatcaaacatataaggcatggtccaaagagaagagggatgcatcatagacttattccagccatatagacaacccaaaagagataagggacttattccattgagaagcaggatgggttgtcatgcttttgggccggccgggcacggcccggctgacctcggcccaggttcagttatgcctgggccctgtagggccgggcggcccgtttggctatctatagttggaccggagcaaattccctcacaaagaggaaaggagaatagtggtaatctcagaattctctatagaagtagtaatatctcccacggtaggatggcggaactcaagtcttgttgtgggtttccgtgtgtcgacggtgggtacccgtagaccggatatagagggtattggggtacactggtacgaggatctacgtagtacgacatcaaggaaacaagagacatagattatactggttcaggcccctcaataggtaatagccctaatccagttaatatgggattatatggagagaaccacaaattacaaagggaataaatggaactcgacgatacccacgagatcgtagtcgagttgattcgactagatcacccggcgacttggctcctgtaggctccggcttcgtaggctgtggtcgttgtgttggctataagattcgatgccttaggtcctcccaggggtcccttttatatcgcagatcaggtggtctccaagtaggacttggagacatcggaccctgcatgatatagtgatgacccagtcctatacgggtaggaacctttccattagtggacttcgtgatggatttccttagcgtatatagagaacgtccgtacgcgcgcagatgtaccatattaccgtatagcgtacatccaaaggtagagggtatagtttatccgtaatcctgacaccgtgtccaatgtatgactgttcgtcttattaaaaaaattaaaaaaataagttaggtataaagtattattcatgctttatcatgtaaaaacaataaaaataatattcatgataaaattttaaataaaacgtatagttaaacgttggacgtaaaaaatcacaaatacacttaaaactggacatatggagtcaaattttcgacacattttgctatcagcaacgggtttccggaggatctctgccccagaagtgggtcaaacgcacgtgagatcccgcgaagcacatcaatggaagaacgaaagcccctctccctttttcttttttcccttttccttttcttttcaagccgtaatgaagagatcgagcgagaggcccaaaatgaccagcacagtgcgccgccgctggtcgcggagatcacttccctccttccgagttccgagcagtctccggcccggcgcatgcatgccccgctcccccccacgcatatataatcctcgcccgcgacgctcccgcgcccgggtagcttagacgaccactgctcatcaccccgttgctctcgcgccgccctccccgccgagccaaaaagccttcctcctcgaaatagcacacctctcgccgccgctggtgcgtgcgtgcgtcgacgcgcgcgatcgatcgatgcctgtgtccctccggcgcgtccacccacgccagccggcgagcctcgtcggcgagtttcgggggcgctgattagatttgcccggtctcgatcgattgatcggtctcgccttcccgccgcgcgatggatccgcgggggaagggcagcatcacgtcgcatgcgtcggacaagtcgtcgcggtcgggctcgttcgacttcgagcacgaccaggacccggaccgcgaccgccgccacgacgacgcccaccgccgcgaggtcgtcgtcaagatcgagcccgaggcccacgtgccggtggacctccacgccggcggcagccacgccgccaacgcgccgggcgctggcggcgtggcggtggggggcgtggtcccggggtccgggtcggtgtcgagcgcgtcgtcctcgccaggcggtgggggcaacggcgagtcgttcagcttcaagaaccggccgccgcagtcgcccgcgtctccggcgatgagcgtcggcggggagggcagcgacgacccgcccacgcgtctcattggcagcttcttgcgcaagcaggcggcggccggcggcgagctggcgctcgaccctgacctggagatggaggagatgaggaggccgccgcgcgcgcccacgtccatgaacgcctccagggagctccgcgtctcgttccaagacccgcacaagcggttctccccgtcgacgtcgtcggcctccacctcctcctacgccggcgacagcaggaaccaggcttgcagcacagcggaggcggccgaggtgatccgctgcacgtcgatgtccaccggaaacaacctgttggcgcggagcaagacgcgttcccggctaatggatcccccgccgccgacgatcagtcaccccaccgaggcggagcgcaacgaccgcaagtcgttcgtcggcaaggggccgcccaagtcagggcagctccggtcgggcctcatcggcaagtcggggctcatcggcttgtcaggccccatcgggaagcccggcgccttcgacgacgacgacgacgacccgttcgtggacgagggcctcgccgccgacctcaagcgcgacacggtcgactgcctcctcatcctggaatgggtcggcctcatcgtcatcatgggcgcgctcgtctgcagcctcagcattcgcagcctcgccaacaagaagctctcgggtctccacctctggaagtgggagctcctggtgttcgtcctcatctgcggccgcctcgtctccggctgggtgatccgcatctgcgtcttcttcgtggagcgcaacttcctgctgcggaagaaggtgctctacttcgtctacggcgtgcgccgcgccgtgcgcaacgtgctctggctcggcctcgcgctcatctcgtggcacctcctcttcgataaggacgccaagcgtgattcccacacgctggtgctcccttacgtcaccaaggtgctctgctgcctcctcgtcgccaccgtgatccgcctcgtcaagacgctgctgctcaaggtgctcgcctcctccttccacgtctccacctacttcgaccggatccaggacgcactcttcaaccagtacgtcatcgagacgctctccggcccgccgctggtcgacgagagccgcatgctcgccgaggtgcagaggctgcagagcgccgggatcaacatccccagcgagctcgaagcaacggccatgccgagcaagccgcccatgccggccaagagcgggcgcctcacggtgaacccgtcgaagcgaggaggagcaggaggtggggccaacaagcagctgcagaagcagaaatccgaccgccattgcgacgacgggatcacgatcgaccagcttcacaggcttagccagaagaacatctcagcttggagcatgaagaggttgatgaagattgttcgttacggggcgctgaccaccatggacgagcagatcaagcatgcaaccggagaggacgagctggccacgcagatacacagcgagtacgaggccaaggttgctgccaagaggattttccacaatgtcgccaagcctcactccaagtgagtagcagcgcaccagtgctacacctgtttttcatgtacaaaatcttgttatcaaatttcatggctatatgcctatccattcctgaaatgtcaacgtgttgcaggcacatatacttgtcggatttgatgcgtttcatgaggcaggaggaagctctgaaagcaatggatctttttgaaggcgcacaggagcacaacagggtcagcaagaggtcactcaagaactgggtggtaatgatattgtcaatcttgacacagtcacagctccttttaatctgagagacacaaaatgttatgcttaatctgtcatgtgaactatgcaggtaagcgcgttcagagagcgcaaagctcttgctctaacgctcaacgacacaaaaactgcagtgaacaagctccaccagatggccaatgttgttgttgtggttattgtgattgcactatggctttccattctagggatcgcgacgtcacgcttcttcgtcttcatcagctcgcagcttcttgttgcggttttcatgtttggcaacactctgaagaccatctttgaggcgattgtgttcttgtttgtgatgcatccttttgatgttggcgatcgttgtgaagttgatgggatgcaggttacaattcttttcattgttctatctgcattgtatgattgcttcacactgtctgacttggttctaaactgttgcgaaattcaggtagtcgtcgaggaaatgaacatcatgacgacaatcttcctccgatacgacaacctgaaggtctattatccgaacagccagctcgccatccaaccaatcatgaattactacaggagtcctgatatgggagatgcagtcgatttctctgttcatgtcgctacgcctgtggagaaactggccctgatgaaggaaagactaatgcagtaagtatcaatgcattaacctcagtttttattgtcttaaatcatttttctcctgaacattccatgcacaagaatgtactacattgactgctttagggttatcaatcatgtcatttgaaatttcagttaccttgacaacaagaaagaacattggtaccctggatccatggttgttctccgtgacgtggatgacacaaacaagctaaaggtatccatatggtgccgtcacacgatcaacttccaagacatggggatgagattcgagaggagggagctattgctccaagaaatgatcaagatcttgaaagatctagacatcgaataccggatgttgccactcgacatcaacgttcggaatgcgccaatgatccagtctttgaggatgccatcaacatggataacgtattaattcttcttgaaatgcagtaccaagttaaacatgcctgatcagttcagtgatgagattatggtttgaagttgctaggtaggcagccgtatttcttgagtaaggtgacgtagtactgtaactgaagtgcccttctcctttcctccatctccttcttgccaagggcatattcggttgagtggattgagctgtgacagcttgccaaaatagcaagaggccgtcttactgtccttgcagccaccgcttgtgctttcctgtaactgtagtgttatgtgtttgggtacttcttatgagaactttagacatgttgctacttaataattttgatgacttaatgcatcaaaagatgaatgcaattttgacagcaaaatacaagaatatcgatctaaatatctaatgttagcttgcagcatacagtactagatctcattttacctggaatttttatgctctctggataggttaagcaggcattggcctgtcttaacaaaagaaggcagatgcttttgtttcctgtttttgccctggtatttgcttcgcctagaataaggttgagaaggatttggcatttgcatttacaaataggcatgcacttctttgtttctcgaataaaaaaaaccagttgaaactgggcagcatacatcatagtgctggaaaaggggaggcaaccgtagtaaaaatagataaatttaagatgaaatggttcatttacaaaggcgacctggacactgacaaaaatgaaacttttttattaatattgtttcggggaaacaaaaaatgagcgttctgtcgttcgacacaagaaaacagagaccagaaggtccagaacaggtgttaccattgaactctagacaagttcgttcaaagttcaaacaaaataaataaatctctagacatggaaggctcgacgctattaaattccacctactgatccttggacctgtggagaagttgccgggcgcggacgcgtacctgaagccgcacgagcaccttcatgaaccggatggcgacgcccgcctgcttccgcacgtacgagccccgcgcgagcgcctgcagcttcaccaggctcctcagcgcgcgaaacgcccgcctcgcctgaaatgaacggacacgcctttctgaatcatcgtggcagcctttgcagaaatgcagcggtaaatgcggccgggttaacgtgcgcgcgtaccaggtgaccgcggaagccggcctggatggtggccgccgcggcctcctctcttgagatctcctcacggttgttgacacctccgtcgcgcgctcctttccccacacgacgcgcagccgtctgacgccttggttcgacgacgacgatgccggagtcgggtgccacggccgtctggccgcacggaggagaccgaccgaagacacgcttcatcccgctcatcaaccggcgtaggcgaggccgaggcgtgggccgcgtctggcgttgccgagcattatcttcacgccgcgtgccgaggcagcagaggaggttgctcctggccatgttcatgtggttgagatggcggcgatgctttggtggagacggaggtgtgcagtgtggttttgggccatttttggaggtgctccagagacacccgagtcttggtggaaagttctcaaacaacgtggcgggatgaatcccaaccgacgaatcgcgtgcatcttgatttcttgaaccggatcttttctcatgccgtattattttagcgcaaaaataagttcccgagaatctgacaaaactcggaccatttcatcttatcattcgcgcacttcccgccaacactccgatttgtacagactttccagttcccaggtacaccaaaacagagcagctataatggtcatcgaaaccagagcaactaccggtggccgcgactgacgaccggtgcccactaggaggcgcagcgcagcgaatgcagtgacgcggtggtgtccatggacgcggcgtcgaacacgccgcaccgttcgctcgcctcgatgccgtagtccatgagcggccgttgctcgagctcgtcgtcgtgccggcgcaccgcctccgggacgtccagctcccccttgcgcacgtgcgcccacaggtactccaaccggctcacgtacctcagcttcccatacaatcttcaggaaaaaaaaacaataacacaaaaatcgcttagtaagcaaatcgatactccctccggttttattttaattgacgatttagacaatgatactctctacaagatatacctttcccttatttttctattataatatatacaataaataaatgcatgtttatttttatatagtattttgaaagacaaatctatatatgtttttctagtttttttaaactaaatattttgacagttattgatgatcaatattataaaagtttaacctcaatcttgtccaaaacgtcaattaatatagaaccagagtgagtaatctctagtacggcctaacatcgcgcgtaacgtatgtaccctgagctgaagaggaaccggccaagggtggagaagaagaggcgggactggagccccgggtgaaggaagtacacggcgtgtagcctctccctgacagccgccggcatggactcgtacgccgtccggaccgcgccgacgccggggaagttctcgcggcgatccacgccggagtgcatgtacaccaccacgaactccgcgtccccgatcgccggcgtcacccgcctccgcacgtaccccttcagcgccgcctccgcgtgcccgccgccgcccagctcccgcgctgcaacgccaacaaaaacgaaacacccgctcgcgtcacgagcccaacacgaacgtactggcgtgtgtgacgtgtttctgccaccgtaccagggaagttcttgccgacgatgcggacgatgggccggccggccttgtcgcggccctggacggtgatcacccgcttcttctcgagcaaaatctcctgcttggtcatggcgtccatatcctctctggactgttctgctcgagattttcgcttcgtaaaactttcgtacgagcgagtatgatgccgtgatggtacgagcgttgttggggttaaataggtcagcgtgcggtgtggggacgatcagatcgagagctgttggatcagggtgaggtttggggacgggagacggacggccaggatggcttgcggtgttgggaacgcgtgccggcgtatggggtgggggccgcgggatccggcagaatatgcggaggatccgtttcggctgcggcgcggtctgcgtctcggcacggcgcgcgggagcggggcgtctggccacgtcgcggtgcacccaggtctcggcgttcggacgcgagcggggggccgggggctcggtttttcgcggcgaaaccgcgaaaacgctatatttaagttctgggtgtcaaattttccgctacagctccacatcttcttttcttgaaaaaacaaacactgcagtgtgtatatactcactcctataaacgcatatacgcacactttacccctaagtactcgttgtcgatgggtatgtcaaccactgaaaaattaattaactgtaaatacgatcacccgtgtaaaatatagtatttaaacccgggtggattggttccactgcaaagaaattaaccagttgagataggctcacttcgctaactccatctcttttaatagtgaagcccaaccaaacgatttcagctccacctaaaaaggtgaaccaggttgaaatactctcacaaaatgagttaaagttatagagttgtttttaggctgcttcacaatttcactttagacccagctcctaaaactaaatttagaagttaaagtcctaccgaaagagtccttagctgtcagttgccaatcacttttgagagtccatgtgtacgtacgaactcgtgtatacatataaagtttatacacgtatgtatgtgtaaagtatatatatgtatatataaaatattttttataggtctaaagtgtacacatacatgtgtgtgtaaaatttatgaatgaattttagaaaacttcacgttttatatggtaaaagttaaaaaaaacactgcacgtattataacacgtggtagatttttaactccaaaccctcttgggccatctcacagctagctattcgatgagggcctttgcggcccatataagcgatccgatggtgaatagtttgtggaccccacatgtcatgcacgtgataggttgcgttggcttttatatgggacgtaaactttcatccccgcctcgtttcctcgccgatgggcgatggccatggctgacggcgccttctgaaccattaaccaaccggttccacctcatcttggaaagaacgtgcagagcccgttcgttcacattggcagcctagcaggcaatggaagtcgccggcgatgtgtggttccctacctcctcagattgtgcgttccatggcatcgatcattctacggcggcaacggacacatggagcagtcaccacctgctatacagcgatgcggccagtacttgaggggaacagagcggatcagcggatagaaggtggcagactggctgtcaggatgcgacggcgctgcggtcaagcacgtcatgaagtggcggcggtgttcttgtaatcgacggcgatccatgccatgtcgcatccggacgccggcgccaacgacccctccccgtcccccaccccggccgcgaggtcgtctctgtcgtggatcttcgtgggacgccgacgacacgcggggtggacgacggcgagggcgcacggggtggcctctctctccctctcccgctcgcgtctgtccctccctctctctcccgttgctggcggccgcgaggtcgtagctgtcgcagatctttgcggggccgctatcgcagatctctggagtgtcgcgtcgccaccgctctccctccgtccgttggtgtcacggggttgtcgctaagccatctccgttgcacggatggtcaccgtcccattctctcccgcccactctcctgccccccgccaccactccggctaccgcccgccgccgctgccaccgtagccgtctccgctgccactgccgcctcctctttcgcctccatccgcgccagcaccaccccaaagtgcctccccaccctctctcccgatgccaccactccgcccccgtccgccgctccatcacccgccaccaccgctccaatcccattcctcgcagacgaccgacgggaagagaaagagagagacataaggggagagtgggagaaagaagaagggttggagagatgatgaccatgtggccccacggtcagtgggtccattgtattttttacgtgtaaatgacaaatgggtcccgcatatctatttttaattctaatattacataagcgccacgttaacaccacgtgggacgaaggctaagttaacaccgccacgtcagcgaaaccaccctctaaaaccactagtgcagtcaaattacaccggtttcaatagatcggggagtcttcttatccggtttatggttaaggggtacgaattagattcagtttacttttaagagagtcaaagtcagtcgactttttccttgtttttaactccgaacctccttgtgccatcttacagccgttcgatcagagcctttgcggcccagattagggcaaattgagttttgggcttgaagttaaactgtctcggtaaacactgggccgggagagggcgctagtcaccaaacaccaggctgtgtcatagctcacgtgcctctgttacatgtagggcaaattttgctacaggacattatgacttcgtagttttagctccaggacaccacacaaagtcacttttggggtaaaacactctcaaaacatgttatttgccaacagacaccgcgtccattaaaataataatttctggttaaagaggagagagaaatcgcgtgaaatgtcaaaattacccttgggcccacatgtcagctctcttatctctcttcactctttctccctctccctctcccctcccctctcttcaccgacagggagccgaagctcctctctccctcaacctgcaggccgaggaggccatgtccacaccgtccccacacgagcggcaactgtagatacagccagtagcggcggcagcaacagcagcggaagcagcaaagagcggcggcaacgacagtagcaagagcagcagcggcggcggcgcgacgagggtggcgctggcataggcggcgcgacggcggaggacggagtcgagcatctcgtgtcggagcatggggatgggggcgctgggtggtagcgcgtaggagaagtcggcggcgaggttggatggcgagaggacgcgcatgcgggtgacaaagtggttgacatggacatgcgggatggcgaactcgttgagcatgcaaagcgggatggcgccgccgcagggcttggcgccagacgagttgcgctcgaggaggaacgcctagtctcccacgaacgccaacgcctctggcgctgacgtgccggcgtggtcgccacccaccacggccatgcgcagcgggcaacacaggtgtggtggagctcgagcaggagatcacgaggcgacgtcggcgtaggtcggctcgagcaaatcgtactcgagcacgcgcgaggttgcgcgtggtggtgacggaacatctacttgtcgagttcgagctacgcgagcacgttcgttgctgatggttgttgccgatgcagcatagttgatgcccagcaacgtcgacgacgtcgcgtcggccattgtcgggagcagcagcgaaaacatggctccggcctccacgccccgcctcgcctcgtagacaaagagctaacatggaaggaggaagatacaaagagaaaagaagagagataagtgttgacagaaaacacgaggcctgggagatctgcttaactccagtgcaggtccaaagctcgccttcgagtgttagcgtgccagttgatttgatcctgtaatcaacaagaaatagaagcaaagaaatcgcgattaaatctataaatgatagtcgatcggctaggtgccgatgacatatcatttatctttgagccgatgacacatatgtatcgatcggcattcatgaataaataagaaggaactaaatctaatcgatcggctgtagataataacaatatatactccttatatcgatatatacttaaatcaagtgattgggatagatcggtcgccatgccgagacaatataaatcacttagatcgaaatatatattaataatgggactatatatgttcatagcatagtcgatcagatagatctagcatgtatcggctaataccccgataccactctatactaagatattaaagcaggtagaatacatcaaacaaaagcttaatatacttaaatgcattaagatcctaaaataaacggtagatttaacatgtcaataaagcatatagggcaaatatagttaaatcaggtaaaatcggatgaaactccaatactaccctaatcggcaaccaaaaggcatgctatagattgatattctaagcacgacttaatagatcaaactaaactgatacagcattaagtatgaaaagaagaacaatatctagacaatcaagccgttggaagtttcatagagtggtagatatcttatataatctaaatcaacgtcgcaatctaacctaatcggctgccctctaccgacagatgttagccgattgtagattaaatagcggtattgccggagattatgtaagatatatgataactcgacgaattacagaaacgagatcagagtatcataaagatggaagcactaatcccgagaatacaagtcgtcataacaagttttaccttttgttgaagatcgaaaccgatgcagttcaacccgaaatcaagaactcgtcgaaataaaactaaagcaaaaagggtggcgatgcgccgaaattgtattgagcgtgtgtgtgttcgtcccaagttacatagggctcgggtctatttatacccgagaattacaagatacgtccataacggacacgactattatctctaacaaactctaagataccataagtctttgcggcagagtcttgcccaaacatatctctaaggaaattacttaaaacatcttaattaatagatacaattgcctcctcaggactctatccatgtgcggcaatcaccttgaagcacctcaactcaacccgatgatgtgcaccgagtcgtattcttggaatcagctgtatcggctagccctgtctgactcgaactctgccgatcctgaccgtagccgattcagattgtagccgatttttgctctgtttccacaacgatcttcgtcttcgatttcgcttcgatctaatattcttttccgatgctgatattaccaaatttggtcgttaacatgtggtcccaagggtattttgaacatttcacgctgtcggagaatgaactcctccaccagggaaccgtgaggccccctttgtgagttcggccaggggcaacgggtgagattcgagggcttggtgagcagagctgtgtgatcttaagggggttaggccccccaagacgatgaaacaaaagaggtttatacaggttcgggcgctgagaagcgtaataccctactcctgtgcatgattgattgaatgtagaacacaagtgcttggggttgcgagacccaagtgccagttcgctccgaagtcccccctccaccactaggcttagacctccttttatacctcaaggggttaccacatgggcccaacaacctaacctaactccggtggagaagtattataatctttccattaaatgcatgtcttgtctcttgacttgggaagccaagcgcacgtcgtcttgatgatggggcctgtcaaatcttgccgcctgacatggggggtgcccctgtcagtcaccatttaatgggtgaagacttctaggctcctattacaccgggaaacgggagccttgctttgacca

SEQ ID NO: 45306 - DNA, 6344 bp, Oryza sativa
cacgtggcgcctagaacggccttctccctttagtctcggccagggagtggccgccgccctacctcgagcccaacccccctcgggggagggccacgtggcattggagggcagcctcctccatccagtctctgcgaaggagtggccgtcgtcctacctcgggcctgactcccctcgggggagggccacgtggcatcggggggcagcctcctccgactagtctttggggaaggagtggccaccaccccacctcgggccttactcccctcgggggagggccacgtggtatcgggggggggggggtagcctcctccctctaaacttgtacccccgggtccatatcatcgacagtagcccccggcgttagtcctgaccaaaaccttccccaggtggtcaaggttgacggcactttcctagtttgatgatttgtgggcccgatctcttattctttctttgctgacactaggacccatgcgcctttttcgcctagcctgagggcgactcgctagcccgtactttaggctgtaaacttattttctgtatatatttagcaaacgttgttatattctctcgggcccgtgaccttacgccgcgtacctcgcttgcccctgccatttgttaacctctgttcatgttctacttcatctattcaaacgattattttcgcgagtatgaggactgaacttttcatagccagcaatcttcacccgtgatcaagctaagctgggcgctgtagccagccggcggggccaaagccagccgctacggaagagctagcacagagggccccaggcgtcgacagtactcagagctcgacgcagggctaggatagagctaggaatcgtagcccccgcactttaagcaaagagttgtttgaatggatgaagcgaatacaaactttttgttaccaagggaggcaaaccggcgcgcgacacataggtaccgcgagaccgcgaggaagagatgggcgagagataaatataatcaataataattttatgcaaacgattatcttcgcgcgagtgtgaggactgaactttctatagccagcaatcttcgcctacgatcaagcgaagctgagcgtcataaccagccgacggggccaaagccagccgctacggaagagatagcacagggggcctcgggcgtcgacggtacccagagctcgacgcagggctaggatagagctaggaatcgtagcccccacacttatagcaaagaattgcttgtatgaataaagcaaacacaaacctttagctcgaagagggccccccaccatgggttccgaaccatcttgggaagcctgtgaccacttagcaaacgaggtcagatttccacgagcctgtgtccccacgctacatattctgtttgctctttcctttcggtggcctccttccaatctcttttccttctacatggacgattactttcacacgagtgtgagagccgaaaactctagagccaacaatccccgtccacagttgagccaggccgggtaccgtagccagccggcgggaccaaagccagccgctacggaagagccaacacagggggtcccgggcatcgacggcacccgaggctcaacttaaggctaggataaggctagaaaacttagcccccacacttagcgaagaatcgttcatgtagatgggagagaggttgggctcttaccaccgagggagcaaataaatgcgcaacacgcgggcgtcgcagggccatgagaatagaatgggggaaataaatataagatttcaagctaatgaattgaaaaattgaaaatacttgaagcttgaaaggacgatcagttgagcctggccgggcaccgtagctagccggcgggaccaaagccagccgctacagaagagccagcacagggggtcccgggcttcgacggcacccggagctcaaaattgcaagagtcctcccaggagtgaatcgaggcggcagcaggttcatgggccaaccccacgcttggcccctgagggccatggggaagacgttcgccatgacccggtcgtcaccccccgcggcctctatgatcgccgtgcagatctggagggactcggaggggtcggcgccatcgtcgtacttctcggtgaggcagggctggagctttgggggccctcggacatttcgaagactcgccacaaagacttggtagccaagcttacctggtggagatgcggggagccttgccccctgcctggggtggcgcgacactcctgaggatgctgcgccttcccctgtagcggcggcacgacactcaccacgccgacgctcgaaagaacctaaaaaatcacgaatgcgccccctaccaggcgcgccagatgtcggagaatgaattcctccaccagggaaccgtgaggcccccctttgtgagttcggccggggtcagcgggtgagattcgagggcttggtgagcggagctgtgtgatcttgagggggttagccccccccccagacgatgagacaaaagaggtttatacaggttcggaccgctgagaagcgtaataccctactcatgtgcatgattgattgaatgtagaacacaagtgcttggggttgtgagacccaagcaccagttcgctccgaagtcccccctccaccactaggcctggacctccttttatacctcaaggggttaccacatgggcccaacaacctaacctagttgcggtggagaagtattataatctttgcatcaaatgcatgtcttgtctcttgacttgggaagccaagcacacatcgtcttgatgatggggcctgtcaaatcttgccgcctgacacggggggtgcccctgtcagtcaccatttaatgggtgaagacttctaggctcctattacaccgggaaacgggagccttgctttgaccagagcgggaggaccgactccggctgggataagaggatgagaacctctcaccattactatttgatgggacatgtcaggctgcacgccgcctgacacacgagcagcgcacaggcgcactagccagtcccatcggtcattcgaccggtcacagaccggttgagtgcactgcacgccgcattaaatgcggcgtggcgcgaccgctcgggacgccataaatgtgggtaggtgggcacctggaggcggacacctaacccaccgtacgtggtgacctagagagggggtcgggggagcccgacccctagtcacgggagggggcggccgccacccgacctcgggcccgatcccctctcgtggggagccacgtggcgcctggggcggccttttccctctagtctcggccagggagtggccgccgccctacctcgggcccgacccccctcgggggagggccacgtggcattggagggcagcctcctccatccagtctctgggaatgagtggccgccgtcctacctcggacctgactcccctcgggggagggccacgtggcatcggggggcagcctcctccgactagtttttggggaaggagtggccgccaccccacctcgggcctgactcccctcggaggagggccacgtggtatcggggggcagcctccttcctctaaacctgataccccgggcccatatcaccgacacacgcaatttctctctccccttcaaccggaaattattattttagtgtggtatcggggtatccgctggcaaataaccttgttttgagagtgtttttctccaaagtgacttcgggtggtgtcctcaagttaaaaccacgaagtcgcgattctctgtagtaaaatttatctatatgtagtggagtgcagtacagtacaacaacttcaatggcaaaatttgcctacacgaagtcgcattgaatcaatgcgcccgtgcgtacatgtgggctgtggcttcaatgcgccaactcggatattcgcagccatgtctgcatctgtcgatcccttgtcaagagccacgaatcacaacgaagtttcgtgttcctgatgctatcaaagacaatgaatcgtggtattaatggattgaccgtttcttagactgaaatgattgcttgagacacgccataacgtggctctgattgtgaatggcctaatctctagactctgtacttatttatggtattgggcctcgaggttcatcaaccacttgcctgatgaacgtgtgttttactagtagttctaattgtaacccgtagatcctcttcctctaaacgaaaagctccttaagaaactccctaacacttgggtgcatgtaccgcaagtccagaactaaacaaaaatgacgggggatagtgcacgatttgtcaccttcctctaagcctgacaaaaagttctgcataccagataaatcagctaaacaattagataccccaaatctcaaacgcagttgatgatgaggtgaaaacgagagagattctcactgtacatcagtacatcctgccgagaatcttgacagtaaaatgtatggctgcgaagcccgaaggaggtaataacaaaactagtaatcccaacaaggccctgacgcctgacttttcattgagccgtggtctccgcggtgaaagcgacgactccttttggtatggcaacattcttacacccctatggcgacatcctttgtagcaagtctgcaggagtgtgtggtctcgcactctggcctcggcctgtacaacgtatcatttatctcccttttttttagagcaaatcgaatcctttttttcctgcccacagattcgcacagctaaaagcgaaagatgatgtataaattacttagtacgaaactctgtctgtcatttggaaatactacttttttctttctttctctcgctctatctgcaattcctgcatttatcaaactgcctaacctctttacgtgcagagaaaaagaaaatgccccccacgtgatcacatcctgcactctatattgacggcattatatcaaacatcctgtacttcgttgtcatcgtgcgacttcttcgcgttgtgagttgtgacccgtgaagaccgctatatatacacacgctactagcccctgttgcattgtatacacatattcattgcctcattggtactttggtagctatgggctccctacccgccgccgacaagccgttgccggcgctccggtaccctccggctcgccgcgacgacgacattgtcgacgactaccatggagttaccgtgccggacccctacagatggtgagtgtcttgtcgacggctgtttccgttcctctgtaatcgattctgtcctgttttgagaggcactctgtttgttacgttatgttatgcacatctgctttttctgaattttaccctttttacccggcttgaaccatttctctgttcgtgcaacatgaaaaaacatagttcctaaattcatggaaagaagtactgcttcaggataagagtgttagaattcctgaggttcagtttttttttaatctcatttcttaataaacttcggccggcttagggcctggcgaaacagttttttttatataaaaatattcattagattattgacatgtattatctactttattgtaggataaattaaatattttttataaacaagttgtctaaataatacttcctccgtttcactatgtaaatcttttttttttgcggggcactatatatgtctaaatttattaacgttaatacgaatgtgaaaaatgttagaatgatttacattattaaacggagggagtacagtagaagagattttcttttgaaaagaatgtaagtattttagcatatggtgtgcagtaagaatgtaagacgcattcccttgtataccgcagtcaaaacacttggtaaatcccagaatgattgcgtttggaataccactatatagtgcagacgaaatgcaaatcgaagcagagttgaacacttgaacacgattcttcccgtacgttctcagtccatccgatcgaaacaaagcatgagtaattttgttcttattattgttggaccgtgcgtggttgatgatcgctgatgtattgtaaaattgaccgcgagtgaaggatggaggagctggagtcggaggaggtgaaggggttcgtggacgcgcaggcggccgtggccgaggcggtgctctccacctgcgacgaccaccgcgtccgcctgcgcgggcagctcaccgcgctcttcgaccacccgcgctaccgcgccccgttcaagcgcgccggcagctacttctacctccacaaccccggcctccagcctcacagcgccctctacgtccaggtcaatcaaagccccccacgcgaatctcgaggccacccagcagagtccgagagagacgctagctttctgcaatctgaaccgtcgcttttgttgttggagttgttgcagcacgggctggggggcggggaggaacctgacgtgttgctggaccca

SEQ ID NO: 45307 - DNA, 6714 bp, Oryza sativa
atctcaatcatgaagtctattaccattttcttggaaccgatcagtcagaggacctgttgtgctgggaggaccctgaccatcccaagtacatttacacccctgaagtttcagaagatggcaaggtatgcagctatggccatgagtcgatcaacttaggacgaagttttgtacaactctgaatcttttctaagcattgacaaacatgagctactcctgagctgatatctcatcacttcacttgttgcagtatgtgattctgtcagtcgcagaaacttcagaaccggtaaacaagttgtactactgtgacctctcggctctccctgacggcctggaaggcatgaagggaaaccatggcaatgccatgcttccttttgttaagcttgtggatgaatttgaagcatactacgcactcatcgccaatgacgacactcaattcacatttctcactaacaagaatgctccaaagtacaagctgtcgaggattgatgtcaacgagccacactcatggatggatattctccctgaagacgagaaggctgtcctagagtcggcttgtgcagtccatggtgataagcttctggtaaactacctgtcggatgtcaagtatgtcttgcagatgaggagcttggttaccggggagttgctccatgacatacccattgacattggcagcgtcaatgggatctctggcagacgtgacaattcagaggtgttcatcgagtttgctagcttccttactcccggaatcatctataggtgtgatgtcagcaaggagactcccgagatgaacatatacagagaaatctcggttggtggttttgatcgcacagattttgaagcaaagcaggtaattttcaatagcattacgagctcttagcacgatacctgaactttgtagaagtacaatgcattttcagagttgcacaattcctgtttgtaattcagctagcatttctccctatttttttcctctccatttttttcaggtgttctaccctagcaaggatggaaccaagatcccaatgttcatcgtgtcgaagaaaagcatcgttcttgatggatctcacccgactctgctgtacggctacggtggcttcggcatgaacatgacgccccatttcagcgtcacccgcatcgtcctcatgcggaatctcgggttcgtgtcgtgcatcgccaacatccgaggcggcggggagtacggcgaggactggcacaaggccgggtcgctcgcgaacaagcagaactgcttcgacgatttcatcgcggctggtgagttcctcgtctctgcaggctacacgaacccgagcaggctgtgcgtcgagggtgcgagcaacgggggccttcttgtagctgcctgcatcaaccaggttttctcactgtaacctcttcagttttttcagttctctgcagaagattgagcaagaactcactgtggattgtgcattttttttacagcgtccggacctttttggttgtgctctggctcacgtgggtgtcatggacatgcttcgattccacaagttcaccataggttctgactcatccctgaaacccatatacttgaactttctttttcgttgaaatatttcatctcaccaatgtgctcggcaacacttgcatgcaggccgtgcatggacctgtgatttcggctgctcggagaaggaagaggaattccactggctcatcaagtatggcactagccctctctctgaccaccaaggaattcttaatccttttttccttcagtcacatcataagttaggaatgccaaactactgacgcgcaggtactctcccctccacaacgtcaggcggccatgggagaaaggtcaccggaggcagcagtacccttccaccatgctgctgacggcggaccacgacgaccgcgtcgtgccgtcgcacacgctcaaattcctcgcggtgcgacccgtgatctctcctcctaccttcgccgccattttctctggattctgatgaattttctctgttgattgggggcagacgatgcagcacgtactgtgcacgagcgtgaaggagagcccgcagacgaacccgatcgtcgcgcggatcgaccgcaagagcgggcacggatgcggccgctccacgcagaaaatcgtaggcgaaatctttgctcgtctgtgtgtgtcacgtttttttctgctgatttaactgaattttgctccgtccgtgggtggcagatcgacgaagctgcggacaggtatgcgttcgcggcaaagacgatggggatctcttggatcgactgaacaagcctccgagcagttggtgccttggtgggtgctaatgggtttaacttcttatagcatataaccctataaaatttgagagttggatctagaatgagatgaacacaacttctgtatatttttggcttaaaaatatttatgggctagatatggttgtgaaaaaaatccatgggtctcaccaatatttagagattggttagttggctatggtcattagataggtgtctaaaaaaaccgtgatgtgagaaggataaaatttattccctcttacactcgccataagaaggtgagactcaaacctgggtgaatgtattcacaaatatgtgcgctcaccacggtttttttttttagaattacacagtacaacacaggtagtcataacgcacgcacgcaaactttacccctacgagcatcttcgaagattgggccgacaaatccatcttggagattgacgaagtcaccacagaatttgtaatgtaattggttgggtttttatagtgattggcatggtaactttgcatcttctatcttcttatgtagttcgttgaaaaaaaatagtgattggcatggttgatactcgatatgtacatatattacggatttcatcacctattcctagatggaaaacagttgtgaaactatgaatgtataaaaggagcttgatcatgattttctacccatatctgggagtgccgaagtttctctaatattttgaagacgtattcattctcctcccaatcctaacctaccatgcgcagcgtgagaaaaccatgtaaaaaaccaaaccagcccacccactgcaccccctaggctcccttccccgactgtgtgagagaaaaaaaactaacagcgccttatcgttggcatattttctgatatttgcaaacgaaaatcaatttgtgaataaaactttttatatatatgtgtgttcttagcgatctaaaagtaaaggctgaaaaataaacttcgataaaaaaaatctcaaaatcagctccaaatttaaagttgaaaattcaaattttggctgataagcatatgaatatgcgagcccataaagcaccatgtcttcttctcgctagaaaaaccatagtttaaataaccaacagaaataccgcctaaaaagcaatccaatagtcccaccgggaatagacatctaaaatcagtttgggcctaaaagacaagtatgacagttgattttatgggtctattgcaatgcaggtccatttaactagtggggagaaggagaaagagagaagggtgtgttcaaagtaaaacaaaagaaaagtggccaaattgcgagcataattattcaaagctagattaaatcatactatttcatatggtaactgtagttgatatacaaccctcgctagagttatggtaggcaagattacaactattttttatatagatcaatatcaataaagtataattgtattcgatatacaacactcacttatatggtttaaaagtacaaatgtattttgtatatacattttatataccaatcaatcaatttcaatcaatcaatttctgttgttataatctaatagactactactgcatctatttcaaaatataataatttttagctatatatctagataagaatataattggatggacaatttattactatattttaggatattttaggatgtatgtagtaacttatattggatggatgatttcaggtgaacttgaacatataaacattgctcaaagggcactaccgtataaaccgaaacttggagatgcccagctcaatatgcaattcaggttctcaaaataaaagaaaatgcaattcagtggaaaagatctagaaaagtggtaaccggcacgcgaccacgcgtacagagtaagctgatcgcacgcgtacactatccgggcaccaaaaccgctgctcaaaccaacaaaccctcccggccccggaaatcccacgaatccgcaaaccagttcgccccccaaatccgaccgccgctcaagccccacgccgcgccaccggccgccaccgccgccgcggacagccgcgatgccgaagaagatgggcgtcaactccaaggcggaggcggcccgcgagcgccgctccgtcgcggaggccgaccgccgggaccgcgtcgagcgcgccaaggaggaggagtactggcgcgaggccgagggccccaagtcccgcgccgcgcgccgccgggaggaggacgccgagaagcgcgccgaggccgccgcccgcaaggccgagaaccgccgcctcgcggaggccgaggccgcctccgcctccgcctccgcgccgtccaagacggccgcccgcaaggcctcccgcgtcggcgccccggcgcccaaggtcaccgaggccgagctcgcgcgccgccgcgaggacgagcggctccgcctggagcgcgaggcagaggccgccaataagcgcgccgcgcgcaccgccgaggaggaggagtacgagcgcgtcgtcttggtcgccaacaccaacagggacgactccatcatcgaggcgaggtcggtcgacgaggccatcgcgcggatgtcgctggttgactcagagggagccttgcccgccgacaagcaccctgagcgtcgcctgaaggcatcattcaaggtatagtgaccaaactttgtgcttattttaactcaattgctgcccgatagtgtggaatcgtgtttacttctcaaaatatgttgcttgaagacaatgaattgagcacctcactactaccatgtatgcatatgatacaatggtagtcgttggttgtagacttgtagtttctactttctactgtgattgtaaatcacaacaaaaatgggaaaaaaatcacaacagattgaagtctgaatgcaggttagtatggcatgtattatttttcctctccactttgtgtcgtaacttaattatggaaattgacatgttatcccattttgtaatagaatgacaactgctaatatggtacttcattagacaatcttaagtttgatgtagcacaaactcggttagatttgattttcccatatgattatttcattatttgacttactaggatgtttgatgtgcaacgattgaacattcggcgtttgaatttatttgtgataatcttgatgataggcatttgaagaagcagaactccctaagttgaaggaagaaaagccaggcctaacactgaatcagtacaaagacatgatatggaagctatggaagaagtctccagacaaccctcttaaccaggtttgctcacataaagatatttaatttagcttgttcctgcttacacataatccttgcacattctaggttattgttgtgtattttaatctgcatgctctaccactaaaacattttattcaaaattatgttcccttaatgttgtgaactcaaaaagggttacgattgtcaattgtggtggtctactcgaatgtacgaagaatggatgcaatatgggtatcgcattaaagttaaggttttcacttaacaccacatgtttttacattggattgggctgttctgctggcttacgatcatcctagaggcgagtaggcagcagcctgcagcttctcttaagcaccggcattcatgaccccgccggagttgttgcgatggtgcagaacatgggcaggcaacaaccaaggaaagagggacctagggcaggcatgtgtggtgaaggcaaagtgttggtgagcagcatgtccatgcatgaggagaagaagagcggctccggggtgaattgtcatggatggtgggaatgtgcagagacgttggtgatgacggtggctaggacgcggacagggtgaatcctcgacggtggcagtggtggtggctggattgtgattttctgacacgaaggttagtgacggtggcagtcaggaagcgggcgtggcggcagcagcgtggacacagggaaggactgagaagatggccagttcatgcttgcttgcgttgttgcgttgatgggttggcccaaataaccaaacccctggccccgtccaaggtgcaatggaatgcaaaatatgtggtgttaagtgggaatctctagctagacctagtccagtgttaaacttaggttaaaaagatggcccagtgtgaaatttactctttctaatatttgctttaactaaggaaatcagaagtactatgattcttagatacttgtatcaattgtccatcatctgactggtatttatatttaggctgcagagtgatgatgcattcctgctgaattgtagaatttccaaggtaagttttcatggcatgaccagacacacattttactgtcaacaattttcttgaacaataatgcactaaaacacactttttcttgatgtgcagacttccaaatgggtcagaacttcatcagatgctcatggactgaatgtgtgggagatgatcagcttctcggctaataatttacaaagtgatgcagtatatatcatgtgagctcgtttttgttagagat

SEQ ID NO: 45308 - DNA, 2457 bp, Oryza sativa
agcatgatacaatatgacaatagcatattactgcaggaagtccatcttaacgtcagtgacatcgagttgcagtatctcagctctgcagcttaacatgacgccaacactgcaagagcagcaaggtcgttaatatatatgatatgatttaaaggaacatggcgccaatacagcaagagcagcaaggccatgaacatattatgaatttaaaaggtcggttaaaagggcttagataagaaaatatgaggaattgaaaattcaggctaggtttttttttgaaacgaaccttgggtgtgtgcgtccaagatctccgtgcacaaactcctttatgtatgtcccagcctgtatggacaccaaggttgattaaaccggagggagcaaactacagaatataaatgcttttgatgaattgccttatgacggattcacaaaagcatttaagaattgcaatatttttacaagttgatctgacatacaaaaccataatatacagtgaagaagaccacattcattcagcgaaaaataataacccaggcaatcacaaaagatagaactgacgggaaggacaaaattgcaatgcttacttgagtgcatagatgcaacaggtaatagtttgacccgccagaaattttttcaatctccatcctgacagatggttttctgtttctcagatttatggaacataaaatggatttgacaaagctgaaatcagtctcaactcaccagtgtataatccgttttctctctaatggacttctacgatgtaagactcttattggcgtcttttgtacaatttcctacacagcaagcaagagttactatgttcacatagtatccaaataccttagaacaacaaagaaaatagaaaatcaatgaccttagctaagatccaaacctattctttccaaatatgaaatatattagtcacaaataagcatgatacatataagactcagatttattcggaaacagcatgtggacattaaggcagagaaggtcttactggataaacatttgaggccaaaggttatgactgtaatggccactggcagtttaaaatttacaagaaatcatccattatttcctgtgatcgcccatacagtatttttctactgttgtagacttattctgcacaacccgtgttctggttctaatttattagatcaggacaatcttatgggatatggcagcacgttgctaggtgtgaaaagaaaatgaaaaaaaaaacaaccaaagaacatgatcaaaagtcaaaacaacactctgcaggtctttagtagaaagaaaatatgttataccatatctttgataagagaaatattatgtaggtcatcatccgtcagagggcgagacgtccatatgagggcagcatactgcttctgcacacgtatagtagaattaagcactgacaatcagcaaaaggttatcacctttcggcaacaaagttatttatggcttcagacaacaatgcaataagtatgaaacatatcatgttaaatacaataacaaactttgatgctatcgtttcagtaaagtgatatatcatcagtggtagagtacctgcttctctgcttctccttcccgcatcattgtccatatttcactgcctaccagcttgagatttctaaccctgacctataaaatgctgaagcataagcacatcatatctaatccaagtgcgatgttgataccctttactgtgttcttacatgtttcttttcagagtcattaatcttatctgctatttgttgaacttcagtagcagatggaatagatcgcacattcaagacttcaactaagaatggacgaccagatccaagcatccgaacctgcatatatggttcattcagcatagaaataacaacagatactctgatgaaaaaaatagcaaaagacacaactcaaaaccatgggattacatcaatatcttctcttccagcagcatggaacttatagccatcacctttgcagatggcacggacattctccccaattatctcctacaaaggggtatggggatgttcagttgtacttttatttcttgggttgagacagcatataaggtattgtgtcttacctcaactgatgcttcccccattctctcatcatcaattatccaacatgactggctgacattccttgaaagctgataatgaggaacgttgtcatgagggaaacaactcagttgaatagcacagcatcaattaaagtgcaaacatgcaaagaaacctttagtttgcttctatgcactgagtatgaggaaacacttccaagtggcattcctaatggtaataatccattacagaagacactgctgcaacaaaaatatttttctgttgcctaacttaaggttgtcctatgattatacagaactacatagttgttccaagtacgtaattaggagattagcaactacaaaaaggattactgtagtgttgctgacatactgatgggctgcag

SEQ ID NO: 45309 - DNA, 10415 bp, Oryza sativa
atgcatctgattcacttaatatttgtttatcatcatctgttgagccccttttactgcttccatctcttgattctgttgagacatcagacaaaacaataaaataaaatgttgaaaaatgaccgcccatcaacaatgcagtctttcttcattaatttctatacctgtttttcttttacgaccacggtcatttggcagaagccttagaagcttttgtgaaccttcatcatgagtataagttaagcgaattcgaaatgaattattaccatgtttcacattctgcacgaaattagtcaaccgttttgagataagtaaacaagcaatgcttgatttcaggagatattatcagaaaaaggcatttaccatttgtttttctactgacggtactagcaatattctcaaggcctccttcactgacattgtctgttgagaaaatattttttcatcgaaccaatttgcactgccatatttctctttcatatataacctattaaagacacaaatgccagcacgttatgaaaatgccagtgcagtgtcatcatagatttaatataagcacacaacagaaagttccatctgtggttgagaacaaacacagtaaattgttgaagtataattattatccatcaagactgaatatacttcatttctctgaattttttgctaattaaaaaaatgtaaatacctttcacttacaaatggttgcattatatatcaccacttacataattttagcttttaaaaatgattaatatgtggcacccccttcagtcacaaaccaattcatggtgctgtataaaaaagtgaggcaaaaattcttaggtgcagatggttacctaatggcacgatcattagctgctataactgcaggcagtgaaatttctagggagaactcatcgacttggtgaccctctctctggactgcttcagatataattgaagtaacattatcgataggagaaacactacggagtggttctacaccatcatcttgatagcaggtgggcagtaacactccaaagcaaatagagcagtacgcctcatcttttgacaaacatgaacaagacccactttttgcggaatcgtcatgctcttcaagaaacgaatgcagaactgatgccgtaagagaaaggcatggtgctgcataactaaaggctccaaagaaccgaaagatgcaccgcacacagacctgcaaatattgtgcaaaaatgttgacaaatttctccgtgtgtgaaactgaaaaatcattgggttcagcatggcatcgaaatgttcattcagtaaaggggaggaaatggatcccacaacataatcgtagtaatacacgaacaatacgtaacacccagtacgctatccaaaaatatttccgtaataggtgaaatcggaattgggggaagttgaacatggattggatagtgaaaagtgtgcagcagagggcatgactgagaagacgaaccccgacggagaggaggtggtggatggcgtggagcggtgggaaggaggacgccgctgcgcgttcgaggatgctcctcgcctccgcatccacctccgctgcggccgccatggtcctcgacgcggttgattaaaccctagttaatcccctctagttcagactagtcctatggagagagagacctccttccttcatctgaacttgggccacctgatttaacactaatctcaaagcaaacaaacctctcaaaatttcacccttcttcttcccccctccttgctgctcgccgcctaccggcggccaccagcaccggtcgtaaaggtcagagcagagcgaggagaagggtgcattcaacacaacagcgaggctcgcagtccgcccatcgccgttcctgctgcggttgggcgtgagaacaccgtgatcctgccgcggccgggaacggaccggtgcagatcccaccgtaatggagcggaaatcgccgccgatgcctcggccgtcgggggcgccgagccgctcgccgccgcgtcgccgtccacggtggttgtcggcctcgaggcgaacagtggcgggctccgcagagagaagctttgcgccgtagaggagaacagagaggtacgctgctctacgatttgtgctaaggcacgtgtcacacagatgttcaatgttcttcagagatcaggtgaagggcgggccaagatcttcagagtaattcttttcttattagtgataaaacgatctgcgatcaattaacttgccaatgttgttcataaccaatcctgacaaaaagacaggtacgtgaagaatctcgcacgacaagcacgccgatgtgcgaaacctgctgaattgcactctatataatacaccatctgtttttaatagatgacaccgttaacttttagacatatttaaccattcgtcttatttaaaattttcatgtaaatgtatatataagctttaaattatgcttaaaatacattaagtcataaaacaactctcaacaaaataaattataattatgtaaatttttcgaataaaacgaatgatcaaacgtacgacaaaaagctaacggtgtcatttattaaaaacggagatagtaccgtgagacaccaccacttattagtaccagcactaacactttgccaatccaagcacacgtacgatgtgcccttctacggccgcagctccgccagctcgtgcacgttcatcgggtggacgaacgccccggggtcgaagaagagctcgcgcgcgaagacgttcgacgcggcggccgtcgggtggaagttgtcccagaagaggtaactcccccgatccaggcacagcggcgccgtcccgttgcacccgccaacgccgccgccgcagcacggcctgtccagcaccgtaaaatctgcagaaaaatcgctacaccgtcagggaccctgcaacgttttcgtatgcccagccactggtgcagcgagatgagaggacgtactcgcgccaggtaggaccgtgccgttgaggacgagctcggccatgccgaccgagtcgccgagggagtagtgcatgccgggcaggtcggcagcgaggccgcgcagcatcgagcccagcatcgggtacagctgcctggagaggccgttcgccgcgcgggagcagccgtggaagtcgaggtcgttcgtgtcgtgcgcgaccgccctctgcgacgggcagcaccccaccagcgacgggctcaccacgctgaatttcctcgccccggcaccgtacaggtcctgcagccaccgtttctcatcttgttcagatttcttgcataacttttagagggttcgttttggagcattggatatacagctctgcaccttgaggtggcccttgtaggaggcgacgaggctctgcaagaattcggtgtcgttgcgggtggtgttcgacgggaagtcggtgtactcgaataggtcgttgctgccggtgttgatgaagatgagggatctcgagatgagatcggccgtcccgttccccatcttctgaacggccgacgtgaagctctgcacctgggcactcatgttgaacacttccgtgcactgctcagacaaaagccatgtcagtgtgacacacaccaacaattaagcggacaaaaaaaagacgagtcagtgcacgtaccactttccaacccgtgctatctatcagccctgatcctcctgacgcgaagttgatacctttgctcatctgtgaaatgatggtcacgtccggcagggagaggtacggtggcgggctcttgtcgaagccaagtttttgagctgctcatcgatgcaacgatcaaaccgcccggtcagtgacattatctccaaatcttactagggaatgctagaaaataaaagcaaacgtttcttctcgatttcagctacataccgagctggtcggccaagttgtatccattgctgaaccgcccggtcggcgactggaacgggtagtcgacgccgtacctcgggtagtttgccttgcagttggccttgcagttcgccaggaagttgttgttgccgacgtccaccgtggagtccccgaacacgaacatggccggcaccgcgggctcctcggcgagcccgcgccgcgcgagctcgagcaagcacagcgccgccacgagcgcgaatgctccgcggcggctggccatcacagcgatcgattctctatgactctcgctgtgcttcttcactgcgatggcgcgcggccgacttggcagtgtagacttgcagagctcgtcaacgtgcacttatatatagcatgcgtggcgaagaacgtgacaagagaagagatcgaaagatcgtgtgtcagcaatgcatgaactgggacgagcctgaacagcagcaggccaatgtcactatcttcgaatccctcgccgcggttaataacaccaaaggatatcctccttgtaccttaatgcttcgtgttccttgatcacgtcgacgattaaaaaaaaaaggcaacgaagcaatgcaacttcaacttgccaatttgacattgtggctgtgaaaagagagcgcatatctggactgaaacgtgctgtgccagcgcaaggcagaatgtcagagtacgggattatggtttggattttcagtcccgtaaatccgttttccgttgcaaactagcgacgctacgtacatcccgtcggtataggacaatataaatccgttttcagtacgtaggcacttccgcatcgcaaaagcatagaatatatcagcgacgaacaggacacaatcgacatcagtatttcatacgcatctaaatacgtacgctactagttaagactaaacaattagaggaatcgcctgttcatgttaggtatactgaatccagcagttcatgttagcctgttaggtataccaatcgactaatccagcaatggtcaattaaaaccgagggaataagctagatgattatgactttttatataaaaaaacactttcagtaattattactccactgaaataattggttaaatatattgactttcttatattattagaaaagatacactgatttcataattcataagcatttgttggtccacttgaaataaatagcaaatttcgctatacctggtggctggctgctcatatgcatacatttcacatcgtagactattgtccgcatccatggtgttttttcatttgcgtagacgagcacatgagcatcgctatccgatgcggagaagcgtgtggaaagagatcgattaagaaaccggatcttcgcttcgaacttcatgttcggcagcaacagacgggcatgctgcattaactgttgatactaactgaaggcgtctgttcactgcagacagcatcacggaatctggaattgatctggacggcgaccataccatgctcgcttgggcaagtggacgacaaatgtacacgctgacatgcacgtacggctcatgtcaacgaagttcgaaacctggttctgtttcaggtggttggcctgtttccagtgtccaagcgcccgcaaaactacaccactacagaagtacagatcggttctctgtaccgctgtacgtgccagcgatttgagaaaacaaggaactagcttactagcgtaacttccggtccgatggcagattggcaggccgcggcaggcaccagagtgagaaacacgaattacagatgagtaattgcgacgattacgcaagtgacctgggccaaaacttgggtaaatccctcctggcccaactacagtagcccgcccattttcagactactcagactaatagtaaagggaggcagaatcgacttttttccgagtccaatcaagttgatgacgctgcacgttactatgacttttttccgagtaggtataatcaggatgatttttttaaaaaacaaataagcaaaaacacttaacaataactaatttataaataagctgaagtgcatatttactggagaatgataattgtgcaatgcatggacggttgatataaaaaacgggagagatctcaacttttattttttagcttgccacatgttgagcttggttgtataataactagatagaaagaaaagaatagcgctgttaaatcttgatttcgggggatttgcaaattaaacctggcaatgtgcattggcgagtaagaaaaggcatataggctacactttggtcccaccccttgtttatatggagttcatttacgccttacaaactgaactcacgctaaataaacccaaccagccaaacttgtgatatggccgagtaaaactttgatgcatttgcgtatacggtatatatacctggccaaacttgtcatggccgagtaactcctggtgttgtgttagggtcgttgacaagcaccagccggtttgtcaactagtaccgcgacagggttcggcttctgccgctcgcgttggtggcgcggccgcagcggagcgcgttgctcgggatggggagctcgtcgcggaacgagtgcgacggcgtgtacacgcggaggtagaactgctggccctgatacctgcgcgcccagtcctccgacctgaggttccacatccccacattgtccagcgccaccaacaccgccgtccacgccctcgggtacacctgcacagcgccatcaagcgagcaatttagccagtccgcaattcgttttcgtgtatatccgcactgctcggcgcccgcgtcgagtgaaacgtggctgcgtgtgttacctgaaccgtgcaccgggagactgcgtcgacgaggttgtagctcttcctgctctgctcgctccacactcccctgtccatcctgcgacaatgccaaaatcagcgaacagatgagaccagatggtgcgggctgcattagtcaggaggcatgtaacgtgggccgtacccaactacgaacaagctgtagccgtcgaggtgccagatctggacgctgtcctcgctgttctcgaacacgatctcgaggaatgaccggtagtcggagtccatcacggccgcctcgctccgcggagccgccgcggcgcccgcgggcggcgcgtccgggatgccgccgagccggaacacgtcgctgatcctgtagtagtcggccagcttgagcggcgtgtcggcctccacgaacgacacgccgttcacggcgtaccgctgcttgccggcgacgcgccccgccgagttggcgagccggattgtgcgtgtcacgttgatcgagccgtagtggtacgagccctgcgggttcggccgtggcccgctcgccgtcaggttcgtcctgggattgggaaaacatcaaaagaaacccaccggtcagtaccagcatctgccgtccatcgcgagaaacggacggtcaggatgaggcgatgcggcgaacctgatggagcgagcctggtcgagcgagaagtcgatgtcgtcggcgaggccagccggtggcggcggtgaggagatggtggcgctcgagccggcgtagcgcaggacggcggacgagttgagtgcacgcttggcgaagcgggtggagacggtgatttggtagacgccgggcgggcggttggccgtgaacagcacggacagcgactggccggcgtggacgtagagggagctgtaggtgttctgcaccgtgtgcgtgccctccacctcgaccagcgtcatgttgtggtcttggatcctcaaattgagcgtgctctgcaggccgacgttggagacgcgcaatctgtacgtcttccctgcaaaaagaaaaaaaaaagtacacattacccgtgcttgaaaatctcacggtatgatcagattggtcaaggtcactcgaaaatagttgtgttctacgtaaaggcaaaaggcctcaccttgctcaacggtgaagcttgcgccatttggacctttgccgttaatcaggatgccatcaggggaaggcagctgctttccactgtccagcatggcttgcagagcctaagcagcaacagcaaaacaatcacttagtacaaggatccatctactgttgatgaaattagtgtaactgcaatgccatgccttgtggctggtcttgtaccagtcgccgatcagcatggtgtactcgccggccggcggatcgaaggggacggggatcagcgggcggctgcggatgcggatggcgccaaagccgccggcggccttgtggaaggcgagcgacgggaagtagaagaagctgccgatctggtccttggcctgcatttggtaggtgaagttctggcccggcgggatcgggcagttcgtgccggacacgccgtcctgccacgagttcttcctgtgctgaagcccgttcctgcaattgtttgtgactttgcatttttgatttttgtagttacggtaaagaatcgatgtaattgtgagggatggcatgtttgaaataatgcacatatgcgtgatctaagattgtatttcaggaccgaaaataaacgtcggaggtgatctaaaactagcatacataacaaaaacggaaacaaagtggaaacgtatgccaacaaggctgtgtgtagattcaaattttggatccaaacttccaactttttccatcacatcaacctgtcatacacacacaatttttcagtcacatcgtaccaattttaacccaaacttccaactttggaaggaactaaacacagcctaaggcaataactaaactctctctctaagtttgtggtgtattagatgcacggacgcgactacaaaagctagctaatcatgtaatcaacctaatctgcacgcaaaatgcgttccaaaacaaacttccacgttttgggttccccatgacaaatctagcctagttgatgtttagcagtatattcaatcaaaccaaagataagttcatctacagaatagtgcacataatttgtacaaactaatgatgaaaatgagcaagaacgcagattgactgggtgcaacgcttgagagcgtttctgtgtaaagtgaacttgccatgacagaagaaacggctccgacaaacggttgtgcacgttgacgatcaagttatcattcgtctggcagtcaatctccggccccggaaattgcccattgatcagaataccctacatgaagaaaaaaacacacacaaacaagtactaaaagaattagagaaacagcgtacacatcaaccctgaccaaagatgaacagcagaacagatccatcaaaatctacacctgctgctggacgccgagaggattgatgttcccagtagtaacctcccaatcgaaaaatctatacggatcttctgcccgtgcggaggagacgaagacgaacatgcagacgcagacagcggccagggctcccatgcttcgccgtgacgacatgacgccggtcgacgctagctgccgggagacggtggtacggcggtcaggcggcggagatcgatagcgcgcgcggcgcctgctgtggactctgctccgggtcccgtacgtcgcacattttatagatgagatctactgggacgcaaccgcaacagcatcgatgtacgtgaaaaaaatcatcgttattgagtttaggcagggtggtttagtttaggaggaattttaattctgttacaaaagagataagatattacaaggggattggtaacagaatttgtggtatgtctatggagcgatggacggtcgtaaaattcgtggtgtttctgttcatcttagctgatgcctttggggatagacgaacttccaagttccaatgtcttatctgccctttgtttgtccggttttgttcatgtccttatattttcaacgcggaacagttttatggatatctcttctacatgtccagcattgatacgacctaaattaaactggtccggaataagttttgtgacaaagttgtgattaatttacagaccgcgcgtgtactcatatgtatgcgtaaaggaaaggaacacgtacgtttgtgctcattgttgactgcattacaaggcagtattaccaccgatctcaacttggaaggcaaggttaaaaaaaaatacaagacagttgtagccaccgatcaactggtaaatttacaaggcaaattttgaatccgtatttgccagcaacgcggactatcatagctagtatttttgacttgaaagaaaaactggtaaaactcttgggcacttcaccatgagatcgtccaaatgggccggagctgcaccgcaaaagcagcccacgggctacaaagcacgcgcgtcactcgctctcgcggcaaagcctctctccctccccctctcgctgtccggtgggcccaggtcgtccccacacgacagcgctccgcctctccttcccgactccaccgaccccccgccgagctttctcgcctcccgcgaagtcgccaccgcgcgctgctcgtccgtcgtcgccgctgcatccgcctcctcctcgtcctccctacggccgtagggtgcggcggcggagggggcgacgatgccacgctgcggagccggaggtccctgcgtgtggatccgggccctatcccagccgcaacgccacggtgcgcgctaccgttgtttggttcgattttggctgtggttccgatttcgctgtgggtcttaccgatt

SEQ ID NO: 45310 - DNA, 4179 bp, Oryza sativa
  unsure (1)..(4179): unsure at all n locations
tgctgctgcacgcgctgttcatcggcgccgtcttcctgctcgatccgacgctccagaggcaaatccacgaggccaagtggtacgagtacgccccccccccccccccccttgaaatttctccgaaatgtttccgtcggagttcgtgttattggtttctgtttgagctatatggagtcgatttgctcctagcttcgggtggcaactagggctctttacatgggcaacatttcgtcgggtcgtaattggcaattggcttgtgtcaggtcgcagcctgctttagttgagagcaagcatggtttttatgtatgccttctatctgcaatgccgtctgtgaggatgatgtcgtgaaattactgggctgagagccttccagcatgttataatagtgtaaattgtatttaagtttgatatagaaaaagaaggattgcgtgacatgtttggacaattagcatggtgtcccgcaaatggtgacatgggggctaagggcatattgcttggcactcatttgtttcgttcatcctattcaacacctgaattaatagaagttttaaatggaacaacatgattgccgtatgattttcaccaaatatgttgtctaaaatttgtagtttactatggacatgccagggtaaatctgcttcgaacaatgctgcagtagcattatatcatgaactttataataatattaatggataaagcggcatgttattgaccttgaaaactaaaaacaacatattttgttacttagataacaattcgatattccaaactaagatagtataagccataaagcataccgcatacacctgatggaaactgatggtttttgtttgtaatttagagattgttgtctcagatgttctagtgcacattttatgacttggacaaagtgaccttcataggaactgaataactatgctactagaacataagtgaattataaatgcctattgatcaataattcaatagatacaatgtgttgctcccttccttccttatcaagctaccaaggtattatcggaaccacaaatcactttttactgttaaaagttgatgaaaaacgtgtttatttaaaatattatatagtccatagaccatgtgcatatttctttgttcatcttgttgtccttgagctatatgtgaaaatagagcatcggatcaaaagttgtgcctatatttaaaaaagggaacatgtatgtttaacaaccagtgctgacatgatgatggcatcagcagacctttgcccctttcctataatccacatgcacgtacttcttcttctagcaggtccacgtgtatgtgctcagttctcatgagacccgtgttagccagcttttgaagttttaaaaaccagcagttatgctttattgacacatattttcaatgagggtccactgaatcaatggccagatgtttttttttccttttttgtgagaattcgtgattcttctctcttttcttagcacttctaaaaggcctttgaccaactcttatatgtaatatgtagtttttttttctatttttatcttagcacctctaaaaggcctttcactaactattgtatattatatatactacagctgaatgtcagctgatgctgtccagcctatttggaaactgaaaacactattgtgtcatttctctgtttatatgtatatctagaagaaattccatcacccctctatttaatcttattctacaatctgctttgatggcaggtacataattctatatgggttgctggttttacttaccttggtacaatacctatatacagccacttcttctccagggtaattgatccttgcggatgttgaagttttccctagatgatgacacttatacgttgcgtttacttgactcttgtgctgttagatatttacctgatatgttgacagctggctcaaggatgcatgcaacctttattaatacaacaactctctcaaagtaatgtcttactttatgttgttttgccttatgatatatatgtattttaagtgctgagcctgagtatcgtacaccacttatttatgctaaattaaatgcctttgtgattaagaaaaggcaggccaattccaaaagtggaagcttaaactctgccatgagtcgcagcaaaatagatcagcaaaatccacaatccactacagctttgttactacagcagacgatggatctatatcctcctgggacatccaccaggtacacctgtttatgtttggaatttatgctgctgaagtgtaatattcaatatcttttgtcatgtaatttctgtcctgtgatacagttgtatgcctccattttattttagggatttcacatgctcttactgccggctcatccaggtatctttggttttccaaatttggcatccagagatagtattaactgaatacagtgctccaaaaatatacaaaaacaaagataatttgacttgacataatgtaggtctttcaaggatgtaacaaactaacaatctgcattttgtaggaggtatgcttattatggtgattagtcttgtgttatgccaatgtactgaatgacaggaccagtgtatcttagattatggcatgtgccaatcgccctattttttttgtatctactaagttgaatgttggtctgccaatgtatgacatgaccagttatgactactagcatcctttctcatcagtgtgtccagtcttaagaccccttatgctttccaaagtccaaacgataatgagagtttctctggcttgatttttgagaagtcataaccatcaccagtcacaatctatctaattagaaaaaggtagacactatctgaaaaagagagaaggacacactgaacttcttttccttcatgaacacaccgtgctatgctcgttgttcttctcaattaactttgtaactgctcacatttgtatgcattatccatattttttagttactacaaatttcattcatactagcgtgtctgaagttttttgtcctgtctactaccttttgcagcctccacgcaccaagcactgtcatgactgtgataaatgtgtcctccaatttgatcatcattgtgtttggcttggaacatgcattgctaaaaggaactactgcagattttggtgagttctgaatttatatattgtgcagcttagtttgaacatatgcttctcaggtgcagcataatatcctgtgtggtgtatgtcatgcaatctctacataagcacccgagtgtcctgcttcagttaacatgtgtttattgtgagaaatcaattatttgtgtgctcatccatccattatttctttaggtagtcaatttgtgtcttgtcttaatttttgtactccaagtctctgtggcagaactgtagatcgagaaaacctgtatgaagataccaggttataacggttatatgccttttgcctaattatcaaaccatgccctcacactttcttcatcttgattcttatcaaggatttatttggctgcaattaactgtgcacggaagctgtgctaaatcattgccatgcctttcctttaatattgatctagtaggaattagcaggactgtgtgttcccagcaattcattcaacctatacctcccatcttccatagtccagaattctagaagtctgatgcttgttattgtgttacattttcttgaggaggttggtcagggatcatgttagtcttaattcttaggcatcctaaatggaaaaaaaaaaggagctaacatgcctcattgaaatgtacatataacaatctaatgttgttctattatatgactcatcgaaagtcttggcagctatcctcaggacatattaatgtttttcaggtggtacatattcgaacaaacagttttaactgtctggactgttgctttctacattcagttcttttatttgggcatcgttgtatcctggtatgtattttaccccttttagaccctatatgcacaaagatttttcagttgtgccttttagttggtctccagtttgattcgccagacatctcatctgagtatattggttatttttcatggacaggtggaagtttgctattggtattgtacttttggtagcattgatattaatcctcgtggtcctgctgcccttgttgatattccatgcgtnnnnnnnnnnnnnnnnnnnnnnnnnnnnnnnnnnnnnnnnnnnnnnnnnnnnnnnnnnnnnnnnnnnnnnnn

SEQ ID NO: 45311 - DNA, 826 bp, Oryza sativa
ctatattttgtgataaattttgaatgatagaagtcgctatattttaagcggtgtagaaaggtagtgtgagatactgcaaattattagggtattagagaatatcacaaattaaagctaaatactattggaccttcatgtgcctctttaagaaccataaaattgctctttttaactatggtagaagtaaatagtgaccaagataggcttttttggagatcacaacattaggtttaggcttgttggttagatttcttgtcacctttgcagtaggagtgccatgttctcttcataggacgacaagaacatcaagttggaaaggactatgataattgtgaaattgcagatgctcaggaacccacttaagaagaggaccctcaagttggtgtgcatatatgtgtctgaatgattgagtgatggataagattagagcagttgtacggggctaaacacacatggtgttgcttccttgcgattgtgaccggggagatctgatgctgatgacatcatgaaaattttcccaatttgcatcccaaaattttccaaacgaatggttgccaaaaagaaaaaaaagaaaaactgaattcatcttgttctttagcactgatgttttactgaagaatttaccacaaactcaatattttttctgctaagaaataactagaatgtagatagttcaaggatgtgtttatggaccttatggtcagggaggcaaatgtcaaatgtgcaattagttagtagggtttaggtagagttgcagttggagcctcccaggcttctctgaagaaaacagcagagttgctggtccagcatgaaaagtcaatgacat

SEQ ID NO: 45312 - DNA, 12736 bp, Oryza sativa
  unsure (1)..(12736): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtttatggaccttatggtcagggaggcaaatgtcaaatgtgcaattagttagtagggtttaggtagagttgcagttggagcctcccaggcttctctgaagaaaacagcagagttgctggtccagcatgaaaagtcaatgacatgtggggcccactttggagtgagagaaggctggcatcagccaccatgctatcatggatcttacctcatgcacatccttccagctcacacattttgacctctttacagagatagtagtattgggcatctgaaagtactcctaagttttatcaagtcaagatgctgagtgtgctactctgatgaatcctctctcgctttcacttcactttaaagttttgctcccatactgctgacctgatcctgacctgcaactctgcaaccacaggttggtagttagttgttgttattgttaactgaacaaaatacacctgtttgatgttgtaaagtttcactctgaatcttgcccaaatccttttgcaaagccttcattatgctgatcattgctattggagatttggagtgatttgaattagtatagccagcctgcagtagtaaactgcattcgaaatatgatgaaccattaaaagatgagtaacatgcagtaatgtattcggtaaaagaagaaagaatggtgaatgagtatagtagcataatcttcagtaaattaagctaagcaagcaaagcttaaggacgaaagcattaatatcacccagggtacatttcaacagtcgaggagaagcatcttatacagtggagaaagggatgatatgcattaactggccaaatctgaatgagtggttcttgttcaccagatgtgaaagtacatttgttctttgccttcagacttgaggtttttgagtacaactcttgaatgcaacacctgctcacttcagcagtttacactctcaagtacagataacagaacaccttgataatcatgattccacagttaaaaggttatgctgtcacattggatggagatagcatttgacattttggggctcagattgaaagaaaaaaaaaagaagctaaaatggattcagataactaagctcttaacttcctacaaagtttcttgattgtagcaggaaactggaggttaagaagcttatatttacaacacaaatacctaagataccaaagatacatgccacacaagaaattcagtggcctacaatttccacaccctaaatgcgaaggcctacataccacacaccctaagcattccagattagaaacccaaacttcaccaaatcaaactgaactgtaacaatttagttcagcatttcttcatatgctgatgagatcaggtggcggtgaagatggtgagtttagctgctgctgctgctgctctttggcttcattggcctctgcagattcagctggcactacaagatcaaacacagcaccttcaccactaggaggctcctctccttgcttcgatgtcggcttgggaagctcactgaggatctgcaccacctccctcattgtcggtcgctgcacgctctgctcctcgacgcaaagcaatgcgacgtagaagacgtgcatgacctcgtggaccggcacagttgagagcctagggtccaagatcttgatcacatgttccttgttcgagtccgtcatcgtcttgacccactgaacgatgtcgacgccatccccaaactcccctaccggcttctttccggtgatcagctcaaggagcacaacaccgaagctgtagacatcgctcttctcatcgaccttgagcgtatatgcatactctgtaaatccacaatcacaacacagtgcatgattagccaacttgaagacatcaattctcttctagaatagcaagacaattcttaacaagttaaaacaagactacaacagaaacacaatagtggtatatcaaaatcaagcgaatttaaaccatatacgaaggcagcacaaatgaaccaaagatcaatcttttacctggagcaatataaccataagagccagcaattgcagacatgcactctgatgtgccagagtcctgcaagaacttggcaagcccgaagtcagcaacatgcgcttcgaaatcggagtcaaggagaatgttgttcgacttgacatcgcggtgcaatatcggcggtgagcaatcatggtgcaggtagcagagccccttggcagcctcaacagcaaccttgtaccttgtgtcccaatgcaggtggccacccttcttgccatggagtagctccccaaggctgccattgggcatatactcgtaaacgagtaggttcgtctcattgttcgagcagaagccgagcaacctcacaatgtagcggtgccggatcctcccgagcgtctgaatctctgcggagaacccgtgatcatgggaggaaccacggctcatggcgggaagccgcttcaccgcgacatgttcaccatccggcattgtccccttgtacacagtcccagctccacctttgccaatgatgttctcctccttgagactatcaagcacatcgtcgcaggtgaattcgaggcgctggaatgcggtgagcttccaagcacgcgcctcactcgccttcttcagtgatcgggccttcaagatcgccatggcagcaaatgcaattgaaagggcaagcaatcctagcacaatcagcagcttgaagctattggagagtccaccatggctgcggccgccatggtcagtgccgggagcaccgggatggcatggcccgaggtacggcccgcacaatcccgggttgccgacgaaggatgtggcattgaagtagctgaattgccctgtggccggcacgagcccggacaggttgttgtacgagaaatccacggcggtgaggctttgcattgcggcaatggtggccggaatctcgccgtcgagctggttccttgacaggttcagatagttcagtatccgcatcccagagatggccggcggtatctcaccggagaggttgttcctactgaggtcaaggtaggtgagcagccggcatttcccaatctccggcggcacgccgccgtcgaacgaattgccactgaggtcagccttggacagctgctgcagccggccaatctccggcgggatttcgccggtgaacgcgttctgatcaaggagcaatttctgaacaccggagaagctcccgatgaacgccggcaatgctccggtgagctggttgttggagaggctaatctggccaagattcggcgcgccggtgccggacaccgccgggaagccgccggagatgagattatcctggagctccacctgagtcaggttcgggagctcgaagagaccctcggggatggagccattgaggtagttgtcgccgaggcggacgcgggtgagcgacgtgcacttgccgagggaggcggggatggcgccgaagagcgagttgccgagcgcgatgagcgtctccagcttgccgccggcgcagaggtccggcggcagcgtgccggtgaggcggttcgacgagaggtcgagcagctggaacctcccgttgcggcccagccggcgagggatcccgccggtgaagttgttctcccatagctgcagcacctcgaggctgggcaggtcgccgacgaactccgggatgtcgcctcgcagcttgttccggaacaggttgagcagggtgaggttcttgaggtcggcgaacgtcgccgggatctcgccggcgagcgcgttgttggacaggtcgagcgagctgaggctcgcgagcttgccgagctcgcgcgggatgccgccggcgaggccgttcacctgcaggaacagcgtgtccaggttcgcgaggttgcccaactccggtgggatctcgccggagaggccgcagttggcggcgtcgaggcggacgaggtcggtcatgttgccgagctcgggtggtatcccaccggagtagctgttgaagtagccgatgtagagctccctgaggctcgtcaggttgcctagctccggtggtatcttcccggagagctcgttgccggagacggcgaggtactggagcctcccccaccggccgtactcgggcgggatcccgccggagaaaaagttgccgccgaggtggaggtggcggagctgcgccatggacaccacctcgagcgggagcgcgccggtgaggttgttgttgtagaggtcgagcacccggagcgcgcggagccgcgacagctgcggcgggaaggtgccattgaggccgttgttggagaggttgaggtgggtgaggaacggcgcgaggcgggacagcgccgccggaatgggccccgacagcgcgttcgcggcgaggtcgaggcgcgccaggtgctgcagccccgacagcgcggcgccgggcaagccgccggtgaggttgcgcccggacacgtcgagccccaccaccgcaccccgcgcgttgcacgccacgcccgaccacgcgcacgggctcgaggtggtgttcgtcgtccacgacgcgagcgcgcccgtcgggtcgtcgagcgccgccttcaccgcgaggagcgcgtcggcttcgccaccggccgccgccgtcgccgccgccgccacggcggcgaggaggacgacggcgaggtggtggtagtggaggcgcattgcgcggcgcggcgtggcgtggcgcggcgagtggagacaagagagtgtgaggagagtgaggaggcaaaggtgagagctttttggcaatggagtcgtctcctctcctctcctgctggctgctactgctataaaaaaaacacatgtgattattttattttatttttatttttatttttgctaggaaaaagaaacatgtgatgttttgttggattttatgcttgaatttttactctctttatttatggacgttttttcctcttttcttgcataaagtttgtgttcttgttttttctttttggtttttggctggggatggatggtgtgttgctgttgtgaatttgtactggtgtctggtgtctttgagtgtgaaattgggtgttgttaactttttaggatgggacagacaagtgtagatttgtagttcaagtgttatttatcaaaagttgcttttctgaggtgacactttttttttcctttttgttgcttggctaaatatttggctgccaagtttcaaaaaggctaggtagcatttgtcaatagtaaccttgatttaaggtggtgtttggattcagggacttaactttagtctctatatttagacactaatttagagtattaaatataaactacttacaaaactaattacataaatgaaagctaattcgcgagacaaactttttaaacctaattaatctataattagagaatgtttactgtagcatcatataggctaatcatggattaattaggctcaatagattcgtctcgcgaattagtccaagattatggatgtgttttattaatagtctacgtttaatatttataattagtttccaaacatccgatgtgatagggacttaaaaagttttagtcccatctaaacagggtcttagcttgattgtgatcaatctaaggtatattattttttataggaaccttgcaacaattattgcaggattatgttggagctagtactatatttgtgtttaaggtctttgtttttaaattgaggttgttatgactttgtggccattttagacatgccgttttggcctacaatttcccctgacaaatgtaaattatcatttttctgaagggctggaaaaacaaactcatataccatgatctcatccctgaaatataccatgaacaaaacacatcactttctaaactaacaagacatcattccataatcatccttagaagtttagaacatgcacttaaaagagacaactgcatatttagtggtacatgcaagagccattttcaggggcagatatccaattaaaccctgtcaaattcatacaacgtccgggtcaggtaagacctcacatccaataccagttatcatcggcaaattcaacataactaatttttggagtggtatatgacacgcccaaaaattcactagtaatttccgaacttatttgtgcataaaatcctcgtccaggaatcagccgaggtacacaaactgacaatttaatatacagattcatcaaattaactaaaacgataaatacttacttaagaggcacttagtcctcaccatgaagaaaactgcagcggaaaataaaatctagcgaagctccagctccactcccacaagcagctcaactggggtataagccaaacgccttctccttctggatcctttttctttaactgaggttgattgattattgcaaggtgagcatatgacatactcagcaagccacacagcaaatatgcaaatgcacaaggataccaaaggatggcataatatagtctcatttgcgaaagcaacatttagcaaagagttaagagtagtaaaacaatagagtaattaatcagaaattttaatcaacactgaacagcacacccatgctgcacaggcccaaccatcctgaacaaccatacccggctgtacagatctaatctccaaaccaggagctaagcaaattattaccaggtataacatctataattattgtgagaagtgtgagactaatcacgaaaaacattgctcaacccgcccataaccgcgggcacggctattcgaatagttttactctggccagaggtgtaccactgtacccacaagacacagccccacaacatgtcaccatgtgcctcagtaccaccacggtacctcggaaaggagctgtgacattacccctcgcataacacaatccaccgcagcgcaccattcctgaatcataatcaccccctcaaaaaccagaggcatggactccccagccacttctcagtctggtgccccacaatgaaccatgctatacaaaaggtaaagccgttgcccacactggcttgtggttggcacggttaatgtttcacaatagtagctcgcgaaccggtccttaatcgtcatgagcacgactttcaaaaccatgtgctcacaacccacctttaccatattttagttggcaagtaattatttaaccaatcacgattgaccatcgtgaactatcattaatccatcattaaataatagtgaataataagttatcccaatagtgtgctaatgtttctaagcatggctaagcaatcatatctaatatctagctgaaccaatatatatagctcaactagttaagttataataacccaagatatcaaggaataaagtaatcaatacaaacaggccataacaaaggaatagattcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccggcgcactcgcgaaccttcacaacgacggaaacgacaagctaacacgcaaaacgaagaaaaagactaataaaaaccaaataaacaatacataaaaagtaaacaaacaggtagatcataattttagatgaattatgagacttgaacggcctcattctgacttcaaatgaatttattatgaattttacaagattaaatctaattaaagcccatttaaaaagaattaaataaatttaattcaatttatggacaattttaatatgtagatctttattttatacaacttttgcaacttgaaccacattaaactgagttacaatgaattagttatgaattttcaaagattaaatcggattaaaacctttatatggattttaattgaattatgacgcaataatgaattatttttgaaaaggaaaaggaggattattgcgtcagcgactagggtttgcggtggaccgggtgcacggcagcggttcacgggaatggacggccgagatcgatcctatccaaaacggacagccgagatcaaacggtccacgaccggctcacggggaacggcaacgagacgtcagcgatgacgtcagcactggcggcggctcggcaacgcaagctcaccggcgaacgacggctcgacgacgcgaacggaaggcaccaacgggtagagggcgacgcggcgaactcaccggtgaccaaaaccacggcggaagagcaacggacggcggcggcgacgaggaagaagcggcggcggtcttcgggtcgacggtgacgacggtgctccgacggtcttcaacgacggcgaaggggcggacgaggacggcgacgacttggcgatcccgacggtggccttcccgagtgatgacgacgaccgaaacgacggcggcgcacggctgaagcggcggcgacgacggcgacgctaggctgcacgaggctagggcgctacagacgacagcgagcaaaggcgagggtggcggcgggtagcggcggacttggggatccttttataggtgcaaggaggcggcggcgaaggcccacggcgaccggcgacgagaaggaaacttcgggttcgggagagagagaggaatccgattcgatctcgaatccacgaacttccaaagcgagatagacgatgattccaaaagagaaaaggtagaggagatcccgaggatcatttcccctctatcattcggccggagaaggaaaggatcgaccgaatttggaaagcgacgacggcggcggcgctagggtttcgggcggcggccgacgcgaggaggacgacggatccgacaggtgggacccacctgtcagcgacggcgagggcgcgcgcgcggctgcggactgggccggctgggccgggggagagagagagaggttttgggccgactttcggcccaaagccaaaagagacttttaaaaacctttttcaatttaaattattcatgaaatgcaattccatttattaaaaatacttccttagctcaaataaatcccagaaaaatctaggaattatagaattaagcaaagtatttaacaaaattttatctagcccaattttatattgagatttaacaaattaaaattagattttctcttctaggcttttaaaataaattctaataattccaattaaacaaaaatttatatatttgggatttttagggtgtgacagtatatcatttatgtttgttcatcaggttcaggtttagccattgtttccaagccgaatccaatgtgatccattaattctgatcatgttggtagctgctagctatgatgcaaatttggcattttgacagctctgtcggctaacttcatacagattcatgtatacatcttgttcattaaagtttttatttctctaccaacatctttgactcggcagaaatgcaacattgcattgtacgtataccagctaggtagattccttgtattcctccgaagaacagtgctgtatagtagtgcatcattgtacattaaaactccataagggcgatgtttggatgcagcataggaaaaatataagactagggagagagggagagagagagagggagggagggagggagggggacatgtttgagatagctgaaattgatggataatttatttttttaataactatttgagggtactcataaataagtgacttaactactacaaagttggaaaagttactttagaaaagtatttcaagaaaatttcatataatttttgtacacgaaatacattgtttaggagcttaggaagtgagcaaatgaaaatccaaaatccatgtaaacgaagaagattaattttctccaaaaatttctttgaattaattaaaccattttggagcatatatatgacacatttgtgtgttctaagacctctaaatagaatctctcaacctatttcctttatttcaaagagccatatataatcttcaagttttggcttttccttggaacactggaatttcacagcaattttaagagaactttgtgttcctacaatcactctaaaataacaaattagataatcactcgttctatctagtacctaacatgcaatgcatgatacaagtgagacgaagttcccacttgatatcgaacaaattctcacaagttagtcacaaaaagaacacgaacgtgtgcttggaagcatgaaggtcatcattgtaagtaactttgtttagtttaatgttcttactcgtaacaaagcatacactttctgttttataggttccttacttgagagcatgcacgcttctttttttttcttttcttacagaaaaagagcatgcatgcaagcttgatgactcacaaatgtatcatctttttctgctgaagcttcgacgattgttagctattggacactagcagctgcgctctgcctcattgtatgttgtgtttgaactgttagaataggtgtcgaatatactagtcttatttggttacagttagacttggagttataatatgtgttaggggatggagttagagtcggactctgtaactcagaaactctcttaaatagagaggggggcaccacaatgtaacgatggcatctacaatgtagcgtagacacgcaaggagatgatggcggcgaggccatggactcgtagcggctaggtgctatattggttggggaggagcgcccataatcaaagcctcggggatgtaggcttcggctgaacctcattaacaaatatcgtgtgttcctgtgttgtcatctagcgtatcttagatgatcaataattaaagcgatctagaaggttagtcatcgttccgctatatcgactaacttttataacatgaactaacatcaatttatcccttcaggtctcaactattacatttgtcaaaattcaccccaatttaaaaacgggtactagacacatcttaactcttaaaattgttcaaataacccctcaattcaaactaagctggtttttatctgttggtgctagcatgacggtacaatcgagagacccaggcccagggcactctaggccatggctcggggcctacggctaagaacccatgaaccaacattgattttcgcttgttaagctaagttcctagaaaattaccacaagctgacccgagatttgctattaggccatgtccgcccttaagtacaatcagacacaaaaataaaagaaatttatagacccacctgttagtgagcccttcatctcctccttttccatttgatatgcttcttccttctccctcattgtcccttctatgttgttgagatctccaatgtgtctctcctccaaggtactacctccgttccataataagttcatttttagctcaatcaatttatctcaaaataaattcgtttttagagtaatcattgcatctgggtttgtgaaaatagagaatatttgtattctgagtagacaaagtgatgaatagttgtattaggatttgttaaagtaaacgtattctagtcttttttattttgtattggtatatatgtaagaaagatgaaaaataaacttattttgaaacagagggagtttgtccaaggcgaactcagcttgccgagatcggcgaccacgaacgaagatccaagttcctccaatggattgttaaatatgtgatctgaattttggacccacagtatatccggattagttatctaataggactctagtttataggattagtttcctattatgactcctagatttctcctatatatatccttgtaagccttacggggagggtgcgatagcccaatgtatctcttgcgtttgtatccaattcctctatagtgatcattaccggccggcgtgtcggagcccaaaactaataacttggatccaactgagattaatgtatcaatccctggatcagtaaaaattgatacatacaatataactggttcttcattgcatacgttaaagtcttacaatactaagggttttacaataataggtactcacctatttaattagtacacagcggaagtttctatacattctgactagtgaggtataacctttagggattttctaagttatcggggtcttcgtagtaataatcataagggtcctcctcttgacccagatctgaaaaaggggttattagagcaaggatgagtattcacaatactcagcaagttatcacggaattatgttatgcattgacatataatagggttctttgcaaaaagcagtattggacaatctggaaaacattatagtagaatttataaaacataaaaactttagatttctaactagggtaccatatgagtcccggtactcaactccatgagtacggctattcgaatagttttgtagatattctactgcagcagatgtacgctttacccgcagtccacgacttgctgataattatcggctttagtcatggcccagcattaagtcattaacaattattgcacctgttccatgaacttatatcctcatatgctctgaacgtaatgttaacagcaacaagaggagttctggcattcccgaggtatttaaggggaactgatcgtatgacaccacgtcatcttgatcagggtttagaaatataccatatagtttatactcgagtatcacaaaccatttacctgtacatggtaatg

SEQ ID NO: 45313 - DNA, 3499 bp, Oryza sativa
tgcagtcaaattttagtttaaaatttaaggatgttacacggcgtccgtggttttttcccgcaagggttttccacgtaaaaatttatgtcttcgttgtgcatctatttcataacaagtggtatcaaagcattggagatcgatctaataccatctcggctgccgacgagttcgtctgcttggagatcctatctgcaagttttagccgccggtacgctcgtcgcaagatttgatcggcagtagcaggcgcgtgtcgtcgcgttgttccatctatcgctgccgtcagattgatttgtttgccgagataagattaaccggtacgaagcggagtcacccgtcgactccgatcgggatttggtgccgccgtgcagcgtgttggagaaaaagcagcaatccatctactccagcacgttgatcaaggaaagaaaaatcagcagatgcactcagccttgttactgttcatgtgaattgaatttcacgttggttttgtgcgcgtgcacatgccccttcgtaccagggattcaattcaattgcggtgcttcggttctgtttgggtgaatcaaattcaggttcaattttgtgctatgttcacaagccatgtttaccaggaagttgtatacggagatcaacttcgttatatgcacccagagtgtttcgcgtttctgctagggtttgtcaaattgtaccagcagattcaggattttattcccaaggtgagtttgaagtttgatctactgcttctggattgagatgcaatattctcattatgatgagcgaagtttcattatggcaagtgaagttttgcagcggggtatttacctaggaggagaagtatgctaaaaaaaaaagagaagcacattcaagtcatcgagagggagtctcgctcctgtctagatcacaaggtgatcaaattgtccggcgaattttgctaccattgtacccaacatacaaggaggttatcaggggatctaagtacttcattttgtgcacaagaatttttcgcgtttctgtttggattccagaaattaatgccagcagattcaggattttattcccatggcgagtttgaagtttgtgcatcagtttcgcgtctctgctaggttcagacaagttaatactagcagattcaggatttgttcccaatggcgagtttgaagtatggtctacctcttctggatcaagggtgttatggattatagtccaagtgactatttggcgcatattgatcttatcatcacgaggttttttttagagattgaagttttttatgctacaagggaaattcgtctcaaggtggagattgttaaatatgttatccgaattttaggcccacagtatatccggattagttatctaataggactctactttataggattagtttcctattaggactcctagatttctcctatatatatccttgtaagccttacggggagggtgcgatagcccaatgtatcccctgcgtttgtatctaattcctctatagtgatcattgccggccggcgtccgtagttttttttcgcaagggttttccacgtaaaaatttgtgtctccgttgtgcatctatttcataacatggattgcttcacaagcccgccatcctcttcaagctcctccagaactatgtgtcacctctcctagctctagcttcaccttccttgacaagttttgcctcttacgcctcaatatcgatcccacgccgtctgccacagtggatgaacttggtcacctttccataccttagttcttggcctctagtgtaattgcccactatgacgaagttaaaatcgatggtgatttcttaaacttctcttcatttttaagttgacggtgatttttagaaaaatgtggtagttgaaggtggtgataaaacggctcttatcccaattttagatacacggactgtaccatgacctgtaaaagaaaacggaggtaacattataaataggtaaacatgttgtgtgcaaattaaaaagctaggcattccatgcaatttgtcaagattcgagattgcccgtgcaacggtgcaagccagcaatcgcgatgagacatggcatgtgagacaaaaatatttggacacgagtttttgtggctatatatgcgcgactaattataatcaggtcgtcttccctgtagatcagggctcggtctagtgagcaaatcgatcactgtaaacaaatgtcactaatatgttagtgaagtggagtatatgatgcagtccccgttgatgctagtagagcaacagactataaaccagctataaatatattttaagaagataaaaaaaaagataaaagtagcgggctacatacttatagccagctgcagcacggactttaaaacgtatgtgtgtatgatatgtgggaccagatattgattgtgtagtatatttatatataactattgtgtaaattgattattaagttaactatagatgacatctataaagttagaaattggctattctattaaacttgctcgtactagtagctatgcctaaaactttgggttatgtagtgatcgatttaattgatagagttgcactacctcgagccagccgtatcttgtcccctcttccaacaaccacatgaactcagatcaaatactagagccctagttgtagttaactagtggagtatactgtactagtactactattagcaggttttttcgttgatgaacactacacgatctgatcattgatttagtataggcttaattagtgtttagacactcaagtactacaatactcctacattggaagctgatcgaacaaacaaatcttgtacacatgtccactggaatattgttactatgatcataattaagcaggttcatgatattaaagactcgagatttaattagaagactaattaagtacacaacgacactgtctgctaacagtttggtttaatttgcaataattcgtgaccggcctattacgatgaccatgatgtctcaacgccagtcgcagcagcagtacagtacactactggtggcgacataatatgtcagcatctgtgatcttgttcatctcatctcatcacttgcagggatcagtgccccctacaccattcatcatgtactcccataattaattaattgagacctatttaagctaatggtattattaattatatatttgattagtacattggagtacgtagaattctactgttgcaaaccacgccgatgcgtgctatcgataggagtaaaatactgtccgcgaagtctgaaacttgcacagtctttgacgcatgcttgcaggtcttcagaaaccacaagttcagaagaacccatcatccggccggccattattttaatctgccaatattccgtacgctgtcaaaagaagaagaaagaacagtcgaacaatgctgtacagctcgatccgcagaatcgatcagagtttagtacttactactataattgtttagcatgtagaattgatagaagtaagcactaaaagttcagaggaagtcaaggaagttcagaggaa

SEQ ID NO: 45314 - DNA, 12076 bp, Oryza sativa
atatatatatatatatatatatatagtaaatttgtttggtgctccatggtgcccgggcaccattgttgaaattgagtatatacccaattcaaatgagtatgaaactttttcaattacttaggtattaacattaactactttactaactagtttaaagcaagtttgaactgaatttgaacttgtttttgttagattttgattctaggtatatagcatccatacatataattagttaggtatgtaatcatggattgtgaaataaagttaaatttgagttgttttgttgataagtataggtatgaatcaaattattataactaggtatatactcacaatttaaaaattttgaaaaatttgagtgattttgtgcattagataccatggtgtccgggcaccatggtgccccatatgagtgtactatatatatatatatatatatatatatgtcattccataggaacttcaaaggaaaggaaatgattcaacccttataaaggatttcataggaatttttcatataagattgaaatcctccaaatttactatgtttttttttttacaagtcaaaggggtctagtagttagaataccttatagctagaaaaaaacagaagaggatattaagttacatgcaccagatagttcacatgaaagtttaaactgaagcataagctgaggagaaaagatagacaatttacttgtatttcaatagaggacgatacattgagatggatagcttaacatattacatatctgacaataaaaaatggccttccagaactgttgttgatacaaaccagaagataacaaatcaaatttcaaatactgagatggctgaatatggcggcccttgttctacaagttgggtcatctcagatgttgaggtaaaagatatcagtgattccattagacaaaatggggtattgcatcagcttcacagagcaaactacaagcctatacatctgctaaaaaaatatggttacatcattttgttttggcgtcacaggattgtgtacatactatcttctaccaccatctttcttcgaaaatatgcgcaagtttgcagtctgccggcgccattcatttatagggacctaaattcagtgggcacagcaaacatttgtgagtgaaggaaaaagttaaacatgtaatgtcatagctataaaatgaaaggcttactgctggaaaccgccatagtcaccgggtttctgaatatcctttgtcaccgaactatttgctgcaagccgaacctgtaaatggattgaggaaaaaaaaattgaatggttaaagggcctttagagttggtcaaggcttaaaagaatagattgagcaatgtagttaaatttgtaatacagataaacacaaaactgaatagagactgaagtagtattaaatcatgttagcaggaagctatgaaaaaagaacagagatgggaaaacagcacctttgaagcaatggagacgtgatcccgaattgccaccctaccacccaaggttacatagtcccccaatctgttgatacatgccaatgacacaagttactaaatctcaaaaagcaggcaaaataaacatttagtcaatgagatgaaggaatgcatacgttgcagaaccagcaattcctgcttgtccacaaatcatgcaacactttccaattactacattgtgaccaatctgcaagaggaactgtcaatttggacaacaagggcggcggaagtccaatcacattaagcagaatatccaatacctgaacaagattgtcaattttggtttcatctccaattactgtatctctccaactgcacttagtaaataatgatgaaaatttccgctcgcgggttaggttcaaccaaacatatattcacaaagaaagagctgatattacaaaatgtttggtatatttaaatcaaccatggagtggccaaaggaacatttgccatttcaaggctgacaaattacctccctctgtcaatacatgtattgcacctatctccacatgatttccaatttttacatgcaacatctggagaagcataaagcttttcaacatatagccatatgatgtttcaattgaatccaaaacaaaacatctaaatacagtctatgagagtgatagtcatcaaacatttgtatcagaagtacttctcccatgtcactggcattttctcagtttcttttttctgtatctctgataccaggtaagcacattgggtgaacgtgacaaatgaaggactgagcatttccttatccttttaatacaaaatgaaccctctttgcgatcctagaatatttcagctaaccatttcactgcccttccatttggaaactactaactcatcatcttcacagaacgtttactaagaaaagggttgttagagagtactagcctgcagtttcttcttaacctgtccatcatcccccacaaagaaaccaaaacctgaaacagatgcatcaaactaaatagcatcaggatgcaagttttaatgcttgatcggagtacataaatcaatatctactggagcatcaaacaagaatagcataaaaacaaaggaaacccaaaaggttgacatttaaatagatggactggacttcaatccacaacaataaatgtaattgggcaaaagtagtgaaattctgaagacagttcacaagttgagaattttttttcctagtttgacatgtgtgcaggtagcagaaagaatccaagattgcagcaatcttgctagttactagtaccctcactggcagaaagagtccaagattgcaacagtcttacttatccctcactgcatcgttgatatcatgtaatcgtttgagaactgaatacatagatgtatgctcaccatcttgaccaatgcaggcgccattgtggagagtgcagaactcgcccaccgaacaattgctcaaaacaacattgtacctgcacacacatcaacatcaagcacactcagctcactaccagcaaaatcaaatcaccaaatcaaacagaattcccccctttgtattcagatcgaatcgtagattagaaacaccattaccagatcctggttgactgaccgatggacacggagggcccgaccacggctcccgagccgacgacgacatccttgccaagaacggcgccggagtgcacgacggcgccggcctccaccaccgcggtggggtcaacggacgcggccctgtgcaagacgcccccgccgttgtgccacgggacgaactcccccgaagcaaccgccgcatctggaaacatccaagaagaagctaagctaagctaactcaagatcaagacgggaagcatatataggagaatataagttgattgctaccggaggaagcagcggaggcgccgccgaggaaccgcgcgaggcgagcggcgtggcgcggtggtgcggagagccggaacaccgccgccgccgccatgggagccgcggttctgcgcagagcggccgccatgtctaacaacggcggcgattcaaggtttgagcgcggcgttcgccggcggcgcgggtaggtgggtctggggactcggctttcaggcccatgggtgggcaaggagatgggccagcgtgctgggctaagaggagagaaaattgggctggccttcagcctgtagaataaagaagacaaaattggttatatagcatcaatgttcacgtttttttattttatagtatcgaaagataccggttcactttaatagcatctaaagtccacattgttttccgtccgtcttgattgctattgactcagccacgcacacggtatgatgtctctacccctcattgccatgtattctactcgggtactattaaagtgaaccggtatctttcggtgctataaaaccaaaaacgtgaactttagatgctactatataaccaattttcccaatatagaaatgaaggaatgccataagcctataataacttattgagtggaggaattaaaaaaaaagaaaaaaggggaggatgaaaaaggaaagggggagaaaaaactattccctttcttaaaatgtgccttcttcgtgtttgaaatttggtatgaaattattgacgaagaatttgatctaaaatataaaaacttctagtgtgctacttctcataaatcacttgtttatttttacctaatgttatccgcaatgcacccttccaggcttccactccccatcccctcatttagtgacattatatcacttttcttttaaccttaattcctccgaaaagaccccaaaagtctttttatggagtatattggaaggagtgagtaataattatttcgtttattattatgattattagttaaatttgaattatagaacttatttttgaatttgaatttttggttctttcatcgtagtgtattttatagcatttattttttagtcgctaaggacacatatgtataagttttactcataaataattttttatttaataataagctatttggataagcatatgaataagcgaaacaatgtggctggaggagtggaaagagtttagataaatttctaaaattcctttattttcaaatatagaaactgttagaaattgaaactaaaaccgaaagaaaagaaactagaagtgtgacaaacacacaaaaaaaaaccagtgacgaggcccacagattcatgaaaatggagaaagcagcatgaaactttagtccgcactcgccccaccgagcgaaaagttattcaagcccacagattcacaggtctttcatgtggttgaaggaatctcacggaaattaaacttagggcttgcttagttggcaaaacatttacccatacatgttacatcggatatacggatacacatttgaattattacacgtagtctaataacaaaataaattacagatttcgccaggaaactgtgaaacaaatttattaagcctaattaatccatcattagtaaatatttacttagcaccacattgttaaatcatgacgcaattaggcttaaataatttatctcgcaatttctcggcgaactgtgtaattggtttttttctacttttaatacttcatgtatgtgttaaatattcgatgtgacagtatgaaaaattttgtttgggaagtaaacatgcccttaagaaaatctgtagtacgatccaaatgagcccatccacaaaggaatactttaggagttaggacggctgacaaaagtgatcaggcatagaaaaatggacgaatcaactaaaatataaataaccctttgcatttatattattagtgatttaaaaactagtgatgtaaaatagactaaagaaaattccaaaattaattttaaaattacatttcggttggctacggctgataagccaatataacaaaatacagacattaacgttgatactccctcaatcttaaaatagagtaacatagtactagcatacgcacactttaggacaaaatataggaattcatggcaatagtaggttataggctgtatatgttactatattttactcttcccgttgtaaaacatagggattatgatgtgtcttcgttaattttggttaataacttaatatattttaggatggaggggtagaagttgtagaacggtgaaagtggttaagggtaagtactatgagcatccaagcacaatcttttagatgtcacataagctaaaatagtgaggtggaggagagaagagatgagagagataagcagccacctctcatgcaagaggcaaccactgtataaaattcaagacaaaaggagagaggggaagagtagactggacaaacaaacattggggctaatgtattaaaattagtatagatgtgatatattgtacatgttacctctacatttattagttgatgatgtggtcaagattagatacaacatccacctcttttataaaacttgccctaagattgatattttattttgaaggagggagtacacagtgggtctgttctgttattatttttcacggctgcggcacagccgacacgaacagagccgtactcagtgtgcgcagctgcaaccgcagccgcagccatggtagccgacctaccgaacgctcccgttgatggtcttaaggctgtgtttgggaggagccgacacgtaaaacgaagtacgtattattacatgattaactaaatattaattattttttaatttaaaaggattaatatgattttttaaaacaactttcgtgtagaaattttttataaaaacacacagtttagcagtttgaaaaatatgtgtgtgaaaaatgagggaggtgagttagaaaatctgggggaagaacacggcctaggcggtcagcagcgaattttggtgagcagtgttggtcggcagcgtgctctggattatggatgaaactggttcggatagtttccgtctgtccggaccatttttcggattcggatagtttcggtcggaattatccggaaattatcggattcggaaacgaattcggatatttttttctcggaaacgaaaacgaatacaataagggtactatccgtcggaatcagaaaacggtcggaaactatccagaatttttttcggatatccacaaacattgaacaaattttagaaaaaacacgtatatatacataactttttcatacgaaatcggatgaagataaactttatatcaatattgtagagctcgatgagatctacaactttattattgactattttattatttgaggtcatttaagggtctaaatattcattataatataccatattaattttacaaaatcttagatctacaattcaaacgacatctgatggagatgtgttccatatcaaaattgtagagcttaatgggatctaccactttgtagtttataacatttgtatttgaaggcatttaaagtataatacaaacattacaagttttgaagatgtgaagtaaaataaataacatctctaatttatacaatggtaagtaagttatatatctagtaaaaggtcttgggaatagaaaataataatcatatttgcatatggtcttagaggaaatcgattatcacatacggttgtgggaccgtctacaaaattgacgatataaatgttggagatgttgaactaaaataataagtgatatctcttccttgatcaagaaactcaatttgaggggttttttatataccggtaaatattcgctaccgtattcgttccgtctcgtattcgctccgtatctgtattcgataatattcgatttcatttctaattaaaaaaaataataaaactagttttcgtccgttttcgatccgttttcatccctctgatgccgccggcacgagcggaaaggtccctgcacagcacagcactacacctccgctggtagggtagccacacgtccgtcttgccatcttggtgtgccttggtgcttctgacacgtaggccaccgagtgagcattttatattttctacttacctttcggcaacgatttctttttagtttatttattattatcactcctcacatgcacatgtcactcctgttgtttatgttactcctatataacatcatccattgtacagtactagtaccatgtggatttttttatttttttagacttttttattttaaattttattaatagacgtttctaaaaagtatttccaaatcagaatcccgtggccaaataactttgtcaagacagtgttgttagctagcgtgacattcaattttcagaaatactttttaaaaagatctattaataaaattaaaaaaataaaaaaattataccacatgtcaatgtgtgttcttccgataatgcttgctagtacagcaagcagcaaccttagcacggaagaaatgatgaattccacaggatggattatggtttcttcggtactagtagtaattcctgtttgaggatttttcacaaaattatgagtttctccggctctaatttaaagagcagaaaagttcaacaaaagcatatgatataccaacttgactacgcaatcagcaggcagcatctattccttgcaacaaaagaatgtaccagtactgttccatccagatccgggcatctcacattgtcattgtcagctcctccacaattaagcaacctagccttaatcatctgcgcttcccaacgcccaatttgttcggtagtgataaaaataaaaatacaggaaactattaaaacactactaattgagttttaatttttttttaaaaaataaatttatctaaatattttaaaataatttctatatataaagtttttgtacaaaatatatcagctgtttaagaaacatgttaagagacacccaaataaaataaatctgacgtgtgtctctctttcttcttgttgcttcttgcaagttaaaccaaaccaacccaaaccaaagcagcagcagccagcaggaacagcaaattaaatttgtccaattaatgccatgtttagtttcaagatttttctttaaactctaacttttccatccaaactttactacgtataaacttttaactttttactacacacaaacttccaatttttctatcacatcgtttcactttcaaccaaactatcaattttgggtgaactaaacacagctttttttttcctggtttctttctgcttctgtgttcttacccacctttttttttcctttccaatttccatttcgtagtttactttacttgtttgttcctcctcttcttccctgacacgacacgaacccgaccacacgagccttctccgctcgcgccgccgccgtccacgcccatcgctcgccgtcgccccccccgcaattctcgtcgccttcgaggcgcgcgctggtccgccgccacgccggctgtgtgggggtctcgcttgcccagatcgcttcggctcgcctcttcttccccgacatcgcgtctccgcctttcctccccgccgccgcccacaggtgagctcctcgtatgaattctgagccacagcaattattttgcaaatgtgccaaggtagaaagcatcctgtagtacagagcaacaagcgatcttttcttttgcgtgggtgttcttcccacatgaagagacaagtgagcactggctgccagaacttatagaattacggtgcgcggacctcctgcctgaaggaagagataatcgaacaattgagggagacttggtgccaaaactttaattgtttatgagtggtctcttcccctgaagagttaagggaacaatggtaggaagacctagtactagaaccactgcagtaaaataggggctttactatacagctaatgaaataaatataccttgtaggataccatgctaatgtgtttaaattgtgttatcttctgcctgtgggagtagcaaacaatccacgcattttttttaggatccttccttttaagttgaattcagggcaatgcattgaataaattcgtttgatctgttaatttatgagcagcaaggcacattctagtttcgtgtgaaaaaagatggatttttcttgcgtccacttcatgtttctgtttatcttagtatgtttcatttttgtcttatgcctctgaatatcttttagaaatgatttctgatgttgacgtttgagttcactactcgcttgaatgagtttatacatcagcatttttttttatttatgcagctctgaccacaagtctggaacatttctccagtgaccaagtgctcacactttctgcttcggtttcaattatgaattctcagtgactcagggagccatatttctatgggaagagaaaagctgcgcaagcaacgttctggtcgtctgattgaaaccctcaaaatggagagggtcaggactatcctgactcatagatacccatacccacatgagcactcaagacatctcatgattgctgtatttgccatctggcttttcttcgtttcatcggataacttgcaaactcttataatgaagttggacaagaatttcaaatggtggtcgatgtatgcttgtttaattggtttcttctatttcttctcatcaccttttattcgaaagactatcaaaccgagctattcaaattttagtcgttggtaagcaacctcttgagtctgtgagaaggtaaattaagcaaaacatggtgtatttgttctctaaagccgttccctgctgcaggtatattgcttggatattcttggcagcattataccatctccccagttttcagtcaatggggttggatttacggatgaacctttctcttttcctcaccatttatatctcctctctaattttcttgatcgtatttcatgtcatctttcttggcctgtggtatttgggcctcgtttctcgtatggccgagaaaaaaccagagatgcttactataatccaaaattgtgcagtaagtttctttggatacagtaattatagaagtgttttttttattttcacctaatcttgtttagttaccacttatcagctgttccttatctatgtttttgcattttgtgctgtgttgcaggttataagtatagcttgctgcgtactttacagccactgtggtaacaaaactattacgagagataaatccattgaccgtagaactgctagctgggttgcgttctctctgtggaaaaaacatgatgacaattcactgatttcaaagctattgcgcatgcataagtttaaagagcagatttgctcatcctggtttgctccggttggctctgctagcgattaccctctcctatctaaatgggcaatttatgaagaagttagtattgcttcaccttctgtgtttctcttgatttttttttagtttattcttattttttttatgtttgctccagttagcttctaatggatccgggcattccaatgacatttcacctgtctactctttatgggctacattcattggtctttacatagccaattatgtcgtggagcggtcaaccgggtatgtcaactatcttaacgtatccacctgataactcacttgtgtactatggaaatttagaagacaaatatatggattctttcatcttgaaaaagcaacagttgatattggaaagggaactaacttcaccatttgttcatataacagagctgtatataatatgttaatgttcggttttttaactttcagctacatgaatatttagacatgttcacaatttcacatgcttatgaaatctaggagataactaaaaagggaaaaaccatgttcacactgtgtaatggccgtgttttgggttttctaccacaaaccagatcatttgaaatataatgatctgagttctaattcttttttgtataatggccaaataataaagaaactaattgtttccttggttatttagtttttctcaactcactttcttatctttgtttcattcgagttgcttatagatgggctctaactcatcctttgacaatgtcggagtacgaaaaattgaagaaacaactgaaaccagattttgaggacatggttccttggtactctgggtatgctgatgacactctacctcttgctacctcgcttggtgtacacagtgactaaatattcgtcgatttgcttgctctgcaggacatcaactgatttatttaaaaccgtttttgacctcatggtatctgtgactcttttcgttggtcggtttgacatgcggatgatgcaggtatgtgacctgttgaagttgaaacttgttcctcacttcctctttttattttggttgttagttttcagcttttccttatctcgtgaagtcatgatcccctcttcactatttttttcccactatgtttcctgttaaatggatagcactagaatgatatatatatacttccttttacattgtggtttatgttttcacttcctatcgaggtcatttgtcctgttaacttaaccattgatattttctttttaattcttgaccaggctgctatgaacaaaactccagatgaatctaagagtagtgacctgttttatgatcatcttgatggaaaagacgaactctggtttgatttcattgcagatactggtgatggtggcaactcgacttatgctgtagcacggttacttgctcaaccttctttagccataaaatcggatggctctaggcagacatttccccgtggacagctactccttattggtggagacctagcgtatgtttctat

SEQ ID NO: 45315 - DNA, 2319 bp, Oryza sativa
  unsure (1)..(2319): unsure at all n locations
agttttcttaccatgtattccttgtcattcgctgatgtgttctatttgttatgctaatgatgttttggtatggaatacccaattatatttccatgacgctactgtgggttgatctattgaaaaacaggactgacaaaatccacattgttttgagcagattggtttgatggactgcacacattcatgaggtatatctgtcataaaagttggctgggtgggtggttcctacctcagaagaggagttattttgccttaaagcttcctaatgggtggtgggtttttggccttgaccaagctcttcatggtgacattgatgtctatcagttcaagttttttgcagagctatgtcaacaaaaggtaagtacattgcgtcatctttaggctattagcaaattatttttgtggtgaatgctatggtctacatttgtgaatttgttgtttcggttcttctagtgaaaacacaatttgattgtagtacaccagtgacattattctacaggttagtaatatgtactagacgttgttatcatgaccagaaaattatgcataatttcacgtgaagtttaccgcgtgtgggttttcttattgactaatactacttgtaactatgcaggttggagaaagtgattctgtaattcttataactcatgagccaaattggcttcttgattggtactggggtgataaaactggaacaaacgttgagtatttaatacgtgaatacctcaagggaagatgcaaactgcggatggctggggatctgcaccattatatgcgccattctttcattgaatctaaagaaccagttcatgtgcaacacttacttgtaaatggttgtggtggggcctttctgcatccaacacatgtctttgagaatttcagagaattttatgggaacaaatatgaaacaaagattgcatatccttcttatgacgattctagcaaggtaaggttgattcctgcttgtgtgccttcagcccttcatttggttcattacatagcagagcttgccctttcatgttcatgagccgattctatttattgccaatttgacttctctccattgtttgcccttccagattgcacttggtaatattttgaagttccgaaggaagaattggcagtttgatgtgattggtggttttgtgtactttgttttggttttctcgatgtttccgcaggtgagagactaaattatttatgaattatttaattcatagtaaatcattttgcttatgcactatgtggttaatgtgaatacttatagcctagaaagaccatccaattttcatatgcacgaatgctatattgtaaagtccatgaaggattgttctccaacagcatattatatgcttgtctgattaaagtagtatcgtatatgtttggcacggaaaaataaccttggtggtatgagttcattgatgattatgccctgctacttacaattgatattggacatgacctatactctccagagtattttaggacttaagaataatgcctgatatcctctatatagttttgttttttgttgcgttgaattggatttaggaaaattattagggctttgctcatagaatcatttcaggcctattcccaagggcgcattaacatatctgagacttcatgaacatttctcataggttcatagttgtactttgtaggtttagttgcctgtagtctgctccatgaactctatggaccaacagttggtgataaataatgttcatctagacaattaatgtgcatgcaccatataatagaagctaaagcaacaagaaccacatttcaactttgggcactagagtatcaaatttatattagagcagtgctagaagtttctcaattactgttcttttgtggcctgacataagtatatattattttcagtgtgattcctttcgtatcttacgtgaagactcttgggctgaccgtgtcaatagtttcttcactgcaatgtggaatgttgtttttgagattctggagcattcctatgtatccctggctggtgttgttactctattgatggtatcttttttctttgtacccacaaaactatcgcgtagaagacgtgccttgcttggttttcttcatgctgtggcccatctaacttcagcagtgatactgatgctgcttatggaattggctattgagatatgcatccgcaacaatctattggcaacatcaggtcggtgtgttatctttctttttttttcatgcatcgttgcttgatatatcatgtaatgtttgtgnnnnnnnnnnnnnnnnnnnnnnnnnnnnnnnnnnnnnnnnnnnnnnnnnnnnnnnnnnnnnnnnnnn

SEQ ID NO: 45316 - DNA, 1680 bp, Oryza sativa
atggctggaggaatttgtgatcagctggagactaagactgagcttctaccgcttctagtggacactattagagggaagagtgtttttcttgtgctggatgatgtttggaaatctgatgtatggattgatcttcttcgatcgccttccgagagaggcttgaattctcgtatccttgtgacctcaagaaacctggatgttttggtcgaaatgcatgcaacttatacccacagggtaaacaaaatgaatgattacgatggcctagaactgctgatgaagatgtcattagggccatacgagcaaagaagagaattcagtggtgttgggtatcaaattgtcaaaaagtgtgatggccttcctcttgccatcaaagttgttgcaggtgtcctatctagtaagaaaacaaaggcagaatgggagagcatccgagatagcaaatggtctattcatggacttcccaaagaactaggaggtcctctgtacttaagctacagcaacttacctcctgaacttaagcaattctttctctggtgtgctttgttaccatcaaattttgggatccatcgtgatgctgtcgcttactggtgggtcgctgaaggctttgtgacgaaaatgcatgggtactcaatacatgaagccgcagaagaatactaccatgagctaattagaatgaatcttctgcagccaaaaccagagtttgttgacaaatggatgtcaacgatgcatgatcttttgaggtcacttggacaatttttgacaaaggatcattccttattcatgaatatggaaaatagcaaaaccttactgaatctacgtcacttagtaataagcaatgatgtaaaagaaatacctgctatagaagagctgaagtgcttgaggagcctcctaatttttaataacaagaactttaagacaattaataaggacattttcagagagctcaagcatattcgtgtcttagttctcagtggaacaagcatccaagtcataccagagtcagtgggaaacttgttgctactgaggttgctagatctaagctatacaaaaatcaaaaaactccctgaatccataggaaatcttaccagccttgaatacctttctttgcactgttgcatacatttggatagcctgccagatagtttgatgagactgtccaacataagtttcctagagctagaacagactggaatcgaccatgttccaaaaggagttgcaaagttgcagcaactctacaaccttagaggagtttttgagagtgcatctggattcagactagatgaactccaatgtctctccaatatccaacgtctccggattgtgaagctagaaaaagcagcaccagggggttcatttgtactcaagaactgtcttcatcttcgagaattgtggctcggttgcacaatcggaggtcatgataaaacttattatcagaccaacgagattgagagaattcagcaagtctacgaactgctaattccatcgccaagcttactgtatatatttcttgtcgggttccctggtgtaaggttcccagattggttgtgctcagaaccagagcgtaagatgccaaatttgggtcatatgcacctcaacgactgcacttcatgttcagtgcttccaccagcaggccagatgccagaactgccagtttttaagattaaaggcgcagatgcaatagtgaat

SEQ ID NO: 45317 - DNA, 9485 bp, Oryza sativa
agaatttccaatctctgtattctgcaggacttgtttgcacaggactgtccagcgctggatcaggcagagaatctaatctcactaaagagactccacatggttgattgccagaatgcaaagcaattcagaatgtgcctcctagaagaccaacaacttgcagtcgatgttgttacagttggtgcagatggcagggatatctttccagatgaaactctctataattaggcaggtgagaaaaactacatttgttagtctcaatggtttcctttccgggatctgtttgtactatggtttgttatccgtggtacatgttttgaaactctggctatagtgatgatttttcactactcccaatcaaaatatccttcatattgttgctcttcttgcagtggtagagtcaagagtggcgcgcgccaaggaaacggtggtactagtgtacctgaaatgttacaggaaacaattgaatttctgtggtaacaagtggtactcaaagtgcagtccagtggtaaatgcagcttggtgcagacctaacagcaggaagcaacaccgtttaccgaaattatagcttgaattcatcagcttgatctaaatgcaaaaattgagaacttggtcagcactgccgaaaactagatatcccttcaagtgaagttgccttactcaaggttaagactaacatcaatttgccactgctggagctgagaacggtgggtgcaagtgctgcctcaattgcagccatagtgtgatgctatctccaagattgtttcaggctgagcagtctctgagaacttgtgcagatttcaaatccaacgagtctctgaacatgcccttgtccagtaggctcctccgtgtaaatatcttgagctgtggatgcccaaactataagcagctagcatgaccaatagacattcccagtactcaatacaaatattttgcacatatattcgattagtcttgaaagtgatccgatgcaatatgtgaaattagttttgaaagtgagctgtccccatgcaatataaggcttcattgatttaaataccgattaacatcgtttgataaaaagggaagaaaccagttcacaacccccaaatccacgatgggccaaggcgcacaactcccacgtcacggcaggtcccccgatgcgcgccacgtgtacggcggatggcctccctccctctgtataagtagcaaccctctcggcctctcggccccccttcctgtgtgtggttcaggtgcccaaggtgatattcagattttctgagtgctcgtgtgttgtgcgatcagtgcccactgcccagttcgatcgatccgtgttgatctttgaaagaaagatgtcgtgctgcggaggaaactgcggctgcggatccggctgccagtgcggcagcggctgcggagggtaagatccgatcaccatcttctgaatttctgttcttgatctgccatgtatatcaactgtctagtcttggtgttggttagatgaaaattcgttggatctcggaagggatattgttcgtttgctagggttttttgtgtgctgtgatctgtagaggatttctgtttgtccatgttgttgatcttggtatgtattcatgacatgcatgttgtatgtgtcatatgtgtgcctctccttggatttgttttggataatagaacatgttatggactcaatagtctgtgaacaaatctttttttagatggtggccaaatctgatgatgatctttcttgagaggaaaaagttcatgatagaaaaatctttttttagatgatggccatgcatgacatggtctttgttgagagaaaaaaaagattcatgataggagattttgatttagctcccttccaccgttataaaacgaggagcatgcatgcagatgactgatgaggatctgatttcattttttatcccatcttcttataacagacaagaaataggctctgaatttctgattgattattttttgtcgggacggccaaagtaggctggccaatttcattaagattgggggaaacaaagttttaattacaacaatttcattaagattgggggaaacaaagttttaattacaacgacatgaaggatgtcgcgccggtctcaagcaaactcaagcccggaaagaaaaggaaaaaatggggcaaatcgggattactcgctagcctgggaaaaaatccctgctaccctccaaattgcgatttcctcgttgatgtcattcgctagccggtcaaccaacttggcgatgtgttgaaagatccttgtatttcgctctttccagataagccaacaaattagcatgaacagactatcgaaatccgtcctgtatgtgttctgaaaacgccgtcttgtcgcgatccaccaatctgcaagcggcctgacatcttccgcagtgattgcaatgttaatgttgcaccaacgtctcagcttgcgccaaagccgccgtataatcacaggacacaagcaaatgatggcagtcttcgttctcgcgttggcatagggagcaaatggcgtcatgcggccagtttctcttcgacaggttgtccgccgtgagacagcggcccttcagtgcaatccacatgaagaagcgaacacgcgacgacaccctggagtgccacagcgtgtccccgtaggaacagtcctctgtcgctatgaaaaatagatcatacgccgaggccactgagaaattaccatcagcagtcaacttccatttgatcgtgtcagccatctgctgcagtgacacgtcgcgaacttcatcccaaagttggaagaattcacccagagcttcattggacagggcaccttgtaatcggcgaatccatctgttagcaatcagggcatcagctactgtcagcttggcacggctcacatgggaaaacaacaccggccacctccaggcgaagcaacctttccctgtccaattgtctgtccaaaactgtgtgtccaccccatcaccaatgatgtgctcagcgacggatcgaaagatctcttccacatcgcttccaggacggaaagctgctaaggtccagggtctatccttctgctccaaggatttcgcagccatttcaaccggagagcttgaccgaacaaattaagatctttgacaccaagtccccctttctcgatgggtgatcaaacctttcgccacgagactaggcaatgcccgccgctgatctcttcctgtccttttccaaagaaacccgcggcacttccgctcgatgtccttaatcgccctcgcggtagctgcaggactgtcatgtaatgcaccggcaacgccattaggaccgacttgatcaagcacactcgcccatcaatagacagcattttcggcttccaaccggctaccttgtttgccagcctatcaaggatcggctggatctcggccttcgtcggtttcctagtggagagagggagtccgagataactgattgggaacttttccactcggcaggagagaatggattcaacttgctcatactgctgctcgtcccattggattggagtgatcgcgctttaggagaaactggctatgagacctgcggcagccctcaacaactccaggatacctttgatgactcgagcttcttcagctgtagggcggaaaaacagaaccgcatcgtcggtataaactgaaattggtggcaaattctgtcgtacgttgaggggcgagagcagtcttgccatccttgcctgggaaactgattgattatttgtacatgcagatgcaagatgtacccggggatggctgaggaggtgaccaccacccagactgtcatcatgggtgttgcaccttccaaggggtatgtgcactaatcctttccttcttcatatcctgtacttgttgttcatgggcaaaatccatgtgttatattactgaatttgttgaatagtataaggagagggaaatattgtgattattgacaccgttgtattgagtctcagggatcactatatatagaagtacatggtgtagagataagaaagaattacggatatggaagaagtccacgtaaatcaatcttatcctactctaactaccatatatatactttaatagaacagaattgagtacctccatctttctagctaccaacctcttttgtcaattatcatatgtttcctgccttttttccccttctgaatcacagagaacaaaagtacaaaacattttgttgagaggctcactgccttccattttacgtgtacgtatgacaaaattgcagcgctagctacagccaatgaaaaacgactaaaaacttcatgcacgttatgacaaaaactctctcctttatctgaagaaaacgattatgccttttactctgaaaactgcgtagcaacaatccaagatcgtttcatgtttcgctgagttctactcccttcgtttctaaatgtttgacaccattaattttttaacacatgttagattatttgtcttatttaaaaaattttgtggaatatgtaaaactatatgaatacattaaagtatatttaataataaatcaaatgataggaaaataattaataatttcttaatttttttaataagacgaatggtcaaatatatttagaaaagttaacggcgtcaaatatttagaaacggagggagtaattaattactgatctatggttggttaattctctgatggatgcagtcatgccgaagggttggaggccggcgccgccgccggagcaggagcagagaacgggtgcaagtgcggcgacaactgcacctgcaacccctgcaactgcggcaagttgaagcaagcaacctcctgatcaggaaaccaaggagatggaaggacctagtactgctaatctagtagtatgatccagttacgagtgatgagttgttgtcactgtaactttgtgtttcctctgtgagtttgtgatctaagacctgagactgaagaaatgcatcctagttaataagtgctaagaataaagatgttttgagacatctatggcgtctgtacgatgatagtccttcctctccagtcttgtggtgtgtacgtaattaagaatgcaatgctgtgtgtcatgtatgctttctatctagtgaaactgaactagtgagttggtatactaattttgcttttttgcttgaatgttgctttaatgtgacttgtgtcactggatgtttatcttgcttgcttggatgttgctggctacacgaacttcatctgaagttcatgctggtaaagaatctagctttgagcctgcttggactaatacactacaaaatgggctgagcccatggatttgtgtaccacatgtctacaactctacatcgtgtttaacctcagtgggctggataattccttcatgtttctcgaaggaagaagtacatcgaaggtccctcgtcttatacctgatatttgctatcctcatcttataggcggttttagttttggttttattcaacgtgacagctggctgcgggggagcatctgggcgcaggcggcggggggagaagctgcgcgcgggcgagcaggcccctctaccccaccgtcgccacgctgctcacgctctccgacgccgtctgccaccacggagacccgggaaatcgcgcagctccttcccgtccttgccaactccgacggatgaaggacgacggcgtcgagcctgatctcgtcacctaccgccaccatctgaccatcaccgcctcgttgctggcgtcctgtcccttgcggactccgtctccatcttcatcacctattgccaccatcttcttgttgccgccttccgcgccgctctaacgggaagagccccgcagccacggcggtggttggtcgcggcggctgcgcctgtcacccccgcccaaattattcaggggatcgccataattctcgtcaccagcaagggatgtgcgtcgccggggctatgcctataaacaactacagggaccagctctacagctatggcgattcaaagagttcgtgtaagcttttctgcagcaaagaatgccaaatgcaaatactactttgattgtgcatgcaggacacggatgtctgctgatctatgaacatacacatccacatgaacaaaacgagctcggccacgagtgcttcgccgacatcgccagaggattcatcctgctcatcggctttgcgtggccatgtccaccctggcgacggagaagctctaccgcatgctcggcatgtacgaggtgctcaccgacatcaagtcggacctcgaatccctcttcacaggatacgcgcgcaacttcttctccttcgaggtcaccagcatcgtggcccagctgggcaacaccatccgccatttatcgatgcagttttggataagaataagggaaggggaggggaggaggcagcgtcgggaggagggcttcgtcgggacgctgctccggtgctcccgtgtcaccgccgtcgtcgcgtcgccacgccatcagaggctgttgctagtgctcctcaccccgccgcccgagcctagctgctcccctgccggccgccgcccgtggccagctgctcccccgccgccgcccgtggagagggaaggagagaggtggagaggggagggaaagaagaggctgatgggtaggatccgtgtgggtcccatgctgagtcagatgtcgcgttgggtaaaaccagagtcaaaacccccgaggactcaaagtgattcggttttataagatgagggatggcaaatacggagtatctggttttgtggttggaggatgattttgtaatccgatgacaaaatgaggggcatttgatgtactttttccatcctcgaaatacaatccaaatcgacttgtttggcattcgaggaaggggattgggagtttacacgagggaattgatggtgagattaagaggggaatttgatttttaatcccaatatcttgtttggtagaggtaatggaaattgatagggagtttagttggagattaagtcattaatgaaaacggatggctgagatttgtttaggcaaagtaaaggaggaatccctcccaattaccacctcctacccaggtattgaaaaggagagagtttcttcgtcaattctctatctccattccactaaaatttttatgtctcccaaccaaacaaaatagttaatagcctatccctctgaacttctaattcctcctaaaaacttcctccaaccaaacaggccgaatgttcctcgaaatgcaatccatatgttcagagcttggaaaaagttcacttcttgtccctcaattatggatcgaatttcctttacatcacttagctgtaaatcaccactcttacggaactaaattttctgacctccacgtcgccctctctcgcgagcggcacggagggcgaaccctagccctcgccaccccctccctttctctcccacccctcgccgccgccggagcgcgccgccggagttccgtgcggccagccgtgagggcggtggcgaggcctttcctccggcgatgacgcgacggctctgcgcgaggacgacgacgcggcgtgcgatgggcgggcgacggcgacggcgacggcgcagagcgaagcttcggatccggcacccccgtggctggatccggcgccctaccgccggagacgagcgtcactgccgttcacggcggtgtgacggggcgcggaggaggcggagcggcggcgcttgtgctggcggccagcaaggtagaggccgaagtgggtgcgacggtgctggccctcccgcggcctgtctggaaaggggcggcggggagcgctggacccggtggcggctggcggcgcaggctgcagcggcagcaggcaggcacgacctcgtcggcgccacacctcccccccaccccccactcgtcggtgcgcgcggcgcggatagcaacctcttctccttcccctccccctagtatcctcgtttgtgtgccctctcccccctagttccaaacatcgctggtgatcttgcccttcaacttcttctcaatctggcgtgcttgtttggaaattgtgctcctgtagccgcttggattacagtggttctatgccctcctccaaagttgtcgttgatgttcttcctctgtgagaatccccttggccatttccccttctattagcccctgctcgtcttcaccctcttcctccagatgtccaggaccgcaaggatcagtgtttctccctcctttgaggcttccttcccttgaagggcgttggagagagttgatctaacaagcaacttgataaagcctgattgaagaagacttaatgtgggtggcctcgagccgcaacctttagtggcccaccctcctttggggcttacttccccaaaagggcgttggcgagctctgatacaaacagcaacaagatcaagtcagcttcttgatggcttcatgcgggtggccttggacttcaacaacattcccttggcctctcttttcttccgacatgcttgtggctgtgtgaggaattggatgttgatttgttggggtttagcagtaggttttggattttggcaagatgattttgtaggtgtcattcatcaattgtaatcttttaggaggttttctttctctgttctctcctcgttgtattctccgtgtattctgttctcctatcctccaaggcccttgcgcttgcgtaggtaaagcttgccattcaggtggggattctcaccccccccggtgatttagtcaaaaaaaaaacttagctgtaaaacagctattgaaaccagcggaaatacagtccttctcgagcacgtggcggtgacacctggtagggaaatttaactgtttgccacttttaggtttggcaattatccaaataccatttttaggtttgcagttatttttttcccttcttaagaggtggtctcttaactatttgttacttttgtccacgtggcatgccaacttgacaacctatattgaagaacggtgtgagacccactcgtcagtctctccttcccccttcatctctctctctccccccacgtccatggtcccccatcgacgccggtaccgccccgccgtcgaccaccgatggcacagcctcacagacaagtagaggtgggagtggaggacgacgagggagatgaaaaggaggagcgtcgtcaccacgggcggatgcactagaacgacccagggtgcgcggcgaagacgcgagacgacgtctgtaacatcgcgccagaggatttggggtgaccaccgctgtcgtggggaggaggtcggcgtcgtcaaggacgagcggcgtggagattgctagcatggggacagcacaacggtgtggcgccgtccttgatagggaggatttggggtagccgccgctgtcgatggggagaaggtcggcgtctttgaggacgagcggcgtggaggttgtcagcacggggatagcacagcggtgcggcgtcgtcctccttctcgtcatccccatcgtcgaaggcccaagcagcgtctggtagggttccaatggtgggaggcagcaaggggcctcacagcgtcggctgcgagcggtgccatcagtggtcggttgcagggcgacgttggcgtggtggggcagcggagc

SEQ ID NO: 45318 - DNA, 2311 bp, Oryza sativa
tattttataattattaaaaaacaagaacaaatcatcaacctataaaatttaaataagtttatatattcaatgatttaaaatcttaatgataaattttaagttgacaaataataacttcttaaaaaataatcgatataaacacatgatggcctaggcttgtgagctagctcggactcgactcatttcagcaacgagctaaataagaggcttgggcttgacttgtttaacttacgagccgagccaagctcaccaagctcgagccaagctcacgagcccaagcttatttttccactcctacatacgagtccagagtccagagtcccaacaccagacgagctcgagctcgccggctctgggaggtcacagcgtgacaggaggtgctagcttcgtttttcttttttaaaaaagtgatattaatcaatttttcaaatttaaaatgattaattaatcatatattaatactcggctcgttttaagtcttaatccccttaacacaccttcttaatcatttagcattccagtcaatgtcaattttcctttcgtcgccacggacacactagtttgtccggcatgtatatgctcacggcatgtcggcatataagtgccacttttccagaaaactcaaatcatttcttaaatggatatcttcttatttttacatgtcacttaaaagtcatcaaggaattttcagagggatgctgatcacttggggaacctgttggcagactttgtgtttgacaagcttttgacagaggccctgcttaattcccaaaacaaaaattttttacctatcacattgaatattaggacatatgcatggagtattaaatataggaaaaaaaaccaattacatagattaagactaatttgagagacgaatcttttgagcctaattatttcatgatttgtcaatgtggcgctacagtaaacatttgctaatgacatattaattaggcttaatatattcgtctcacagttttctggcggaatatataatttgttttgttattagactatgtttaatacttcgaatgtgtgtccgtatatccgatgtcacaaccaaacctaaaagttttccccaactaaacaaggccagatttcactcttcaggttggaaattttgagtctaactagtttgtaaagtacacgagcggtccttaaacttgtagggatgtatcatttaggtccctaaactcttaaatgcttaaccagagtaaagtgcattggcggtccttaaacttatagggttgtgtcatataggtccataaactctcaaaatgcatatccaagtctcagaacttgtcaaagtatatcatctaggtcccaaattgacacatcccctctaggatcttatgtggcgctgatgtggcaatgccacatggacatgacgcgctctttgctcttttttttcttcttttcttttccggctacttctcattcttatatttttctttcttttgcacggatcacagacaggagaacaacgggataaatgagaagaaaaatattgtgccacgccatgtccgtgtggcatgccacatcaacgcctcgtaggatcataaaggggttgtggcgatttgggacctagatgacacactatgacaagttccggtacttggatttgtattttgagagtttcggggcctagatcctatgcactttactctctctcttttttattttgccccctaattttgttggtctagctgtttctacagtggaaggctatgttatcctcatgtatatattaacattctatttgttatctccttgaagagatcaaggtttggaggggtggttgttacttgttacttgttagggcttaggaattcaattcatgtgctgaaaggttttgaaatttatatactgggtgaggttgaaggagcaattgtttttaaccagtttttggatacataatctcgtagaagtaatgttgaagaaatttatgagtcaacaaatggtgaggagcaggaattcatatatattctgaaagttccctaaactcttatctactcaaactgctgctgattctgcctaaaattccaagaaaaatttgtaatatttataggtgcaaaatgcttcttactagcgctcatgagctcgtaagctcccaaccatgtgaaaactaaaggaataaatccactttgactccctcaaatataggtcaaatcaaatccgtatcccttaaccgtaataccagatatcttgacccccctcccactattaaatccagtgcaaaatgactctctcggtggttttgaggatagtttccactaatgtggctcgttcacctagtccaaccagctgagtc

SEQ ID NO: 45319 - DNA, 1117 bp, Oryza sativa
ccaaaagagtcattttgcatattaaacttgtaactaggtgtaatcggtgtcatgcatgcagcaaaccgacagggacatattaaacttggacccctattcgggtctccgcggggagcggggacaaggaaaggaccatctccgcccccgcgaaaattgacgggggcatgtcttctcctatttatgtccccgtgaaaaaccaattgtaaccatccttgcttcctaataggtgaattcaccacgagaaaacggtgaacatctctaggcatgccccgccacacccagtgaacaacactcgacatgaggaagatgccgcgcgccaaacattggtgaacagaaagactaacggagaactgtgttttgtcggttttgggcctatttagttcgcgaaaagaaaatttttggatgtcacatcggatgtttgataggatatcggaaggagtttttggacatgaataaaaaactaatttcataactcgtctgtaaaccgcgagacgattgagcctaattaatccgttattagcacatgtgagttactgtagcatttatggctaattatacactaattaggctcaaaaaattcatctcacgatttctcccctaaccgtgcaattagtttttttaatctatattgcattattgcatgtgtttaaagatttgatacgatgtttttgatagaaaaaattggggaaaccaggcctttgtttaccggcgcagggagtcactattcactagcactgaaaatatgtcatcacctcagggagcaaaaaaaaaaagatttaagaaaaaggagatttttagagcacggttggcacaagagaattttattaagataatatggagttcaaacgtaataaagtcattaaacggttagcaagattaaaaaggttgatatagcttgacttaaaaacaatactgatttgaatttcattactaataattaaagataagaaaattacatgcatattcacttgcagtatgtaagtagagaaattacaatttaaaattacaaagaactaccctgatcacttttcttagtaataaatttttagagcacattactctcatggaacatatgcaaatttcaaaatctgtctgttacggtaaaagaagcaactgg

SEQ ID NO: 45320 - DNA, 6814 bp, Oryza sativa
atctagtttcatcgcaattcgtccatttcaaacagaacccgtggcttcaccaacgaatataagcatatttataaggatccataacgattccattgctagccacaaattaccataaacaagacaacagacaccggagaagttgtctagttcaagcagatgcataaccaaaaccaagtcaaatttcgcatgaaacaccaaatctaaaattatagctggctaaattactgctgctttcaccaaacttacattcatcatagtggacagtttcagtccaaatacagcctagtcttgccactgttcgttcaaaccttcacatggtcattctgcttccctgcatcaggcaaaataaggattcagacataactcagaacacaagttattcccagcaaacaataaaataaaataagtaccatcataggtctcatgacaatgaattaaaataaatggtcaaatggttaagaaattccaatcgtcacaagagatcgggtgaaattgctttatgaaccaccgaatttacatactgcagttcggtaacatcgtaccatgaaaagaacatataaggatttcttgttccagaccgtgaagctacctgagtccagtgcatacttttgtaaaatataagtattgtgttgcgccgtttaaccaagcacagacttgttgacagtttaactcaacagaataatcaccggatatcaatctaagctaaccatgaggcagaccggtaacatcataccatgaaaagagcatatgaggatttccaattccagaccatgaagctaccctagtccggtgcatactttttttgtgttgcgcaattttaaccaagcacgtacttattgacggtttaactcaatagcataatcactggatatcaatctatgctaaccatggggcggacgtcccatatgaacaggtagatatttgggttacattagcaatggaaacaaccttaatcacagcttttgatgatttgatcaagcgtgccaaataaaagagccacagccagatctgaatctaatctagagcataaatgcaggatcgcagttgtatacaacaattgttggcttgttaaacatagttccagattaaaactgtattcgctagttgcctacctaaaataaaaaaaactcaaatgtttaagcaaatataatagataacctaagaggatgattactactccgtagttaactagtacttacttttgtgggcatgtgtactttaatggtgtataccagattaataagggttgggtgagcacaggggatggagcacagtccctaaggaacaatacatcgaagcagatatctacactatcttaacgacagagtcaagtggtacaaaacaattcagtgaaggctagaaagcaacttaatgatcagttataacctttacagagtaaccccccccccccccaacacacacgcacacaaaaaaagagaaggaaatccatgcagaccataaatgaccttcatccaggttgcctaatactaaactgattagtcagctaatcaaattctcaaatgcagcttcctgacaatttgtcatgtcataacttgggtggaaaactatactgcattagtcagcaaatcgaaatctcaaatgaggcttcctaacgatttctcatgtcacaacttgggtggaaaaaaggaagactgcattagtaagcaaatcgaaatctcaaatgcagcttcctaaagattttctcatgtcatgggacctgattgagcagcaacgtaagggtgtaaagaatggaaagtgtttgaagcttacatagttaaagcagcaacaaccggcgaaggatgagccaaatgacgagtccgatcaataagtttgtaaatctgtctgtgctgtttggttatgacagtataattattgtcctcagtgtcatcccctccaacctgagagtaggtgcgatgaacgatacgcgctttatgcagcttggcgtctggaccaggagtagcagcagatcgaacgtcgatggaagagaagatgcccttccccaaggagcagaaaagctgccctggaacaatgcccttggacaccacggggatgttgaggatggacaactccgtcttgtgtgaccctgaacttgttggctgtaaggggaagaccctgatgtcgtacactgcagcagcaccgccattggctatggagcgggcaatgaagaggtggccaccaaggggaacagccttgccgatgaaaggcaagttgttggcgtccaccatatcccactggttggtgtccatgtcgaaagcgcaggtgcccttgtcttgctgcacggagagcagtatgtgggagccgaccacggcgtaggaggcgacgcggacctccggcgggtcacggtactcgagcgggttgaggcggacagggaagatgggcggcggcggcaagtggtgccatcccatggttctcgcgtcgtgaggggcgaccaagacgtagttgaggtcgaggtacacgaaccagggcaggaagtcgaggccgggcacgacggaaggggttcgggagagcgcatacagcttgctgccccgcgggatgaggacgggccggagcttatgctcgacgaggaaggggccggggatctccatcgaggtcttggggtcgtacaccgtggtgaacaacttgccgccgacgcctacgatccggggcccgtagcgcgactccacggtggcgaaggacatcccgcggacgttgtgaagcacaaggtgggcttcgccgccgccgccgccgccgccgagctcgacgatggagtgcgcgggcacctcctggtcatcgtcgtgctccaccgcaaggtacaccggcttcccggcggcctcgcgaggagaagcacgacccaggcgattaagcctcagtcccaccggcgccaccgcgccgtccttccccttactcctcctcttcttctggctaggcgtcgacattgtttggtctgggacttgggatggggaacggcagcggcggcgagtgcgagtagacagagaaagaggaaggaaaccctacataggccgggtcctcctcctcattggcccgagtgaaacggcccatgctccgccatggcttttgaatcggaagtaagtccactttgactccctcaaatatagctgcaccgcatatccaacagcctctccaagtgactttccaagccaaattttagccattattataaaaaaaaaagggggttaattggatccatgctattgcaacttttctaaattaaaaaaataccactactattcgtcatatcagctacatatgccactcgaaatgtctaaaattagaattatgtcactctagtcactttttccgtcctgctctctcacgccgtctttgttcccgtccttatccccctccctccttcccgtcctcccgctcccaggtcaccactgctggggacaacaccaccaccgtcgtcgtagcctacgcaagggtcggcggcggcggtgcaagaagacgaggctggcttgtggttcctgttcgctctcaccgactcactgagaaggacatcatctcggacctcttctacgaggcgctcatcgcagcggtggtggcggctgcggctgctggcccaggcgccgacagcgacggcgacgggcataaacctacatccacgaccaaacctatggagtaatccacacttgaacacctcgagacccctacaccttctccaccacccggaagcttcctcgccctcgccacgcacggtcgctgactgagacggcggcggtggcggtgtcgccgcatacggagacggcgtgcctccccatgaagccgcccttgtcagtcgtcggcctcatgtaggaactggtcgccgccttcctcgtcgtccccttccgtctacggtgcccatcacccgctcgtccgccaccaccaccgttgcggcacccactctccctcacgagcaccctctccaactcccgcgtgatccactccacctcatatatgtccaacagcatcatccccttccccggcgaccgcgccggtagtggcggctgcggcggcgaaggaaagccttgcaaggactacgcggcaatggtggaggaggagcatggcgggccaagcgcagcgttcgatgcgccacacgacctgatgccggcggccaagtcgacgcacgcgttttgctcagggcagcaatgatgagcctggcggatggcgacgacaatgccggggacctgtcggtgctcgtccgggcgaggacgtccagtggcgcggcgcatcagaaggcggaggcggcggcgccacgtcgtcatcatgctagtgcgatcgggtcgagcatatgtggatttgttcggattcgcccttgtcgtcgtcgatctgactcactcggacctccttgcctagttcgtcttcgacgtttccctcaccgggaggtccaccgcggtggtcgggatgaggacgggaacggagacggcgtgagagaggaggacggaagaaagtgactggagtggcatggttacaattttagaattttccagtggcatgtagctgatataacaaatagtagtggcattttttcaatttggcaaagttgcagaggcatggatccaattaacccaaaaaaaagcatcttccaacagcgtctccaaatggccaaaaccttccctccactagccaaacatggccagccaaagtcactagtcaaaggtgcgccccacattcattcctcctcccatctacacattcttttcttcgctggtgctcgttgctgttagtcggctagcgttgacgacggcatggagcagagaggcgccggagctgcctccctccgcccgcataccccctgttgtcgtcccaatcttccctggagacaggatgcctccgccgcccctgccgccgacgatggcatggagcaaagatgcaccggagctaccttcctgtgacatcctggcccaatttggattaggtttgttatgcccatgtgagttgtgtgcgcatatttagtaccaccttactagcttagtatgagtggaaccaacttataaagcctattcccttcaactatatcactctcgggttaacccttttacacgaagcgaggacgaaagtgtaagtggggtggtatgtgtaagtgggcctgcccgtcggatgggctggctacgcggttctggagggacgactgttacaaatggtaccagagatgacccttgcggttgcacgtaccggtcagtgtgcaggcatatggcgcatagcgatgtgggatctgtgtgatgcattgcctgtgtggaaccaacttataaggcatatttggatgtgtgcgcatgtttactaccaccttgctagtttagcatgagtgaaaccaacttataaggcatattccctccaaccatgaggcatattccctccaaccatgagtggaactaacttataaggcatatttctccaaccatgagtggaaccaactaaggcatatttagatgtgtgcgcatgtttactaccaccttgatagtttagcatgagtggaaccaacttataaggcatgttccctccaaccatgagtggaaccaacttataaggcatattccctgcctccctccaaccatgagtgggaccaacttataaggcatattccctccaaccgtgcctccaacccgttacaaatggtaccagagacgacccttgcggttgcgcgtacgggtcagtgtgcaggcatatggcgcatagcgatgtaggatctgtgttgatgcattacctgtgtggaaccaacttataaggcatattccctcggttgcgtgtacgggtcagtgtgcaggcatatggcgcatagcaatgtaggatctatgttgatgcattgcctatgtggaaccaacttataaggcatattccctctaatcatatcaacttataaggcatattccagccatatcatattccctccaatcatatcaacttatatggccgttacaaatggtaccagagacgacccttgcgattgcgggtcagtgtacaggcatatgacgcatagcgatgtaggatctgtgttgatgcattgcctgtgtggaaccaacttataaggcatattccctccaatcatatcaacttataaggcatattccaaccatatcatattccctccaatcatatcaacttatatggcgcatagcgatgtaggatctgtgttgatgcattgcctgtgtggaaccaaccatatcaacttagctgtgtgcatttgccatgtgagctgtgtgcgcatgtttactatgtttagctgtgcgcatgtttactatgtttagttgtgtgcgcatgtttatgttaacagtgaaatttggtaagccccaaagtcaccatcagcttggagtcaatgtcggcttcaaagttctagaatcagccgatgagagtcaagtcgccacgatgtcgtgttctcgatggagtcggatcaaagagttcgagttcaagaaggatgcggcatggcagtttatctattaattaggaatagtttgttagtttccttttgtctttaggaaagtgtgtttagtgtccgataaggactttatgttttccttttatctttaggatagtttctttcttgtccagcaaggacttgtattaacccatgggtataaatatgtgcacccggggtctatgtaatctatcaatctatcgatcaataacactctcggtgcatcgccaccctcttccctgaggtttttacttctcttctggcggaatttgggcacctgacgcggggctgcattggcttttgatctccagcgaaggggtaagtcctacattccgtcgggccctagtgaatctgtcatctacatcggcgtcgttcaaggctgcattgttatgatctcttggatcactctggtttggttgatatatt

SEQ ID NO: 45321 - DNA, 7461 bp, Oryza sativa
tcctgcagccccaaacacaacccggcgaccttgaacactttatgctcttagaacacaactgttccattgcaatcatacaaatcgcattattactgtaaaagtgataacaaatcacgagatgttcttgaccatcatcagtgagatctgatgtatatcactactctacacaacagctaaagatcaataacaacaaagtggtattttagctggagtttgagaaaagagagtggcccttcatgcacttctcaagctctcatagctgttctggtcctgaactccgccgtattacttctgatcatctctgtcatttgggcatacattacaattttgaaactgcactttagtatcccatcaaaactgaaaaaaaaaagatgatctaagagctgcaaatatgtatgtttagaacaatgaagaataaactgattttacattttctgattgctttactcggccatcacatggatcttgggctcagcaatatttatgaataatgatgttgtggtaggtgtatcatccaagaacatgaacatatcacttgtttctatatcatgctgctgcagtgtccctattagaaatctaatcaagcatctctgaattccatcaaattacaactacaattgtgacataagatagtgccgatgatagatcacattttattcaacgccatgtcaaataaatacaaagtcaacgtgtcacattagccgaaaccaccatccaaaatcatcttgagactatagttgcactcgttttggaaaatgagggatgtgttggtactggttttaggtttgagtgacgcgatccaaactcgagcattacatgagtgacttaaattgaactttttccgcgtgagaactagcaagtgggctgggccgtgtccaccgtgccgctagcgggccggtccgcagaagacaaaacaccgggccatgtcgacacggcctactttgtcagttccatcagacacaaagccacaacaaaagtctaaacctctagctacccaaaccaaaccctaatttctcttctcaaaaaaaaaaaaaaaatccagcggcggcggcggcgcacatggatcagatggcggagcggcagcacaagaagcggaagccggagaagatggccggcgcgcgcaccagcggccatgataaggaggaggagaagaaggtgaaggctccttctgtgtacctggtggtaggccatgaggtgagctgggcaacctactccgtgttcaaggtggatccctacgcggcggcgaagagaggcggcggcggcggcgacgaggaggatcccgctccggtgcctatccctcgccggctcgcccgcatcagcgccaagttctgcatgtctttcgcccccgtgcccgtgcgctcatggatcgtcggcgtcgggggcgattcagcggatgaggactacgccccggagaccatcgtcttcgacaccgagactcgcgccgtgatccgggggcccaacctcctgtcgaccaagctccacccggttgtgctcaccatcggccacaagatctacgccctggcacggtatccctccgtcacggggcaactcgacttcgttccatggttcgaggtgcttgatctctcccaagcgcgcgtggtcgatggccatctagagagctgcgagtggaagcccctgccacggcctcccttcttcccatgggacctcaccccattgcagtacctttctccgccaatggttactgtcgagtcctacgttgcactggcctcctgcattctggtgtcattatctcagcaggagggcacgcacatgtttgatgtcgacaaggagcaatggtcgaaactggatgacaacagcctgccattcgtcagaggcgccgttccacacggacccatcttccttggcttatcgagagccaagaaaatcatcaccgcatacaatatcacagtggtctgccaaccaaggtcaggcggcacagcgccgtccttatcaattgttgagttccctgtggtgtctgacatggaagaggagatcttaagcacaccaatatttctttctctcggtagccctggcttctgttctttgaaaagttggagcgaccacccaacgacggatgatccatgtactcgtgcacgtatcaatttgatggcataccatacagaggaacccatatcacaagagtacatcgagtcttctcatggcttattgataccgaaccagtggaaacaggtgtacgagatatgtgattcgtccagggaattgatttggcaatgcctgatcactgcaatgtccttatgagtaagcccctttgtcacatctagtccctggagtcaatggattgtggatttcatttgatttcttgcactgcctgtttatttacaactgcaaccataaagcatctataagatgacattactgctaatcatggattaacaccttagcacggtactgctacaatgtatgtcaggattgttggttcggggtgtgtatgtttgacattgctatgcctgttattgatttgcgatagtgaccacatagaccttgtcttcataatactgaagataaatatcaatactggctttagtttatataagacgacataaattgcccagagctgtctttttttttttttgatttttagtttttttaggaagcttctcatatgttagttctgtaaaggtactcgatttaagatttgtatctacaaaaagcaacaatctacaacagcaacagtatatttgtttgctgttaattagtttgagaaatatattaacattgctcaatcctgagctcaaaaggtaaaagcctactaatcctccctaatcttgccgctctttatacatgttaaccattggcgtctttattcttatatctcgtgttgtttcatggctttgagcttgggcccattaatgtgaatggtgaggcagcagagttatcattgaccatccttcatttctaggtcataaccttttctagactacataagcgacaatttttgttgtaaacttgtgatggcttttcatggttttgatttacacatcagctgtttactactagagtgattttagttgcactcttaaaatatttcagatggaaaaagaaaacagatattatagaagaagctgggggtgatctatcactctgcaagattgtatgttgctagctgtatgtagatatatgttgttttcaattttctttgcacgatgatggtggttatagattgatctctttactcgtgtacatgattgttagatcagaggacgaatatctctttttccatttttaacttaatcttgtagcttacttagtaagcacccatctcctggagccggtgcaacactataaaattcaaccacataccacaaacaattgctatatgtctacaaatatttttcctggattgggagaacactgcaaataatataactagaattcggcaaaaggatcattggtgctgaagctcctattttgttctatggttgctacaaccatgcattgattttttatctctttctttggagattataaggcatgtgtagaaagctttggttgcatgcttttattaccagctttgtgtggctactgggctagtggctatattcataaataggaaagcacattagctccaggatgtgatgactgatgagagcacatatggtgattggggaatgcagtaaggtcgtaaattctggcaataaacttgttatgacttaccttgcttcctatggtggatattagctccagcagtaatatgcctttaagttgaaaatagcattcgttttagtttgatgttgtcacatgcatacctgcttttttgtactgtatcataaaactgaaaaaaagtattccagtaagcccataattcaatcagtcaataatatatttacctcatgaaatgtactgtttgtattgaagctgcttgtattagctgtagtatgttatacatgttgcctatttatgcagttaatcgtttggaacccactcattaagtatgccgtcttttttggaagtactttgttcaatgtgcagggaaaatgttgtgagagctttgttgattgaacaactgtcattattatgctatttcgtctatagaaacatgttttttgggcatttcactattagttcatcggttaaaaaaactcatacaacattattgggcaagcatatgcttcctataatctttatcagattgccaatatcattgtttgttctgttgtggccttccctgaatctggtatgttgggtaattacaggtgtataatcttacgaacactacaaagtaatgtgagtttgtttgtgttaatcacattccacatgtatactgccttaatctagctcattttttgggtttaaccgtttattggtagcagttttaatatttactctattttacatataattctcaatattttatggttccacaggtatattccatgatgttggagccaccagaagtttattgtagaggctggcttaagaaaacggtttacttgtagcaccctacaattccagtaaattcttcagagtacaacagctttgcatggcttcgaacttagggagtagtgctgcagggcatcttttgcttgtgtattaagtggatttagaatatgatatttgaggagaaatgatcccctgtagtatctatgctggactgatctaattgaacctgtctaaaagagtttcatgtatgaaacagctgtacgtatatgtgatgtgacgtttaatcattcgtttaactaaaaaaattatataaatattatttactagcaaaatatgcccgtgcgttgcacgggtgaatatcaaacaaatatggtccttgtgtacttataacacgtgcaaaaagatattgaatttgtacatattcaaattttatacaagaaaatatcaaaacatctcatactgtatacacattcagattcaggttgtatctcaaattttatagtacatgcatgagatattctaagttttctacacattcagaacatactccaactttcacaaatgttcacaagagggtgtagttacagctctgacttcaccatcctctacaaaaggaaaaaggtaaaatgcatctgcaataggaaagaaacatgcactttgtagtatcataataaattcactcaaaaaactttagtggaatatgttcggattatagaaataatttaatatttaagaaagtaataattatcttgacataaaaccatattaacgcttatcaaatacaatataacataattaataatttctagataattttttagtttggttcatttatctaaaaataatttactgagtgatcaaataatcgatcataatttcgtagcaattttaaatggcttaaaatagtgccaaacaaatttctgtaaatctaaaaataattaaatcaattccttagaaaaatactggattttcgcttaaaaggctcgaaccggcctagcactgtgcggcgcgtgctagtgcacagcgacccagccgataggcgcgatcgcggcccagcgagcagcgcaggcgggccgttaatttctgtggcccaaagcgggagagaggatggccgtccgatccaatggacgtccaagattgcagccgctccagtgaaattgccgtcggatgagaggggaaaccctagccctcgttcttctcgttttctcaatcccctattcccctttctcccatgagcgagcgagagagagaggcaacgacgatggtggtccagcaagtgagaagaggagtatagggtattaagtagacttttgcatatgcgggctgaagaaaaaaaataggctgaaaaaggcccatagagaaaaaataatttttatttaaataaatgctgaaatgatatttgtattatcaaaattaccaattaagctatgtaaattctaaaaaaattgcaaagagtgtaattaatatagaaaatttaataaaaactaaatccaaccataatattttatttctcacacttactttacttgaaaattaatttaattatatacctacctccttaaaaataccctaatattctagaaaatgtgtatttcatttaattagaatttaactagcaaaatgcccgtgcttcgctacgggtataataaaaggttaaatgctatacatacaccattaacatgtatataataatgttccaacatagataaattattcagtgggttaatgataatcaggactgataagaaacactattgcatattgatatactcatattttcataacatgcactctctctcaactcttgcatggcaagcgcctaatataattatttctaaaatcgaacatggacttgcgtggagatgaatcattttcacggctcatgcgtggacgatagatggtgcggactctaatatgtcgtgttttgcagatgacgaaaagaaaaaaaatatgtttaattttcaaattaaaaaatggttcattataagatttcagaatcactaaatatctgttgaagaaagaggtgcaaaaacttctgattttttagccatcggattcatggcaagcgcttgatataatttctaaaatcgaacacggacttgcgtggacacgaatcattttcatggctcatgcgtggacgatagatagtgcggactctaatatgtcgtgttttgtagatgatgaaaagaaaaaaaataattatgtttaattttcaaattaaaatctggttcattataagatttatcactatctgttgaagaaagaggtgcaaatagatggcgcggactctagtatgtcatgttttgcagatgatgaaaagaaaaatataattatgtttaattttcaaatttaaaagtgggagggaaagtagacttattctgagtaggatttgagctgtgggaggcaaagtagacttattccgagcaatgatttgagatatgggaggcatagtagacttattccgagcaatacaacctaggaaaggtgaagtaatgagatgtgggaggcaaagtagacttattccgagcaatgatttgagatatgggaggcacagtagacttattccgagcaatatagccgtatataaaaaggatggatgatgggaatcgaaccctggtgggcaggttgaaaattttctccaccaaccaggtgggcaagctactacttgtgattgatggttacattactgatacatatcatatattaagcaaggttttggagtagattagaaaacttccgaccgactattaagcggattaaaacgtattttggcaagagggagacggacgaaaagaagaaccggaagtcttacgtatttttttattattaggtatatatatatatatgttttaattcaattttctctttttattttcttttcattgcaacgcattgtcacttttgctaaaattttaaaatgtataattaatattgtagaaattttgtatttcattaaattagaatttaatatgttttaatttaattttctcgttttttttctttgcgttgcaacgcacatacaattttgctaatttatataacgttacctgaaaaaaaaaa

SEQ ID NO: 45322 - DNA, 1775 bp, Oryza sativa
tgtcaatgttacaagtagtgaaaaagaatgtctcatactccatccgttccgcaacaactcaacctaggaagaaagggatttgcccctttaggacagagggagtatggtatagacacatgaagacagaccacaaagcatgcagagacttccaaaacatgaaaaaaacaatagcacggatatttgagcaaacaccaccaatacgtgcacacctttccggtcatactcaactaaacgtgattagcacgaagctgtcacgaactgagataaaccacatattccgaacacatcgagcaaactacacctgtgctgtgcggctgttctgaacacatattgtcaggcaagttcaaccaaaacgtgattccgcacaaagctaccacgagttcaaacaaataaaaacattaacagatgtctgcacagattttcaggcatgctcaacaaaaatgctattcagccaatccaagttgtcatgaatagcagatgtatgagaaaatcaatcggtcctactcccagcggatgtatagccaaccccagtttctccatcaaatcaaccacattgtgttccaatgaaaatccagcccgccctctttgtgtgtgaggtaacatcattttaacttcctgaaccaaacaaggaaaggataattcagagattggcatttgcgggatagaaagcaatagaactgttgatatcatcaaatatttaataccagaaacggaagtgtaaagacaaaacttactttcttgacttcatgtatggttccaaacttttttgaatggcacgcaagtacgttgggtagcgggaagttaaaatataatctgtccatgacaaacgaaagggggtgataccatcctgcagagagtagatataattagaataggaagatattataacacataaaagagtatcaaattctatccttttacctttaatgccttttcaggtatatgaacatcggaattcctcataaaatcaaactgtaagataccatttttagatggttttctcttatccgttccaaccttgttaactttcaaagccactttttttgaatccaaattagcaacgagctttagatactcattgtcttccgttctgttcatccagcagtccaaatacgggatgtgcttaaataaactatcacgatcatcttcgctaatagctggactaatattggttttatattcagtgtgcaaattgaccaataatcctttcttctctttagctgacattaatgagctgctgtctatcactgattcaagtctcttcaaaggattttcctttaaatcatgtagatcaccttgcagatcagccggtatcatttccccaacaaaacaacttttaaccaactcaacaacctgcagcacattatttattgcttcatcctcctcatatgcaatcacttcaagttgaaagaacttgacatcagatccttttaaaagaattttcctccttctcagaaggtctgttcccatcctcaaacatttccccaaagagaacaagttaacaaggtgtgacagcatggaacgaataattgccttagcaatatttcgaacaaaattacattcctcatcattccttgacccaacaatatgctttatcttcagaaaagaattcctctcgagaaattcttccaaagtcaaacagaaaccttcaaaatgtgataaatccaagccattctccaaaaaaaataaatagttctgattattcaaagcaactgagtggagagtgcagcatccaagtttatcatttggcacacagtaatatatatctggggata

SEQ ID NO: 45323 - DNA, 14463 bp, Oryza sativa
caaaatataacgataaagaaacaggatatacctattttatgaataaccgtgtttaaatttgtgttcaagacgaaaaaaaaattaaatgtatattataatttgtattgctagtattattcagatatcctacaaaaggacttaaattttctctaaattcagagaatctccatggtgcagatgcatgatagaccacaatttatcgctaaattgtttttatgttaactattgctgtgtcaatgcacttatcgtactgggaaatataaatagaagtgcaactatgcactgccaccaatgatcaggtaaagtattgtgaccataggactaggaattgaaatgtgcaatccaaacaggtgattcagaatactccttaactctctaacaaatgagatagaagccacgattgaacagaaataagatacagtggactggcacatattggttgttactgcattctatatcctatcctaattcctacattcctatacaagtataacctatgtaggaaattatggccataaagcagccttctgatgcagccacatcaaccgttcgataataagttcagcatctgtatacgcacataaattaggcccatatttacggctaggcccagccagcagactccacactctactaccccgtcaactacactcatgtgactcgactcacaaccatttcttttccttcactaagtgcaattgtaaaatagaaactgacaccatccatggttaatcccatttatcctctctgcctctctataagattcttgtaattcctatgctcaattgatcattaatgcgagaagtcatggttgagtaggcaagcagacagtacccattgttattatcctctactactatcatctatccttccctccctcagtcttgagaaattatcaggtaaactcagtcccttacttgtctgattttacaacaataaacaatttatagtttttacaacaatatgttgacatgtcaatccactacgccatgctaggtaccatccatttttaagtaccggacaatcattcatttaatgcataagaaattaacagttacctgactatgaagtccatccagagcttgatctcagtctgagccatcataagctcggtggacatctaaaagcttgaggcagaaatttagcgcaacataaaagcagttcacatgttttaagtttaggaatggaccacacatgctatatgattagggatgaatcaataaactaatcaagatcaggaatggacgagaagtttatacctcatcaagaaccagtggattttcactgtcgcatgcagggatactagtgatctgggtaatacaaaaaaaaaatctcaggacaagattatacatgaattatgaaatttattgaaaataaccagcaacttcttaacaaataagttagttgaataccttgaaaatcctgaagtaaacagaatctctactctttgtgaagacatatagatctgaagctgcacgctcatcttcttgaactggagaaaacatctgtttaacaatatcagatatggcatttatatacacgctaaaaactgaaccaaaaaattgaataaaatgagttcttaccatcattagcatctccttcacaagagcccaagtttcatcttcaacaaaattggatgaaaatgaaagtaaaggatttgttactttcacttccatactttcatctaggaatgctgcaagaaattttaattgttatcaatatcatcatgtagaaatcatcatagttatcaatattataattaattactgttgccaatcggattatataagtgtatctgggttttatgcagtggcagatccagaaaattggttttatccaaatctgccctggtttcatgaaacattttgtaacaaaatctaccgttctttgaaacaaattataaaacctaggattttgcgttaagaaaaccccaaaacaagggttttgaaaattttactcttatttaaaattgtaaaaaacattgaaattacctggatttataagaaacgatatgtgaatctctttcaatgtattgaacatatgacaaatcatcatctgatcaccttctgcccactgacataaggaaaaaaaaagattaccttaaatgaatgaaaataatgttatgcgtgtaaaaaaaaagcagattattcattatacctcaaagaagagacaaaagttgcatctgctccatttaagaaacacattgattttgtccgaaggacaagcatatgcctttccttgaccatcataaggaagcagaaatgagatgtttctcaagagagtcccatacctattaacaaatatcattttagatatcaactaaaattgcatttcatacatatatatttgtgtgtatgtgttccgaaagaatttaccgccgaatgaggttaggcgtataagcaataaccacatttgaggcacggggtctattatttgaattcttattttcctgcaatgaagtacagaaaagttcagagaaatgtgccaacaaagtctgcaatgaagtactgctatgaattcaaatacagaaaagttcgaggtagtagtgtaatccttgctgctgcagacaatagagtcttttcctgagggaatcagtttccttagggggccaagtcttacactacaagtcatagggggaagtcatcccttagccagcaggttgcctcccacaatccttgcgcctgcaggaaacacgcatcaccatgtaccactcagtgtagttggtccttgtcaacgtggggtagacgacagaacctgagctccacttgatcaggcgatcgacgatgacctccttactccggcgcacgtggcaaggtaggggcaagacggagagccaccggttgcataggtcttcagctcttatggggagtgacatcatgccaggggtgtagcctcacccttataccacttgttagctgcaacagaggatgtagcaaacacgtgcgagagagagaagaatcgacaaaacgatgagcacacgtgttttggtgctttcgtataaaacttgcagcgttttctgcattctttccttcttttttttttcctttcttgcaaaacagagaatgtggacgctatgtgtacgatcccgtagcggcgctcccgttcgcgcacgtcgaacccaacggcgcacgaccaattcattcacgcgcccaagtttattcctaacaatagaaccctagatccctaaatttatccatgtccaatctgagttttctgaatattatgtgagaagtctgaatatgtgcatccatttcgagctcgggccgtgacaggaattacctcctcaagcttgcgtctgaaggcacgagctcttctacctcgaccatgtcgcagcctcctgcccccaccgccaccagatctgctgccggagaccgacgagcccatggcgtccttcctcctcctcttggcctcgactcccccacccccggctggcgatggggcccttcgcttgttcgcagcgcgtgtggcatccgccttggcctctccgacccggccgcccggatcgcccccgccgccgccgtccatgtcggcgccccgccccgccgttgttttttttttgtcttgtttaatctgctgagcagagagggcgtggtgacgtggtgtgaagtgtgtgatactacgagaatatccccttcatcctcgtctggatgggccagtatgggccgatgcttcattttctatgggcttgtgacgtccgtctcaaaatatcttggcactgggcttgttttaaaaagagaaataagttcactttttttttgcggggagaaaaataagttcacttaaggtcccttaatttgttgctcagtctgattttcgtcctcagttcataaaaccggatacaacacatccccaacttaccaaaaccgtgcagacgaggtccctcggcagtattgtgcccggttttggatgatgtggcacctacgtggttggtttgactaggttctcgtcccatgtggcattgacgtggcgcttacgtggcaattggatcttaaaaaaataataaaaaactatggaacccacctgtcaattacacacaaaataataaaaagggtggggccatgttgcagaggtcgcctccagcagcgggctggggcgaagcgagttgcggcggtgtgaactcctgctcccaccgcagctccccgacctcccgcggctgctgtggcgtcggcgataacaaggaggaggcaaaccgtcagttagtagcacaccccgagagttcaatctaaggggtcgtggcgcggagaagggcacattgatgcagcacgcattaacttggagaggcgtaggacacgctggaggaggaatcggggccagaggcgaaggaggaggagacgtggagggcgatggcgaccagcgcggcgacggcggtgatggtggtgcccgtcgcggcgagcgagaacaagccaccaccgcatcgccgcccgctgcctcgttgcagtggcatcgcatccgccttgtcatggctaccacacgggagggagggagggagatggatccaagcacgaggggtggtcctccgatgaagatgttggcagcgaggatgaacgggaagatgcggtgcatgaaaacccccttcttcgccgacgccgcctctggcggcgacgcggggtcgggcacgacgacgggcatcgcgacgggtgcggatgggtcgcggtcgaaggacggaggcgaggcgactgcttctgtgagcctgaaatccatccaccccccctcccccggtgccaccacgccgccggtctcctccaagaagacgcctgcggctgccgccgcgccgaccatccccaccgcaacgcccaccaccccgccgacgacctcctttccccagtcaaggcttgcctccttgccccatcgctgagtccctcacccccgacgcggcgcacgccaagccgccgccgccggagctcggactgcccgcctcgctcacctgctctgctgcccacccgctctgctgcccacccgctcgtttgctgctcagaaagaagaagaagaagaagaagagagagagagagggaagaaggaagaggagaggattgaggatgaagaagagagagaagggaaaggaaagaaggaagtgaggctgacatgtggggccacgtgggccccaccatttttaaaatactttctgtgagtagctgacatgtggggccatggtttttattatctttctgcaatataattgccacataagtgccacgtcaatgccacgtggaatggagacctagtcaaaccagccatgtaggcgccacgtcagccaaaaccgccttcaaaaccgctgagggacctcatttgcaccggttttaatagttcagggaccggttgtatctggtttttgggttctaggacgaaatcggatttggtgtactcaaatgaacttattcctttaggccccctttgaattggaggaaaaatggaggaaaaacaaaggaattgaaatcctacactattcatgcctttgatttgtaggaatgtgaaaaggtaaaacgtaggaaactttcctattcctacaattctagagtaaaaacataggaaatttaacatctactctgacctattggaaaatttcctttgaggccccctttgattcaaagaaaattcataggaattttagaggattttattcctataggaatttttcctacaaagccctttgaatcaaatgaatgaaccctattgaatcttatgaaattcctatggaatgcctcttcccatacaagttttggaggaattttaacatgaggtagaacctcatggaagaaatcctttgagtctttatctctcctcaaattcctgtgtttttcctatggtccaatcaaacggtcattcctatgtttttcctgtgttttgcaatcctctgttttacacttacattcctgtcataatcatatgtttttcctattcctccgttttttcattcctatgattcaaaggggccctaagtctatctctctcatctgattcctgtgtttttcctgtggtccaattaaacggtcattcctatgtttttcctgtgttttgcaatcctctgttttacacttgcattcctatcagattcctgtgtttttcctattcctccgttttttcaatcctgcgattcaaatgggcccttaaaaggagaacttggcactaaggctaaagttgaaaaaagtacatgcgaccctcgtctttcaccgaattacaaaatcattcctaaaccaaaaaaccaatgtatgacattcctcaacttataatgtggctttgtttttgttttgttcgacgtgggtcaatgtgggacccacgtgggtcccataggcatatgggtctccatcttatttgcgagggccgacgggaaggaaatccggtgcggcggacggacgacgggggaggagcactgccggcgataggcggggagaaccggaggcttcgtgggcaatatcgccttcgacgcctccgatgacgagctctatgatgcctgcgaactcatcggccccgtccattccctctgcctcgccgccgacctagccaccaacaagtgtaggcgacgaagagatggcccgcaatgcctgccgcaacctccacggctacctcctgcgcggcctccttcagccgggccacgagctccgtgttgacctctccgaccgccccagcagcaggcgccgcagccaccgcgagcccgtcagcatggaggacgccgtccacgccgcgtccctcggcatggagtacttttgatatagtaatttgatatagtaattttctttgcattgcactatgcaacaaacatgctcggctcgaagcaaacattttgatatagtaatatgcatgcagtacttcatctccataaagcccctgaaagatcccaccactaacagcatgcatgtcctatatatagatcaggtttgtggcgatgctatccttccacatatatatttttttgaaaacaagggaagcttattatagatttttttacaccaactttattaaaaattaaagacaaggttcaagggaattagatccccggtacatcgctaggagcaaaataacatatagaacaaggccacccctttgacatataagggtaacctgaattacggaaacaactctgcggccgaaacaatacaacagtaaaggatgaaatagacaagggcaacggcgttgtcgcaacgattacattcaaaagcctctactacagtctacagtgacgtgcacaccacttgacaaatcagcatccccttcggctgtcttcatgggaacacatataattcgaggtttttagctgattcgtagattttggataggcttcaccggactccacaaacgattattgtggactccacaaacaatatctgaggagcgctaattgcaaacccaacgacaaatgccacattgacaaactatactcaactcgaacgaataacccgacacacatatatttcccccgaaaaataatgcttacatggagtaatagcaaacatgtgatattttggaggtttataatgtgcgtacacgctcaccaactagaaattgataagcttatactttgcactatatagtataccgctatgtactctctccgtcccataaaaaaccaacctagtactgaatgtgacatattagagattaacttttttttttggacggagggagtatatggagtatatcattagctaattcactagatgatgacatgcgctttgttgcaggatatatgttagatattggataaatgatgaaatgatttggattgaaatattatgaaaatgatttgagaatgatgatttaacatgtctatgtttagttttagaataaaataaattgtagacatgattattatatgcttacatgttaagcttcgtgtgtttaatgggttgatgtggcatgtctgttggtagattttagaagtgataataaatagtatgcttgcatattaatatttaggtgtttaatgggcattagctttatagaaagaagagattagccaggcgtcctgaaattaatgtgagctcacttaataagggaaaaaataaacaattagtgccctcttgcaataaggttgttgtatttgttcctacgagagagagaagatatatattccctccattttaaaatgcataaaatgtttgaccatttgtcttattaaagaatattatataaatatcacttattttattgtgactttgttttgtcatcaaataaaatataatctcaacttacacttttacatatttatattaaatttttgagtaagtcaaatggtcaaacattataaaaaggttaacggcgttatacattttgaaaaaggaggtagtatcatttttcacgcgcaagcttcccaaaccactgagcggtttggttaatttctataagtttcacaggaaattgctttcaaaaaatcatattaatcattttttgagttttaaataattaatacttaattaatcacacactaatagatcatctcgttttacatatatatcttccctatcttcttctttccctcctctcaataatcaataaaaatgtttttatttatttttacgatgattttcgttgtagcttaggagtatatcaaagtcagctagcaaatctagcgcttacccaatctaagaggagctcgtgaaggatgggagagagccaaccgtctcatttcaaagtgcgtgagaaatttagtccaagaggtgtgggagcctgcagttatgtaaaaatactctaaacaaactaaatgtttggtttcacattagtttattaataataaagaaagataatacttttgtttttaactgtcaaggtggttctattttgtttagacttagccacgagagtcggccggtggatgattgattgatcatctttttggtggtgaggatggttttttatttttaagatgaaccgatgactttagattaatgacccaactaaatcgctggcaaccaaacattccaaccaggcggacattcagcagcaaaggcatgagccaccttattacagtcacggggggccatagctaactgaaaaagagtagttcatatgtcacgaacaatccaattcttttggccgaaacagatgttggtaacactgcatcatcgagggtttggccttaacattcactaccagaaaagacgttttcccaggcggtcaaaacacgttttgacagacggacaaaccttctgcctgcatctaaacgatggtgaaaatctcctatttttacaggcggactatgattttcacaggcaacagttgggatcttttcagacgctatagtagccccgcctgcgaaaatactcgcggcaccataaaaaacattcccgtcagccccacccctccttaagtttcaaatcacaaatctcatccaggaaacaaaatccaatcactaacatccatacatcaacacaaaagaattggattcaaatccacagcatcaacttgcaagttaacatcaatcaacatgtaaacttataaaaaaaatcatcttcgccggcgaactcctttgcatgcggtggctgccgccgcccccctctcccgtcaggccagatctgggagggagggaggtgtccaccgccgccaccaccctcccttctcctcgtaggggccagatctgggagagggaggggaggggagccgcatccgcgccaccgccgtcgctccccctccttcggccagatctaggagcgggagggagagagggggagctgccgtcgccccttctgcgccgcggtcacctcgtccgcgccgccaccgtcgctccccatcctccggccagagctaggagcggggggagagagggggagccgccgccgccatcgccccttctgcgccgccgccgttgctccctcttctccagccagatctaggagcggggagagagagagagggggagccgccgccgctaccgtcggcccgtcctcgccacgtcaccgtccgcgcgttcgcgccgctgccgtcgtcgtcgctccccctcctccaacggggagggagagacggggagccaccgccgccgctcggattgggagggagggaggggaggggagagggggaggagagtgagccggtggggaggggtggagaggagaagagaagtgttgagggagagatagagagttgagaggaaaatcagtggtggtcggtggggagtggtggtggagaagataaggatgacttaagatttattttaggtaggtatgatttttgcaggcggaccgcataaggttccgcatgcaaaaatcattttttaaggtgattttcgcaggcggacctcttcagtgatccgcctggaaaaattgattttcccaagcggatgacaaaaatccacctcggtttatattttcgtaggccaatatttgactccgagggtcatatccgtctggaaaaataaaaggacaacgtcgctaaaaaaaagttttttagtagagattgccaatcgagatactccctccttcccaaatttatcatcatataatgaaatttaaaatttatcaaattgatcatcatataaccgtatagacacggatttcatcagaatacaattaatacagcatgacagaatgtgtgcatgctaatgtgtaattgttatgatgttttaatcgatgcatgcattgtgggagaatgtgtgtacggtgtcttaattgatgtgattgaattatccttaatcttggtgtataaacgtatatgatgatcaatttgggaaggagggagtagtgtgttataattttcattatttcttagttacaacaatggatataaaaatgttggttgtaaatttttgtctgctcaatggtaattaatagttattgtcattgatatggttatacagggaatggcatcaaacgcatattaatattcaatatattttattctcatctttgtaatgcatggtattttttaagtaaaaaataaaaatgagaaacttttaattctacgatgattttttttcaaaaaaaaggaaaagaaaaaaagaagactcaaaatgagtcaccgcccaggacctatggaaggcaaatcctaggctagagatcaaaatttgtgcgaaaaaacctctacagcttaattacttttggatatagagacaaattttgaaacatttatctgtcatcattttcattttcacatcaaaaaaaactagacaaagacattggaaaaaaaactatagacaaagaattttattcatatagtttaaccgtcaaaagcaaaatgatggcacttacggtcttgtccgtcaaatcgctgatgattcttaggattcaggtcagtaatttctttattaacgccatatttgaggatatgcaaaagaatgaatactacctccgttccaaaataagtgcagccgtgaatatacgtatccaacgtttgactatccgtcttatttaaaaaatttatgagaaaataaaaaaaagtcacacataaagtattgttcatgttttatcatctaataacaacaaaaatgctaatcattaaaaaaaatcaattaagatgaacggccaaacgttgaatacgaacaatgcagaactgcacttattttgagatggagggagtacgtttctcactctctctatatgtatgtagtactccctccgtttcaggttacaagacgttttgactttagtcaaagtcaaactgttttaagtttgatcaaagtctgtagaaaaaaaatactccatccgttttagattataagatgttttgactttggttaaagtcaaattgttttaagtttgactaagtttatagacaaatacaataatatttataataataaattagtttcatcaaataaattcttgaatatattttcataataaatttgtcatgggttaaaaatgttactactttttctacaaacttcaaacttaaagcaatttttgacttataacctgaaacagagagagtagtaacattttcaaccctatacaaatttattattgccagggttacggataaggtataccctttacccttgggtatatgtcatgcatcgatatggtatatctgcgcgtatatggacgttctctgtacacactaaggaaattcaccacggaatccacatatggaaagattcctactcggatagaaccgggtcgtcattgtatcatgcgggtccgatgtctccgagtcctacttggaggtcagttgacctgcagtataaaaaggatccccgggaagacctaagacatcgaatcttactatcaacacacctaccacagcctacgagtccggagtctacagaagccaagtcgccgggtgatctagtcgaaccaactcgactacggtctcgtcggtatcatcgaattctgttattccctttgtaatatgtggttttcactatataatctcatatcaactgaattggggctattacccatcagggggcctgaaccagtataatctctgttttctgtttcctcgatgtcgtattacgtagatcctcgtaccagcgtactccaataccctctatatccggtctacgggtatcccccgtcgataattatgaaaatatattcaattattgatttgataaaactaatttagtactataaatattactatatttgtttataaacttagccaaacttaaagtagtttgactttaatcaaaatcaaaacgttttgaaacaaagagtacatgtatttagagagatacttatatataaataaatttcttaggaaattagtttatttttatttatttattaactttacaatacctaattaacttcatgtacccttgaataataataaaaaaaatgagccgtaaaaagaaaaggcagtagttggtacctcgtacgttactcgataaggttaaagatgcatcaaaaatggcattggtgtaattatcttctctttacatatactgcatacgtcaagtcagaggaacgtggtggctgacatgtgagccccaccgctcacgggcccacctgtcagtgaccacgtcaggtgcgaggatccgctttcccagtagaggctccagtaggcaggttaggtcaggtcaggtacggacgcatcccctcgattcccctctcccctcactttctctctctctctctctctcgacgcgagcagatcagatgtgccgccgccgccgccgccgggcgagccggctggccgccatggagctgagctgcgcgcgcatctgcgattcgggccgccctcctcttcttcgccgaagtaaataatgcaaagatgagaatatgagtctagctagaggtgaggaactccgaactcccgatcgacctagctacccccctttaatcgatgcagaggcgcgcgctaagctgcaatttgatttcatttatttcatcagtactagatacatatgtactcctgtatatttgatgaccaaatcaacttcgcatcgaggccgggttgcatacctagctaatatcaccgactagatctctctccttaattagtgctgcacttattatcatatcagattaatgaggggtttggtttgccaattaattaagttgatgaaaagaaatttacttatcgattcttaattcattagcgatgacctcccaattcccattagtatgctcttgagcctcttgactggaatcaagtagcagtacccaagcaactaatgatgaagatcgatctcatgggttagctagaaagaaagctcagaagttccggtatataatatccaacagtactagctcccctgcacccaaaagaagtggttcgtttaagtggtcatttggtcggcaaaagatgctaaccaccttaaccttgtatattggttgtgcgcttcatttggattttgccgttgtaagagtagttttcgtgatataagtgttactggtttggttgtgcgcgtactagttatgcacatacagggaatgttcttagacggttgtatcacctttgtataattggttgagtttaataaaaactttcattatctaaaaatatgtgtcaccgacatctagtacaagcatatcatcgatgttgggttaaccaaactatagcattttatttgtacctaattaggttattaccaattttcttttaaatccatttgtccgggctctatgataagaacacattgcattcaagcttttctttagaagttcccaataatataatataccatacattattttggtcttcaacttttttccctcatcattcaatacccaagtccaatttggatggcaagggcactttgctttttcccaaaagtatatcatatactatctccatcccatatcatagctatctctgctattcacacatgcattaatcaccatctcaacgaatgtaatatacgcttgaaaataccatatatcattgtacacatgaggattttgcataaatctagggttgtgaaacagtttaccccaaagagatagtatgttggtttttcttttttttttaaaaaaaaaggatagatcctcttagccaggtgtacagaactattaagttcaggaaatactagtgcaatttgaaacaaacacttacaattgttattctagttttactaaatgaaacata

SEQ ID NO: 45324 - DNA, 2357 bp, Oryza sativa
tcttttcaactgcgattcctaaagaagaaattgatgtacatgttcgatctaacaaggaagttaaaaggcttggggttatttcatcttatgacacttcattctcctgtaaattggactttgaagaccagtttactctatcacatacttcacaagaagaggatgtggtattctatggatacacacttcgtcacgtacaatatcctttcttttacctttattatcataatatttgtagttacagatttattcatgaaggcttaggctacaattcaacatagctatggtctgtggaaactcagtgcgattgacccaccatgggtttgagagagcaagaggagggggcaggggtgttagatgtattacatagctagctgtgtatttacagggcgctttctgcacttgtaaacagttccattgtatacctgttggtccattgcaattccaagtccatttgtgcttaacggtaccacgtcaatgaatgctaggctggcacaatattattatttgtttacattgatataatcacactctgtttacttaacttctatatgatgatggaacttcgtttgaatatagaggtacgcaaccttcttttaatatttcatctgctctcttgctctctgtactaaattttctactctgtagagctgcctatctcatgtcccagtcttctttgcacagtcaaaatatcaggtttacctctgttcatctttttaacgtaggacaatgttcagtttagatttgcagaactttgatgtttgctttaatttggtgttaatacagatgatccagagtatcgtgcgtctaaggcactcactgcaaagagagaaccagagatgacgattgtgccatatgtgccagatacagttacctactgtggcgattctcggtgatggacctatctggtgcaaggtaacctacgaatcatatcatgttgaatttgcgtcccttggaaaggaaaatatttcaaaactgtttgcatataacttatttgtaactcggtgacgtgttgaattctgcaaagtttgtgtcctatctaacgttttgactcccacctttgatcgaacgtaatgtaaatgtatactgctgctgctactctttgtctgtaccatttcaccttgtcgtcgtcaatttgccaaatatattgtcttttccccaaatacatgccatccaagttggctagtttgcactcggtgctgatgtgggctaactgttgtgttgtgtcgacaggcttttttgatgtgaaatatttctggagctgtcaacgagacctgagacccacgtgtaattttccaatgagaacaaaatgctttgtcacccgaagcctaatgtaggagtataaattaaccactgtgcgctttgtgctcatgtatgtttataaacgttctgactcctgtctcacgcgttcagattccctgcaaggtttcgcggttctgttgctgcgcgaactgttcataacttttattgtatgatcagtcttttctccgtgttgttaatggctggatgccgggacacttgttatatatggcttcacaacggacgaacgagcgattatcaaacttgaaaacctcgtgttccacttctctccgtactctgaattgtttttggctcttacgttttctgaattgttttttgctccttggaaaaattgacacgtggaaaactattttacaaagacttcatatcatatatgcacaaaatctcgtgtaggtcttcaaccgcccgacgtcttagttgtataaagacatgaccgtgaaaaagttctctgttattacacgggatattgatacacggcctctgttaggtcctgtgtggaaattacgatgatggtaaggtgcttagcggcggaaacaaagaaactaaagctaagcaagtcagtggcaggagataccatctgttgtacgtggagataccatcctactagggacgtaagtggggtggacaaatgggattttttcctgttcatcccacttctaatttattttttcttctaatttattttttcttctaaaatttatgttaccatgaggtccatgaactaataagcggagtggaattgcccactgacatcctttctccggtcctctaccgcatctggcccacaaccataatgattagcaagaacctttccttcatcggagccgagcccccctcttctttgcactcgcactcacccgagccaagaaagacatcagcgcatacaatttagatcagcctctcccctccaagacccaacagacccagctcgtgaattgttgggacgtcatttgtgtcggccatggagattgtcagaccttggtacccatggcttcgacgtaacttctacaagctacaggttttttactgtccttgagata

SEQ ID NO: 45325 - DNA, 8239 bp, Oryza sativa
agctgaagaacagtgccatctggatgagcagaagaatcagacgacagaaacaacgcagtacaacacaacggcatttacatgcatgagcagagcatagtggttataccttgtgtgaggaagcgttgttaccattaaaaagcattgatcccaaattgcattcccccgcacagctccagaaaatattcacatcacaagatcctatcgacaaaacacaataaactgatattaagaaaaaaagcactcacattgcaatatggcaatattgtttatagactaggttgtggtgattatccataactgataaacaagagtgaaggaagatgttcataatcttctgtaaataagaagccttgcagaccattcagctatgtcaattcgtctctcgttatagtttctactttttacagtagttgtcagtcagttcatctctcgttatagtttctacttctaacaatagttgccttggtagaagatggtaattggtgagagttatggattgctactatggtatcagcctggggtgagtaatactgacaaataatgtgactaagtaaattagaataatctggatggctgggacataactttttagttgggtggtcaccactgactaccatggagatgtgttactttttcatcccctttacgacacccagccagaatagggtagaatgcataaatgagtagtaatagcagtagctgcttgggcagggcaatctgccggttatctcaatcctggggaggatataaggcctcattgatttaaatactgattaacatcatttgataaaaagggaagaaaccagcttttggtattccagaatcaaacactaacaaaatatagatgatacagacctttggatattgtcccacagcacactgcactcaatcagatccataaatgctgatggttgtctgcctaagtacttcagaagtcctgtcaaggctgtgagatgccacctatcatgtcaaaaggagggcatgttattcgaaaattcctgatgattgaaatggagccgttaataaaggcgggtgagcctactaccagatatgtgagggctgcgtatctttcttggcttagatacaaaggctttcctctgtgcatgtcatgatcctgcaaccaaatagcaatacatgagaagaaaaaaggcataggatcacatataatgaaattacccatagcattgcccaaggccatcaaggggtcgtttggctcacacatccttggtagcatatgccccaacctcaggtgagaacaagcctcatccttgtagcattaccctaacctttatagcttctttgcattgcaaggaaatatctcaataatctacaaggcatgcatcctatactctaattcatcccatctagaaatcaaatcatatgccatcaatccgtcctaggtgcaatgttttaaacgatatgcatacaggtaaaaaatcttcacagcaccctgccctggttccgtgtatgtatactcaacagtggcagtaaagagaagttacgtctggtttcagtcaatgggatcttcacggtattgacaggataattcttcagttcatttgatgatggtattttacatcaaggcagttagtgttcgatcttacaattgctcatcgaattatgggtggagaagattgctcagccaaggtccattcaagagcataatttcatgaggcacactagcatagaagcatgctggcgcaagaatgcaaggatagcaaggcaagcggggatagtgaggcaaataaacatgctttagtgccagcaaaaagctattcagtatttaaattaatccagtacctcctcaccgaaggcgtcaaggtagggagatggccaaaaggcgagacgaatagatcgctgcaacagtattgttgttttctgcacaaaacagacaacaaaattgaagaaagcaatctcaacaccgataacaagaatgatatgcagtcacaacttaatacataccctaaccaaaagaaatatgccaacgccagcaccacattgagacgcatgattaaggcactttccagtcctacacacaatatacaaaataaaagtttaccctcacttcataattaaaacacaaccagcaagagtgaaacaagaactaaatgaacaccatcacctgcagcatggtttccaactaggcgaacatagcttgccacaaagtaaacataatgctggttcatcaggcactgaaccgcaatcagggcattgcatcttgacatatctaatgggaaaaacagtaagtgttagccttcagccttaaaagcaatatatggttcctgaagacccagaaccagaaagggagggaatcaatcaaaattaggttcagattaaacctttccaggagaacttgatagacaggaggcaactccatcagcctaaatggcactgctggggtagagaaatgaacgcctctatatttacgggttttgtaatcctcgcagaaatgttgtgtccattttaacgcaagcatatgtacagattcatcttggagaattggatccagtgactgaatctgaaacaggtcttccaattcccttatcccattcagctccactgccagtgagtctgccgcgctattattcaagtaaagatgtgatgatccttcccagatattagaactgtcatacaaaggtgctgaggaagacgatcttagaagctcccatagtaacgcacacctccgaagatacggataagtcaatctccggaccatatcttttgggtgacaagaaggatcaatgtgtttggatacaaaatattctctagcaatatcaattgttgacatagtctggcaaacatcattaaggaggcagttgctgaaacttgatctgtcaaatgtttcttctccatagcatgttatcaatgcctacaacacaatgcatgccataaaacgtaatgaagtaataaaaaaggataatatgcacattccaggagatggcaaaacagcatacctgaacaacacaaacaacatagaataggtggacgaaagggatgaagaattcagtggacattagaaactgaacaggtaaacagaaaagagttgacaacaatgatgaaaaagatcttgagcaaggactggatctgcacattgtttccaaaattggatatcagggaagactccaccctcactagtggggtcacccatcggtggcataatgcctgttgaaaatgaaaaaatgtgaggggatattcaagtatgatatcgtgcataatgtatatgcaattaaaaatgcacatgcagaatctaggatgcaagatacggcacacagctcacgtatccgtatcagatacattctcggataaggatacagatcggataccctccgatacatatcccatacatattcttgattaacaaggttttcaaataaacagaataattcaggatatgctctcgatacgatcaatgtgccgccgccatctcctggcctcgacatgacgacgcccatctcacaaagcgcagcaacgatgatgctggacaccaaggactgccattatgccgcagcaccttcgccatctgccggccgtcatggtgcagctgtatgccgcagcgcctccgccatccaccggccgtcatggtgccgccatatgccacagtgcctccgccatccgccggccattgtggtgccaccatctgaaacagggtctctactggcagccggctgccacagctccgcaaccaggcatagccgcacagcctgtgctgcctagtacttggttcttccagtccactgcagatcttactttcttagtacaagactacaagtgacatatcttgttagatgcgatggatattgatggaagcttgaatggtaatgcatctagcattccaactgctagtgtggctgctgatgcagcggggcgatggaagagagaaccaatttgggtgttttagtattctacacttattattcagttttctgtattttttattccctctccctctccctctctctctctctgtgtgtctgtgtgtatgtatagacgtatccccgtatccgtgtttcttagaaaatgccatatccccgtatcacgtatctgtatccccgtatctgggtaacagtacaaaatatagaggtatttgagtttcctgtgaaacaagagcccgagtaaaagaacaccgattctagaagtgcatcaaactaccttgttatgacattttggtttcttaaggctgtcagattacatttatcaaacacttcttgcattaatatattaacatttgccattataattatcagaaacaagagtatgacattgatattgaaacatatacagggaataatatttagaggcagagatgggaaattaagtgtgcactatatacctttccgcttagtggcattcagaagatctttatcaccagaagtgccagagcaaatagagctcgctaacagttgtagaccttcgaatctcaaaagaacctcaaggcgactcaaatttctcgcagagtgagcaacacgaaataacagagacagtataaatccatttgatgaattcagttcatggcgtaaagattctatgcatgacttcgattcagaatagcttgcaattctaccacgagaagcaatttctgtagataccacagagtatcttagtgtatcccagagaaatagggacgggtttagcctttcagatgctgaaaaactgttgtggctacgacggtagtaaagcatacacaatcttcgtagggaaggatctagagctggctctgtagtatcattgaccttcccacttaaagcttttaaaaacttgctttgtccaacaatttttccagcagtttcaagaagccagagtgcatgagggaactgtaagttacttgtcgtcgtccatgatgacgcaggaggagcttcagacggtatctgaacagatggcatcgtcttcctcaaagatttactagagaaatcaggtgatgctggaagaatagaatttgcaaatctgcgacagactggacacagcaactctccctggaaaaaaggtactgagttagagagagagagagagagagagagagagagttatgaaatgtatagatagaaaataccagatccggatcaacaatatgaccagtttcaaaaccaagtctcctgacatatctgcaaatgttcaatcaacagaagtgtaagcagcttggcataaaatatgagacaccactctttttcagtcaacaattgttcctaaaagtctaaaagtgtaaggtagtagtacatattctcatttcaagctgtgagaaggtgacctgtcaaattgaacagatgaataattgttaaatcaagaagctaccaattgtcgagttgtgcactgctaaaagtgcgagattctcatccaaatatggtaccacacaatacgcacacgatgcaatataaagaatttcttacttgaactaaataaattttgagtgcagcttacctttgtttcaaggagaataaatatcgatcatggcattcctggtgtacagcatgtccacaagaggatatgtggatgccatcacaatcaacaggaccaaatctgttccttgtaactgaaccagaagatttggacggatgaaggtgttttgttgaaagacaattaacatatgttcccagcacagaacttctggggcttctgtttttcttggagccaattgacaggttcgaagtattcactgtttgttcatcatctttagtttctacattgttgggcccaaacatatgatctaaaatagtcttacagacatcatcctcaattgtctcaagagaggtggtatcaccagcattgctgttagagtacacaccaggcaaagatgatatatatcgaatgagtggatgttgctcatttgagaaatcaaggaacgcatcaacttccatagcatctgaatcaaatgaaggctctactgctgtatcagcaatgaattcctccgaactaaaagaagaagcacctgagggatcagctgattcttcccttctgatggacccagatatcttgtttgatttagttggattttcccaggagggatgacccatctcaacaaaggttgcaagtcgagatctctggaatatataacatgtaagcaagcatgtataaaagcaccagcacacatacagcatactagcaaagttataattaatcctatccgcttgtgttttgaacacaaaacagaaatgggtaaaaaatacaaaatggcaatcactatttcatgtagatgtgaacataattgatagagcaatccatttgccaagcaaactacggttacctgaagaagaatcagatagcacaatggacttttagaatctgaatccctgcacagggagcaaactggcagcgactcctctgagactacaccagttgaacaggacacatctggctcagacattggaacatcctgcccctcacttcctgatgacttcatactttcagcaaacttcgactgttctgctttcatttttgcctaatatataacaatatataataacgcaaatgaagaaatgccaacatcaagtaaatttgcaatcaagacaagtaaactatttatggatcaaagcctaaaaaaggagaaaaaaaataataggcaatcaagggaactgcagacctagcatttctataataaagaaaatcaacgtaatagcttagcaaacccatccaacaaacataattgaacttgaatatgagatggcttgagaatataattagattgtaccatgattgcagcttggcgttggcgcgcctttgccttcttgtccatagaatctgaagatcctggattttgtttgcaactggtatcctgtggcatggacgggactatatgcggcgccatttgtcttattgcagaaaagcattccttacttaagttggcaaatttctttaacaagctctcaattagtgatggaatattgcagtacttggatccagaaaaggagatatcattctcttccttgtatttgtgcattaatgaaaccagcaaggtaagcatgctctcattcttcactttgccagaaactggaggtactagttcagtagaataggtcaatatgggaaaagcctcttctgcataagatgacaggacacccatgattcatcatcatgctgcactatatccataccatattggttggcataccttttgctctccgattcacatatatcaagtgccaaccaaagcaagtgcaaaccagtcacaaggacgttgtcaggggcacgtgatacagataatggatcactgtaaacagcatagaacagaacagcgcgaacaatttgaaggacagctttcgatgttgcaattttagaaatattatgcaggggcctaaaaacatgtgtccattgaggtagctgagcattgagagcaaatactttgcaaaaacggtaatatctctcctcggcaatttgtagttccctggaattccagcggggatgatacaagtccagctccttccagaatgttttgcgaagtacatacttaccctgtgataacctttgttataaaacatacgttcaaaaataaaattagattttcataagcatgtaatataatttaaggattcaaacctgcttcatgccagatggattagaataaactgcaagtgaatccagaacattctgaagctggtcacttgacgaaagggcacggggaagagacttcacaatctggctgtgtgtggaatccacaacagctaacttataaatcaattctcttttcaaattgtctgatgtggaaagcccacaaaatatacgttcttttgactaattgtatgagaaaagttagcatttcttgcataagaactgattcatacctgtaaaagggtatgctgtcagcctaatttgacatcacaatttctttcaattgacaaaagttcaagtacatactaatttggacagctgaggaaaacaatgagatgaatgtcacagcaatgagatgaaaagtcacagcaagacaatggcatttcactaaaagctgatgtatgataatataatgtatgtgcctgatcaccatgtccctggacccaagcagctcaaatgacatcatggaggcaaccagaccacaatggcagggagacagacaaactaaaaggaacccccttttattctggttcaatgccgtgtataagattaatctaaaaaatcaattgtctactacgaaataagataccaaaataacctacagttagatctccttataacaaccgctgcttaatccaaggtgctgttacattcactcgtgataacatgccacacagggtcatgccagcaatgccccggggca

SEQ ID NO: 45326 - DNA, 3534 bp, Oryza sativa
ctgcatcaccattcttacgccacattccagcacgcacttgtgcgcaaaatactcttagtctaatggatgctgcatcacaattgacgcaaacccatagggttcacagcctctaagtacctgagaaaaaaactcattggtctggacaactgaacaatgcccaggtttgacatcctttcaaaacatttccccattgccttccgcaataggaaagaaagcatacgatgcaaaggatatgaaatgatgtttcttgtgagctgacatcgaaaacaacatgaggccagcctactgtgttgattatacctagttcctcaattctagaatcagggtgggcatacaaaaggctgccgtcagtcatagtataagaaatggcattctcagggtgcaattgtgtatctgctgcattgctactttcgtgcatctttcttttgcctgccatgttactaggatgaggcaaccctatttgatcaattagcatcagattgtccggatcttgaacagaggaactaaatgactcaggaatatctgcaatatcacctggtcggggttcttcatttatcttggcattcacttcagcaatatttatatttggtttgcctttgttagaagtcaaaggctcctcaagcaaagccataaaattgtgaggatcactactgctcgcatcaaggaaagataacttgcccctcagagctatacctggtgccagccaaccttcaatagctttcaggcactgaagaattaaccaggcagcaggtggtggcaatccaccgactgaagaactgtctttgctgcctaaattgcacactgagctattttgggagacccttcccacttttgcaagccgctgattctcagaactttctatgctttttgttgcagtggagcaaatagtaacatcagttgactcatgttgctcaggaggagcaaatgctcctttcaccaaagaaccatgacaaactccaagatagtgtcccagcacaaagggtgcagataggttctcattctcatcttcaccatgaatacttgtcactctcttctgaggatccatcccttgtacaagtgacaggagcttaatccatgaccttgttaaatcaggcctctcataagcaacatatttagaaacttcctcatgactaaggacataacgtgtatcttccaatagtctgacagtagcatcatataagtttgtccatttgtttgtctgcaaataacaacgtacaaagactttcatgaccgtatgaaatcacattatactatatgaatcacagtgcaaagttgatcaatgaataatgatagaaggcccaacaaataaaaccttaatcaggttcacaagaactataaggcatcagagatatctacaaatatttcagagactcattggctatgtcaatataaatttattaaaagccaataatgctagtgcctattgtcaaacccattcccagttatccaagtaactcgtctttatttcctttatgcataagcttgcgagatgctagtataactaattattgatggaataaaacagactcaggattgatggcacatgattaacattgagtcattaacattatatcaaaagcagacgaacaaacatgcttggcacaaaatgtaccaacagtagtcatcttatacttgaaagaaaataccaatagtacacgctaactgggtcaacatagtttcaagccataggatgaatcaagcatacctgtaaatggccatcctcaccaatgcaagaaagaaatagatctgtcaggcatccaagaagaactcccaacaaattcacctcacgcacaagcctaggagtcagcgtaggcacggtgaatatttgcacagaaaaggtaggcatcagaggatactcctccaacagagaatcgttgcaccctttaataacttccccaaatgtaacaggatagtagtgtataaaaactttggcaaaatcatacttaaaagctggttcactgataagtttcaaaagcaactcatgcaattttttaacagccttcttgtccagcaacctttctgccttcgtcaatgcatctaataggtctggacattcacagattctttgggcgacaaaactaagaagactttcactgcagctgcagaattcaagcagcatattagcaacacaagttgtcaattcttcagcgaccctcttgcacgagttaccaccatcaccctctgcgtgtggcggaccttcaaccaggcatattctctccttccaaaactgcaagagcacatccagcacaggccctacagaacttgcaagctcctctggaagtggtttaatctgctcggcccccttgtgccttgagcaaaacccttcacgcttccaggcagttgtatccccacagtcacaacatccaccaccagtatacatgatggagtaatcatggtccttgtgattgccattctggaaacatggtacacagattgcacatgtgggatcatgctcacaggtccggcagcgataagcaagatcattctgtccccaaacagatccacagacagcacgctcccctgcagtgctacgttccaagtcatcaagcatcgcgtgtggctcattgttgaacattaaccactgtaaccaagacaaaatctcgtcacatgcttcactgttgctgctgtcaccatccttattcgatgctttccgggcctccaataaatcagcaccaactgacaagacgagcttggcgatttcaggaatcagctccttgtgttcctccaagtaaatgagtaagccttcttggtgttcctgaagctgttcttgtggaactccaaagagaatcagtttctgcagtgggacaacaatgccaggtacattagagaagttcaaagatttcagcaaaaagtctacttaccctaatgaccaccgaaactccttatgaagcaaatctctaatcattacaaaaagatgtatgattccgtccaacttattcaacacgcgcaatgctggagattcttgctcctcgcattatgaaaggacaatacttctatttttttttaaaaaaaaaaaaaacaattgacacacgcacagctaaaacaataatttactagctgcgaaacaaccgctatttcgtatatcctgaattccaccaaaagtgtgttctacgtaggagagttttctgattttgtgtattctgaattctaccaaaagtgtgttctactacatacgagagttttctgatgtcgtgtattatgaattctaccaaaagtgtgttttgcacagcaactcctaagtcctaacacctatccatgcttggtacaaacaagtgtgtcctactacatacgagagtcatgtattctgaattccaccataaatgtgctctacatatcaactcctgcaggtgttctacatagcaactcctaacaccaatccatgcttggtgccaaaaagtgtgttacgagagttttctgatttcgcgtattctgaattctaccataaatgcgctctacgtatcaactcctgcaggtgttatgcatagcaactcctaaccccaatccatgattggtacaaaccaaaacaattcacag

SEQ ID NO: 45327 - DNA, 5593 bp, Oryza sativa
tcgctctctcgctggacggtgggccccacgacttcgggtaggtggtcccgggatggcggcgacactacgtataatgcgtgcgtgcgggtttcttttgtgtgactcgaaggagatggagagggggctgcctgggagatcgggcccacatggaagtgacccaagtactctctccatggctccgtcccacaactctaggtctctcgctcccgcttcagctccacctctcctcgagttggagctcggccaaacagtttcagctctttgaataactaggcttatcatatcctattctatattcatttattttagatgaaaggagtgtcgactggcattggtatttttatgctttgagccaaattatcagtttaaatgggagcggaactgggtggagctctctcacaaaaatgagctaagatgtggagttggattagtcagctccacaactccactccaaaccaaactcttgaagctaaaattaggagttggaactctaccaaacagaccctaacttaggatacgatattacagtacctattagaatgaatctgaaccctgaacggttgggtctatcacatcctattctatattcgtttattttaggatgaagggagtgtcgattggcattggtattcttatgctttgggcccatttaccagttaaaggctttaagtgctattcgactatgtagagtagttttctttggagcattcttacacatacttaaaatagctttgccaagaaaacttataggactcgcacaaacaaagtttctcatcatttaatttaatctactgggagaagaattggatgtacatatagctttgtccattttcattttgtcaaaattatgcgcaacatagcagtgacaaagcattgacaaaaataaggtgtagttgacagtatcattttgtcaagaattaggttatatgttctcgagtcgataatgttgtcgtattctattagtcaatgttatagtagcaaaacagataatattgttgtgttctatttctatgtcaaaacaaacataaatatatggttatttttctgttgatatatataatgtgagcagaatatgagaaaaaaatgctttcttatcttttgctgaaataagtgttattttgtcgaaatgatggaagcatatcgtggactttctgcccattttcaatataagcaacttatggcctgtagatatgtgttaaaaatcgccataaccatcttaagatacgttgtgcgagtgaaaatgatctgaatgaattatcatacatccggtggtggaaaaaggcaaccatccgacttattttagtgatacgagcgattctgttggggtacttaattacttactgtcaattcacaaatgtactttcttagcttagaaaaaaaggaaggtagtaaaaacactcatacaacgtataaatgttaatgatgtcgataaaaatggcatatcttgtcgatgtaaatgaataaatggtacacaaaacaaattaaatggagggaaacagtgtcagagacccatgttctcaaaatttcggtaaattattttgaatttcagataacctcacgtcctctccaactgaatatagtttcgtttattcacaagtatcaaatccttggctccaaaaaaagaagatgttgacttcttcatccagaaaggaaaaggagagagagatcaaagagagaaatattcagatgttgctttcaaagtttgtactactggtttggaggatttatgagaagaagaagaagcagagaccaagcttccgaaaaccggttcttgacttgtttatcctgaccatgacaatttttgattaaggttgtgtgtagattcaaaatttagatccaaacttaagtcatttctcatcacatcaacctgtcatacatacataacttttcagtcacaccatctccaattttaaccaaaatccaaactttggattcaactaaacacagcctaagaaataacaagaccatcgggtcagtatgtcacgacgtggacatactcaggtaacgacgacgctatcacattgtggacacaccatggacgacaatgtgctcggcgataattaagattttaatacggtattttactgctcgataatgacacaggtaacaacatactattaacctatccctgtcacgattcacacacgacgtgcctgtccgaaatagtggccgatctagcttaaccaatgatctccagaagattcatctagataattgggaggattagccaatgatatccaggaaattcattagtacttcctcgttcccaaattatcatcatataataaaatctaaaatttctcaaattaaccatcatataaccgcatggatacggatttcatcataatacaattaatataacaaggaagaataagcgcatgctaaggtgtataattggcatgatgttttaattggtgcatgtactgtgagagagtgtgtacatggtgtcttaattaatgcgatttaaattattcttatccttggtgtataaacatatatgacgatcaatttgggatggagcgagtattacattacgaggggattaatatgcgcctaaaacacataggtggctagctacttagctatactctctctgttaaaaaaaagccaacctagatgacgatttgacaccaactagaactatagatctggataactaaatacaattaaaattatttcctctgttctaacacataaacatatagaaatgtaagatttttttataagataatgtaagattgaatgtgacatattctatctaataaagataatgaaattttgattgtgacatacttatgataggtatatatgtactacttggaatttaagttattcaagagtcctcacaactgatcacagtcacaggttgccgaccaaaatctagctgtcaatgaagtaattatcacgacatgttggtgttgtttaaaggtaatgaagattaagattaagcaagggcacgctaaataaaaaagctattaggatataattaattaagctttaatattacaaattttaaataaataaatttatttcttattttaaagtaacttttatattaaatttttcgtacggaacatacggtttagtagtttaattttttttccgacgtagaatctgcatattcattagaaaagaacgggctagttgttgagtccactatagactcttaaataggccatgttagagaaaaacgatagttctgtaaaggccggctttctgatcgtctctctactagtaatacgcaataattaaattcttgtagcaagtgccatgattttctacattttggatctaaatacgtgacttttcttgtagatggactatacaacggccgttgcttatctcgtctgctcttgtttttctcgttgtgagccggtgtcaggctgatggcatgcaaaacatccctgcatgcatcttccttcttggttctttctcttccacatcatcaaatttgtttacataataataaatagagcgcatcttccttctttgtttctttctcttccacatcatcaaatttatttacttaacaataaatagagcccattgattaatacctttgtacatgcccttacgcgggaaggaatcgacgacaatggtgcgcatggaccaacgtggctatacatcagcgacgacaactcacaaccgcgaagcaatgtaaacgcagtagcatctaaataggtaacgacaaagatgttcactaatctccaatttgtagtttgtagctagtagcatatcatcccagacgggcatatcgcggttataaataaccagcgatggtccaattagtttgtccaattactttcacgagttaatcccgatcattccaggattaatatatagcaggtgcacaatacacatcggtctcaaacggccttccttttagacaactaattatacaagagatatgtaattaattaggtgaacccatcgatcaaaagcatcacgaccttacctatagagctaaagcctccaatggcgagagagttggtgagtaaagagcagatgacacagaacgcatatgtacacatgattgtttcttctagacgatggtctttcctggcttgaataatgatgttttatagtagtattccactaataattaataaatatccctagttggtcatcttcccgacgactaagcggtcacctaagcactcaacagctactagtactaatgaatgtcgatctgcatgtgcttcctgatgtgacactaatgattgattaatttaagactatatgatgttgaagattgaaccacccaaattctctacccatttatatttattccctaatacaatgaagcatgcatttatttctagactagagacatttaattattttgccactcttaaatgtggtaagtaaccatttaccatgtatacccacatgtcatagacacgtaaggatccaaatgttaacacataggtgtcagatagttaaacgtctaacctaaaagtaacaaatatttaaatatcccttatatctatgattgaaaggaaaaaagtctaagtacaattgtcgagatatggcaggtttggtaggtctctaacttctcaacttaactcaaataattaagtttagagtggaattatggagcaccttgaatccagattcatctctctaatttgttttaatagcactgctctactcccttttagatggaattgaaatcgtttggttggacttcatccctaacctccataagaggtgaaattggagctagaagtatgtcaaacatggccatataatctaagaacagcttatcgagatatccaacaaaaaataatcgttctcctatttcagtgagtaaaaacctgatggtccaaacgagttgggctgaaaatgggacagtgtttcggtgagacgggcccagcaagaacataggcctggttgggcccctattccccctacgttttctcggcccacccaccgttgggctcggctcgggcctaccatcgggcggagaggaggcccaactcgggaaaaaggagaaacagaaaagaggccgaaaaggcgaaagggatcgatgaggtggggaccaccggaccagcgagagatgcgcatcccgatgcagcacgatgccgcggcgccctctgttccgctccgcgccgcggccacgaaaaccacgacgccgccgggatcatctgcgtccgccttaccagtggccgtcgctgctatggatgacttaagcagttttttttatgtgtataaataaaacagggtagttaacgagtcatactttggttctggaagagaatatctttttaggaaaaaagcaataggtcatcttactctttgctacaggtgcaataatttgcccggacaatagacctgagtatagtttatttagttctaaacaatgcatcagaatatggaggaaaaagatggccttagtataggatcaattgagatgtacagttaaacaaaaaagtagatatggatttacaaaattgatgcggaatattatatccatgtagtagctcccatgtactagtttcttttgcttgaaaaaataaaagaagcagataatttctagagaagtccagagaataaaaagattggtggtgggagtgggacccacctgtcattg

SEQ ID NO: 45328 - DNA, 6686 bp, Oryza sativa
acacgattagccgcgttttttggcgtttcaacgcgagacactcttagtgggaaatttggagttcactgatcttcaggtgttccatcttgcgcaaagtgtgatgtcgggtatgtttagctcggttcagacttcagagtctgaaacttttatgaggtgcatgcgtgtattatccagtgtctagaatttgtctctgacgtgaattatcaagtgtctagaatttaagtcagatcaaggagccaacacccggagatttattaatcaaatggtgcatattagcttttgtcaatcgtgatttctagctttgaactgttgttaacttacacaagaaacgcgtcatgcacttggagaacggtagtggtattgatgcttcttgtcgaatttctcgtatgcatatatgctgagaaatgcgaaagaaaagcacgggtattttgtgtgatttcaatgtcgtagtgtggtctgtatcaatcttcaaatatttgcttgctaaagactgacatgattcattttgatgtaacagaacgggaccactgatcaggtggacaaaattgtgaaaattctgaatgagggacagattgcttctacagatgttgttggtatgtgggactacgttgcagattgattccttttaagtgcgatattttctgtttttatcattcccacgaaatctgtatacaaaaaaactgcatggtaggacatgcttatcaatctggaaccattgtgctgcagaggtggttgtcagcccaccttatgtgttccttcccgtggtcaagagtcagctgcgcccggagatccaagttgctgctcagaattgttgggtgaagaagggcggggctttcaccggtgaggtcaggttagttatcagttctgtttcagttgtacacccaacatgctgtaatgatcaccagaaggttagctacaaacctacttgcagaaagatgcgccattacgctgtttgattaggtctcatatttaacatcacccagaaacaatgccatcttttcaagctagcatgccatcttttcaagctagcctgccttcacttggtattacatgttgcatgttgttatatttgctcagtcacagttagtgttgtatgattggcagtctcaatagccgtcttcgcttttaggcgaggttataagccattcaccattgaactcatcttttgtttaagttggttgttaatctattatttttaatgcagcgctgagatgcttgtcaaccttagtattccctgggttattcttggacactctgaaaggaggagtttgttgggtgaatcaaatgaggtatgatctagtttacattctatgaaatgtgcagatatgaattttgtatagttttagctggaaatagtgcaacaagccaaacctggggataacggtcactggagacaatattgtagctacttagctggcactaaatttgatcctaatccaatatatcaccaacttaattttacaaaggtgatcttgttcgctacaaattggtggatgatctgctgtgaggttttcgtatcataatcatctaatggtttcctgctctttcctgaattgcagtttgttggagacaaagtggcatatgcgctctctcagggcttgaaggtcattgcatgtgttggtgagactctcgagcagcgggaatctggttcgaccatggatgttgttgctgcacaaacaaaagcaatttctggtatctaacctctacttttggtctttttgactctgttgaattccttatccatttgtgtactcgtttgatctaaatggtttgctgttcgcctatatgttcaaatggtatctaggataattttccattcattgaagctttatcttgcgaaagttagttagatctcttttgatgcactactcatttcttgtttggctaaattctacacattctacatcagaaaaaaaaaatcttgctaaaagtcttataagccacttggttatcacatattcactatgtgggagcactctaaaaatgggaacatctggtgatcagatgaatccacaggcagtaatgtaatgtaatagttcaagtgattacttgttcaagtggttaatggtttaatctagaccttaatgtaatgtctcatagttagcatcatttgataaaagattagctcatcacatgagaattcaggctgaaatgactatggactgttttacagaaaggatcaaggattggactaatgtggttgttgcctatgaacctgtgtgggccattggaactggtaaagttgctacaccagatcaagcacaagaagtaagtttcttatattgataagcacacaaagtgttcattcatgaacttctgcacgttccataattgttacctatgctctagataaaatatcttgtttaaacaaccatctggtttgtattattgtatcaggtgcatgatggcctgaggaagtggctcgctgctaatgtcagtgcagaggttgctgaatcaacaaggatcatctatggaggtataaatctacagtatattttcttgaacaaacactttacgattgattgcacaagtgcaccttaggcgacaactgtcctggtgcctggacatgattgtttacatgattttgctacaggttccgtaactggtgcgaactgcaaggagctggcagcaaagcctgatgttgatggttttctcgtcggtggtgcttcattgaaggtaaagaataatacgaacacagtagaacgattgtacagacatgattacccgcctgattcactgaataccgtctccctttctttgttctgtagcctgaattcatcgacatcatcaactccgccaccgtgaagtccgcctaagatcttcaccccattcaccttcggcgtgggaagatgtctgaagaggatcatacctttttctgtgcttatgtaatgctagtagttttgtgctggagcagctactctttttcctccccttcacttccctgaagctacctgcagcttgagcaatgctaataatgcacaccactgaacatactaccataccaataatgtttagctccttttgtcgtgagttattatcatgtgagtgtcagatcagatttcactggtcccttcacctattcttgctggcatatcagtctgatgaatcaggcatcaattctggtttctctgtgttatggtctgcaatgtctagtgaggtttaaggtttttgcatcttttggtccccatgattgattccaagtaacaggctaactgccatagtacctcaaattttggaatatcttgtgttgtgtgctgatctgctcagttggcacaatcctctgaacgcaaccgttgagcaaactttgcacggttgctgccaatcaatttgagaatggaccaatctttcgtcagatgtctggaccttgcatcacactttcgtacgatgatatattctcttgagcagtatacaaacttttaggccgccattattataaggccatgggtttcataacaaaattttaaccagaattggcaaaactcttaatagcatagtactcgatatgtaatttgattctttggccactattagcccatcgaataatttgattatttggtcagataaacaaagttatcgtgtaccaagagtttgggtatttgatctcagaactacaaaagatgaacacaaatttggcaaatttgatttcagaacggattgattatggactatggaggtagatctcagaaccaaaaaaaatgaacacaaatttgagatggatctcagaacggcttaaaaactagtaaaatttagattcagctgtgtttaactcgagttttaactcaagaaattaactggacggtccgctgccgcttcccgccattactgggcagcataaataaatgagttcccgcgagctcatctccctcaaccgcctcgcgagaattcaagccgctcatgcgttgcatcgccgcgcgcttcgcgtcacccccacgggaagcgtgaccccgctcacgccgcgctccaccgccgccgccgccgccgcctcctcctcctctcctgctccctctccaaccagcaaccgagagctcacctgttcttgtttctcccggcaccgaaagtgagaagaaaaaggagaggtataaatgagctcgccgacgccatcacgggccgccgccgcgtcgtcgtaccggaggcgtgggaggtgcacaataagaagggcgcgggtgcggcggtgcaggatgaagctgatgtacttcctgatggacaaggaggagaagcatcggaagcgggcggagctggagctggaggtgtcggagctggaggcggcgctcgacaaggagacgcgcctcggcaggatcctccactgctccctccagggccgcgtcgtctgccattgctgcctctccaccctcgttcctaacaaggtgatcgattgattagtagtagtagtgatcagcctctgttcatctgaattttcttgggttcttcgcattgtgatatttgctggttctttggaaatgatttgcagttatttttcttgaaatttcaaagaagttactgttttgcagataatttttactgtctctgacgaggtaccagaattacattagaaaatgtggttccttctgttacctcgttaaggatagtaaaattactcttttttcgagcccgaaaaacctcaataaatgactctttcgtgtctccatttcattgtcgaggctgttgagactggagaaagtttgatgaaaacatgattgcaagtgattcatcagtggcgtacagtcgaagagagagttgtcatgataagatttgacacctgatactgatactgtccagtttatgcctgctgcttgtctgcaatgagcatggagtagacacaccaggatatccccctatgataattgtgacagatgattgcttcttgggaatttttcgtagtcagggatttcagaaactcagagagtcagtgaatgattcttactgtatctcaggttgaaaaactgtgcccactttggattccttcccccaacgtacaatgttatctggatctctgactcctgacatgaggacaatacaagtactgtttgcccatttcattgcacaatcttgatttgtctacagataatctctcacaccttatctaccagatctgctccccttggatcctggccactcgtacccgttataacttgtcgatcgcttgcaagatggagccatagattcatagtaattctttctattttattcctttttaattcaccttgtggtaacagccaatgtaaaatttctgctgtatttcatactcttctgagtaacctgagcaagtgagcagcacactactctgatcaattatcggtgcatgtctgtccatttcgattatcagagaatgcgaaaagtatatcactataagccatcatatcacttgaaacactttggtaagtcaataattcattctttccattgttgcagatcaggggcctccttgcagagctagcaattgtggaggatgagatattctacctggagaagaaggtggacgacttacggctgcggcttcaccgggagcgcaagtggactgatcagtgcatttttcagcagcagcagcagaattggccgcaaaatcgccatcagaggcactccatctgcagccttggtggaaggagggagcttcaaggagctgagttgctaccaaggctaccttgtcctggcagtgatgaagctcttgaatgtgaaagcaaggcttctgttggatctgtctctagcaaaggtacacaaatttcatcattcatatgcactccaaagttctaggtctaaaaatgttctgttggttgttgagttcttgctcaagtattcagagtcatcaggacacataaaattcagtctgtcaactttttgttcatcttcgcagagagaattttagtacacaggcttctttgcagattcctcttttatattatacagcacaaacgaacatcttgctgcatctatctatcagagaaggatagaaaacattttgattcatgattctttttttgttgagtaggtgaggaagttgagcaaatacgaagaagcagccactcatttgagaatttgaagctccctgaaaggaaaatctgcttgagtggcccaaataagctctctgaggagctgatcagactgacagtgaacatcttccacaagctgaataaaacaacgaatgcagcagagctggagatgagcagcacatcaaagctcaacatctcctgcattggccccagaagtcttgttcctaagtcgtctgcgatcaccggcgcagccattagcactctcaagaaccgcagaatgtcacagggcggcgacggagcagagaaggagattgggtgccacaagagatttgttgaatttacgaagagctcgtttgatgtaagccgcatatcgtcgtgtcttgtagacatcaagaacttgaggtgagctataacccctttttttgttgcagtacagtaatcaaagtaaaactcgattctgatgtcacttgttttgcttccacagaatcttgatgcagaggctttgcaatgttgatccaagttttctgacgaacaagcagaagctggcgttctggattaacatctacaacttctgcataatgcatgtacagtaagctgccctgatcaacaaaacacactggtgatgaaataagcactgcttcattcattgctaatgcaagaaactgtactttacaatggttttaggcatgtcttcagcatggg

SEQ ID NO: 45329 - DNA, 4819 bp, Oryza sativa
cgctgaacaaagtatttctttaccaccaggcttcagtgaacgtgggaggaacagttctgaatgttctgtcgatcgagcatctcatcctgagacactcccctgaaggcaagcaagtaagcagattcacaacaatccacatgccattatttttcacagttcttatacatcaattagtttgattcaaactcaacaatgataaacttgatgaacaaaaagggaatcatggacgaaagggagagagatttgcagctctcctacgggctaggataccctgaacccaacgtcgtgttcgctctgtgcagaggcagccgctcctcgcctgcagtacgtacaatcttgaatcgtttcattggcagatcgaaacacagtctttcctgaacaaaatattttcattgttcagaattcagattaagaattcttgtgtgtttggatttgcagctgagagtttacacggcggaggacatctcgaacgagctggagcgagccaaggtggagtacctggagtcgtcggtgcgcgcggcgagcaagaagaaggtggtcgtccccaagctgctgcactggcacatgcgggacttcgccgacgacgtcgcgtcgctgctcgagtggatctacagccagctccccggccggtcgtcgtcgacggggcagctcaagcgcaccatcagggagctcctcggcgcctccggcgccggtggcaaggcggcggtggcgaaggcggtggaggtggagccttacagcgccgaattccactacctgctgccactctgatgcgatgaacctctgatgatgagtttcttctccttgcatgcagcattgctacgtacggctttgaagatattctgttatttcgccgcgtataccaacgtgtacatcggtgcaagtgactaatctagtcaatcaaacaaataaatttagtgaagtatatatagttcaattttcccccctactgaatccaacgatgtgcagccattttagaagttagtagttgtagtatgactgatactccctccatccatcccaaaatgttttgggggagtaattgttagaaggaaaaattgcaaaaatgtccctcaatatcatcctgagttaagatcccctataaaatatttggtgcagatccttcctcctttttttcgaatacgcaaaaggattgcacatcaatatattagaaggaatgaatatttgttacacacgcaatcagccagaccaacttatgtgaagaaagggagggaaacaaaagaccaagttactacgactccaaacagtgggaaaggcagagcccactactctcccaaaaaaccctaaaattagcaatgccagctaacgaccatagatggccctctgagaggatggattgtaggacctccgagaccgaagatagtgtagagttgaaaaccttggagttccgttccttccacagttgccaggaggatcagagaatcgaagccgggatggagatgctcaggcaagcatgccctagacgaaggccaccagatacactcatatttgaatactgatagacaagaaattccccgcacatcaagcctgagatgacacgattagcgcatcctcactcattgcactcaccacgttgttgggccacggcgatcgtaagtctccactatgggataccggaagatgagatgttgtgcttggctcatgggattcggtggcggctggtttctttggcacattcaaattcagtagatgattttggtatgacattgtgccgctaagaatgaagatgtgtcaagggccatgtccatcaagaacataacacaggtggaaagaggagaaaaaacacgggagcaaaattgattggggataaatctcaaaattaagatgaatgaggaggtatttatagcttagaggggaatctgaaactgagatgagatgatggttttgcaattttcaatttagggccatttgaatcagaaaaatttatatatgatttcatagtattcaaatcttaatggaatttttcctatgtgatcatttgattcaaaggttaaagctttccaaatcctatgaaatttatatgaaatggctcattgcatgtagattttggaggaaacttagtaagagttctaactgcttagaaatttttttagtctatattaatctctcaaccgatttctatttttcttacaatccaatcagacgactattcctatgttttacaattctctattttacacttgtattctaattttacgttcttttttatttctcagtttttccaaccatgcgatttcgagtgggctcttggattctgaactcccgtttatgctggcagaacatttcctacacgttgcaacgctcaacagacaagaacaaacgacaaacgcactgaataagcacaggccatcataaacccccatggagtagtacgaagcatcagctcgtcaggtcaaagctccctgacatgtgggccctacagaccaccgacaggtgggacccacccgtcatcatcatgaccgcaccaactcaactctcactccccctcacctccctcccccttccaccgtacacccccaaaacccccctgccttctctcgccgattccgccaccgccgccgcgccgcgcctcgccgccggccgcccttcgatctcctcctcctcctcggaatggatctctacatggacgactacatcgacccctacgaggaggccgaggcggaggccgccgcggaagccgccgggctgacgtccgcggcagcggcggaggactcctccgacgagggcgactccgaggacgactccgaggccgagagcgactacgaggagaggtcctacggcctcctccgctccggcaaccaccgcgtgcgcaacccggacggcaccttccgctgccccttctgccccggcaagaagaagcaggactacaagctcaagacctcctccagcacgccgacggcattggcgcctccagcaagcgccgccgccacggccgcgagcgcgccttccaccgcgccttcgcccgattcgtccgcaccgacccttccttcgcccaagacctcgccgccatcaacgggatcgccaccactgctgatgctatctctaattctagtgctgccggtgccaaggagaaggcggatgccaatggcgacacagacggatccgcttcggtggcggctgtggccgcggggaatagacgggaggaggagaggtttgcttggccatggagtggggttcttgcagctggtgcagggttcaatgccgaggacttcgcggatagggtcgcaatgtttggtttggatgatgttgtgcctttagttgtcgatgatgcggaaggcgctgatagctttgcgattgtgaggttcgctaatggttggggtggattcggcgatgcgctcacgctcgagaaccatttcaacaagaataagcttgggaagaatgaatgggatgcaaggggtagtgctggagatgctgtgaagggagatgatggggacacagatgttaaggtttatggttgggttgcccgagaaggggactataatgccgggaatgtggtgggcaggtatttgaggaagcatacgaacctgacaaccatagatgaggtctccaagagtgaatcggaaaagtcggggaagatggtagcgatactggcaactcagatcgaggcgaaaaatcgattcttgcaggacttggagacaaaaaagaatgcaaccgaactctccattgcacggctcgaggaggacaacaggaagctacacgatgcatataatgaaggtatgatgtgcaactgtgcttcatttcttataggcgtagttgtcacatgcctagccatgttagctgagcttgtatgaactagaggaaatcaagacatgatatatttctttttctgtttgacggttgcactatcaattagctgttgtgatgctaaaattcataaatgtcagaggtacaggagatatgcatgtcatgtgcattaagcaaagaatatatgtgctacaaggacatgtggcacatgagtatccccatttgcccactgtcataacccatagtcattgtagcatgcgtgaagataacaagaaaaatctaagagtatcactaacagcagaactagattaggttgtaggtagttctctaatgcaatttgatcctgcttccatccgctgttcacaatcaggcctgatctgtaaccactggtcctgtaacctgtcatcgcttactggtagtttctccaactctccatacctcaaggacatgaattatctatagaatctacacagaagcagcaaatgatggattgtctctttgtcctagaggcacatgtcaaatactcaaatgattgattgtggaggagccctctgcactgcaactgttgggctatttagcttcagcctttatattagacatggattatttagagaaatagcatcctcttagttggttagactgttagacaaatagtggtcaggtctgccattatctatgtgattcctttcttgttttgttgtatgctattaccatataccacaagaccaacctggttagataaatgttggtaacagggacaaacacaataataatcctaatcattaactttcatcgcttagctagtaattgtattttcatttcgttataaaataaaataaaaactgtctaagacatcaatgtacgacgttgtaacaacatttatatttccatttcagaaatgcgcattacaccggagagctcgtgattatgctttaagagttttccaggataatgaaaacttgaagcttgaattagatagcaggaggagagaattgaattcacgtgctaagcagcttgaaaagataacagctgagaatgcaagcgacaggaaaaaact

SEQ ID NO: 45330 - DNA, 841 bp, Oryza sativa
ttcatgataagatggagaaattgagtgaaagattagaacatgaaaagaaacgtttggaagaattgagcggagagctggtgaagaaagaacgtgaaagcaacgatgagttacaagaggccagaaaagaactgataatggtattactccatttctctatgatgattggcaaaattccttatacctatctgttctttatttctttaatgattgatattcatgaaaaggttttcatacatgatcataatcatttgcaattgacagggtttggaggacatgctaactgggcgaactgctattgggataaaaaggatgggggaacttgatgagaaacctttccaaaatgcatgcaagagaaagtacggaaacgatgactatgagaccaaagctgcggagctggtctcaagttggcaggaggaaataaagaagccatcctggcatccttataagattataacggttgatggcgaagataaggtatttgctctgctgttctatgttttactcttgtaccatctctgacattagaccctagggtttttttcgtaagtggtaaccatcgtcgaattttataggaagttgtagatgatgacgacacgaagctgcggcacttgtggatcgagtacggtgacgatgtgtgcaatgcagtgaagaccgccctgagcgaggtcaatgagtacaatgccagtggacggtatgttgtgcccgagctgtggaacttcaggaaaggccgaaaggcgacaatgaaggaggtgctcaagtacatctttggacagatagagacaaccagcaagcgcaggaggccgtgaagttcgtccttcgatggatgaagaagctgacaggc

SEQ ID NO: 45331 - DNA, 1494 bp, Oryza sativa
aagggcaccggcgaggggaggatggcggggcggaaaaaggcaaaaaagagcgtcgagacctacaagatctacatcttcaaggtgctcaagcaggtccaccccgatatcggcatctcctccaaggccatgtccatcatgaactccttcatcaacgacatcttcgagaagctcgccggggagtccgccaagctcgcccgctacaacaagaagcccaccatcacctcccgcgagatccagacctccgtccgcctcgtcctccccggcgagctcgccaagcacgccgtctccgagggcaccaaggccgtcaccaaattcacctccgcttaggcttcacccctgcatctatctatgtgttagttttagtgctatcgatgattggaaaatggatgttagatcgttagtttggtagtcagatgtcagtgatctggaacagtagctctgattttaaaccatgtgaatgtgattcctgggtatgtgatgtttgaccgccttgtgtctgctggtcaacgagtgataactagatctaatttttgtggaactatttacatggttgctacttgcattctgttcaactgttgtaaattcctctgtcactcgttggagttttattctctggagcatgtgtggaattgcctgggcatgcttttgggaaactatagtctgtagtcctatgttatgtttggttaattggttgccctgagcttgttggaattaatctatgtataattttgtgcaattacatcctgtgagtatgttgctatttgcattgtcttgcaaactcctttgtatgccacaggaatttaatttctggagcatggatgtttggagtttgatactgttcaagtgcttattggcccatgtagtttataagtacgagtaggtttcatctaaggacactttctaaaagaagagttgtgaattggttagtatatagtatgacaacttggccatcaccgttctattttagctgataactttgacatctgaagtaagttttgctttaccttagtactgtactgtttcaactttcaaagaagtttaattggaaatagtaactgaaacaccggaaccgtaagtattttgcttgctattgcaggatgctgctacactagcctgtttcctcatttatgttccgaaggtctaatgaaggttctctctttgttcttgattagcttgtaagctaactggcaagcatgaggtatgcactaaactgctgcatcttctatcaaagcttgctgttggagttgttgctctgcaggatatgccatgtgtgaagatgatgaccaaactcttgtggactctagaatcttataatgttatcctttggttctttgtccaaactcttgtggactctagaatttttattggtattgtttaattttgcattacagtagtagccagataatatggtgtttcattattaaaatttattaaaggaaacaattttaaccaacttactaaactatcacatgttcaatttgtgagtatctcatg

SEQ ID NO: 45332 - DNA, 2570 bp, Oryza sativa
attaactaccggaaacacattatctatgttgtatgtgtaaaatatctatatatttataaaaaatcattttaggaccaatttctacaaatatgataatataaaattcaacttatattttaaaaaatatgcattctagattttctctattttaaacttatgcttctttctacaatgcaagtgatctaggaattactactacaacatagtgtatcttctagtttttacaacaatatgttgacacgccaatccactacgccattgttattgaatgagaacttcttatgttgaaagacatgattcactctttgtggaaaagtaaaaaactatgtatcaatattgaaaatttcttgggatcccccagtacatgccccttgggcctatttataggcttagtgcaggctcatgtgccctagggttactaagtacatgggaatttacatgattacccttacaatagggacatttatgaggataattatagacaatttatccttgggcctcttcttgggccgccaagtgggcctccattggttggttggccccctcgggccttgaatccctcggcttgggggcgaaggtcttcggcttcgctcgacgatttgcccagagcctctgtctttgtgacatttggcgttttgctgtcgtgcttcgtcctagcgattgtagacttgtttcggcaggctcggttgaaggccctcgtgacatgcctccaacagccatgctacgcaccatatcaatttttaagtacaggaacaatcattcattcatatgatgcataagaaattaacagttatgtgactttgaagaccatcaagagcttgatcgggatctgagccaataaaagcattgtggacatctaaaagcttgaggcaaaaattttggccaacctaaaagcagttcatatgtttgatcaagtttaggaatgtaccttgagtgctttatgtttagcgatgcattgataaaataataaagatcaggcataggggtgtaagtgggtgttaacgaaaaatccgcgctttgctaatggtgccagaattgtattggcgcgaactaagtcgacgaacataacggccctaggagatctgtttagctctagtgcaggtccaaagcttgtagagatgcgggcatgccagtcagtttgatcctgcaactaactagatatataaatatgttgatcaccaaagagctgatcggctgacgagtcgatcgagcgatactagccgatgccgatagcaaccgatgtcgatagagttttgagcaatcgactatatgtccaatgtagagtctgatacttgagtaaataatgatataaagataattggctgatgataatgtaataaaacaacaatataatccaataaaaaccaatcggctaacaatgatatgatagaataagtgacccgatggttaaagcatacatcggctagtggtatgatgtcattaattaaatccaaatgattagataaacagtgaaatctttgttacaatctgctaaaaacaacttgtatgcaatctttgtaagccgatacaacgtctagataactcattggctgaatcctcgatgaaacccttattataatcaaagacaggttagcgtttaggattctaagcacgactagggatgatgcatcgcaaagtatgcaaagaaacataaagtctaaacaatcaagcctttgactaattttcagggtggtggatatcttagttaatctaatctagcaagatactttagccgataccagtataaaacctaaaacgaatctcagccgatatgatcaaattaagatgctaaattagattaactaagatatatgataaataggtaggcaaacatatcaaccgaaccagagcaatccaagaggtcaaagctatgcagccttgaaccacgccaatgtagccaatacaattgccagagctagcagaacgtagtacttaccccgtcggatgataagtaaaaaccttggtaaagagggtggcgatgcgccgaaagtaattgtattgatcgagagatagtttacaatgtctctgggtgtacatatttatacccatgggtagatactagtccttgttggacaagaaaaaaacattcctaaagataaaaggaaaacataatgtccttatcggacactaaacacatttttctaaagataaaaggaaactaacagactctttctaattaatagataacttgccatgatgcatcatccttaaactcggtcttttctggataagcttaattgaatatattaattttcttaatcgaatatagcaagattccgactattggcgacttgatagtttccatcggccgattataggactctgaaaccgatactgactctaggccgatgatgacttcggggcttgccaaatttcactgtttacagtgggtcaaccgtgaacccacttataggtcaaaataagcaggttcgtggcttattttagcctataagtgggttttgtgggctagccacttacacccctaatcaggcatggacgagaagtttatatctcattaagaaccacattttcactgtcacctgcagggatactattgatctgggtaacag

SEQ ID NO: 45333 - DNA, 4405 bp, Oryza sativa
tttcatcaccaacaaaattggatgaaaatcaaagtaaaggatttgttactttcaactctatactttcatctaggaatgctgcaaaaaaaaattattatataaatatcttcaagtaaaaaatcatcataattatcaatatcataattaatataccaattggataatataagtgtatttgggttttatgaaacgttttgcaacaatatcgggtgttctttgaaacaaattacaaaacctgggattttgagtgaggaatgctccaaacttaaggttttgaaaattttactcttatttattttttctgtaattactattatttaaaattggcaaaaaaaaattacctggatttataagaaatgatatgtgaatttctttcaatgtattgaacatatggcaaatcatcttctgatcaccttctgcctactgccataagaaaaaaaagattaccttagatgaatgaaaataatattacgcgtgtacacaaaatatacacattattcattatacttcaaagaagagaaaaaaggttgcatctgctccatttttagaaagacgttgacaaatgtatgcctttccttgaccatcataaggtagaagaaatgaaatgtcattctagatatcaactgaaattgcattttctctattttaatcgggttcgccctgggcgtgtagtcattcccagggcatgtgcagctgaagctgttgttgtagctgtaaatcttgtaaagtttgaactttctcccctacttaaataaacttcgaccggctttcgcactggtccagcgaaaaaaaatgtaattgcattttcatacatatatatttgtgtgtatgtgttctgaaagaaccttcaaatgaggttaagcgtataagcgacaactacattcaatccactaggccttaattatatctacttcggttgattataccgatacgaagagtttggtttccctcaatcctaataacattagatttgcctccttggttcataccagcaaaagaaagcagataatcgaattttgatccaatttttgcatatgaatttaatccactctaacatcctctcaaaaagtgaactctaatataattacccccttctcttcctttacttttttcccccttgactcctattgatgtatttgaatcctatctttctataaagttaaagcccactacatcttaaagctcaacatgcaaagatgctatatcatcactaacatttactacatctcaaatctcatgtaggcatgctaatttattaagttttagagctttaaaatgcaagcatgttaattaaattattatcccacataatccacataatatttcaatatacctctccttcactttttataatatcctatatgcttatatagttaattaaaattttagagcttaaaaaaatccaagcatgttaaatcatcatttcacataattctcaaaatatttcaatatatctctccatcattttgtataatatctatataccaatacaattcattctcacatagttaatgttatttctttcttctttcattaagctatatcacctcaattgtttctaacgctcaaatgattaatttatggttggaattatcttcctcatttttttctttcataaagccacatcatattacttttaaatttgggtcatcattctgtatactatttaaattattataaaccacatcaacttatgcaagtttctatcatctagctatcttacacattatttatatttcttattatcataccaaactcccgcagcaacgcgcggggtttcatctagttatattatattttactgccatacctgtgccttctctttcttactgcactgaatatatgaaattgaaattgaggccacaggaagtttgtatggctgaatatgaggcacttccaagggttcatcacccttgtctcaagagttcaatttaagtacaagcaaaacccactatttaagccactaaaagaaaaaaacagaatttaaatggcacaatcggggtaagaggattattggttatgtcaccccacataactgaaacagatgtacttcgatcgttgtttatcacacccagttcttgcatattccaagtttaacatgttgatcgatctgaagtcctgaaaagtatttgtattgagtactgggaacgtctattggtcatgctgttcaagatatttacatggaggagcccaacggacaagaacatgttcaaaaactcgttggatttgaaatctgcacaagctctcagaggctgctcagcctgaatcagtcttggagatagcatcacactatgctgcaatcgaggcagcatttacacccaccgttcttacctccagcagtggcaaattgatgttagtcttaaccttgagtcaggcaacttcacctgaagggatatctagttttcgacagtgctgaccaagtttccaaatttttgcatttatattaagctgatgaattcaagctataatctcggtaaacgatgttgcttccttctgttaggactgcaccaagctgcatttaccactggactgcattttgaataccattggctaccacttaccacagaaattgaattgttttcctgtaacatttcaggtgcactagtatcaccatttccttaagtgcgctccactctagtactgcaagaagagtgacaaaatgattaaatgaaggatattttgattgtaaatagtttaaattatgatgtctcggtgcaatagccagaattacaaaaacaaaagataaaccaaaccatagtacaaacagaatcaaaggaaaagatcgagactaacaaataaatgtagtagaacttcctctaataatttgtagagtaaattgctcacctgcctaattatagagagattcatctggaaagatatccctgccatctgcaccaactgtaacaacatggacggcaagttgttggtcttccaggaggctcatcctgaattgcttcgcgttgtggcaatcgaccatgtagagtctctttagtgagattagattctctgcctgatacagcgctggacagtcctgcgcaagcaagtcctttagattacagagattggaaattctcctcaaacacctgttgttcttgaccttgagccataacactgaaggaaggttgtcaacttcttgcagcgtgtgagcaccttcgatatggattcttcttaagttagcaatcctatgcaagtcttcagggagagcccttagttttgggcagtcgttaagaaacaaacgcttaaggcaaggcatcagaacaagctgttcagatttgccacacaaattccatgtgttgagagaccaactttccaaattgctcatgttagtgatgagaagcaattcgagttttggaaaaatagttatatgctttgcgctattgacgcctttccctagcagctctgcactgatgaatcccctaatgattttggtaaaaatcattaagttaaggtggatacacatcttgtcatatgatcaaatggtttcgcgaaaaatcaataatcagacaacaagatgtgcgaactcgatattttacacgactctctttaccaattctgccccgaattacacttaaaacgactcaacagcttaacgttggcttgccacgcattacttgactgtaaaactctcactcttaccgaacttggccgtaacctgccaaccaaagcgagaacaaaacataacatcaaacgaatcgaccgattgttaggtaatcgtcacctccacaaagagcgactcgctgtataccgttggcatgctagctttatctgttcgggcaatacgatgcccattgtacttgttgactggtctgatatccgtgagcaaaaacggcttatggtattgcgagcttcagtcgcactacacggtcgttctgttactctttatgagaaagcgttcccgctttcagagcaatgttcaaagaaagctcatgaccaatttctagccgaccttgcgagcattctaccgagtaacaccacaccgctcattgtcagtgatgctggctttaaagtgccatggtataaatccgttgagaagctgggttggtactggttaagtcgagtaagaggaaaagtacaatatgcagacctaggagcggaaaactggaaacctatcagcaacttacatgatatgtcatctagtcactcaaagactttaggctataagaggctgactaaaagcaatccaatctcatgccaaattctattgtataaatctcgctctaaaggccgaaaaaatcagcgctcgacacggactcattgtcaccacccgtcacctaaaatctactcagcgtcggcaaaggagccatggattctagcaactaacttacctgttgaaattcgaacacccaaacaacttgttaatatctattcgaagcgaatgcagattgaagaaaccttccgagacttg
